United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 43

SEQ ID NO: 194942 - protein, 96 aa, Glycine max
  Coding DNA Sequence Number=SeqID_78164
MLPPSLAASHLRHHDSTIAPPTDPRYHCAQIWGGEGGGAIDGSWLGGTCINLGDRGGGSTRRKEVVSVGGGGGGHADGVAGMIDGSGGREEEEELG

SEQ ID NO: 194943 - protein, 506 aa, Glycine max
  Coding DNA Sequence Number=SeqID_78165
  Gene Ontology: Mol. function=DNA binding; Cellular component =membrane; Biological process=DNA integration
  Homolog annotation: Hit_ID=Q1SS72; Match level="QueryCoverage=97%, HitCoverage=80%, E-value=3e-61, Identity=48%"; Hit description =Integrase, catalytic region
MADNVVINSATFVNLLNSYYTHPNEHPGVAIVAQVLNGVNYHSWSHAMLLALKTKKKVQFVDGSLPRPALNDHNFTIWDHCNTLVVSWLHHSLDPEILDLQEELYLLKQGDATITTYFTKLKGLIQELDNFCPIPSYTCVVVCACDLIPVIKSYREVDYVIRFLRGLNEQYSISDDSRVFAQVDTSHGPYGRGQMDTSHASYGRGRGRGGHSLGGRGGAINQYSLDDQEIEDDLQSLGQKEVVADPSSTAFTPEQHKAFLSLLQQTSQASSSHPTNQLIGSHKNGNSGIFCATLHAYSSNINSWVLDSGATNHFKANGSIDKHKARLIAKGFTQTAGLDYIETFSLVIKMTTVRLVLSLTASQGWHLHQLDVNTAFLHGNLHEEIYIKVPPGLTVDNPALVCKLQRSLYGLKQASRQWNVKLTSTLLDLGFQQSKADYSLFTKRSPTGLTIVLVYVDDLVLTGTDLAEIQQLKHSLDAKFSIKDLGMLKYFLGFEVARFASKNILF

SEQ ID NO: 194944 - protein, 112 aa, Glycine max
  Coding DNA Sequence Number=SeqID_78166
  Gene Ontology: Mol. function=ATPase activity, coupled to transmembrane movement of ions, phosphorylative mechanism; Cellular component=membrane; Biological process=metabolic process
  Homolog annotation: Hit_ID=Q9LU41; Match level="QueryCoverage=80%, HitCoverage=8%, E-value=5e-31, Identity=63%"; Hit description =Putative calcium-transporting ATPase 9, plasma membrane-type (EC 3.6.3.8) (Ca(2+)-ATPase isoform 9)
  Pfam annotation: Domain name=Cation_ATPase_C; Domain location=2-91; Score=-42.8; E_value=0.087; Accession=PF00689.11; Description=Cation transporting ATPase, C-terminus
MTDKILSNLQIFNEFNARKPDEFNIFKGVTRNYLFMGIIGLTVVLQIVIILFLGKFTTTVRLNWKQWLISVVIGLIGWPLAVIGKLIPVPTTPINNVFSKFRISRKDHEESQ

SEQ ID NO: 194945 - protein, 101 aa, Glycine max
  Coding DNA Sequence Number=SeqID_78167
  Gene Ontology: Mol. function=DNA binding; Biological process=DNA integration
MGRRSFSRNNNHCASQDAWARARYAASEEDLDTMDCFLLFQEIREVPKKKHIHVMDLRVSRQAPQSESLNLVKEVEDEEEKNKPLLVVPLGYLRTWWAACM

SEQ ID NO: 194946 - protein, 61 aa, Glycine max
  Coding DNA Sequence Number=SeqID_78168
MFGRRRFLSFPMVIGAVIIGVVSGKAIFGPPLDEYWKKKQQEEVAAAAAKENDSTSTSTST

SEQ ID NO: 194947 - protein, 80 aa, Glycine max
  Coding DNA Sequence Number=SeqID_78169
MAYTHIPVKVENPDLAPYTSEPYNAQWNAPGLLRDKHTLRSSRILGEMEVDEPWLGLWLPLNLSSGLRHWKCGRQTLWLI

SEQ ID NO: 194948 - protein, 272 aa, Glycine max
  Coding DNA Sequence Number=SeqID_78170
  Gene Ontology: Mol. function=catalytic activity; Cellular component =mitochondrion; Biological process=metabolic process
  Homolog annotation: Hit_ID=Q9SZ48; Match level="QueryCoverage=99%, HitCoverage=65%, E-value=1e-101, Identity=67%"; Hit description =Enoyl-CoA hydratase-like protein
MGCGSGISLPGMFRVVTDKTVFSHPEAQIGFHPDAGASYVLSRLPGYLGEYLALTGDKLNGVEMIACRLATHYSLNARLSLLEERLGKLITDEPSVVESSLAQYGDLVYPDRSSVLHRIDTIDRCFSHETVEEIIEALEKEAAESNDEWYSTTLRRIREASPLSLKVTLQSIREGRFETLDKCLVREYRMSLRGISKHVSSDFFEGVRARMVDRDFAPKAYLFCPRICTFMNPWDPPRLKDISEDMVEYYFSPLSEVQSELVLPTALREPYM

SEQ ID NO: 194949 - protein, 122 aa, Glycine max
  Coding DNA Sequence Number=SeqID_78171
MATCINAHKIFIQVLNEESLKVQKNTKKSSNTEESYCNSLCCDNIHKLQRFHLCHCYRRLLLSMQKALDPGFTTSSGRKGVREDVRVLRSKSKILTMQETSTDQCHFALKWLRKWTRQLGFE

SEQ ID NO: 194950 - protein, 259 aa, Glycine max
  Coding DNA Sequence Number=SeqID_78172
  Gene Ontology: Mol. function=RNA-directed DNA polymerase activity; Cellular component=chromatin; Biological process=chromatin assembly or disassembly
MADHGTRKTTTSRLEEAIARLSNSQANLTERYTDLSGRVDSILDHLRMRDAHQNQPSSNSSRNHRNSVKLDIPRFDEEERITVASLYLDDAALSWYQWMFSNGFITSWQGFLQALESRFAPTFYDDPKGALFKLVQRGSVNDYLTEFERLANRVLFHLWIKSRTPTRGARLTILIDSGSTHNFLQPRVAQFLHLPVKTTRPLRVLVGNGYVLDCNQRCPDTQLSIQGHSFPVTFHLLQISGGRHNAWHRLVKTIWAHHD

SEQ ID NO: 194951 - protein, 101 aa, Glycine max
  Coding DNA Sequence Number=SeqID_78173
  Gene Ontology: Mol. function=catalytic activity; Biological process =metabolic process
  Homolog annotation: Hit_ID=Q9FWQ0; Match level="QueryCoverage=71%, HitCoverage=14%, E-value=5e-13, Identity=50%"; Hit description =Putative enoyl-CoA-hydratase
MQRFKALLPQQTRSSLRTLCSHRRAFSAQPNYAKHHDDDSQEQILVEGRAKSRAAILNRPSSLNSLNASMVARLKRLYDSWEENSDIGFVLMKVSQSFSRQ

SEQ ID NO: 194952 - protein, 644 aa, Glycine max
  Coding DNA Sequence Number=SeqID_78174
  Gene Ontology: Mol. function=RNA-directed DNA polymerase activity; Cellular component=chromatin; Biological process=RNA-dependent DNA replication
  Pfam annotation: Domain name=rve; Domain location=338-509; Score =22.4; E_value=8.1e-05; Accession=PF00665.16; Description=Integrase core domain
  Pfam module annotation: Pfam domain module=RVT_1::rve; Domain location=22-200::338-509
SSVSHLPPVAAPVARLLRRYEKLFQPPMHLPPSREVNHRITLLPSTAPAEYEPILFSSPSGEEEGRHMANLGHASWFSKLDLRQGFHQILMNKADIEKTTFRTHHGHYEYLVMPFGLCNAPSTFQAAMNHLLAPFQRRIATVFFDDILVYSDSLSSHLECLGHVISGKGVAPEPSKIQAIVQWPTPTSAKDLRAFLGLTGFYWKFIQQYAAIATPLTHLLCKDAFEWSQESQNAFDKLKTAITSALVLALPNFNEPFTVETDASGTTMRAMLMQQGHPLVFFSKNFSPRLSHASTYVKELHAIIAATPKQHYYLSKLLGFDYTIQYKAGAANVVVDALSRRPPASVQLLLLSVPSFESARFVSRTRPVPGAWQVYCNLYQLRQGFSKGVHLGALPTGFSAFKVATVFLDIICKHHGFPRSIISDRDPVFFSAFWRELFRLCGTRLRLSTTYHPQSDSQTEVMYGKPPPTIPHYIPSLTNNEVVESLVATRQVMHDKLQKRLKKAQDSMKKYADARREDVTFFVGQWVYVKLRPTRQRSVAGVNHSKLSKCYFGPFKILARIGEVAYRLELPARARIHPVFHCSLLRQYHGAPPSTTEPRPLEIIGHKPLQRPLCILDSKLDSSTSPPTQLVLTQWAEQPPEDTS

SEQ ID NO: 194953 - protein, 69 aa, Glycine max
  Coding DNA Sequence Number=SeqID_78175
MDGVRHKTDIKESSLNHSLMATVSLKQQNQKGFLRLVVRLGYKNSLVFLGFKGLDSQRAQIPDLSQWSF

SEQ ID NO: 194954 - protein, 60 aa, Glycine max
  Coding DNA Sequence Number=SeqID_78176
  Gene Ontology: Mol. function=amino acid binding; Biological process =metabolic process
  Homolog annotation: Hit_ID=Q10DH0; Match level="QueryCoverage=89%, HitCoverage=9%, E-value=1e-17, Identity=74%"; Hit description=ACT domain containing protein, expressed
VCIDNDSSRDCTVVKIDSANRHGILLEMVQVLTDLDPVISKSYISSDGGWLMDGQYICLP

SEQ ID NO: 194955 - protein, 97 aa, Glycine max
  Coding DNA Sequence Number=SeqID_78177
  Homolog annotation: Hit_ID=Q1RWN2; Match level="QueryCoverage=90%, HitCoverage=7%, E-value=1e-09, Identity=36%"; Hit description =Peptidase S8 and S53, subtilisin, kexin, sedolisin; Integrase, catalytic region; Zinc finger, CCHC-type
MEFDSEGENDGNNVRGSEARNEAGSQENVIQGREMRQPTWIGEYVSGEGLNEEKEVEAYMVQDVVGDDPTQFEEAVKHEKWRKAMDSEINSIEKNQT

SEQ ID NO: 194956 - protein, 156 aa, Glycine max
  Coding DNA Sequence Number=SeqID_78178
MDEVEATTEYEQDYVVVFLPVAELIMDLNACNTKADAAPTQHMPYNISHMQQDTWVGPRESSGDGHLLNLKVEGRGLTMPSLDKGIDYAFIHGHRHMWGGMREWKRKRRMRGSEKGGGEKKRVGHMEKGRGKGGSPDTNTMFENEDNAYTTIFNEL

SEQ ID NO: 194957 - protein, 156 aa, Glycine max
  Coding DNA Sequence Number=SeqID_78179
MWSSAPFPEMSASSGRDREKVSLLLSWLENLIACGDTLRLSAPLSSRDNKFDDTRRQHMVARTLPVQRLLKSLLSSGDEQVYLCHPETFKSNDAQGSSLLTRDDQVSHCMPSKATMTLTHFEDKNVFSHYMPSKATMTLIYILKTTMSSVIACLQR

SEQ ID NO: 194958 - protein, 275 aa, Glycine max
  Coding DNA Sequence Number=SeqID_78180
  Gene Ontology: Mol. function=hydrolase activity; Cellular component =membrane
  Homolog annotation: Hit_ID=Q1SUH7; Match level="QueryCoverage=62%, HitCoverage=12%, E-value=3e-78, Identity=73%"; Hit description =WW/Rsp5/WWP; Synaptojanin, N-terminal; Galactose-binding like
  Pfam annotation: Domain name=WW; Domain location=113-143; Score=54.0; E_value=4.9e-13; Accession=PF00397.16; Description=WW domain
KRKSAQYANRLSPRVGRFINAAGTTGFPTGKRAVSATQLIYDHDYEFELGTLSEGDYLPSRQRINDCRGEVIYNDGFEVFTEQCRRLGISLDSDLAFGYQSMNNNYGGYIAPLPPGWEKRSDAVTGKTYYIDHNTRTTTWMHPCPDKPWKRFDMTFEEFKRSTILSPVSQLADLFLLAGDIHATLYTGSKAMHSQILSIFNEDTGGKFKQFSAARGSSRVDLQACKLGTGRRPHRSPFPTVAQPEWRMAPDAVFSPYASVRYFTPHMVHSQYNLL

SEQ ID NO: 194959 - protein, 444 aa, Glycine max
  Coding DNA Sequence Number=SeqID_78181
  Gene Ontology: Mol. function=ubiquitin-protein ligase activity; Cellular component=ubiquitin ligase complex; Biological process =protein ubiquitination
  Homolog annotation: Hit_ID=Q84QD5; Match level="QueryCoverage=84%, HitCoverage=91%, E-value=1e-35, Identity=29%"; Hit description =Avr9/Cf-9 rapidly elicited protein 74
  Pfam annotation: Domain name=U-box; Domain location=59-133; Score =43.1; E_value=9.2e-10; Accession=PF04564.6; Description=U-box domain
MPMFEPHCKRGGVEGQILDLDTAVKDGVLGGGVDTGVVGTGVGEKLDLGKMIEELDLCEVPSVFICPISLEPMQDPVTLCTGQTYERCNILKWFSLGHFTCPTTMQELWDGSLTPNTTLHRLISTWFSQKYLVMKKRSEDVLGRVLEIVETLKKVKGQARVSALKELHQVVAAHATARKALVDGGGVSVVSSLLSPFTSHTVGAEVIGVLVSLSLDCESKRSLVQPAKVSLMVDILNEGSIETKINCTWLIETLIEEKDFQMVIFRSHSLLVGLMRLVKDKRHTNGICSGLRLLRTLCLHSEVKSLLVSIGAVSQLVQLLPGLEHECLELALSILDALASVPEGILALKDCSNTIPVMVKLLMRVSENCTQYALSILWSVCNVAPDECSLIAVEAGLAAKLLLVIQSGCNPILKQQSTELLKLCSLNYSDTIFISKCKLTRTIQ

SEQ ID NO: 194960 - protein, 555 aa, Glycine max
  Coding DNA Sequence Number=SeqID_78182
  Pfam annotation: Domain name=rve; Domain location=379-529; Score= -9.4; E_value=0.036; Accession=PF00665.16; Description=Integrase core domain
MDVVQHQPFSKVYGKIWDLAMIEMLVEAIAALTQYYDQPLRCFTFWDFQLALTIKEFQGILGWPMGGRKPYLFSGYYSSMEKEVFGGKGGSLSKPREVSIIHGCISTAGVWGDGLVDLAAIDAFLVYHRSKESPIVVVLANVYDTFDLRYEKSSDHHMCLGKDKVNWEELLTSATGFFISWFPRWKEGVAGVLCSGEGFLNVPLMMTRGFNEANMRIFQKICRVWNQLERIDKKLRGRRNGAIGGYHKWLKVRVKGIAWLKKLEGPNKVETEVLEESKEVRVLKAKLERTKVAKDKLKGVITWVRQKCDRLKDINMSTVEALEQEMKKPEGKIRAEKEIVGSQRKSLKEQLSMTEKNMLIIIDQYKEKLMKERHNLATIHEQTLRYEQMKVFTLTLNESQELPKLLAKAKAMAAYALLPMNDIEQVQEQMKADMEAMKGQMTMMMEAMMSMNKMMKDLCKNFKIQHHDSTPYQPKMNVAVEATNKKIKKIIQKMTVTYKDWHGVLPFGLHGYRTSVRTSIGATPFSLVYRMKVVLPFEVEIPSCWTSGLNNLRGG

SEQ ID NO: 194961 - protein, 107 aa, Glycine max
  Coding DNA Sequence Number=SeqID_78183
MRNPAKLCFCGRIIVVEIAPMPINNPKSIDVNEVIVHQLGILQSFIFCGRKAVVKITWMPINNPKCIDVNEVTIRPLGILQSLVFCDIKVVAEIAQTTTNNQQPKMH

SEQ ID NO: 194962 - protein, 66 aa, Glycine max
  Coding DNA Sequence Number=SeqID_78184
  Gene Ontology: Mol. function=ribonuclease H activity; Biological process=DNA integration
MKNIFDKRVSPRRFIEGDLVLKKAQNYEGPFMVKKAFLGGTLILTNMDGEELPSPVNSDVVKRYYA

SEQ ID NO: 194963 - protein, 353 aa, Glycine max
  Coding DNA Sequence Number=SeqID_78185
GRMISPEIHLIGESSNDDPSHHYSGFNTASDHVSSSPADNTAPIDGMAPPNTGVVAPIGGTATAEGGLRSNSNVCENPGEDEVESPLPNPPPMQVIVPCPFIPPPPPPLRKPSKAKKVFPLVVLLGYTWVHREDGCVFMCASPNDTPFMYMYSTLFSHLHLIVPFNRLTSRRMKGLRLPRLKLRKIRGSGNKTLKDEWVPPPSPINPGVANRVELMPIATSFTIESHPTFLSMKEGTTSLWSKDFNYGALIQSSMLNQSNRDMLREAGPRVESQDEALKTKLAIAKDLAKALQDMIDRLNEKFSLFMVNAKKVEGNLKSDLSTRLKPVSSRPLAKPSNSSKKSMSSSSILIRT

SEQ ID NO: 194964 - protein, 61 aa, Glycine max
  Coding DNA Sequence Number=SeqID_78186
MRDSAPTSNVIEPLNAAREVVGDVDSIKDELVLWLINDDNRTCGVTCEQYWFRCLTLAMRA

SEQ ID NO: 194965 - protein, 157 aa, Glycine max
  Coding DNA Sequence Number=SeqID_78187
MALKRFGHVKDKTSSSFFKLQGLVFMLLPLSLTIIMWLMPILLGLDEPSYSMVPRVGYSNLKNLVDIIKKETNCNLTYFLIPVYLYTFNLSIEVSSQSQSQVLEEACSVELIQLRLRIDLHLISSHNTEDCTTLKDKIENLIQKGHLPKFFKDPLHD

SEQ ID NO: 194966 - protein, 287 aa, Glycine max
  Coding DNA Sequence Number=SeqID_78188
  Gene Ontology: Mol. function=DNA-directed DNA polymerase activity; Cellular component=chromosome; Biological process=DNA replication
  Homolog annotation: Hit_ID=Q66DE5; Match level="QueryCoverage=95%, HitCoverage=84%, E-value=3e-91, Identity=64%"; Hit description=DNA polymerase III, delta subunit
  Pfam annotation: Domain name=DNA_pol3_delta; Domain location=1-274; Score=254.7; E_value=1.9e-73; Accession=PF06144.3; Description=DNA polymerase III, delta subunit
ESADAIRAAAAQQGFDEHFSVSVDAQTDWEAIFASCQSLSLFTQRQTLTLQLPENGPNAAIAEQLVKLAALLHSDIMLVLRMAKLTKAQENSAWFKALSASAVLVPCQTPEQAQLPRWVAARAKALQLSIDDAAIQLLCYCYEGNLLALAQALERLSLLWPDGKLTLPRVEEAVNDAAHFTPFHWVDALLAGKSKRALHILRQLQKEDSEVVILLRTLQRDLLTLLQLQRQQAKQPLRTLMDQQPTGCATAAASGASAGSTRTDHEAGLRSESVAAAGDAVVAAVPS

SEQ ID NO: 194967 - protein, 173 aa, Glycine max
  Coding DNA Sequence Number=SeqID_78189
  Gene Ontology: Mol. function=RNA-directed DNA polymerase activity; Biological process=RNA-dependent DNA replication
  Homolog annotation: Hit_ID=Q8H6Q8; Match level="QueryCoverage=99%, HitCoverage=44%, E-value=2e-23, Identity=40%"; Hit description=CTV.20
MVATTYQTSHECSEETIIDILVAGFSGQLKGCTVKTDLNGKVITNDDNKEILDAVNTLVFTIAQHFIGDPSFWKDRTLADFRWYRDTFLTRVYPREDSQQPFWKEKCLARLPRSLGDKVRDKICSQSVNGDIPYENLSYGQLISYVQKVALKICQDDKIQRQLAKEKPKQREI

SEQ ID NO: 194968 - protein, 179 aa, Glycine max
  Coding DNA Sequence Number=SeqID_78190
MSSRKRKSVGSRPTAQYDTRRFHSFEAWTRYTDNVMGRHILAERKVEIYHTELDEFKGEQERRNFHKRLTNLADRSIDLVLVKEFYASLYSPEGPSPKQVRIRGHLIRIDADSLNAFLETPVVLAEGESLPAYSRYCRMPTNIREIEVALCIPSRGFILNVEGHPGKILRKDLTSLAQV

SEQ ID NO: 194969 - protein, 83 aa, Glycine max
  Coding DNA Sequence Number=SeqID_78191
MSAPKFSVFFLLLVVLLSSMQESTSHLDNHVELERKSSEEKVSSMFVQNYSAILSSLKNSRKNRKFKQTLGLKVPSGPNRLHN

SEQ ID NO: 194970 - protein, 281 aa, Glycine max
  Coding DNA Sequence Number=SeqID_78192
MDQSSSLNAFVNDNKIPNPATEKTQNGKRKYKKKEYNLPRRASKRLAGIKVDPAIELKTSRFKRVAINQSCESKMITNMDEHPSCLPVGIVNQQFDAVEGGTESKSKFDCTFEEYMRLLENGEKVDGMSDYSRDFPIAEILKDPCIAFAVQVLTGDTFETYYKKSQMPSESLAAVEGQNIIDVEQEECKTVLSPPEKLIIPKECVAADEIGHTDQGNENLGTSSEMPLEISRMDSLLEYAKSLFDSGNAIPLDTDSKELPSATTQLIKCSKVVIIPLFAGH

SEQ ID NO: 194971 - protein, 152 aa, Glycine max
  Coding DNA Sequence Number=SeqID_78193
MAFSSIMSSGNDVAFEGLLPLQHCGHYLSKLWYAPPNVSRSIFYGVGAWRGSYHCLRKIKEKKVVTRGTKAQLFISLRFYSDLHCQILLHSSPPSSSLSSRPMPTVSCTSNVAHQNLNAHPSFTALQLLDGKILTFDSTASNKTPRTYHYHY

SEQ ID NO: 194972 - protein, 134 aa, Glycine max
  Coding DNA Sequence Number=SeqID_78194
MESTPDTQTASLWTDEKHLHYLNTMEASFVRTMLHHYAVVSPLRLDRYLPDTSESTLDSKPKKQATADSMGGSRGRRTKRRSSSKNKVQNSSPAEEQGVTGDLHMSPQDGSKLEKGIESAACGQGGDDKEPIEN

SEQ ID NO: 194973 - protein, 1267 aa, Glycine max
  Coding DNA Sequence Number=SeqID_78195
  Gene Ontology: Mol. function=protein serine/threonine kinase activity; Cellular component=integral to membrane; Biological process=protein amino acid phosphorylation
  Homolog annotation: Hit_ID=Q9LYN8; Match level="QueryCoverage=97%, HitCoverage=97%, E-value=0.0, Identity=57%"; Hit description=Leucine- rich repeat receptor protein kinase EXS precursor
  Pfam annotation: Domain name=LRRNT_2; Domain location=26-64; Score =43.1; E_value=9.4e-10; Accession=PF08263.3; Description=Leucine rich repeat N-terminal domain
  Pfam annotation: Domain name=LRR_1; Domain location=115-137; Score =13.4; E_value=0.81; Accession=PF00560.23; Description=Leucine Rich Repeat
  Pfam annotation: Domain name=LRR_1; Domain location=139-161; Score =12.6; E_value=1.2; Accession=PF00560.23; Description=Leucine Rich Repeat
  Pfam annotation: Domain name=LRR_1; Domain location=163-186; Score =17.8; E_value=0.04; Accession=PF00560.23; Description=Leucine Rich Repeat
  Pfam annotation: Domain name=LRR_1; Domain location=188-210; Score =13.5; E_value=0.8; Accession=PF00560.23; Description=Leucine Rich Repeat
  Pfam annotation: Domain name=LRR_1; Domain location=212-234; Score =7.7; E_value=10; Accession=PF00560.23; Description=Leucine Rich Repeat
  Pfam annotation: Domain name=LRR_1; Domain location=260-282; Score =13.2; E_value=0.93; Accession=PF00560.23; Description=Leucine Rich Repeat
  Pfam annotation: Domain name=LRR_1; Domain location=284-306; Score =7.3; E_value=13; Accession=PF00560.23; Description=Leucine Rich Repeat
  Pfam annotation: Domain name=LRR_1; Domain location=308-330; Score =17.8; E_value=0.04; Accession=PF00560.23; Description=Leucine Rich Repeat
  Pfam annotation: Domain name=LRR_1; Domain location=355-377; Score =11.9; E_value=1.7; Accession=PF00560.23; Description=Leucine Rich Repeat
  Pfam annotation: Domain name=LRR_1; Domain location=379-401; Score =14.6; E_value=0.37; Accession=PF00560.23; Description=Leucine Rich Repeat
  Pfam annotation: Domain name=LRR_1; Domain location=403-425; Score =10.4; E_value=3.3; Accession=PF00560.23; Description=Leucine Rich Repeat
  Pfam annotation: Domain name=LRR_1; Domain location=427-449; Score =12.5; E_value=1.3; Accession=PF00560.23; Description=Leucine Rich Repeat
  Pfam annotation: Domain name=LRR_1; Domain location=450-472; Score =10.2; E_value=3.5; Accession=PF00560.23; Description=Leucine Rich Repeat
  Pfam annotation: Domain name=LRR_1; Domain location=474-496; Score =3.7; E_value=59; Accession=PF00560.23; Description=Leucine Rich Repeat
  Pfam annotation: Domain name=LRR_1; Domain location=498-520; Score =16.1; E_value=0.13; Accession=PF00560.23; Description=Leucine Rich Repeat
  Pfam annotation: Domain name=LRR_1; Domain location=522-544; Score =16.3; E_value=0.11; Accession=PF00560.23; Description=Leucine Rich Repeat
  Pfam annotation: Domain name=LRR_1; Domain location=546-568; Score =16.9; E_value=0.071; Accession=PF00560.23; Description=Leucine Rich Repeat
  Pfam annotation: Domain name=LRR_1; Domain location=570-593; Score =10.3; E_value=3.3; Accession=PF00560.23; Description=Leucine Rich Repeat
  Pfam annotation: Domain name=LRR_1; Domain location=606-628; Score =12.2; E_value=1.5; Accession=PF00560.23; Description=Leucine Rich Repeat
  Pfam annotation: Domain name=LRR_1; Domain location=630-652; Score =6.5; E_value=17; Accession=PF00560.23; Description=Leucine Rich Repeat
  Pfam annotation: Domain name=LRR_1; Domain location=654-676; Score =19.6; E_value=0.011; Accession=PF00560.23; Description=Leucine Rich Repeat
  Pfam annotation: Domain name=LRR_1; Domain location=67-89; Score=0.3; E_value=2.5e+02; Accession=PF00560.23; Description=Leucine Rich Repeat
  Pfam annotation: Domain name=LRR_1; Domain location=678-700; Score =15.3; E_value=0.22; Accession=PF00560.23; Description=Leucine Rich Repeat
  Pfam annotation: Domain name=LRR_1; Domain location=702-724; Score =18.3; E_value=0.028; Accession=PF00560.23; Description=Leucine Rich Repeat
  Pfam annotation: Domain name=LRR_1; Domain location=726-748; Score =16.7; E_value=0.083; Accession=PF00560.23; Description=Leucine Rich Repeat
  Pfam annotation: Domain name=LRR_1; Domain location=750-772; Score =7.3; E_value=12; Accession=PF00560.23; Description=Leucine Rich Repeat
  Pfam annotation: Domain name=LRR_1; Domain location=776-798; Score =12.2; E_value=1.5; Accession=PF00560.23; Description=Leucine Rich Repeat
  Pfam annotation: Domain name=LRR_1; Domain location=800-822; Score =17.2; E_value=0.061; Accession=PF00560.23; Description=Leucine Rich Repeat
  Pfam annotation: Domain name=LRR_1; Domain location=824-846; Score =15.5; E_value=0.19; Accession=PF00560.23; Description=Leucine Rich Repeat
  Pfam annotation: Domain name=LRR_1; Domain location=848-871; Score =15.4; E_value=0.21; Accession=PF00560.23; Description=Leucine Rich Repeat
  Pfam annotation: Domain name=LRR_1; Domain location=91-113; Score =15.8; E_value=0.15; Accession=PF00560.23; Description=Leucine Rich Repeat
  Pfam annotation: Domain name=Pkinase; Domain location=991-1261; Score= 131.2; E_value=2.8e-36; Accession=PF00069.15; Description=Protein kinase domain
  Pfam annotation: Domain name=Pkinase_Tyr; Domain location=991-1261; Score=114.1; E_value=4.1e-31; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::Pkinase::Pkinase_Tyr; Domain location=26 -64::115-137::139-161::163-186::188-210::212-234::260-282::284 -306::308-330::355-377::...
  Pfam module annotation: Domain location=379-401::403-425::427 -449::450-472::474-496::498-520::522-544::546-568::570-593::606 -628::630-652::654-676::67-89::678-700::702-724::726-748::750 -772::776-798::800-822::824-846::...
  Pfam module annotation: Domain location=848-871::91-113::991 -1261::991-1261
MALPLNLVLSYLVLFQILFCAIAADQSNDKLSLLSFKEGLQNPHVLNSWHPSTPHCDWLGVTCQLGRVTSLSLPSRSLRGTLSPSLFSLSSLSLLNLHDNQLSGEIPGELGRLPQLETLRLGSNSLAGKIPPEVRLLTSLRTLDLSGNALAGEVLESVGNLTRLEFLDLSNNFFSGSLPASLFTGARSLISVDISNNSFSGVIPPEIGNWRNISALYVGINNLSGTLPREIGLLSKLEIFYSPSCSIEGPLPEEMANLKSLTKLDLSYNPLRCSIPNFIGELESLKILDLVFAQLNGSVPAEVGKCKNLRSLMLSFNSLSGSLPEELSDLPMLAFSAEKNQLHGPLPSWLGKWNNVDSLLLSANRFSGVIPPELGNCSALEHLSLSSNLLTGPIPEELCNAASLLEVDLDDNFLSGTIEEVFVKCKNLTQLVLMNNRIVGSIPEYLSELPLMVLDLDSNNFSGKIPSGLWNSSTLMEFSAANNRLEGSLPVEIGSAVMLERLVLSNNRLTGTIPKEIGSLTSLSVLNLNGNMLEGSIPTELGDCTSLTTLDLGNNQLNGSIPEKLVELSQLQCLVFSHNNLSGSIPAKKSSYFRQLSIPDLSFVQHLGVFDLSHNRLSGPIPDELGSCVVVVDLLVSNNMLSGSIPRSLSLLTNLTTLDLSGNLLSGSIPQEFGGVLKLQGLYLGQNQLSGTIPESFGKLSSLVKLNLTGNKLSGPIPVSFQNMKGLTHLDLSSNELSGELPSSLSGVQSLVGIYVQNNRLSGQIGNLFSNSMTWRIEIVNLSNNCFKGNLPQSLANLSYLTNLDLHGNMLTGEIPLDLGDLMQLEYFDVSGNQLSGRIPDKLCSLVNLNHLDLSQNRLEGPIPRNGICQNLSRVRLAGNKNLCGQMLGIDSQDKSIGRSILYNAWRLAVIAVTIILLSLSVAFLLHKWISRRQNDPEELKERKLNSYVDHNLYFLSSSRSKEPLSINVAMFEQPLLKLTLVDILEATDNFSKANIIGDGGFGTVYKATLPNGKTVAVKKLSEAKTQGHREFMAEMETLGKVKHHNLVALLGYCSIGEEKLLVYEYMVNGSLDLWLRNRTGALEILDWNKRYKIATGAARGLAFLHHGFIPHIIHRDVKASNILLNEDFEPKVADFGLARLISACETHITTDIAGTFGYIPPEYGQSGRSTTRGDVYSFGVILLELVTGKEPTGPDFKEIEGGNLVGWACQKIKKGQAVDVLDPTVLDADSKQMMLQMLQIACVCISDNPANRPTMLQQQLTANFRS

SEQ ID NO: 194974 - protein, 49 aa, Glycine max
  Coding DNA Sequence Number=SeqID_78196
MDGCVVGFERTGEVFCNWQVVACEKIACERSLHNFNILVDTSCVLGFKD

SEQ ID NO: 194975 - protein, 77 aa, Glycine max
  Coding DNA Sequence Number=SeqID_78197
MEEPLGIPLSIEFQVQAIGQFAQATCAPEFGLPRLFNKRLLVLHVGGVAVKQRRSELSRIGCWTNGLSYLEKKRGLN

SEQ ID NO: 194976 - protein, 202 aa, Glycine max
  Coding DNA Sequence Number=SeqID_78198
  Gene Ontology: Mol. function=chromatin binding; Cellular component =chromatin; Biological process=chromatin assembly or disassembly
  Homolog annotation: Hit_ID=Q1SAV4; Match level="QueryCoverage=78%, HitCoverage=39%, E-value=6e-34, Identity=47%"; Hit description =Integrase, catalytic region
  Pfam annotation: Domain name=Chromo; Domain location=106-159; Score =22.8; E_value=0.0012; Accession=PF00385.14; Description='chromo' (CHRromatin Organisation MOdifier
MKKYADVKRRDVTYQPNDWVLVKLRPRRQLTAKDSSTRGDKLSKRYYGPFRIVERIGAAAYCLQLPEGAKVHSVFHCSVLKPFTGPIDLATSSTLPLQFEAGQPLVTPLSILNRRQIPGSSPLVWEVLVQWDGLSPDETSWENWEQLCHDYHLEDKVDFQGAKDVTHESEMPQTQETPASMVQKKGETKRRIVKPAYLADYV

SEQ ID NO: 194977 - protein, 82 aa, Glycine max
  Coding DNA Sequence Number=SeqID_78199
MGSPAVDEEHHLPVKHNPRSLREAISSGVKRFMVGGFGRGGRVRRGTDGGTEGGGGRCKEGGLREGVGEGGYGGRGQNNKRN

SEQ ID NO: 194978 - protein, 343 aa, Glycine max
  Coding DNA Sequence Number=SeqID_78200
  Gene Ontology: Mol. function=RNA-directed DNA polymerase activity; Cellular component=intracellular; Biological process=RNA-dependent DNA replication
  Pfam annotation: Domain name=RnaseH; Domain location=24-144; Score =31.6; E_value=6.6e-08; Accession=PF00075.14; Description=RNase H
MKDCDEPLLGEGPDPESRWGLIFDGAVNVFGNGIGAVISTPEGNHLPFAARLQFDCTNNVAEYEACILGIEKAIDLKSKNLDIYGDSALVINQIKGEWETRHPGLIPYKDYAKHLLTFFNKVELHHIPRDENQMADALATLSSMYEVSHRNNLPTIRIQRLERPAHVFAVEEVVDDKPWFHDIKCFLQSQEYPPEVSNKDRRTLRRLSDKKEAEFLMHEIHEGSFGTHSNGHAMARKLLRAGYYWMSMETDCCKHARKCHKCQIYADRIHVPPTTLNVLSSPWPFSMWGIDMIGRIEPKASNGHRFILVAIDYFTKWVEAASYANVTKQVVVRFIKNQIICRY

SEQ ID NO: 194979 - protein, 72 aa, Glycine max
  Coding DNA Sequence Number=SeqID_78201
MGKGFCCLKALKTDGEFNYFKLGNGEQMKVEGIGSMKMKLHDDDITRVQVYWFKVGMQGLQGETFGVARTEK

SEQ ID NO: 194980 - protein, 233 aa, Glycine max
  Coding DNA Sequence Number=SeqID_78202
MNLLKTGASKEGGCSPQSGPPLRWWPPRPPTRAPSLWWPIGLRRGGGTTIQTNEEVVVKLESVKTKHPQLLSQGKVEVSSIVYKVGESMQELIKLWKEHESSQSKMEENGESSSNGPTLEIRILSEHVTATNHQKAPEWDQSSSHGQFCIMYGSIKKEILQKGVDWLASMTKVVAPGEPTTSELMCTLAQVESLVDSKIKVHLERQNAQISEQVAFSPTTTTTTTKKSKPRAF

SEQ ID NO: 194981 - protein, 579 aa, Glycine max
  Coding DNA Sequence Number=SeqID_78203
MDKCLSGVGSGNLDKCENYSLSMVDMLSILQARSNMSAYAVQVLYSCIRVTCGVGRYWRRGVWVSGVVSNGRLICDHGHFKFLPSFSQNLFACMLASCDSLSPSFIFFNLRGIPSLTMSSFLPDSAIGMGGSDFGGLIQQPFMDREVISVGGSSSEDTRHDASNNESSSLKRLRVSHRIGGGTSRIHGRVQSSAASSIGEPIPVTNGGRDVKAFPCVRRSHSDWSSSSFPAVIGFEWVRDDVLKYKTSTTFTMKLTGKIGWVSLNSISKKLFEFGLNVFHCFKDHFFKSGPTKFKLFDKDLLTLVERVDKAMLEQLSASLNVQIILSLPSACDPLIALDGKCLPCLPSLCLNCIMVGPTGGNVPSSTVAPTAGERGQPAVEVDPIKDHGTGSSVHKKSRAPFSLCALRQVAGLMPSSSRPSSLQHIPPATLCVKASASTIVVVVTPTTEVSALAVSVGSFVAPLSTIDAPLLSAGVETTSASVMSPPPSLAPSGPTCHKFYQGLSSKKFGNPSRIWEKATRGTKAITHKIRRVECPEVASATVTFPEAVKSNHKLSSKVGSVLAKLLRTTLDGDELFKC

SEQ ID NO: 194982 - protein, 89 aa, Glycine max
  Coding DNA Sequence Number=SeqID_78204
MVRWRLLGHNALIEWCHKKDLVGKVEGFAAEKDELAKVVADLQVWLKESESRLEDVKNDVMHDEEDIATEEEATEEKDGEEEQDVRASV

SEQ ID NO: 194983 - protein, 79 aa, Glycine max
  Coding DNA Sequence Number=SeqID_78205
MDASLVGSPKVRQTQGPPLLNRIRRPITRLGDKTFNQVEIKPEIISYYPLLYFTRDHQGLSSYIAKVLLPTPSKTSFSP

SEQ ID NO: 194984 - protein, 99 aa, Glycine max
  Coding DNA Sequence Number=SeqID_78206
MQWRVFGLVLAMIAGGFGAMLPGALEVNVNKTIKAAGAAGFFVIVYFFNPAVLVSEDPFKFPPPPPSADAQKVAEKMLSEVNNGQYVELYESMHPEFKA

SEQ ID NO: 194985 - protein, 66 aa, Glycine max
  Coding DNA Sequence Number=SeqID_78207
MTIKEDEIQEEFPDKILLVVQERPWFADIANFKSNDIIAMRRVVTILREEKLKIKPGMQEKALGFS

SEQ ID NO: 194986 - protein, 306 aa, Glycine max
  Coding DNA Sequence Number=SeqID_78208
MVLAEGESLPAYSRYYRMPTDIREIEAALCIPGQGARLIFGLVTQLDMNVRALISRQITSMAQSNSSRLGFPALITTLCKSRGVVSDSLAFERLSSVINLAYIRKNCWNPDDPTVIIRGGRRPRARPAEVLSTSAAPHPTSTLAAPSTLPPADFQRFEAMLRSIHQGQIILLQSLQLVAPPDSIPTVEQFNEWVAWPGTQPPLHREDEDPAAQVPHQSKDESSKSSTPEPLIRKRRVVVTQEAAATSEKSLEATLELPTPVADTTSPQQATDPSTPEDQTTSVLSSNISPVATLVLHLSEEEEGQT

SEQ ID NO: 194987 - protein, 115 aa, Glycine max
  Coding DNA Sequence Number=SeqID_78209
  Gene Ontology: Mol. function=DNA binding; Cellular component =chromatin; Biological process=DNA integration
MDLGCTVSVERHETQDANSISSGVKRFDKLQAQPSSKFDTDLDTWGVNFLDLRALPTLVSQRALRGRVRARLTGALSKGGKMRGVATNVYLWKTSEKPKETGQNENSKFRSCIYA

SEQ ID NO: 194988 - protein, 318 aa, Glycine max
  Coding DNA Sequence Number=SeqID_78210
  Gene Ontology: Mol. function=cyclin-dependent protein kinase regulator activity; Cellular component=nucleus; Biological process =regulation of progression through cell cycle
  Homolog annotation: Hit_ID=P42751; Match level="QueryCoverage=65%, HitCoverage=62%, E-value=3e-43, Identity=43%"; Hit description =Cyclin delta-1
  Pfam annotation: Domain name=Cyclin_C; Domain location=187-316; Score= -0.3; E_value=0.04; Accession=PF02984.9; Description=Cyclin, C -terminal domain
  Pfam annotation: Domain name=Cyclin_N; Domain location=51-185; Score =133.9; E_value=4.4e-37; Accession=PF00134.13; Description=Cyclin, N -terminal domain
  Pfam module annotation: Pfam domain module=Cyclin_C::Cyclin_N; Domain location=187-316::51-185
MSFDSSNHPISPDLYCSEVTSEVIHLDSDDEALKFNVLWGDSDHDDSDDESILLNLLESEHNQVQEQTKFLGQQLRKKTWLINAREEAINWILKVHAYYSFKPETAYLSVDYFNRFLLSHTFTQDKAWPLQLLSVTCLSLAAKMEESKVPLLLDLQVIESRFLFKPKTVQRMELLVMASLKWRLRTITPFDFVHLFISKLLCSASTWGDLSYIVSLVSDVIIRTCLVMDFLEFSPSTIAAAALLWVTNQCVDDKKSYCLHKNISIEMVKKCYKLMKQKLIIRRSELYWPKISQLLPRSPTCVLDHAAAMQESSDAHKL

SEQ ID NO: 194989 - protein, 72 aa, Glycine max
  Coding DNA Sequence Number=SeqID_78211
MKNFHRIAYGNISEALRKHLGLDFLHENTFFHPKQLKCIAKGFGILETQPPPPIYRKNGEVFAAQRLLEEDF

SEQ ID NO: 194990 - protein, 180 aa, Glycine max
  Coding DNA Sequence Number=SeqID_78212
  Gene Ontology: Cellular component=microtubule
  Homolog annotation: Hit_ID=Q9FJW1; Match level="QueryCoverage=99%, HitCoverage=99%, E-value=4e-37, Identity=48%"; Hit description =Arabidopsis thaliana genomic DNA, chromosome 5, TAC clone:K9I9
MGNCQAAEAATVVIQHPGNKIERVYWSLSAHEVMNSNPGHYVALVVSSPTLKAENGAPMKQLKLLRPDDTLHIGQVYRLISFEDVLKEFASKKCGKLGKLLKETGSHGIQMKHKDSRATNPSPNSKTEFGSIKVEQEIQRMGNHGSSSSNNNNNKGVGRHFVGSGGQWRPALQSIAEIGT

SEQ ID NO: 194991 - protein, 81 aa, Glycine max
  Coding DNA Sequence Number=SeqID_78213
MATSMYLIALKAFGSGPNMSIPHMAKGQGSPKLGILVGGHPVWFLLFSGHNFLSIYGGSLERLLDDSLEMPDLLGVGQLGE

SEQ ID NO: 194992 - protein, 326 aa, Glycine max
  Coding DNA Sequence Number=SeqID_78214
LTHVSKCQVGCHVDFVVPGQYISPPSSELACKQKRLSSVEVDCPALRDVERGSLDECESCKSIWTCVVWVASIKLFVMDVSLACTCDTLAYLSHTEWARTRVTVMRESGNVMSYENTHRGAFDKDSFSSERVRTSRRTNGGTSCPRGRARPSAVEEPVSVTMILPPSTSTGARRAGSGGDVRLAGVMTSQSVSSKEFGNSGGEWTATPRDYVEGGILGGGVERPKVANATIAFVEAVRRWKDLQAEKMDLGGKVESIAVEKNGLANRIAEESESRLEESELKAAQERETSKELKEKLILYKKEDVKEGILLDEEEIDVEEEVVDEG

SEQ ID NO: 194993 - protein, 70 aa, Glycine max
  Coding DNA Sequence Number=SeqID_78215
  Gene Ontology: Mol. function=structural constituent of ribosome; Cellular component=intracellular; Biological process=translation
  Homolog annotation: Hit_ID=Q1XVY0; Match level="QueryCoverage=100%, HitCoverage=48%, E-value=3e-17, Identity=60%"; Hit description =Ribosomal protein L21
  Pfam annotation: Domain name=Ribosomal_L21p; Domain location=1-70; Score=62.4; E_value=1.5e-15; Accession=PF00829.11; Description =Ribosomal prokaryotic L21 protein
MFAIVEIAGLQYKVEQDQKLFVHRLKGDKGGKVSFDKVLLTVNGTITVGAPAVSGITVEAEILDHVKADK

SEQ ID NO: 194994 - protein, 155 aa, Glycine max
  Coding DNA Sequence Number=SeqID_78216
MEDNVLPNSSTENAKIEQPGDLQRSCSYVDQNWSSTAVLLTGLQTSADTNFMNGQMTKIASKIYYGYAIYADAKNKGGDIVNAMILAHEYGHQLQYAFNLPSVNESTARPNELEADGFAGYYLRRPNGYNKTQFSEIAAAYEFAQSIGRLSDLKL

SEQ ID NO: 194995 - protein, 57 aa, Glycine max
  Coding DNA Sequence Number=SeqID_78217
MALIFAKNMAILTALNNTVSKILVDKVALDDTLLSLDDVLEQQGFDSLLNDLFHERS

SEQ ID NO: 194996 - protein, 253 aa, Glycine max
  Coding DNA Sequence Number=SeqID_78218
  Gene Ontology: Mol. function=catalytic activity; Biological process =metabolic process
  Homolog annotation: Hit_ID=Q1SP37; Match level="QueryCoverage=33%, HitCoverage=26%, E-value=2e-21, Identity=60%"; Hit description =Bacterial adhesion
MKSRGSETNIMRDAHAIYLQDVKQSFKLETVWLIVGKESKWLAQFERFSKRTKVFSYGDYSSSSNLDAPSSYEPTSPTMEHPVGAKATKRKAKEKDIDKEKSSDVVDLTTMGDIIKTKVKAIEDLACARQHHNKLKEKRDVDKGKRDRLSNPLRGYCYDVLLHIVQALGNQDPYFQQQVDAMGRMGLSPLQKGTIVIRILAYGSPTNSIDDYVRIRETMTLLCLDKFVKGVYDVFGAEYLKDPTIMASNTYCK

SEQ ID NO: 194997 - protein, 46 aa, Glycine max
  Coding DNA Sequence Number=SeqID_78219
MPKCVYQKDAKGLTGGSLTGKLKRPRWRDLGKTTASSSSLDFYLYI

SEQ ID NO: 194998 - protein, 52 aa, Glycine max
  Coding DNA Sequence Number=SeqID_78220
MRWSTVILRPKEPVGLKVVAFLLLQIRIASGWWWRNGKGKRERERDDVAMTC

SEQ ID NO: 194999 - protein, 161 aa, Glycine max
  Coding DNA Sequence Number=SeqID_78221
  Gene Ontology: Cellular component=endoplasmic reticulum; Biological process=ubiquitin cycle
  Homolog annotation: Hit_ID=O82264; Match level="QueryCoverage=87%, HitCoverage=43%, E-value=9e-38, Identity=50%"; Hit description=NPL4 -like protein 2
  Pfam annotation: Domain name=NPL4; Domain location=38-160; Score= -124.3; E_value=0.037; Accession=PF05021.5; Description=NPL4 family
MCTTRQENPHCELVSFDRDYANAFQLCVNDTLAFAVKHDEFMYEIVLKVRKVKVDFIYKPHQQGSKDNLVFFRDPKEEKFVEAIMTITQDKKDYTLSNREVLQAVEYHSDSRLKEWVTIVIKLKEGWFQTEIKEDDDPKLSIGYDSSSSLDQNQQWVVVAW

SEQ ID NO: 195000 - protein, 67 aa, Glycine max
  Coding DNA Sequence Number=SeqID_78222
  Homolog annotation: Hit_ID=Q9C6A6; Match level="QueryCoverage=95%, HitCoverage=5%, E-value=2e-07, Identity=48%"; Hit description =Disease resistance protein, putative; 11609-15699
LKTLDLSINNLNESIMEFVGALRSIKNLSLAGNFIARPFPIKELSLLPNLEVLDLSMNHLVSSVTTQ

SEQ ID NO: 195001 - protein, 138 aa, Glycine max
  Coding DNA Sequence Number=SeqID_78223
  Homolog annotation: Hit_ID=Q6D0J1; Match level="QueryCoverage=43%, HitCoverage=53%, E-value=2e-19, Identity=79%"; Hit description =Secretion monitor precursor
MANDGADGVLMPVVNVETGATRAFLQANQAGRDWPPPFPTGDEARNSVCRVVASVRKSRSPFVHHARIKGLTADFTFFAQGLITDNRVLRAGLQRQRRAIKNGGPVAVQLRLRRSPIPRLPASPVPPATVCCSAHGRT

SEQ ID NO: 195002 - protein, 122 aa, Glycine max
  Coding DNA Sequence Number=SeqID_78224
  Subcellular localization annotation: CTP_CleavageSite=52; ConfidenceScore=5.05e-01
MEDAPLALDVGLFVPPLKGSGSASSNDISWWPPMVVGGGRGGVGAWVGFALSTMELRSTQQFTFSAFPSQEPVEAKLHDESTMIQRMQKNSRLKKKVYNQESRFKIQDLKNQDQDLRLKIQE

SEQ ID NO: 195003 - protein, 100 aa, Glycine max
  Coding DNA Sequence Number=SeqID_78225
  Subcellular localization annotation: CTP_CleavageSite=35; ConfidenceScore=5.17e-01
MSHPNFVRGPLFGGMQPLLDRLEQPGPLGPSRGFQQKAVPSGGSNQLAWASWAATTSLFSPINRGNRVEQKCSALLVFRILSKLVRKIVSVEKIQAEVLL

SEQ ID NO: 195004 - protein, 128 aa, Glycine max
  Coding DNA Sequence Number=SeqID_78226
MPDTNALYSANEAGGAKLHLSSNAEYMVWLMRRKECIIWQHHNIGNQMQSLNEMDRITVPTQQAPLPNQHFSQQLDNVDIGVDSREGHRLHRQRRVVEHHTWEFPPPPTQPIDETYFVTLSQSFGNFT

SEQ ID NO: 195005 - protein, 1109 aa, Glycine max
  Coding DNA Sequence Number=SeqID_78227
  Gene Ontology: Mol. function=nucleic acid binding; Cellular component= beta-galactosidase complex; Biological process=DNA integration
  Homolog annotation: Hit_ID=Q1S0A6; Match level="QueryCoverage=99%, HitCoverage=89%, E-value=0.0, Identity=62%"; Hit description=Zinc finger, CCHC-type; Peptidase aspartic, catalytic; Polynucleotidyl transferase, Ribonuclease H fold
  Pfam annotation: Domain name=rve; Domain location=261-407; Score =13.0; E_value=0.00049; Accession=PF00665.16; Description=Integrase core domain
  Pfam annotation: Domain name=zf-CCHC; Domain location=122-139; Score =12.8; E_value=0.0078; Accession=PF00098.13; Description=Zinc knuckle
  Pfam module annotation: Pfam domain module=RVT_2::rve::zf-CCHC; Domain location=615-870::261-407::122-139
MVTYYGKLKSLWDELANYQQIPLCTCGGCKCDVGSKMEKQQEEEKFHQFLMGLDDVLYGTVRSNLLATDPLPTLNRVYATLVQEERVRTISRGKEERGEVVGFSAHARGRTKGLAESKDRNMVCSNCNRTGHEAESCFQLIGYPEWWGDRSRGEVKANGRGKGRQRGGAAPSRGRNGGVRANATLTNGETSAAPTNANNALTGLSTEQWQTLVDFLNSQKGNINDKMSGASSHMTGNLKFLHGLREIAGCPVGLPDGKQVLATKEGTTILDGGLKIKNDRTSKMLIGTGERRDGLYFFKGIRSEKAHKASGICQFNLWHQRMGHPSLRTTQLVSNIRCEESELKNKACDNGRVERKHRHILNVARALRFQGSLPISFWGECVLTAGYLINRTPTPVLHGKTPYEMLHGQAPLYSHLKVFGCLCYAHNLGKTNDKFASRSQKCVFVGYPNGKKGWKLFDLDTQRYFVSRDVDFFETEFPFAHTSKERNISSVDSPVVFPLLVGDNDSRSHDQIDIEEEVSPDNGVDMGPTELGRGHRIKMPSVKLHDYVTHTVQKLSPSPSSPSPQHNSGAPYPLIHYVNCDKFSVKHRRFIAALTMEHEPVHFFEAVKDAKWRVAMQQELEALESNGTWTLQTLPDGKKPLGCKWVYKIKHNSDGTIERYKARLVILGNHQVEGIDYTETFAPVVKMVTVRLVLAIAAAKKWEIHQMDVHNAFLHGDLHEDVYMKLPPGFRTSQPGLVCKLRKSLYGLKQAPRCWFAKLSFALTNFGFQQSSSDHSLFTLLNHGVQLVVLVYVDDLIVCGNDSTAIQKFKVYLNKCFHMKDLGTLKYFLGVEVARNPSGIFLCQRKYALDIIQETSLLGAKPVSTPLEHNHQLSLATGRLLDQPERYRRLVGRLIYLCFTRPELSYCVHLLSQFMQQPREEHWNAALRIVKYLKGSPGQGILLSSTAKFQLHGWCDSDWAGCPLTRRSTTGWFVFLGHSPISWKTKKQHTVSRSSAEAEYRSMATTTCELKWLKSLLSELGIFHKGPMRLHCDNQAALHIAQNPVFHERTKHIEVDCHFIRNEVLQGNVQPSYVPTSEQLADIFTKALGRHQFQILLGKLGIRNPQAPP

SEQ ID NO: 195006 - protein, 307 aa, Glycine max
  Coding DNA Sequence Number=SeqID_78228
  Gene Ontology: Mol. function=helicase activity; Cellular component =intracellular; Biological process=embryonic development ending in seed dormancy
  Homolog annotation: Hit_ID=Q6Z7E0; Match level="QueryCoverage=86%, HitCoverage=84%, E-value=2e-47, Identity=32%"; Hit description =Putative pentatricopeptide (PPR) repeat-containing protein
  Pfam annotation: Domain name=PPR; Domain location=117-151; Score =37.2; E_value=5.5e-08; Accession=PF01535.11; Description=PPR repeat
  Pfam annotation: Domain name=PPR; Domain location=12-46; Score=5.1; E_ value=1.9; Accession=PF01535.11; Description=PPR repeat
  Pfam annotation: Domain name=PPR; Domain location=152-186; Score=8.8; E_value=0.68; Accession=PF01535.11; Description=PPR repeat
  Pfam annotation: Domain name=PPR; Domain location=203-237; Score =38.7; E_value=2.1e-08; Accession=PF01535.11; Description=PPR repeat
  Pfam annotation: Domain name=PPR; Domain location=47-81; Score=50.0; E_value=8.1e-12; Accession=PF01535.11; Description=PPR repeat
  Pfam annotation: Domain name=PPR; Domain location=82-116; Score=37.5; E_value=4.5e-08; Accession=PF01535.11; Description=PPR repeat
  Pfam module annotation: Pfam domain module=PPR::PPR::PPR::PPR::PPR::PP R; Domain location=117-151::12-46::152-186::203-237::47-81::82-116
MFEINLQPDVFPYNSIIICAEKNQGKWEAGFELMSDMVAKGCEANVVTYSVLISSLCRDGKVEEGVGLLKDMKKKGLEPDGYCYDPLIAVLCKEGRVDLAIEVLDVMISDGCVPDIVNYNTILACLCKQKRADEALSIFEKLGEVGCSPNASSYNTVFSALGSSGHKVRALGMILEMDGMVDEAIELLVDMEMESSECKPSVVSYNIVLLGLCRVGRVSDATEVLAAMVDKGCLPNETTYTFLIEGIGFGGWLNDARDLATTLVNMDAISEHSFERLTDDVHSPPVFVISLCLSFLTAKKVVYDSEC

SEQ ID NO: 195007 - protein, 234 aa, Glycine max
  Coding DNA Sequence Number=SeqID_78229
  Gene Ontology: Mol. function=RNA-directed DNA polymerase activity; Cellular component=chromatin; Biological process=chromatin assembly or disassembly
MEKFHAQDTIISHDGSKGLEPLHAQDHVGTTPGQDMEVHDKLITLDSDGDCFTEVVTVKGLKRQMTRERVEYDLDLSRVSGIRESRFRGTDDGVFAGTRSNGVATDDRGRGGGTTRVGGRAWLREFNPEIKQLKRNSGGNLTIRFTRSSNSERYMETWPGCELTIIGHPLKPGQGAPLHVEGGDGQSIMLGRGMVFEEFVDLKDPTKGFGTIKPGSIEFQAVRGGGGHGWSGIG

SEQ ID NO: 195008 - protein, 137 aa, Glycine max
  Coding DNA Sequence Number=SeqID_78230
MFMVQALPTDLWVRVVFTKYHCGLDGILVIDKEKGRSNFWEKVVSYWEDVAKSVFWKENKWVPNVGSLSDHNSSDISAFHELKDFYGYLIILGVFEKYFTDKTLRWHVLEVGSTGGTGQPIGAFRDASHDYMRRFHV

SEQ ID NO: 195009 - protein, 169 aa, Glycine max
  Coding DNA Sequence Number=SeqID_78231
  Gene Ontology: Mol. function=calcium ion binding; Cellular component =mitochondrion
  Homolog annotation: Hit_ID=Q8L5L1; Match level="QueryCoverage=92%, HitCoverage=98%, E-value=6e-46, Identity=60%"; Hit description =Protein phosphatase 2AB regulatory subunit-like protein
MEVVGDTASLEVDLLQLPEVSALALKSNLTFVETLFEQWLSLPESNRLVTSLLNEAKSGAPLNVPGNRSSPNAASNSLPSMFPAGTAPPLSPRSTSGSPRIVKQRVGPSNLGSPLKVVSEPVKEVIPQFYFQFGRPPPNDLKEQCLIRIDHLFHDHMDGLQIHGEILGI

SEQ ID NO: 195010 - protein, 279 aa, Glycine max
  Coding DNA Sequence Number=SeqID_78232
MKYKPKLEIEDKLELDQSSWSRGSDGKQAIHWYLVAMDERLSCYALIARASVNVTIPLLIRVFSERVGCLNQIETKGGSLETRNASCVNFTRQGPVWGHVQWCFELATHVDNMTVFSDGNGYCSPVKKAKRSTGDALRQKKRRSVRHWPEMHHVSIIRRRGYCRLPEKEKKFPERGTTSIKVHWNVETGHQKTGEKQNGPLECGNRSLEIGRQAERSTGTVDHRISDGGRWLLEKFSGKEKRSPKGNQSRKRSIGDSRSLVENNFRYSRVKNNLSSDTI

SEQ ID NO: 195011 - protein, 88 aa, Glycine max
  Coding DNA Sequence Number=SeqID_78233
MENVSASTRSHQHRDGSGTITRIWWKECVYHSIEQIPDIYKLHELTHGVMPSYPARALDRKLQVDWARDAREGPRVLMSLMVDFGPMG

SEQ ID NO: 195012 - protein, 74 aa, Glycine max
  Coding DNA Sequence Number=SeqID_78234
MNLNRNARNALERAVDSAGGTLDLSSTVGKLGSITDADRGNGTDPTDLIHVLATLIRVVVNQKSSRRRARCVVK

SEQ ID NO: 195013 - protein, 425 aa, Glycine max
  Coding DNA Sequence Number=SeqID_78235
  Homolog annotation: Hit_ID=Q337K5; Match level="QueryCoverage=96%, HitCoverage=32%, E-value=5e-86, Identity=43%"; Hit description =Expressed protein
MENHERRGNWRRLEFVPAEKEALFYQVNQAIVGIHGIDVQFAGIKFLESLVSEFSPSTSSAMGLPREFHEQCRRSLEQDYLKTFYHWTQEAASSVTNRIIESDSVVPEVKVCSAALDLMLQILNWDFCSNTIETKINVNVFSAGVRQDGDSLKKSECHLVQPGSDWRDVLILSGHVGWLLSLYAALRLKFSCEGYWLDCPIAVSARKLLVQFCSLTGAVFLSGMSIPRLPLCQLYVHFRRMTIFRLRCQAIFTDNDGKMHEQHLLQLLSGIIEWVDPPDAISKAIENGKSDSEMLDGCRALLAIANVTTPYVFDGLLKSMRPIGTLTFLSMLMSEVIKVLMTSNTEEETWSWEARDVLLDTWTAILTPINTINVNALLPSEGIKAAANLFGFIVECELRLASATAFNDEGDSDHLHASVSGMDRL

SEQ ID NO: 195014 - protein, 66 aa, Glycine max
  Coding DNA Sequence Number=SeqID_78236
MHAESIRLALQMGEGFEEMGVFEIGNGRKSAVGIRRGNGAVGVGRKSVETVVVIDVVVASWTNGEN

SEQ ID NO: 195015 - protein, 130 aa, Glycine max
  Coding DNA Sequence Number=SeqID_78237
  Homolog annotation: Hit_ID=Q35639; Match level="QueryCoverage=22%, HitCoverage=16%, E-value=9e-07, Identity=93%"; Hit description=NADH -ubiquinone oxidoreductase chain 5
MRLNAITLICSLLLIGAVGKSAQIGSHTESGLPLKTSMKTPEKSVALLGFLIWDPGKEDQAVHLLVTRIVHLGRKSGWLFYTFYFKQEASSLMMAYGVLDHASSATFVGSSLVGMGIKLKEVRRFNVSEE

SEQ ID NO: 195016 - protein, 90 aa, Glycine max
  Coding DNA Sequence Number=SeqID_78238
MAPNRMQLQNMCKREHESFKEYTQRWRDLTAQVVPPMMEREMITMIVDTLPVFYYKKMVFAGKRIKVGLRRGKFDYVALMNRKLGVNGEN

SEQ ID NO: 195017 - protein, 86 aa, Glycine max
  Coding DNA Sequence Number=SeqID_78239
MDWPLFRDTTQVQLGMPTLLCPRKGEIPSSDMECGFNGGQAATTIFRHASTDAMRMYPSTLEKLTVRKIYQLLVHNEDKEIMALHP

SEQ ID NO: 195018 - protein, 66 aa, Glycine max
  Coding DNA Sequence Number=SeqID_78240
MGSEIYLEIHENLRAFFSSSSPILLKPLAHGSGDWSLPREDCISKSHKKHKNLQQIVMVALGDQLD

SEQ ID NO: 195019 - protein, 33 aa, Glycine max
  Coding DNA Sequence Number=SeqID_78241
MYHNCFIFLRHTYFVFPKAWVTLRLSTSKKLFE

SEQ ID NO: 195020 - protein, 219 aa, Glycine max
  Coding DNA Sequence Number=SeqID_78242
  Gene Ontology: Mol. function=transcription factor activity; Cellular component=nucleus; Biological process=regulation of transcription, DNA-dependent
  Homolog annotation: Hit_ID=Q1SCX0; Match level="QueryCoverage=75%, HitCoverage=80%, E-value=2e-34, Identity=47%"; Hit description =Pathogenesis-related transcriptional factor and ERF
  Pfam annotation: Domain name=AP2; Domain location=64-129; Score =145.9; E_value=1.1e-40; Accession=PF00847.10; Description=AP2 domain
MSSSNFESPYEYSCSSSSSRHNQYSLPFNHNDSQEMLLYQVLTQAGATSSVSHGSGSVVEAEVSVSYRGVRRRPWGKFAAEIRDSTRNGVRVWLGTFDTAEAAALAYDQAALVMRGSMAVLNFPAEIVRQSLRNMEQYGSFQEGSSPVLELKKRHSMKRKSETKKHQLHDVMVLEDLGAEYLEHLLTLSQDMDMDACSGIRSVQECPLLRGICGPFSVQ

SEQ ID NO: 195021 - protein, 47 aa, Glycine max
  Coding DNA Sequence Number=SeqID_78243
MARNNGHGSDGWGLRRVKVIIWILECWELGMEEERQKAKHEKVKNTL

SEQ ID NO: 195022 - protein, 93 aa, Glycine max
  Coding DNA Sequence Number=SeqID_78244
  Subcellular localization annotation: CTP_CleavageSite=50; ConfidenceScore=5.74e-01
MKCLAFTLTIPTSLVNEASVFSTVIFVAPFAVLVSSSSAGVGSSCGASIVAASIGSCAVSSFGFSIAAGSGAGTSMPDCSVSGISLGRYLVVT

SEQ ID NO: 195023 - protein, 74 aa, Glycine max
  Coding DNA Sequence Number=SeqID_78245
  Gene Ontology: Mol. function=hydrolase activity; Cellular component =cytoplasm; Biological process=cell division
  Homolog annotation: Hit_ID=Q0EAF2; Match level="QueryCoverage=78%, HitCoverage=18%, E-value=2e-22, Identity=88%"; Hit description =Catalytic subunit of protein phosphatase 1
MEQSVLDDIINRLLEVRTRPGKQVQLSESEIRQLCVVSREIFLQQPNLLELEAPIKICGITYWLIQCVVLNCMY

SEQ ID NO: 195024 - protein, 97 aa, Glycine max
  Coding DNA Sequence Number=SeqID_78246
  Gene Ontology: Mol. function=DNA binding; Cellular component =chromosome; Biological process=regulation of transcription, DNA -dependent
  Homolog annotation: Hit_ID=Q39601; Match level="QueryCoverage=98%, HitCoverage=20%, E-value=9e-10, Identity=55%"; Hit description=FACT complex subunit SSRP1
FKGLENYELRRCLTYCWYKEGSLFEDDDVVDPHLERIKNEAGGDESDEEKPAKKESKKDMPSKASTSKRKSKDDEDGKKKKRLKCTQEDNVWFHVHF

SEQ ID NO: 195025 - protein, 324 aa, Glycine max
  Coding DNA Sequence Number=SeqID_78247
  Gene Ontology: Mol. function=two-component response regulator activity; Cellular component=membrane; Biological process=two -component signal transduction system (phosphorelay)
  Homolog annotation: Hit_ID=Q9XET9; Match level="QueryCoverage=99%, HitCoverage=49%, E-value=1e-92, Identity=48%"; Hit description =Ethylene receptor homolog
  Pfam annotation: Domain name=HisKA; Domain location=5-70; Score=40.4; E_value=6.2e-09; Accession=PF00512.15; Description=His Kinase A (phosphoacceptor) domain
  Pfam annotation: Domain name=Response_reg; Domain location=214-323; Score=44.6; E_value=3.5e-10; Accession=PF00072.14; Description =Response regulator receiver domain
  Pfam module annotation: Pfam domain module=HisKA::Response_reg; Domain location=5-70::214-323
MARKARSSFEKVMSHGMRRPMHSILGLLSMFQEDNIRPEQKIVIDSILKVSNALSRLINDVMEIAENDNGSFQLEMKPFHLHSMMREASCTAKCLCIYKGFGLEVDVDKSLPDLVIGDEARTFQINGISFHSDESVSTRNYTGRNHCNNELKEGLSFSMCKTLVQMMQGNIWISTNSLGLAQGMTLLLKFQIGSSHGRFILAPKEFSNSQFRGLKVVLADDDDVNRTVTKKLLEKLGCQVTAVSSGFECLGAISASGNSFKIIMLDLHMPEMDGFEVARRIRKFQSHNFFLCSLLLLQVQNNGGEERCLQVGMNGLIRKPILLH

SEQ ID NO: 195026 - protein, 173 aa, Glycine max
  Coding DNA Sequence Number=SeqID_78248
  Gene Ontology: Mol. function=hydrolase activity
  Homolog annotation: Hit_ID=Q1SPB9; Match level="QueryCoverage=60%, HitCoverage=19%, E-value=3e-15, Identity=40%"; Hit description =Transposase
MDEDQWMYDNIMTEEVDMNDQNEGEVGVNEEHVDCFDAFNACLLPVMMFCIRLDLLLMKLDLWRCDALPEVIVTDRDLALMNVVKTIFHEATNLLCRFHIDKNVKAKCKTLVGKKKECDDVMEAWGSLVDCHSEQQFDECLKKFEIACSPWPMFVGYGNQTWLIPHKKRFVKV

SEQ ID NO: 195027 - protein, 90 aa, Glycine max
  Coding DNA Sequence Number=SeqID_78249
MGPIFVRATETPRGRYDVRKKAQAIQKQNTAPHVLSRGDLLEEQASHVGVTIKQYFGPAPRTSRTLLVASAKRNTPGLSARKTLEEDELY

SEQ ID NO: 195028 - protein, 51 aa, Glycine max
  Coding DNA Sequence Number=SeqID_78250
  Subcellular localization annotation: CTP_CleavageSite=43; ConfidenceScore=5.13e-01
MENEGSPPDSGAQSSSSVTVAVSPPDYFRQRPYQSTNNPSSISSSLFFSSG

SEQ ID NO: 195029 - protein, 254 aa, Glycine max
  Coding DNA Sequence Number=SeqID_78251
  Homolog annotation: Hit_ID=Q9ZRR7; Match level="QueryCoverage=67%, HitCoverage=49%, E-value=2e-18, Identity=36%"; Hit description=SAP1 protein
  Pfam annotation: Domain name=DUF296; Domain location=46-148; Score =41.7; E_value=2.5e-09; Accession=PF03479.5; Description=Domain of unknown function (DUF296)
MGLEMGICFKCWCRNGYYSALFQILSISFPIRRLIHNSLPPLRGSFTIIGLKCNIILEWMENLALAPSYKKIDLHSSVTCQSTDTKGRFEIISLTGSYVRNELGTRTGGLSVCLSNTDGQIIGGGVGGPLKAAGPVQVIVGTFFIDNKKDNGAGLKGDASASKLPSPVSEPVSSLGFRQSVDSSSGNPIRGNDEHQAMDGSHFMIQQLGLHGTPPRSTDWGRPDSRNTGFELTGRTGHGAHQSPENGGYDQIPD

SEQ ID NO: 195030 - protein, 40 aa, Glycine max
  Coding DNA Sequence Number=SeqID_78252
MCGYTLILAIGFSTAKTLERYHRCSYGALEVQHQPEIETQ

SEQ ID NO: 195031 - protein, 64 aa, Glycine max
  Coding DNA Sequence Number=SeqID_78253
  Gene Ontology: Mol. function=structural constituent of ribosome; Cellular component=intracellular; Biological process=regulation of transcription, DNA-dependent
  Homolog annotation: Hit_ID=A0FIJ3; Match level="QueryCoverage=95%, HitCoverage=25%, E-value=2e-15, Identity=67%"; Hit description=MADS -box transcription factor MADS-RIN
  Pfam annotation: Domain name=K-box; Domain location=2-64; Score=15.4; E_value=2.2e-05; Accession=PF01486.8; Description=K-box region
MSPHALVQRRYQEYLKLKSRVEALQQTQRNLLGEELEHLDVNDLEQLERQLDSSLKQIRSNKIE

SEQ ID NO: 195032 - protein, 92 aa, Glycine max
  Coding DNA Sequence Number=SeqID_78254
MPLFASQQPQEAALPMSYSSNNLSIKGKGTVETCNFGQNLVYFPVTLKVAERKNIPGRDDDRIWTQCVPKTNHDKEGKYPLNGFGTRINFSI

SEQ ID NO: 195033 - protein, 50 aa, Glycine max
  Coding DNA Sequence Number=SeqID_78255
MSNDKLRMRISNSQDNNLGMRRRNALRGMLIEGSWVENPTVIKAEILQHF

SEQ ID NO: 195034 - protein, 161 aa, Glycine max
  Coding DNA Sequence Number=SeqID_78256
  Pfam annotation: Domain name=AT_hook; Domain location=70-82; Score =16.6; E_value=0.031; Accession=PF02178.9; Description=AT hook motif
MEPIDNHLTSFFHHHQQQQQHHQHQHQHPPPPPPTTASPTNGLLPNADGSHMLYPHSVASAVSSQLEPAKRKRGRPRKYGTPEQALAAKKAATTSSQSFSADKKPHSPTFPSSSFTSSKKSLSFALGNAGQGFTPHVISVAAGEISASACLLHRATRVTYL

SEQ ID NO: 195035 - protein, 165 aa, Glycine max
  Coding DNA Sequence Number=SeqID_78257
  Homolog annotation: Hit_ID=Q6ET43; Match level="QueryCoverage=36%, HitCoverage=26%, E-value=2e-12, Identity=55%"; Hit description =Putative Chain C, Structure Of The Plant Transcriptional Regulator Pbf-2
  Pfam annotation: Domain name=Whirly; Domain location=113-165; Score= -33.5; E_value=0.0064; Accession=PF08536.2; Description=Whirly transcription factor
MRLGWARQHTSEEKEPSKMFKLSRMLPLTSTSRHRLLEVLSSRKVEVGDRLSHSAGISTATNNYAAKGIALYKCLYFCYLFLADIPLGISFTSVFLPLKITGYASDRIFAPYTVYKGKAAFSLIPCLPTFTKLNSGTVVVDRRGSIMMTFMHSIGERKYDWEKSQ

SEQ ID NO: 195036 - protein, 58 aa, Glycine max
  Coding DNA Sequence Number=SeqID_78258
MPWQRHLRRKQLIVNLLKMGSKASALKLAILGGPYSFFTCAKTRQKKVRTTSLWSKRS

SEQ ID NO: 195037 - protein, 61 aa, Glycine max
  Coding DNA Sequence Number=SeqID_78259
MKSSQPDEAISTIHYTGRRQYYNNEPKEGLSFSMCKKVGTELSNVELFMMFEMGGETIITS

SEQ ID NO: 195038 - protein, 88 aa, Glycine max
  Coding DNA Sequence Number=SeqID_78260
  Homolog annotation: Hit_ID=Q1SXD5; Match level="QueryCoverage=99%, HitCoverage=80%, E-value=3e-17, Identity=55%"; Hit description=Cupin, RmlC-type
  Pfam annotation: Domain name=Cupin_3; Domain location=12-80; Score =9.7; E_value=0.0019; Accession=PF05899.3; Description=Protein of unknown function (DUF861)
MSVESKPTELRLLELGVISWTKWGRAPGQYESHTEAQETYFLLRGRVKFIPKDSTYDPIEFGAGDLCYHTKRTHMHMGHLCCSRRTLQ

SEQ ID NO: 195039 - protein, 417 aa, Glycine max
  Coding DNA Sequence Number=SeqID_78261
  Gene Ontology: Mol. function=ubiquitin thiolesterase activity; Cellular component=intracellular; Biological process=ubiquitin -dependent protein catabolic process
  Homolog annotation: Hit_ID=Q6Z1P7; Match level="QueryCoverage=85%, HitCoverage=88%, E-value=1e-119, Identity=57%"; Hit description =Carboxyl-terminal peptidase-like
  Pfam annotation: Domain name=DUF239; Domain location=198-377; Score =342.3; E_value=8.1e-100; Accession=PF03080.5; Description =Arabidopsis proteins of unknown function
MGTVGCSCSTTPHPSHHHHHLLLVIGFFLTLLLQTVEVEPSALNCTRYRKVSSLRLQRIQRHLDNINKPPVLTIESPDGDLIDCVHKRKQPALDHPLLKDHKIQKVPTKMPRGMKKVKRMEIRSARQMWHKNGTRCPKGTIPVRRSTVHDVLRAKSLFDFGKKQRRFPLTRRRSDAPDVVSGNGHEHAIAYTGSSQEVYGAKATINVWEPSIQVVNEFSLSQIWILSGSFDGSDLNSIEAGWQSDSYQATGCYNLLCAGFVQTNGRIAIGAAISPISSYESNQYDITILIWKDPKVGNWWMSFGDGTLVGYWPEELFTHLATHATMVEWGGEVVNTRANGQHTSTQMGSGHFADDGFGKASYFRNLEIVDTDNSLSSVHNILTLAENTNCYDIKSSYSNEWGTYFYYGGPGNNPQCP

SEQ ID NO: 195040 - protein, 691 aa, Glycine max
  Coding DNA Sequence Number=SeqID_78262
  Gene Ontology: Mol. function=binding; Cellular component=cytoplasm; Biological process=regulation of translational elongation
  Homolog annotation: Hit_ID=Q9XIR5; Match level="QueryCoverage=97%, HitCoverage=24%, E-value=0.0, Identity=65%"; Hit description=Similar to translational activator
  Pfam annotation: Domain name=HEAT; Domain location=10-46; Score=27.4; E_value=5e-05; Accession=PF02985.12; Description=HEAT repeat
  Pfam annotation: Domain name=HEAT; Domain location=138-173; Score =16.9; E_value=0.073; Accession=PF02985.12; Description=HEAT repeat
  Pfam annotation: Domain name=HEAT; Domain location=179-214; Score =9.1; E_value=3.3; Accession=PF02985.12; Description=HEAT repeat
  Pfam annotation: Domain name=HEAT; Domain location=254-290; Score =25.0; E_value=0.00027; Accession=PF02985.12; Description=HEAT repeat
  Pfam annotation: Domain name=HEAT; Domain location=338-378; Score =9.0; E_value=3.4; Accession=PF02985.12; Description=HEAT repeat
  Pfam annotation: Domain name=HEAT; Domain location=379-414; Score =5.3; E_value=9.6; Accession=PF02985.12; Description=HEAT repeat
  Pfam annotation: Domain name=HEAT; Domain location=420-456; Score =20.5; E_value=0.0061; Accession=PF02985.12; Description=HEAT repeat
  Pfam annotation: Domain name=HEAT; Domain location=48-82; Score=6.1; E_value=7.7; Accession=PF02985.12; Description=HEAT repeat
  Pfam annotation: Domain name=HEAT; Domain location=501-537; Score =14.9; E_value=0.29; Accession=PF02985.12; Description=HEAT repeat
  Pfam annotation: Domain name=HEAT; Domain location=545-581; Score =22.4; E_value=0.0016; Accession=PF02985.12; Description=HEAT repeat
  Pfam annotation: Domain name=HEAT; Domain location=99-135; Score=8.4; E_value=4.1; Accession=PF02985.12; Description=HEAT repeat
  Pfam annotation: Domain name=HEAT_PBS; Domain location=275-301; Score= 1.0; E_value=74; Accession=PF03130.6; Description=PBS lyase HEAT-like repeat
  Pfam annotation: Domain name=HEAT_PBS; Domain location=31-64; Score =6.0; E_value=15; Accession=PF03130.6; Description=PBS lyase HEAT -like repeat
  Pfam annotation: Domain name=HEAT_PBS; Domain location=363-391; Score= 10.8; E_value=3.1; Accession=PF03130.6; Description=PBS lyase HEAT -like repeat
  Pfam annotation: Domain name=HEAT_PBS; Domain location=566-602; Score= 7.0; E_value=11; Accession=PF03130.6; Description=PBS lyase HEAT-like repeat
  Pfam module annotation: Pfam domain module=HEAT::HEAT::HEAT::HEAT::HEA T::HEAT::HEAT::HEAT::HEAT::HEAT::HEAT::HEAT_PBS::HEAT_PBS::HEAT _PBS::HEAT_PBS; Domain location=10-46::138-173::179-214::254-290::338- 378::379-414::...
  Pfam module annotation: Domain location=420-456::48-82::501-537::545 -581::99-135::275-301::31-64::363-391::566-602
MASAAKSQLLTFMNELIPTIRTALCDSVSEVRESAGLAFSTLYKSAGMLAIDEIVPTLLHALEDDETSDTALDGLKQILSAFNAHALGALAVVAGPGLDFHLCTVLPPLLSAMGDDDKEVQTLAKEAAETVVLVIDEEGIEPLISELVKGVNDSQAAVRRSSSYLIGYFFKNSKLYLVDEAPNMISTLIILLSDSDSSTVTVAWEALSRVIISVPKEVLPSYIKLVRDAVSTSRDKERRKKKGGPVLIPGFCLPKALQPILPIFLQGLISGSAELREQAALGLGELIEVTSEQSLKEFVIPITGPLIRIIGDRFPWQVKSAILSTLTTMIKKGGISLKPFLPQLQTTFVKCLQDSTRCDCRTVRSSAALALGKLSGLSTRVDPLVSDLLSSLQGSDGGVRDAILTALKGVLKHAGKNLSSAVRTRFYSILKDLIHDDDDRVRTYASSILGILTQYLEDVQLTELIQELSSLANSSSWPPRHGSILTISSLLHYNPATICSSSLFPTIVDCLRDTLKDEKFPLRETSTKALGRLLLYRSQVDPSDTLLYKDVLSLLVSSTHDDSSEVRRRALSAIKAVAKANPSAIMSLGTIVGPALAECMKDGNTPVRLAAERCALHAFQLTKAYSTSDKLNDSLVNERDWCFFMTLRSSVQKMFKQHRSISLAWMLGAYPSFLNIVMIVTTVTKIPQVAK

SEQ ID NO: 195041 - protein, 114 aa, Glycine max
  Coding DNA Sequence Number=SeqID_78263
GKGTRRRGGDREMTKNMQSGEWSSDRHVLDRETAKLDGGCPDGGGHGWSHKQVGVAEEVPRAGKEGGHELHVPKKKHTWEHGDDVATKQWQRTEALFSVKLHTRSGRDQRTLIY

SEQ ID NO: 195042 - protein, 213 aa, Glycine max
  Coding DNA Sequence Number=SeqID_78264
MVIKVDLGKAYDRVNWDYLRLTLIDFCFPSIITDLIMWGVAFGLKVNLDNYIFNCSLAVPQRIQDEISNILEISCTNHLGKNSVLASTPIYPMQACGSLPQWAPSLTSVVQILSSKYLQNDAILTAKLKPRDSYVWWSVIKAKDVLLDGFSSQLGDGQSFWYSNQLADGKLCMKIVVPSNPVRDDIIFWKGHSSCVYSSKSNYNKVSKFDDVP

SEQ ID NO: 195043 - protein, 258 aa, Glycine max
  Coding DNA Sequence Number=SeqID_78265
  Gene Ontology: Mol. function=nucleic acid binding; Biological process= RNA-dependent DNA replication
  Homolog annotation: Hit_ID=Q1T6D0; Match level="QueryCoverage=64%, HitCoverage=40%, E-value=2e-25, Identity=31%"; Hit description=Zinc finger, CCHC-type; Lipocalin
MATLNGEKSNQVSGESGIPEKSPDGEGGEVVQILSYKDRVLGKVSVLKEPTNLLHEGVMILEYEGGNWMLLKFITKQAKFEQLYMPWKNCLIMKLLGKNVGFLTMREKLKFVWKLEGEATIDKTLVWIRFPSLWMVYYDETVLLTLASTIATPIKVDLNILNMHRGKFVRGDGDTPPLAAETNPNTKEIVTMQFEDSTNITTHGEWMVVKWKERKSANHLKVANTHSQSQGHVGKRMRKRESDWIKVMVLKNHMLVNP

SEQ ID NO: 195044 - protein, 197 aa, Glycine max
  Coding DNA Sequence Number=SeqID_78266
  Gene Ontology: Biological process=response to brassinosteroid stimulus
  Homolog annotation: Hit_ID=Q84UT5; Match level="QueryCoverage=74%, HitCoverage=87%, E-value=2e-15, Identity=29%"; Hit description =Hypothetical protein OsBLE3
  Pfam annotation: Domain name=DUF588; Domain location=32-178; Score =139.9; E_value=6.7e-39; Accession=PF04535.3; Description=Domain of unknown function (DUF588)
  Pfam annotation: Domain name=MARVEL; Domain location=44-189; Score= -8.7; E_value=0.03; Accession=PF01284.13; Description=Membrane -associating domain
  Pfam module annotation: Pfam domain module=DUF588::MARVEL; Domain location=32-178::44-189
  Subcellular localization annotation: CTP_CleavageSite=50; ConfidenceScore=5.32e-01
MADAKDSSIVDSKSSPTSTLTSSASQQQHRIIRTFLMAQDILRILPTLLSAASIAVMVTNNQTVLIFAIRFQAHFYYSPSFKFFVAANGVVVAMSLLTIILNFLMKHQASPIYHFFLFLHDIVMTVLLIAGCAAATAIGYVGKFGEEHVGWQPICDHVRKFCTTNLVSLLLSYFAFIAYFGITILSAYKIVSSSPKN

SEQ ID NO: 195045 - protein, 94 aa, Glycine max
  Coding DNA Sequence Number=SeqID_78267
  Homolog annotation: Hit_ID=Q9XIR5; Match level="QueryCoverage=88%, HitCoverage=3%, E-value=9e-33, Identity=79%"; Hit description =Similar to translational activator
VLYHVLGVVPAYQALIGPALNELSLGLQPAEVASALNGVYAKDVHVRMACLNAVKCIPAVANRSLPENVEVATSIWIALHDPEKLSVIERQLVF

SEQ ID NO: 195046 - protein, 154 aa, Glycine max
  Coding DNA Sequence Number=SeqID_78268
  Gene Ontology: Mol. function=DNA binding; Biological process=DNA integration
MFKFGENIVSWKCNMHNVVSLSTTEVGFIVVLEAIKEAIWMKGKGTKLGAKEVGVRIYSDSQSGTHWAKNQLYHERTTYIDHCLRILQVMNSKVKPRGLQSLPDLPEFQLSLRPDDYELPEIDPAWDSENWESLGQPLKEHLRDSDEHDENPTD

SEQ ID NO: 195047 - protein, 93 aa, Glycine max
  Coding DNA Sequence Number=SeqID_78269
MATKSKTYQDTVDTTDTRRGAKSALVPMAARKATSADTADIVDTKQENLPERNEEGGFATRARLGWLCETPRGGSRTMAIRGWLCKVGQEQWQ

SEQ ID NO: 195048 - protein, 64 aa, Glycine max
  Coding DNA Sequence Number=SeqID_78270
MESMMLSGLPYLGATDIIYYCICYKISNDMVREDIFELNGDGNPENKNLNKMNFIELKRAQELL

SEQ ID NO: 195049 - protein, 108 aa, Glycine max
  Coding DNA Sequence Number=SeqID_78271
GNIKVAHKTLKSQNSQNNSSISDLVENSCSLHVYIAVCVSGLQQLALDKIYHSPEKSALKDLKDKIYVSSIFGQDVLDIVSDIVDPAASILHLTFYLALCIVQPNLIP

SEQ ID NO: 195050 - protein, 491 aa, Glycine max
  Coding DNA Sequence Number=SeqID_78272
MDREVILIGGFSSEDTCRGAFHNKSSPSKRLSGKIGWVSLNNMSKKLFEFDLNIFHPFKDPFFKVLVTDVVADGMPLMLNGDREPHFIDLLTALDDIMSDFDWRPLVKRVGPAGGTVLPSVATPSAGEVGPVVVVVTEVAPNALSSILLKRKSDDVVGLSGRLMTAQDGPPAPLAVEAPATTAAVEVSPAAIEIVVPATQAESVVVLSSTIAAPLLSVVVETIGTPTVLPPSLSASMVLPADVLMAMVLPSSSSCPCVSLDHLYTYYDVESLWSVTYKSEQKTSENKLRHQEVVQKVASLEAKVAKCRATARTLWRAERPKSEPLTVFQGWWCIGQVVVHPEMAMTCLDVARLRELESRFEESELRATKEREANKDLEEELILYKKEVVSFFASDLDLGLFDPFKDVRDGVLLGEEEIDAEEEATDEGRGVSQPTLRQEGDARLAGESSKEGKRVESPPTFIRGKRRKNPKRHGLRTLSVKGSGVVFTHGE

SEQ ID NO: 195051 - protein, 98 aa, Glycine max
  Coding DNA Sequence Number=SeqID_78273
MACVSSKAGNYFRIALLILSTKAPRQVSSDEKPPIKMTSRSMMGYSIEPSESLPPIPMVESDRKEDIVVDVSTFRSWRKKKGKPKARKQARKQEDNKQ

SEQ ID NO: 195052 - protein, 156 aa, Glycine max
  Coding DNA Sequence Number=SeqID_78274
GTSTWVVVTENKRGYISCGSVQVEGFYNVEKKSQGPQVAWGLDVGAELKLMVEKTKKKLEEAAQSGSTEGVINPPSPTRRHVKWKMACTKKTRQMTSEAAKDIVEKFASQGSFVPHGHQEVLTAAIGQLEHPGHVCPARAGVTIKQYFVAHQCGCG

SEQ ID NO: 195053 - protein, 80 aa, Glycine max
  Coding DNA Sequence Number=SeqID_78275
MLTNNNEAYIIENNQNQNHILWKAYIAENSQNTNKRPTLSKTTKTPINLQNQNQNQNHDFTVKKSFKRKTYSESESDNDI

SEQ ID NO: 195054 - protein, 109 aa, Glycine max
  Coding DNA Sequence Number=SeqID_78276
MPHPIVAECTQVMTVDEGSHVRALTVYQASLGGEFDIDPRYDTFNRGLKPIEDLAQLQLRPKLGPNKYHRRKGRREKSGIKLSKKKLTSYSTQTSSERLGYVPSSPMSS

SEQ ID NO: 195055 - protein, 101 aa, Glycine max
  Coding DNA Sequence Number=SeqID_78277
MEVVLYTKVSRIHRLTCIPNEELAHEVNYTGNQPRQNFNADEGRAEEKVKGYKQQLEAEPALEPVSDFVELEEVVEDEDDQQEREIPIKESEIGIKMKEKQ

SEQ ID NO: 195056 - protein, 144 aa, Glycine max
  Coding DNA Sequence Number=SeqID_78278
  Subcellular localization annotation: CTP_CleavageSite=58; ConfidenceScore=5.66e-01
MATPSSSPPLHPPPSLPTEAASHSPSTLKWTRKATRLRSLATRPAGAGRPVVHVDPTTGMAVGPHKKKLRTYLGIVARDKAEFDIPEASDVRTKKKILQTMVERWRQFKSTLTSKWVLAIDKDSVDDTVCEKYGISKEKWAQCC

SEQ ID NO: 195057 - protein, 54 aa, Glycine max
  Coding DNA Sequence Number=SeqID_78279
MNSLSEHAALSVFINTYCIWPLRNVRVVILGHRIRMITGDFNQRKPRTDISIIF

SEQ ID NO: 195058 - protein, 171 aa, Glycine max
  Coding DNA Sequence Number=SeqID_78280
  Gene Ontology: Mol. function=branched-chain-amino-acid transaminase activity
  Homolog annotation: Hit_ID=Q1XNF3; Match level="QueryCoverage=93%, HitCoverage=92%, E-value=4e-50, Identity=63%"; Hit description =Hypothetical protein precursor
MKFKSILLAVAISTSAVAFAQETSQKKFAPPAGNAIVGDTYGAGVDSSVESKAITVEKLGKKLKKENKKLENVAIKGKVTDVCEKKGCWLTIQTEDNSQFFVKMKDYAFFVPTALKGKNVVLEGNAERKVISVDEQKHYAEDAKKPQSEIDAITKPKEEVRFVANGIKVVN

SEQ ID NO: 195059 - protein, 83 aa, Glycine max
  Coding DNA Sequence Number=SeqID_78281
  Gene Ontology: Mol. function=amino acid transporter activity; Cellular component=membrane; Biological process=amino acid transport
  Homolog annotation: Hit_ID=Q1XPC8; Match level="QueryCoverage=99%, HitCoverage=17%, E-value=1e-27, Identity=66%"; Hit description=Amino acid permease-associated region
MGSMIGSGIFIVSADMMRNLGSGYWLIVVWVITGIMTVAAAISYGELSALFPKAGGQYTYLKEIFGKRMGFLYGWGLFTVIQT

SEQ ID NO: 195060 - protein, 166 aa, Glycine max
  Coding DNA Sequence Number=SeqID_78282
  Homolog annotation: Hit_ID=Q1SDS1; Match level="QueryCoverage=70%, HitCoverage=23%, E-value=2e-11, Identity=35%"; Hit description=IMP dehydrogenase/GMP reductase
MCAEKGKANWEQLLASMVGASINWFPRWKKGRVGVLSSCEGFSNIPLMGMRGCINYNSVLAIRQLGYPMRGVPSEESITPFIARGFSYPNAMIFQRVRKAWSAVQRKDKELRGNKNGIVGGYYKWLKAWTQELDWLPKVKVSSEEEAETPEESKKVQALMAKLERA

SEQ ID NO: 195061 - protein, 160 aa, Glycine max
  Coding DNA Sequence Number=SeqID_78283
MWAFLTDRQIDWAHLVKYRMHKALRTNAPLPYPQLVTLFLRHFQIPLDDEPFVQVKTSFAIGVGVVTSFGYRKDIDGQWIRKQDLPPLIPDERTSSPLPQRDASSTLMHEVLSELCGLRAFVGDRLDAMDAHFEGMDTWITHLEDDMGFIRRCFDPPAAP

SEQ ID NO: 195062 - protein, 221 aa, Glycine max
  Coding DNA Sequence Number=SeqID_78284
SEFLIGGYVGARASLLSTTPPFVAMTQELVARGDTLRLSAPRHSVTPSVIDEQRLMWSSAPFPEMSAFSDGDFSSLTSYLELRHVTCTLVSSRGGGPDDTRRYLTVIRTLLSSRGGGPDDKQRPKAAGPMTSRDQVWSFCTLVSSRGGGPDDTRRYLTVIRTLLSSRGGGPDDEQRPNRTLDSMQRLTQSSAPFVPPGTASHLHAEISWSPATLVNREERN

SEQ ID NO: 195063 - protein, 96 aa, Glycine max
  Coding DNA Sequence Number=SeqID_78285
  Gene Ontology: Mol. function=oxidoreductase activity; Biological process=ethylene biosynthetic process
  Homolog annotation: Hit_ID=Q8W3Y3; Match level="QueryCoverage=82%, HitCoverage=26%, E-value=2e-15, Identity=50%"; Hit description=1 -aminocyclopropane-1-carboxylic acid oxidase
MGTNSRNPYYYKNISCTRRDWSKLVNHGINAWKRGSPKSTTGNAWKRFKELVASKGLHAVQTKVKDMDWESIFHLHHLPDSNILEISDLIYEYKLQ

SEQ ID NO: 195064 - protein, 109 aa, Glycine max
  Coding DNA Sequence Number=SeqID_78286
MVPFCKLIPQMGSFLNNFCHGVVFYVVCMQNACKTQAPLATSWALDTWKPNPPVLLATSGGSASRQFCWRLQACAEIAALIGNFQGYQARVQDAQKPFPRELQSKESPV

SEQ ID NO: 195065 - protein, 100 aa, Glycine max
  Coding DNA Sequence Number=SeqID_78287
  Homolog annotation: Hit_ID=Q9SKM5; Match level="QueryCoverage=44%, HitCoverage=5%, E-value=2e-11, Identity=64%"; Hit description =Putative RNA methyltransferase
MLEVKRHSLSTDGFEPVEDINLGNIKYRDRMCQTLYPELGQESLIPCQEPPLPKSQAVDCPNVSTIACKYATIFQEFLQDSDLPVWNRFKNTGFWRQLTV

SEQ ID NO: 195066 - protein, 80 aa, Glycine max
  Coding DNA Sequence Number=SeqID_78288
MLCAGVVCVTIAAVRALEAAVGRAAEDCCVVLFVALFSRFEFPFARETRVGLGRTVREVLMTVQNQVDLRSRHSEKSFRS

SEQ ID NO: 195067 - protein, 113 aa, Glycine max
  Coding DNA Sequence Number=SeqID_78289
MSLYNLYLVTKIEIEGTVASIILLMWQSWSDPSWPTKNGFGWVENPDPSHLRGGLAVKNKKKRSVGQLVPSRLVGRVRRDKQYGDREIESPNPPLDIFGWLDCWAKTRPQCQP

SEQ ID NO: 195068 - protein, 132 aa, Glycine max
  Coding DNA Sequence Number=SeqID_78290
MKVGTSKETPSQRTRVTITRKKEEEDSISWLRKKYLVRIGLSWGVRGVEAKVSYSMATGCRSRSQSVIGLREKRVLVNALLGNSDSMAARRMRVRERKRRPRRRRVQRKKKRRRKREGMEIKEDTTGCNVCG

SEQ ID NO: 195069 - protein, 90 aa, Glycine max
  Coding DNA Sequence Number=SeqID_78291
MGAQLRKSAVKKMIVVMKIMLASRGLPLWLMENLILILVHQTGMFSTTQTEAIEELAKAGLRNPVRVEGVLVDDTYSYLSKQHRECVIRE

SEQ ID NO: 195070 - protein, 210 aa, Glycine max
  Coding DNA Sequence Number=SeqID_78292
  Gene Ontology: Mol. function=protein transporter activity; Cellular component=cytoplasm; Biological process=intracellular protein transport
  Homolog annotation: Hit_ID=Q2QP84; Match level="QueryCoverage=96%, HitCoverage=26%, E-value=2e-63, Identity=55%"; Hit description =Vesicle tethering family protein, putative, expressed
MATTRLQEAILTIPRGITQLMDMLMDREVIRNKALLLLTHLTREAKEIQKIVVFEGAFEKIFSIIREEGNSDGGVVDCLELLNNLLRSNASNQVLLRETVGLDSLILILKLRGSSFTFNQQKKKVLDHLLILGVESQCVPVLVRCAAMRCIGDLIAGDSKNRDLLASKVLGEEPHIEPTLNSILRILLRTSSMQEFIAIDYIFKSFCEVS

SEQ ID NO: 195071 - protein, 55 aa, Glycine max
  Coding DNA Sequence Number=SeqID_78293
MSLNQVPVKRKKARWYDKNIEIMLKVCIEEDTGLGWDGEKKTITASDEWWEAKIQ

SEQ ID NO: 195072 - protein, 35 aa, Glycine max
  Coding DNA Sequence Number=SeqID_78294
MSTSSRRLGSSSPEFHFLHPTAVILLPGTMFVIIT

SEQ ID NO: 195073 - protein, 107 aa, Glycine max
  Coding DNA Sequence Number=SeqID_78295
MQTSMQCTLTQQSNGDFSLLASITNPNRNIDVRFELFDVELFFSDRIISTLHSALYSGRREGRTGAQWNRVKYSVRGNIKVIKVRVSVGFFHLSYLLVVAQEMPDRD

SEQ ID NO: 195074 - protein, 367 aa, Glycine max
  Coding DNA Sequence Number=SeqID_78296
  Gene Ontology: Mol. function=DNA binding; Cellular component=nucleus
  Homolog annotation: Hit_ID=Q8S8Z9; Match level="QueryCoverage=25%, HitCoverage=39%, E-value=9e-14, Identity=45%"; Hit description =Syringolide-induced protein 1-3-1B
  Pfam annotation: Domain name=Myb_DNA-binding; Domain location=143 -190; Score=22.4; E_value=0.0017; Accession=PF00249.21; Description =Myb-like DNA-binding domain
MSDYYFDEEEILELLKENDWPVFDDLFNNFATQDSSPPADEILPANEDSSPPADDEILPAHEVLDAPAPLPVPPPAPAPNRVHTSATALDPAPQMVLASQDPTKPSEETLSSSHPHHLLQHNMDPSHVILSGDSSHSVHHKKYEHWTIEEHKSFLFGLEIKKEKGWKQISDKYVPSKTASQVASHAQNYVKRKNSPMKERKRRSIHDTILEDIDIIRIDQHNWVPPTSNFIVQPHTLGSNWVPSTSNLMVQSHSTVTDQHNWIPPCAPNFAVPPRIPHVDQNNWVSPPSNLAVQSCTAHIDQYTWVPPPPNFAVQPPTPHIDQHNWVPSPANLAPHTSLIDQDNWVPTPPDFAVQPHEMQRAQHMQM

SEQ ID NO: 195075 - protein, 63 aa, Glycine max
  Coding DNA Sequence Number=SeqID_78297
MEELFKRWNEYLDSTRSRETTKSTQRAFQSAEIQVGELAEKVTQFMVRSEKDFVEVEAQEENP

SEQ ID NO: 195076 - protein, 68 aa, Glycine max
  Coding DNA Sequence Number=SeqID_78298
MRGYRMVIRTFRQPGANEPVDALRLTSSSAPFVILTHEVRNGKSDDMRGYCMVIRTFCQPGANEPVDA

SEQ ID NO: 195077 - protein, 254 aa, Glycine max
  Coding DNA Sequence Number=SeqID_78299
  Gene Ontology: Mol. function=RNA-directed DNA polymerase activity; Cellular component=chromatin; Biological process=chromatin assembly or disassembly
MVSAHSVDLVAAKAQAITQWPIIESQRALRDFLGLSKFYRLFIRGYATIRTPRTSLLAKDNFIWSDEAQIAFNSLKDAITTSQVLLLPNFELTFILEIDAFSIGMGIVLSQQGHPISFFNNPFSSKLYHASTYVRELFVITAAVKKWRQYLLGHPFTILTNHKSLKELKTQVVQTPEQQMYLAPFVAQYVKFCDMPEIKRKHCYTIREISMFLQKAVASGGSNLARLGELGGKHLPYFPINMGRSEGERGSALL

SEQ ID NO: 195078 - protein, 161 aa, Glycine max
  Coding DNA Sequence Number=SeqID_78300
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=99%, HitCoverage=52%, E-value=8e-25, Identity=51%"; Hit description=E3 ubiquitin ligase PUB14
TCPKTQQTLVHTALTPNYVLKSLIALWCESNDIELPKRQRNCRTKKYGGSCLSKDAATALIKLLCEDEALAIMAILASHHEGRVAIGQAKPIHILVEVIRTGSPRNRENVAAAVLWSLCTEDPLQLKLAKEHGAEEAQQELSENGTDRAKIKAGSILELLQ

SEQ ID NO: 195079 - protein, 266 aa, Glycine max
  Coding DNA Sequence Number=SeqID_78301
  Gene Ontology: Mol. function=exonuclease activity; Biological process= DNA metabolic process
  Homolog annotation: Hit_ID=UPI00005F80F0; Match level="QueryCoverage =99%, HitCoverage=64%, E-value=7e-99, Identity=72%"; Hit description =COG0420: DNA repair exonuclease
RAGESGAQKQQALQEAIAEHYQALYQAACERRDRLGLPLPIVATGHLTTVGVTTSDSVRDIYIGTLDAFPAQAFPPADYIALGHIHRAQNVAKSEHIRYSGSPIPLSFDELGKAKSVFLVDFADGALQQVEALTIPQFQPMQLIKGDLAEIERQLQQFADYAGELPVWLDIEVATQDYLSDIQRRIQLLADELPVEVVLLRRSKEQRRQAIAQQDKETLNELSVNEVFERRLAQEADMPEARQQRMHQLFRQVVEAVQHNPEETQP

SEQ ID NO: 195080 - protein, 66 aa, Glycine max
  Coding DNA Sequence Number=SeqID_78302
MKHGSKLFGGGCMNENAIHGAPKKKARMEDCTRGFSLVNREAWLQTLWWRMHERKRNSWGSEKRRD

SEQ ID NO: 195081 - protein, 332 aa, Glycine max
  Coding DNA Sequence Number=SeqID_78303
  Homolog annotation: Hit_ID=Q0C4S3; Match level="QueryCoverage=58%, HitCoverage=76%, E-value=6e-28, Identity=35%"; Hit description=Abi -like family protein
  Pfam annotation: Domain name=Abi_2; Domain location=132-329; Score =98.9; E_value=1.5e-26; Accession=PF07751.2; Description=Abi-like protein
MPRYLHAPDVAVQLSKVPDMKKRLFIDALWYTGGRLNEILPLTREDLCTGRSADRRPAFLTVRGAAHAQAAKARGGRAQPPARPANEGGTAGLVKKRGIGRRSGWAHFSATTSASMNTLPTLRLSRRVWSFNRLRERELVIKDEHIAENALRFVGYYRLRGYFYPFYRMTEERVPRVHEPKRFLSGTTLGQVIDLYEFDRRLRLIILEQIQKVEVALRTCLSEHMSARYGAHWFMNLAIMRPDYDHQEFFRQIAGAKEVFIQHYRERYSTPVCPPSWMITEVMTFGTWSAMYASIPVSDQRAIARMFSLNSHDVLGSWFHTLSHLRNLLRAS

SEQ ID NO: 195082 - protein, 36 aa, Glycine max
  Coding DNA Sequence Number=SeqID_78304
MDAESYLAVTPMSLSDITLEVWALFAQFMGCPKRLD

SEQ ID NO: 195083 - protein, 105 aa, Glycine max
  Coding DNA Sequence Number=SeqID_78305
LRLPAIKQQLILQFKAAFHCDKDVIEIPGFYQRQWLPNYPEIVEFKYDGETYEIQDRQHKGKLYFADGLTRLRTELQIYESVTINFLACDHPSKFDLHFTPPLDQ

SEQ ID NO: 195084 - protein, 208 aa, Glycine max
  Coding DNA Sequence Number=SeqID_78306
HRRKTKRCRPLGQDSSKLNSQRKVQSVALRIRKENIELRDVNIATTKALEQETKRARREEHGRNKFRGALWGSNNELKLRREKRDQSWVDSLILKNEWKACLRSKRSLSQRLCETETNMLAIISKYQKELSLATAHEHRVADEYAQVYAEKEARGRVIDSLHQEATMWMDRFALTLNGSQELPRLLAKAKAMADTYSAPEEIHGLLGY

SEQ ID NO: 195085 - protein, 140 aa, Glycine max
  Coding DNA Sequence Number=SeqID_78307
  Gene Ontology: Mol. function=RNA-directed DNA polymerase activity; Biological process=RNA-dependent DNA replication
EFKDVFPKEIPHGLPPSRSIEHQVDLLLEASLPNKPTYNSKPQETQHKDAQVKVEYVKRLYDQVKVQIAKKNESYTKQANKKRKEVVLEPGDDPGHLRANVFQEGRNDENPEIGQMQAKGPSGEGRRPKWRRIKPPSGEG

SEQ ID NO: 195086 - protein, 72 aa, Glycine max
  Coding DNA Sequence Number=SeqID_78308
  Subcellular localization annotation: CTP_CleavageSite=52; ConfidenceScore=5.22e-01
MTLPLSNILPSNHNADLPLRKYQLGSRPQDTQWTRRSPTGPWGFQLGLQAFVSSTKRSLPPARSFGPPLTGL

SEQ ID NO: 195087 - protein, 67 aa, Glycine max
  Coding DNA Sequence Number=SeqID_78309
MVINQNLLKTKKKNTESRRDEDENIQSKNGPLRVHRMNSKLQNRKLTSRRTMNDEEWTKNSEEHSRI

SEQ ID NO: 195088 - protein, 126 aa, Glycine max
  Coding DNA Sequence Number=SeqID_78310
  Gene Ontology: Mol. function=nucleic acid binding; Cellular component= intracellular
MGENIRKLEYGVVNVVEPGNKYLTHCSMRGLCKETTKENPQQIYDGNNNEDHPSFHESKFETNQQTQTLADEAPADTTNSMSSSTCEDPPPPLSEWLEDTFIDLYLFGYKNIQEHGLDGDEYVRMF

SEQ ID NO: 195089 - protein, 86 aa, Glycine max
  Coding DNA Sequence Number=SeqID_78311
MTQKTINQTCKYRDVVIQDICKCIYGNALPFNLLRSPLFVQMLKSVGEYGRGLKPPLIMSTFKGAKGLFGLEMAITARDKKQPALL

SEQ ID NO: 195090 - protein, 99 aa, Glycine max
  Coding DNA Sequence Number=SeqID_78312
MVSVRSEAMDIIPSSRQQSHSSGSTFQQGNIDSLEENDGYCSKKVDGLDRATTLSDGEICGGSNSKVNKDVGKLDTEVLVKDTPSTGNGSSLKSKYVRV

SEQ ID NO: 195091 - protein, 164 aa, Glycine max
  Coding DNA Sequence Number=SeqID_78313
  Homolog annotation: Hit_ID=Q8LLR1; Match level="QueryCoverage=47%, HitCoverage=32%, E-value=5e-31, Identity=79%"; Hit description=MADS -box protein 3
  Pfam annotation: Domain name=K-box; Domain location=12-87; Score =44.6; E_value=3.4e-10; Accession=PF01486.8; Description=K-box region
MVELTTKTIEQYHRSSFTPQDEHVECETQSWYQEVSKLKAKYDSLQRTQRHLLGEDVGPLNIKELQNLEKQLEGSSAQPRQRKCLGGSCLGFGGIPTPARIWEGVDCIVGFFALSGIQVFGWMLMMLGPTSSKAASGTTYALLPKYVLCGTTYVLLPKYVPVSQ

SEQ ID NO: 195092 - protein, 178 aa, Glycine max
  Coding DNA Sequence Number=SeqID_78314
  Gene Ontology: Mol. function=amidase activity; Cellular component =cytosol; Biological process=translation
  Homolog annotation: Hit_ID=Q1SF95; Match level="QueryCoverage=86%, HitCoverage=29%, E-value=2e-44, Identity=57%"; Hit description =Amidase
MLIILLTISSCLSYTVSAQQIRIREATISDTKAAFKEKILTSRELVQFYLDEITRHNPHLNGVIDVKLDALYDTEKADHEHERNSTAALLALHGIPVLLKGNMGTQGKLNTTAGSYALLGSVVRGDALVVTNLKDAGAIILGKSTMSEWGYFRSSTAPNAWSARGGLGRMYIVRAFMI

SEQ ID NO: 195093 - protein, 73 aa, Glycine max
  Coding DNA Sequence Number=SeqID_78315
TPQQHWDGRQRETDAPPSPLEFTSAHPQKGLSIAYTHGRPVGDQVQSQRMHLVAHDPGDLNKTSASSKGRKIP

SEQ ID NO: 195094 - protein, 41 aa, Glycine max
  Coding DNA Sequence Number=SeqID_78316
MSIKKGLGGKIARELDDTRESKRQTAQNPLLVKAEQDQYNW

SEQ ID NO: 195095 - protein, 67 aa, Glycine max
  Coding DNA Sequence Number=SeqID_78317
RPNQKSLVAALFPLPEDSEVIVTQLLHDAFLVLAVLVDGTMVDGVRNVLAYNRREYKYRGRMSVVEK

SEQ ID NO: 195096 - protein, 153 aa, Glycine max
  Coding DNA Sequence Number=SeqID_78318
  Homolog annotation: Hit_ID=Q47522; Match level="QueryCoverage=38%, HitCoverage=79%, E-value=2e-20, Identity=75%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPVIHTSAMLEPLASAATNVDMLRHAVDTCQKTAESLECMIGMRMATARTEAYTLTEHYLRLARGVTEQ

SEQ ID NO: 195097 - protein, 108 aa, Glycine max
  Coding DNA Sequence Number=SeqID_78319
  Gene Ontology: Mol. function=ATPase activity
  Homolog annotation: Hit_ID=Q1SCH7; Match level="QueryCoverage=72%, HitCoverage=8%, E-value=8e-11, Identity=49%"; Hit description=ABC transporter, putative
MIGLTKPTPGIAFVQAWVYAHSMSKLEFPPIYMVLLSLLWESLIGREHLLFYTRLKSLKGSALTHYLWHTSGRLSVFEGKGTMEKLKLKRTMENGIDKTEDKDRTSDK

SEQ ID NO: 195098 - protein, 331 aa, Glycine max
  Coding DNA Sequence Number=SeqID_78320
  Gene Ontology: Mol. function=protein binding; Cellular component =ubiquitin ligase complex; Biological process=cell cycle
  Homolog annotation: Hit_ID=Q10CD7; Match level="QueryCoverage=85%, HitCoverage=31%, E-value=1e-136, Identity=87%"; Hit description =Cullin-4B, putative, expressed
  Pfam annotation: Domain name=Cullin; Domain location=31-233; Score =134.6; E_value=2.7e-37; Accession=PF00888.12; Description=Cullin family
MADGGRPKFRHINTPLRLMAGLSSQIAHVSWQNIRHAIPPMRCHGRYDIELSKEINESFKQSSQARTKLPSGIEMSVHVLTTGYWPTYPPMDVRLPHELNVYQDIFKEFYLSKYSGRRLMWQNSLGHCVLKAEFPKGKKELAVSLFQSILCCTHVSVINSACLIVLQTVVLMLFNDAEKLSFQDIKDSTGIEGKELRRTLQSLACGKVRVLQKLPKGRDVEDDDSFVFNEGFTAPLYRIKVNAIQLKETVEENTSTTERVFQDRQYQVDAAIVRIMKTRKVLSHTLLITELFQQLKFPIKPADLKKRIESLIDREYLERDKNNPQIYNYLA

SEQ ID NO: 195099 - protein, 61 aa, Glycine max
  Coding DNA Sequence Number=SeqID_78321
MTTVLYKVENIGEGTYDVVYKGIRILVWGEVVSSLSENPAAAEARAMLEKFNRKFEEAYRK

SEQ ID NO: 195100 - protein, 316 aa, Glycine max
  Coding DNA Sequence Number=SeqID_78322
  Gene Ontology: Mol. function=protein binding; Cellular component =membrane; Biological process=red or far red light signaling pathway
  Homolog annotation: Hit_ID=Q69NY4; Match level="QueryCoverage=100%, HitCoverage=78%, E-value=1e-120, Identity=63%"; Hit description =Kelch repeat containing F-box protein family-like
  Pfam annotation: Domain name=F-box; Domain location=51-98; Score =39.2; E_value=1.5e-08; Accession=PF00646.23; Description=F-box domain
  Pfam annotation: Domain name=Kelch_1; Domain location=146-193; Score =24.5; E_value=0.00038; Accession=PF01344.15; Description=Kelch motif
  Pfam annotation: Domain name=Kelch_1; Domain location=195-241; Score =51.1; E_value=3.8e-12; Accession=PF01344.15; Description=Kelch motif
  Pfam annotation: Domain name=Kelch_1; Domain location=243-289; Score =6.9; E_value=0.64; Accession=PF01344.15; Description=Kelch motif
  Pfam annotation: Domain name=Kelch_2; Domain location=142-193; Score =8.5; E_value=2.9; Accession=PF07646.5; Description=Kelch motif
  Pfam annotation: Domain name=Kelch_2; Domain location=195-241; Score =18.0; E_value=0.035; Accession=PF07646.5; Description=Kelch motif
  Pfam annotation: Domain name=Kelch_2; Domain location=243-289; Score =0.6; E_value=32; Accession=PF07646.5; Description=Kelch motif
  Pfam module annotation: Pfam domain module=F-box::Kelch_1::Kelch _1::Kelch_1::Kelch_2::Kelch_2::Kelch_2; Domain location=51-98::146 -193::195-241::243-289::142-193::195-241::243-289
  Subcellular localization annotation: CTP_CleavageSite=28; ConfidenceScore=5.01e-01
MQRVRFSSQQAPVHKLGDPQMTLSPKFRLAVIQSSLANPSPELELSLREEPLIPGLPDDVALNCLLRLPVQSHSSCRAVCKRWHMLLGNKERFFTNRKQFGLKDPWLFVFAYHKCTGKIKWQVLDLTHFSWHTIPAMPCKDKVCPHGFRCVSIPCDGTLFVCGGMVSDVDCPLDLVLKYEMQKNRWTVMNRMITARSFFASGVIDGMIYVAGGNSTDLYELDSAEVLDPLNGSWRPIANMGTNMASYDAAVLNGKLLVTEGWLWPFYVSPRGQVYDPRTNNWENMAVGLREGWTGSSVVVYGHLFVVSELERMKLK

SEQ ID NO: 195101 - protein, 57 aa, Glycine max
  Coding DNA Sequence Number=SeqID_78323
MVKSVVQNEMQQSNELKARRMHVDKNFASSVPRNHEVSNKQLSRIRLQQECLTEFNR

SEQ ID NO: 195102 - protein, 273 aa, Glycine max
  Coding DNA Sequence Number=SeqID_78324
  Homolog annotation: Hit_ID=Q01GW9; Match level="QueryCoverage=71%, HitCoverage=73%, E-value=2e-40, Identity=43%"; Hit description =Homology to unknown gene
  Pfam annotation: Domain name=DUF1365; Domain location=50-260; Score =232.5; E_value=9e-67; Accession=PF07103.2; Description=Protein of unknown function (DUF1365)
  Subcellular localization annotation: CTP_CleavageSite=37; ConfidenceScore=5.31e-01
MEIFYLLCSIVSTSLTSLFLSLVLTFHALLRRRNSSRAASSFSNIEAEPISLYEGTVWHQRRHPVNHSFQYRVRYALIDLDRAPREPHDHLSPDKARQITDTNGPILLLTIPPSVGYEQNPLSVYYCYAVEGSTKWLKKCIAEVTNTPWGERVSFLFNPHSDLVAKALHVSPFMDMLGSWNIKANDPGENLTISISVHHPEHGNYFAASLKARKLCSSPESDHAVFFWLMPHKVAVWIYWQLKFTETSSLHSEVALCTEQKWGLGTKLLTMTL

SEQ ID NO: 195103 - protein, 171 aa, Glycine max
  Coding DNA Sequence Number=SeqID_78325
YQGSVWRKGQRPWKIKANGLSFIDILTLLIFGGVLFPNMEGLVDLAAIDAFLAFHHGKETPVVAILAMYDTPVYPLQGHRSCVEKGKANWDQLLASMEGRLLIGSLARRKEESGFYLHAKDECHQTKASRLSSHGVSVTTTRGYSKEFARHGMRREERTESLGGSSNGIIG

SEQ ID NO: 195104 - protein, 374 aa, Glycine max
  Coding DNA Sequence Number=SeqID_78326
  Gene Ontology: Mol. function=protein binding; Cellular component =anchored to membrane; Biological process=protein amino acid phosphorylation
  Homolog annotation: Hit_ID=Q1SBD8; Match level="QueryCoverage=89%, HitCoverage=71%, E-value=4e-39, Identity=34%"; Hit description =Unnamed protein product; contains similarity to elicitor-inducible receptor EIR gene_id:T5M7.12
  Pfam annotation: Domain name=LRRNT_2; Domain location=34-73; Score =13.2; E_value=0.036; Accession=PF08263.3; Description=Leucine rich repeat N-terminal domain
  Pfam annotation: Domain name=LRR_1; Domain location=112-137; Score =3.1; E_value=76; Accession=PF00560.23; Description=Leucine Rich Repeat
  Pfam annotation: Domain name=LRR_1; Domain location=139-162; Score =10.6; E_value=3; Accession=PF00560.23; Description=Leucine Rich Repeat
  Pfam annotation: Domain name=LRR_1; Domain location=164-186; Score =17.2; E_value=0.059; Accession=PF00560.23; Description=Leucine Rich Repeat
  Pfam annotation: Domain name=LRR_1; Domain location=188-210; Score =17.7; E_value=0.041; Accession=PF00560.23; Description=Leucine Rich Repeat
  Pfam annotation: Domain name=LRR_1; Domain location=212-234; Score =15.2; E_value=0.24; Accession=PF00560.23; Description=Leucine Rich Repeat
  Pfam annotation: Domain name=LRR_1; Domain location=236-258; Score =14.6; E_value=0.36; Accession=PF00560.23; Description=Leucine Rich Repeat
  Pfam annotation: Domain name=LRR_1; Domain location=260-282; Score =14.3; E_value=0.45; Accession=PF00560.23; Description=Leucine Rich Repeat
  Pfam annotation: Domain name=LRR_1; Domain location=284-306; Score =3.2; E_value=71; Accession=PF00560.23; Description=Leucine Rich Repeat
  Pfam annotation: Domain name=LRR_1; Domain location=308-330; Score =9.3; E_value=5.3; Accession=PF00560.23; Description=Leucine Rich Repeat
  Pfam annotation: Domain name=LRR_1; Domain location=332-354; Score =16.2; E_value=0.12; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1; Domain location =34-73::112-137::139-162::164-186::188-210::212-234::236-258::260 -282::284-306::308-330::332-354
MASFSFHLVVFLLFACEMVGMRSNIVLGEEMVMQEEELLGLFEVMDALVDDPDWSQAHPQPCTDTQWPGIECEVSNDPPVFHVTKIHIGPDILSPPCKSSAYLSESLLKLTYLKTLSIFNCFVASPVNLPSTLFGPFSTLEHLALQSNPTLSGEIPPSLGGVASLRVLSLSQNRFQGNIPRQLGGLVSLEQLDLSYNNFNGQIPKEIGGLKNIAILDLSWNEIEGNLPSSLGQLQLLQKMDLSSNRLTGKIPPDLGKLKRLVLLDLSHNFIGGPIPETLSNLELLEYFLIDDNPIKSEIPLFIGKLSKLKSVSFSGCGLIGSITNSFSSLKNLTALSLDNNSLSGSVPPNLALLPNLDQLNISHNKAEWCSSAP

SEQ ID NO: 195105 - protein, 87 aa, Glycine max
  Coding DNA Sequence Number=SeqID_78327
MESSEGCKEKKAKACCRLWVPKFAIVSMTVLVCMEKGSEMGKDKAVTIKGNAHFQKSLMVNAVYADKYIALIRHDCNKSKVKGGMIN

SEQ ID NO: 195106 - protein, 188 aa, Glycine max
  Coding DNA Sequence Number=SeqID_78328
  Gene Ontology: Mol. function=metal ion transporter activity; Cellular component=membrane; Biological process=metal ion transport
  Homolog annotation: Hit_ID=Q9FXX5; Match level="QueryCoverage=95%, HitCoverage=50%, E-value=9e-12, Identity=31%"; Hit description =Arabidopsis thaliana genomic DNA, chromosome 5, P1 clone:MTH16
RGTCMDTYRRELVQGAINLDKVSLQEHLKLLDIKLLGDDTIGGAIVGSMVVPTENRELKGKEEVPVSVIMNMRLKKIIVVSRREIHLSHIFVVIEQVLQFILDLLNTTGDGFSLIFQDATSSFQTDLEGNKLEGKNLDGVGVGVGVNISLVVVADDPCLELMKEAGDGGFARVEEEELLGGDDGLDVL

SEQ ID NO: 195107 - protein, 63 aa, Glycine max
  Coding DNA Sequence Number=SeqID_78329
  Subcellular localization annotation: CTP_CleavageSite=57; ConfidenceScore=5.69e-01
MMSDAFGLFMCLSHGYQGRRRFSGSAVSRTSTSKATSFSRTTPSNRGASLLSSCHVDCSILAT

SEQ ID NO: 195108 - protein, 180 aa, Glycine max
  Coding DNA Sequence Number=SeqID_78330
  Gene Ontology: Mol. function=calcium ion binding; Cellular component =flagellin-based flagellum; Biological process=ciliary or flagellar motility
  Homolog annotation: Hit_ID=Q9LI84; Match level="QueryCoverage=78%, HitCoverage=88%, E-value=6e-47, Identity=67%"; Hit description =Calmodulin-like protein
  Pfam annotation: Domain name=efhand; Domain location=11-39; Score =7.6; E_value=2; Accession=PF00036.22; Description=EF hand
  Pfam annotation: Domain name=efhand; Domain location=122-150; Score =38.4; E_value=2.4e-08; Accession=PF00036.22; Description=EF hand
  Pfam annotation: Domain name=efhand; Domain location=47-75; Score =24.3; E_value=0.00043; Accession=PF00036.22; Description=EF hand
  Pfam annotation: Domain name=efhand; Domain location=86-114; Score =29.9; E_value=8.7e-06; Accession=PF00036.22; Description=EF hand
  Pfam module annotation: Pfam domain module=efhand::efhand::efhand::efh and; Domain location=11-39::122-150::47-75::86-114
MSKLQVNKLNQLREICATFYMDSDGSLTILELAALLRSIGLNPSGDEIHALLANMDSNGNGFVEFDELVDAILHDISAEILLKQEMLFGVFKCFDRDGNGYITAAELAGAMAKMGQPVTYRELTEMITEADTDGDGVISFNEFVTVMASRYGYSSFSLVDRLRWMIFKFHQTKINMFPVC

SEQ ID NO: 195109 - protein, 264 aa, Glycine max
  Coding DNA Sequence Number=SeqID_78331
  Gene Ontology: Mol. function=serine-type endopeptidase activity; Cellular component=chloroplast; Biological process=proteolysis
  Homolog annotation: Hit_ID=Q9SEL7; Match level="QueryCoverage=87%, HitCoverage=86%, E-value=4e-80, Identity=58%"; Hit description =Protease Do-like 5, chloroplast precursor
  Pfam annotation: Domain name=Trypsin; Domain location=71-250; Score= -13.9; E_value=7e-05; Accession=PF00089.16; Description=Trypsin
  Subcellular localization annotation: CTP_CleavageSite=32; ConfidenceScore=5.66e-01
MALFSLQNNLFPLPMLTTPSSTKSFPSVTTCRATIFGSSLVLLYSTPLTLAQQLPNYDELQQQEDHLVQLFQGVMLNEDEDAKVEGTGSGFIWDKFDHIVTNYHVVAKLATDTRGLQRCKVFLVDAKGNSFDREGTIIGFDPAYDLAVLKVDVDGYEVKPVVLGQSNNLRVGQSCFAIGNPYGYENTLTTGVVSGLGREIPSPNGGAIRGAIQTDAAINAVNTATFTKKGTGISSGVNFAIPIDTVVRTVPYLIVHGTPYSNRF

SEQ ID NO: 195110 - protein, 220 aa, Glycine max
  Coding DNA Sequence Number=SeqID_78332
  Gene Ontology: Mol. function=transferase activity, transferring glycosyl groups; Cellular component=integral to membrane; Biological process=GPI anchor biosynthetic process
  Homolog annotation: Hit_ID=Q6ASS8; Match level="QueryCoverage=93%, HitCoverage=86%, E-value=2e-31, Identity=39%"; Hit description =Phosphatidylinositol N-acetylglucosaminyltransferase subunit, putative
  Pfam annotation: Domain name=PIG-P; Domain location=45-216; Score =106.6; E_value=7.3e-29; Accession=PF08510.2; Description=PIG-P
MESPHSQNSPRRTLSLSKKRRATASCFDPDEISSGFGLSGDHGPKPSEVYGFVGSITTVVATVIFLVWAYVPESWLQSVGISYYPSSNYLSALNKLRKLLKSELLSEVGLLGKGLSVVGSTSSFRDLNNEKYMKKEFEAGYWALAVPTYVMVTIVLMLGFYIGLNFISTPSPASLNTVFDEFSRDPLSLECTLEDEKPIEPISDIGIDRINDIMFKNNAA

SEQ ID NO: 195111 - protein, 84 aa, Glycine max
  Coding DNA Sequence Number=SeqID_78333
GVVFEVFPRGGSFGRKTHAWPKQTASGTGGFAVDEGLATANGDMHMQAEELGTWNGDMHTARGTASLTGEFPPRRLRAIGVRPC

SEQ ID NO: 195112 - protein, 149 aa, Glycine max
  Coding DNA Sequence Number=SeqID_78334
MASRKCKSIGARPTAQYDTRRFHSLDAWNRYTDNVLGKNILPERKVEVYHTEFDNFKTKLERRNLHKRLTNLADGTIDLALVKEFYANLYSSEVLEEGESLPTYSRYCRLPTNYREIEAALCIPGRGFILNAEGHPGRILKKDLTTLAQ

SEQ ID NO: 195113 - protein, 180 aa, Glycine max
  Coding DNA Sequence Number=SeqID_78335
GSKIGATLWQELFTELRDKLQCGSSYLVQNLRIIDNQSEYRVSPAPYLVYFLKTTSVKEIHRPKIPSNVYLITPFTDIISGLAPRHTLVVTIWEDYAIQLHDAIDKNLLLQEPLVVMLTLGKIKDATDKYPLSVHNIKFGSKLYVNADITEIHEFRQSLSVPFYSGGMINDKDGSQSQSS

SEQ ID NO: 195114 - protein, 74 aa, Glycine max
  Coding DNA Sequence Number=SeqID_78336
MGAKDSSFLNRCRLPPQVPEMVWQQGHKPWWRLYSIGTIWSELCMEVSKGAGVGVGGGGAGAERAEEEVSGPQS

SEQ ID NO: 195115 - protein, 241 aa, Glycine max
  Coding DNA Sequence Number=SeqID_78337
  Gene Ontology: Mol. function=helicase activity; Biological process =viral genome replication
  Homolog annotation: Hit_ID=Q1SN45; Match level="QueryCoverage=100%, HitCoverage=14%, E-value=3e-46, Identity=41%"; Hit description=AAA ATPase
MFTFTSPGIKFDKSYNAGKEPPTFRIHGQTHHLIGSLLPMPNNPPKFAQLYIYDTDNEIINRLSQNPLIIIAIKDMLDHHNHYAQRFRMARDKLHSAAVPDLKMKLISQRQTDRRLYNLPTTTEVAALIVGDEHSADKRDIIIEKQSGLLKRIHELHHAYLPLQYPLLYPKGEDGYRLNIPHKDHANIHAAKRKQVTLREYFSYRLQSRTDEAQTILHSRRLFQQWIVDGYCMVESQKLNY

SEQ ID NO: 195116 - protein, 194 aa, Glycine max
  Coding DNA Sequence Number=SeqID_78338
  Homolog annotation: Hit_ID=Q8P5A3; Match level="QueryCoverage=42%, HitCoverage=23%, E-value=5e-14, Identity=51%"; Hit description =Oxidoreductase
HMLARSQCRDCQRRMLFIRRGDHYGIHGWIVEHLLRRGTHVHVAERAQQRVALRAHDAVQHQARRVLDQGRMEDAAGKAVADQGQMQRHACSTPTCPDWQHIPQEYDTMSNTTRTLIASALTLALALSSSAAFAKDPAAKSPPKTDHSAMTHADRHDLNEPVTDSWITTKVKADLLASRKVPGTEIKVETVNGV

SEQ ID NO: 195117 - protein, 96 aa, Glycine max
  Coding DNA Sequence Number=SeqID_78339
  Homolog annotation: Hit_ID=Q6Z5L0; Match level="QueryCoverage=57%, HitCoverage=10%, E-value=7e-12, Identity=62%"; Hit description =Glucose-6-phosphate/phosphate-tranlocator-like
MVKTEGLDPSIYKQNSGSITSFDAEIKNLSPDSPSSLEIDGKALEDLRASLFNQFRSSEGAKCQQQCIYGPGIALSFNFLVAVGTIFMNKMVLQTV

SEQ ID NO: 195118 - protein, 80 aa, Glycine max
  Coding DNA Sequence Number=SeqID_78340
MEEVNMENLSFEAKEDLVMTMRKIEDVQNLSLCLVGRFLTERAIYVPIMKERMAEVWQPLRGVSIRDMGVITFLFQFSHL

SEQ ID NO: 195119 - protein, 320 aa, Glycine max
  Coding DNA Sequence Number=SeqID_78341
  Homolog annotation: Hit_ID=Q1RTB4; Match level="QueryCoverage=52%, HitCoverage=39%, E-value=1e-13, Identity=32%"; Hit description=IMP dehydrogenase/GMP reductase
MGSNQAPLFKKRFYQVKIKSLEVASLQELGQLMDQLQRQAFRKTYGKIWDLAMIEVSIEAIAALTQDLGIPARGKKATSFSEFYPSMARIAKAKALVDQGEWASFIDVLALLIFGVVLFPNMDGLVDLAAIDAFLAYHHGKEVRSLLFWSMPMTLSTEDAKGVVTACAPRKGRQTVSNSWLGFSNVPLMGTRGCINYNPILAIRQLVYPMRGASSEESIMPFITQGFSDPNARILRGIRKAWSAVQKKDKELRESRNGIIDGYHKWLKARTLELDWLPKLKVSSEVEAETPEDSEEVQALKVELERAQAVKEKFKTTAIK

SEQ ID NO: 195120 - protein, 110 aa, Glycine max
  Coding DNA Sequence Number=SeqID_78342
MEAMKDQMAPMMEAMLSMKKIMEVNAAADATTGVATEVDPTHPSSLNQNKHSFPPYGLPPNYTPPMLHTFLMRMSITPISYSLRANNPNLVRHRSLNPWGRHMSHPKTTI

SEQ ID NO: 195121 - protein, 81 aa, Glycine max
  Coding DNA Sequence Number=SeqID_78343
MGDANSKFEILNWAFQTVFQRWIASGGSNPVRLGELGGNLLPLFPIKRQNGVVLRVPDSPGYAFQLFWVKKIVFEKKIQAE

SEQ ID NO: 195122 - protein, 224 aa, Glycine max
  Coding DNA Sequence Number=SeqID_78344
SEFLIEGYVGARALLLSTTPPFAVMTQELTKFGHSAPLCHPEAAGPMTRRDKIWSFCTLVSSRGGGPDDTRRYLTAASPMTRRDTLWLSAPFCHPEAVGPMKRRDKIWSFCTLVSSRGGGPDDTRRYLTVIHTLLSSRGGGPDDTRRQNLVIPHPFAIQTQSCPMARRDKNWSFCTLVSSKGGGPDDTRRYLTVIRTLLSSRGGGPDDTQRQNLVILHPCVIQR

SEQ ID NO: 195123 - protein, 362 aa, Glycine max
  Coding DNA Sequence Number=SeqID_78345
  Gene Ontology: Mol. function=translation initiation factor activity; Cellular component=eukaryotic translation initiation factor 2B complex; Biological process=cellular metabolic process
  Homolog annotation: Hit_ID=Q9SPU4; Match level="QueryCoverage=97%, HitCoverage=82%, E-value=1e-132, Identity=70%"; Hit description =Putative translation initiation factor 2B beta subunit
  Pfam annotation: Domain name=IF-2B; Domain location=47-336; Score =164.9; E_value=2e-46; Accession=PF01008.8; Description=Initiation factor 2 subunit family
LAVGNIVRRVLHIIREEDLSLATAAMDGLGVSAASDDEDDAERDENPVLSAAAVAAAARSTLRPPSLQTLLEDTSDSAAAPPTSSSGGESDGRSRSVEKGSRGRKLKHDVIEAVNELIQDISTCYEQIAEQAVEHIHHNEVILTLGSSKTVLEFLYAAKEKQRSFKVFVAEGAPRYQGHLLAKELAARGLQTTVITDSAVFAMISRVNMVIVGAHAVMANGGVIAPVGLNMAALAAQRHAVPFVVLAGSHKLNCTPIVCCLSISIECNLCPLYPHNPEVLLNELRSPSELLDFGEFSDCMDSASGAGSLHVVNPTFDYVPPKLVSLFITDTGGHNPSYMYRLIADYYSADDLVVKRRPTTGS

SEQ ID NO: 195124 - protein, 81 aa, Glycine max
  Coding DNA Sequence Number=SeqID_78346
  Subcellular localization annotation: CTP_CleavageSite=75; ConfidenceScore=5.16e-01
MSIGFNDEICAISGENKLSLAHQWAKRASTAKRSFNTLSAIEESDRTSSSRSRAKRKISALSVAVVFSQAQCTTRAKLKST

SEQ ID NO: 195125 - protein, 326 aa, Glycine max
  Coding DNA Sequence Number=SeqID_78347
  Gene Ontology: Mol. function=ATPase activity, coupled to transmembrane movement of substances; Cellular component=integral to membrane; Biological process=transport
  Homolog annotation: Hit_ID=Q9C8G9; Match level="QueryCoverage=93%, HitCoverage=17%, E-value=1e-121, Identity=68%"; Hit description =Multidrug resistance-associated protein 1
MEEDKMSRKAESSVLYFYISEVVGQVLFGILLLVYVPTLDPYPGYTPIGTEMITDATYDELPGGDMICPERSANILSRIMFSWMNPIMKLGYERPLTEKDIWKLDTWERTETLINKFQKCWVEESRKSKPWLLRALNASLGGRFWWGGFCKIGNDISQFMGPLILNQLLQSMQNGEPSWTGYVYAFSIFVGVVFGVLCEAQYFQNVMRVGYRLRSTLVVKELLDSIILNHLVSAGVAVQVAAVFRKSLRLTHEARKQFATGKITNLMTTDAEALQQICQSLHTLWSAPVRIVVAMVLLYQQLGVASLLGALMLVLMFPLQICSQEG

SEQ ID NO: 195126 - protein, 1014 aa, Glycine max
  Coding DNA Sequence Number=SeqID_78348
  Gene Ontology: Mol. function=ATPase activity, coupled to transmembrane movement of substances; Cellular component=integral to membrane; Biological process=transport
  Homolog annotation: Hit_ID=Q42093; Match level="QueryCoverage=99%, HitCoverage=61%, E-value=0.0, Identity=71%"; Hit description =Multidrug resistance-associated protein 2
  Pfam annotation: Domain name=ABC_membrane; Domain location=355-627; Score=84.4; E_value=3.5e-22; Accession=PF00664.13; Description=ABC transporter transmembrane region
  Pfam annotation: Domain name=ABC_tran; Domain location=63-253; Score =71.0; E_value=3.9e-18; Accession=PF00005.17; Description=ABC transporter
  Pfam annotation: Domain name=ABC_tran; Domain location=703-883; Score= 152.7; E_value=9.9e-43; Accession=PF00005.17; Description=ABC transporter
  Pfam annotation: Domain name=MMR_HSR1; Domain location=704-793; Score= -13.0; E_value=0.016; Accession=PF01926.13; Description=GTPase of unknown function
  Pfam annotation: Domain name=SMC_N; Domain location=692-887; Score= -113.8; E_value=0.0027; Accession=PF02463.9; Description=RecFRecNSMC N terminal domain
  Pfam module annotation: Pfam domain module=ABC_membrane::ABC _tran::ABC_tran::MMR_HSR1::SMC_N; Domain location=355-627::63 -253::703-883::704-793::692-887
VVNANVSLKRLEDLLLAEERVLLPNPPIEPGLPAISIKNGYFSWDAKAERASLSNINLDIPVGCLVAVVGSTGEGKTSLVSAMLGELPPMADSSVVLRGTVAYVPQVSWIFNATVRDNILFGSVFDPARYQRAINVTELQHDLELLPGGDLTEIGERGVNISGGQKQRVSMARAVYSNSDVYIFDDPLSALDAHVARQCSNSKVICYGIVFGHLRASPGAAAAYNIPPSYLRIAKSLRAMGYEVNRIILVHEGMVKEEGTFEELSNHGPLFQKLMENAGKMEEYEEEEKVDTETTDQKPSSKPVANGAINDHAKSGSKPKEGKSVLIKQEERATGVVSLNVLTRYKSALGGFWVVFVLFACYVSTETLRISSSTWLSHWTDQSATEGYNPVFYNMIYAALSFGQVLVTLTNSYWLIISSLYAARRLHEAMLSSILRAPMVFFQTNPLGRVINRFAKDLGDIDRNVAPFVNMFLGQVSQLLSTFILIGIVSTMSLWAILPLLVLFYVAYLYYQSTAREVKRLDSISRSPVYAQFGEALNGLSTIRAYKAYDRMADINGKSMDNNIRFTLVNMSGNRWLAIRLETLGGLMIWLTATFAVMQNGRAENQQEFASTMGLLLSYALNITSLLTGVLRLASLAENSLNAVERIGTYIDLPSEAPSVIDNNRPPPGWPSLGSIRFEDVVLRYRPELPPVLHGLSFTIFPSDKVGIVGRTGAGKSSMLNALFRIVELEQGRILIDDYDVAKFGLADLRKVLGIIPQSPVLFSGTVRFNLDPFNEHNDADLWEALERAHLKDVIRRNSLGLDAEAGENFSVGQRQLLSLSRALLRRSKILVLDEATAAVDVRTDALIQKTIREEFKSCTMLIIAHRLNTIIDCDRILLLDGGKVLEYDTPEELLSNEGSAFSKMVQSTGAANSQYLRSLALGGDKSEREENKHLDARRKWLASSRWAAAAQFALAVSLTSSHNDLQRLEVEDENSILKKTKDALITLQGVLERKHDKEIEESLEQRQISPDGW

SEQ ID NO: 195127 - protein, 107 aa, Glycine max
  Coding DNA Sequence Number=SeqID_78349
MQGYVARTMTLLGGSSSLLGIGMWGLLLAAFPLALQNPWKAESAWFAQFAKSWYRTRLASGSGYSQNQSQEIELDVHKEKMCAETEGMDPIEVVADGWLCGENAMGR

SEQ ID NO: 195128 - protein, 89 aa, Glycine max
  Coding DNA Sequence Number=SeqID_78350
MALRARVALSEWTIEKFSKSFMSISSPRLRNPLFTTKQVEKLITITSNYPNYMQAILNEKEKRERKVGLPPNKRSFNVTSLMHHPVILA

SEQ ID NO: 195129 - protein, 522 aa, Glycine max
  Coding DNA Sequence Number=SeqID_78351
  Gene Ontology: Mol. function=protein dimerization activity; Cellular component=nucleus; Biological process=regulation of transcription, DNA-dependent
  Homolog annotation: Hit_ID=Q52MZ2; Match level="QueryCoverage=84%, HitCoverage=86%, E-value=1e-178, Identity=71%"; Hit description =TGA10 transcription factor
  Pfam annotation: Domain name=bZIP_1; Domain location=233-286; Score =17.2; E_value=0.002; Accession=PF00170.11; Description=bZIP transcription factor
  Pfam annotation: Domain name=bZIP_2; Domain location=233-283; Score =20.4; E_value=0.0065; Accession=PF07716.5; Description=Basic region leucine zipper
  Pfam module annotation: Pfam domain module=bZIP_1::bZIP_2; Domain location=233-286::233-283
MGFSIAVDKLEEEAQQQQQEQETKSLGSSLNIVMASSSVKSNTNSTTQLEPFLPPLHLHHQQQPPQHHFHHHQIPDQQISFGMMPSSSLASIPGNFLSKDSGAYDLGELDQAFFLYLEGQADPSSVQDQKQNSSSGMRPPPTLNIFPSQPMHAVPPSNSKVNMGLPSTQTSTGSKRQPESSMAKPNPHTEAPSAPEPPKAVKREGNRKGTTSSSEQEAPKTPDPKLNNVLVSKWCAKTLRRLAQNREAARKSRLRKKAYVQQLESSRIKLNQIEQELQRSRAQGILMGGNTLLGGEQGFPMAMSGISSEAAMFDVEYARWLEEHHRIVCELRAALQEHLHENELRLYVDNCLAHYDQVMSLKSMVAKIDVFHLVFGMWKTPAERCFMWIGGFRPSELIKPLTEQQILGICGLQQSTQEAEEALSQGLDALNQSLSETITSDSLWCPPNMNNYMGQMVVAMNKLSTLESFVRQADNLRHQTIHRLHQLLTTRQAARCLVAISEYFHRLRALSSLWSTHPRQDQ

SEQ ID NO: 195130 - protein, 75 aa, Glycine max
  Coding DNA Sequence Number=SeqID_78352
MLLKKGSLNEEDWLSKAQPLSEEVSSLSEYKTLENVEPKSSKLSAQPARLARTLSLLTLSAYLWLDYPFICFVRF

SEQ ID NO: 195131 - protein, 59 aa, Glycine max
  Coding DNA Sequence Number=SeqID_78353
MDIPQHPTTAVAMDEAPADAPTHVEQPQHVVKTCEAIVERLEQLFNLRIVIKGLSWKTA

SEQ ID NO: 195132 - protein, 205 aa, Glycine max
  Coding DNA Sequence Number=SeqID_78354
  Gene Ontology: Mol. function=protein binding; Biological process =protein modification process
  Homolog annotation: Hit_ID=Q1S0J6; Match level="QueryCoverage=85%, HitCoverage=46%, E-value=1e-32, Identity=41%"; Hit description =Ubiquitin; Apoptosis regulator Bcl-2 protein, BAG
MTGEVKKVLSGETGLEVDEQRLLYRGKERENGEYLDVCGVKDRSKVVLIQDPSSIERRFIQMRINAKIQTAHRAINNVAVQLDQLADQDSRMDRNKDLCFAFDYEYSRIEVSAIEKSISNGVKVPEVQITTLIEMLMRQAIKLESISAEGDASAQKNLQGKRVQKCVEKLDQLKVSNARIKPVVVTTKWETFDHPPSSTTWELFD

SEQ ID NO: 195133 - protein, 985 aa, Glycine max
  Coding DNA Sequence Number=SeqID_78355
  Gene Ontology: Mol. function=zinc ion binding; Cellular component =intracellular; Biological process=DNA repair
  Homolog annotation: Hit_ID=Q019Z0; Match level="QueryCoverage=29%, HitCoverage=46%, E-value=2e-21, Identity=28%"; Hit description=[K] KOG1084 Transcription factor TCF20
  Pfam annotation: Domain name=BRCT; Domain location=754-835; Score =45.0; E_value=2.6e-10; Accession=PF00533.16; Description=BRCA1 C Terminus (BRCT) domain
  Pfam annotation: Domain name=BRCT; Domain location=869-975; Score =22.4; E_value=0.0017; Accession=PF00533.16; Description=BRCA1 C Terminus (BRCT) domain
  Pfam annotation: Domain name=zf-C3HC4; Domain location=13-50; Score =30.5; E_value=5.8e-06; Accession=PF00097.15; Description=Zinc finger, C3HC4 type (RING finger)
  Pfam annotation: Domain name=zf-MIZ; Domain location=9-53; Score=0.7; E_value=0.00096; Accession=PF02891.10; Description=MIZ zinc finger
  Pfam module annotation: Pfam domain module=BRCT::BRCT::zf-C3HC4::zf -MIZ; Domain location=754-835::869-975::13-50::9-53
MGDLERMARELICPICWSLLDSAVSLTCNHLFCNSCVFKSMKSASACPVCKIPFTRREVRPAPHMDNLVSIYKNMEAASGVNIFETQNAPVTNLSDGEKQCEVDANSGKMEAGGTHTGRPREKKTRKKKESKKTVQASMESSGSDFAKPSFPAKKRVQVPQNLLSETPMKSLKIGVSLSEINKEKEGTEKVPVMESERPLQREKDNPVLSPFFWLREEKDGERLSQQTDDDEIIDGSTPNPPSFSDLKDSDDEIPSNVAPMDEVQNKGSVNLFDSEMFEWTQRPCTPELFSSPSKMQVMDTYEDDENQEELVASSLELAENQPRVDAGNMKFDNPKEGNIMADVLPPSVSPQIRSSDDLNGMKKSTKRRRKGRDKNKQEHIGEPKNSIDEMHVDSYISLEVTQEQALDKSSNPRKDSRRDKRVCFNTSTIPTPITACTVPNTLGVQSIGEMKKAKNTDISPLKQENEKHHAQEISGKSRMKRSGKQNVSQTNEFAGSDSSIFSLQTDNNGKDSNSRQCKSKYSRKSMSCSKELKATKRQKLSSDCISKTKNVEEILPIESIHQGPDVRDLNDTSKEKHCPLMDQTALRKCESHVTKYQCIFCLSSEESETSGPMVHYLDGRPVTADYEGGSKVTHCHRNCTEWAPNVYFDGDNAINLEAEISRSRRIKCSFCGLKGAALGCYEKSCRRSFHVPCANWTSQCRWDTQNFVMLCPLHASSMLPCEGSGSQKRSKKCAASEGKNHGLKHDTTNQSRAAHRSYKKIVLCCSALSVQEREVVSEFERVSKAAVLKNWDSSVTHVIASTDENGACRRTLKVLLGILEGKWILNIEWIKACMKEMGPVDEERYEINVDIHGIRDGPRLGRLRVLNKQPKLFYGYKFYVMGDFIPSYKGYLQDLLVAAGGIILHRKPVSGDQESTSPDTHPYQTLIIYSLELPDKCKPLKKDTICSQRRHDAEVLASSTGSKVASNTWILNSIAACKLKCLAQ

SEQ ID NO: 195134 - protein, 389 aa, Glycine max
  Coding DNA Sequence Number=SeqID_78356
  Homolog annotation: Hit_ID=Q1RW53; Match level="QueryCoverage=76%, HitCoverage=73%, E-value=9e-10, Identity=21%"; Hit description =Cyclin-like F-box; F-box protein interaction domain
MAFCPDELLLFKICSYLPAKAIYRFKCTCKTVSNIVEETEFATKQTENSLKKDDTCFFLRHETPQTYDEKVELYPLPGKQLSSGVSEDVLRFLSKSSTRMLASTKGLILLCLTTSNTYTPAVELFICNPATKSWSNIPSPIQVQEKQLYADPKMVLLEECSTGYMIIHFEVQTDWSADYPCNIYKSKEGLWKAMKRSFYAGGRNMKFEMPVYLNGAIHFISDCFPYLTERSPFYRPYIMSYNLESCLSTMLRVPEDATHDLSCDCEMSIFSWGKAQSMSICLVRLRKSVVTVWILTDYESHTWFRILEVATQEMGLREEDPKITGFTVINGDLLILATETRVYSYGLTDDGNCMRVEEICQHRFASKVCFTSYSDILRLCGPGATCLPC

SEQ ID NO: 195135 - protein, 520 aa, Glycine max
  Coding DNA Sequence Number=SeqID_78357
  Gene Ontology: Mol. function=metal ion binding; Cellular component =intracellular; Biological process=protein kinase C activation
  Homolog annotation: Hit_ID=Q6ZLQ1; Match level="QueryCoverage=87%, HitCoverage=91%, E-value=1e-121, Identity=45%"; Hit description =Putative pentatricopeptide (PPR) repeat-containing protein
  Pfam annotation: Domain name=PPR; Domain location=113-147; Score =13.6; E_value=0.18; Accession=PF01535.11; Description=PPR repeat
  Pfam annotation: Domain name=PPR; Domain location=178-212; Score =46.6; E_value=8.3e-11; Accession=PF01535.11; Description=PPR repeat
  Pfam annotation: Domain name=PPR; Domain location=213-247; Score =14.4; E_value=0.14; Accession=PF01535.11; Description=PPR repeat
  Pfam annotation: Domain name=PPR; Domain location=249-283; Score =10.2; E_value=0.46; Accession=PF01535.11; Description=PPR repeat
  Pfam annotation: Domain name=PPR; Domain location=43-77; Score=31.3; E_value=3.4e-06; Accession=PF01535.11; Description=PPR repeat
  Pfam module annotation: Pfam domain module=PPR::PPR::PPR::PPR::PPR; Domain location=113-147::178-212::213-247::249-283::43-77
  Subcellular localization annotation: CTP_CleavageSite=50; ConfidenceScore=5.03e-01
MGKHLIFTIVSLSAPMSYAYNVFTWVLSYAYNVFTMIHNPNVFTWNTMTRGYAESDNPSPALRFYRQMIVSRIEPDTHTYPFLLKAISKSLNVREGEAIHSVTIRNGFESLVFVQNSLLHIYAACGDTESAHNVFELMRDRDLGVEPDGFTVVSLLSASAELGALELGRRVHVERNAVSWTSLIVGLAVNGFGEEALELFREMEGQGLVPSEITFVGVLYACSHCGMLDEGFDYFRRMKEEFGIMPRIEHYGCMVDLLSRAGLVKQAYEYIQNMPVQPNAVTWRTLLGACTIHGHLGLGETARSHLLKLEPKHSGDYVLLSNLYTSECRWADVQLIRRSMLKDGVKKTSGYSLVELGNRVYEFTMGNRSHPQSQDVYALLEKITELLKLEGYVPHTANVLADIEEEEKEQALSYHNCHMAIKLMAKVYDREIVIRDRGRFHHFRGGSCSCKDYWPYGNHQDLKWHLESQLLLDPIRKELNNDPSNNRWPDVEVQALITENFIGTQVSSNGIKRVNMGGDI

SEQ ID NO: 195136 - protein, 296 aa, Glycine max
  Coding DNA Sequence Number=SeqID_78358
  Homolog annotation: Hit_ID=UPI0000E47346; Match level="QueryCoverage =86%, HitCoverage=13%, E-value=8e-09, Identity=24%"; Hit description =PREDICTED: similar to Golgi-associated microtubule-binding protein isoform 3, partial
MDHARAYSSPHFLSSSTSNFNGQPEEECSLEGLATNVKLLLKLIQDHNGSSTKENDERKFHRVNGMMFILDEARSRIQKIQSTSQRRAELRRCNTDLRPKIPSPKDRKPPSDVPIDEKERLKRELNASLVARQSLQAMCSSLGKEKQIMAAELARKAQELTELEDFIGDLKAQNDMLMEKLHAWSSEQKEKKGSGVEMECNIVLRERNKALSEQLQKSIDGYRSLKRRLRDIQEENRQIRDTVEQMEEEVDAGIHRIGSFKEGRMRTNEIKEEISAMEHMLDSLKMKISKYTQKKT

SEQ ID NO: 195137 - protein, 209 aa, Glycine max
  Coding DNA Sequence Number=SeqID_78359
  Gene Ontology: Mol. function=protein binding; Biological process =ubiquitin cycle
  Homolog annotation: Hit_ID=Q9SY41; Match level="QueryCoverage=74%, HitCoverage=70%, E-value=5e-37, Identity=52%"; Hit description =Putative nodulin
  Pfam annotation: Domain name=LRR_1; Domain location=116-133; Score =1.0; E_value=1.9e+02; Accession=PF00560.23; Description=Leucine Rich Repeat
  Pfam annotation: Domain name=LRR_1; Domain location=7-34; Score=10.1; E_value=3.8; Accession=PF00560.23; Description=Leucine Rich Repeat
  Pfam annotation: Domain name=LRR_1; Domain location=91-114; Score =5.8; E_value=24; Accession=PF00560.23; Description=Leucine Rich Repeat
  Pfam module annotation: Pfam domain module=LRR_1::LRR_1::LRR_1; Domain location=116-133::7-34::91-114
MFFITSNLRSLRLACCYQISDEGLCEIAKELPQLEELDISISSFNPTRDPLEAVGRCCRHLKTLKFNMKGYRRPHIECDEEAFAIAETMPTLHHLQLFGNKLTNEGLLAILDGCPHLESLDLRQCFNVNLAGSLGKRCAEQIKELRLPCDPTDDCPFEADVDYGSLDEDSSAISDIDFLSDDDYDYYEFSGGSDFSDYDFDSDPDYYGL

SEQ ID NO: 195138 - protein, 360 aa, Glycine max
  Coding DNA Sequence Number=SeqID_78360
MSGSTRRVELVLKNRFLSYLIWQSIHSSLIFISLLSFSSPHYPFLSFLLFLPSHLLFSTTLSFIASPHPRPRFTLSLLFAFSAAFSASLSLSSVAPAAHGLPGVSRLGFRGFLVGSLFGSHYVFKRRWVLHFPIIQRPPFFSFKMGVPSSARRALKLSIVASVFSGILLELLPHPFKYSVATGRFFTEQITSLAATFTIFFSWELTHHLHWVLHTKRSIFAPPKGSAAAETNPSEHLLSALEESSPTSLLRYLAYLDLCMVCENNVDTWRRAGFFEETGETYKRVIAVCLKPLEHLATKLGEGLGNPVDKATQLSNQLLSPTDARPDLKHIEELHNFQAPKPHLVLVLTTNSCLEDEAYY

SEQ ID NO: 195139 - protein, 305 aa, Glycine max
  Coding DNA Sequence Number=SeqID_78361
  Gene Ontology: Mol. function=ferric iron binding; Cellular component =extracellular region; Biological process=iron ion homeostasis
  Homolog annotation: Hit_ID=UPI00006A0333; Match level="QueryCoverage =83%, HitCoverage=84%, E-value=2e-30, Identity=35%"; Hit description =Melanotransferrin precursor (Melanoma-associated antigen p97) (CD228 antigen).
  Pfam annotation: Domain name=Transferrin; Domain location=1-285; Score=-29.4; E_value=5.1e-13; Accession=PF00405.8; Description =Transferrin
MESIKKGEADLVNLEAGLAYNAFINHSMKAIANEMYYDHSKTYKAVAVVNRRACENNEKITLMDFKGHKSCHGGYSTAAGWNYPINYIKNLINNEELSDREIATSFFSSVCAPSEVEGFDICNACSKENETCPEKGLYSGHSGAFRCLVEELGDIAFVKGDTVLLYSMEGPHSQLWSSKSVRDFMYLCPQGGCREINGYPGDCSFGAVPANVIMAHNSMPNKKREHILETLTNSSLVDALYAPNNVSIIHLFSPSTQGLAMIEKVTRPYLGKSASISQSILRLNAPETRVASYEADNGSGFNNEK

SEQ ID NO: 195140 - protein, 106 aa, Glycine max
  Coding DNA Sequence Number=SeqID_78362
MGGTLLMVGGSGGCAGATFIGQGGFEQLRDEIEEKVNENDAVLSVVGGIELGEVKKVIGEGHDFVVIGEVDMEGEGVAAQEVHVKSVGSRVEAALQDHAGGEEGEG

SEQ ID NO: 195141 - protein, 206 aa, Glycine max
  Coding DNA Sequence Number=SeqID_78363
  Gene Ontology: Biological process=protein modification process
  Homolog annotation: Hit_ID=Q9FGZ9; Match level="QueryCoverage=35%, HitCoverage=100%, E-value=4e-35, Identity=97%"; Hit description =Ubiquitin-like protein 5
MEGQCLSKVYKLDVEDMQKHSTPMRKNLQKKIQNINMICPCCGEEEESIEHCFLTCPEVQSIWFASRVKDDKYENGQGGGGHKQIWRPPTQEEAIKINVEEGFSPKVAEALSARWVVQLALDLCFDRVVRVTKMIEVVLNDRLGKKVRVKCNDDDTIGDLKKLVAAQTGTRADKIRIQKWYTIYKDHITLKDYEIHDGMGLELYYN

SEQ ID NO: 195142 - protein, 91 aa, Glycine max
  Coding DNA Sequence Number=SeqID_78364
MCSQKYWFVTYEKQSGGNVLLESGSHASNGSSDIPLWHLCLGHMSEKGLDIISKRGLHRNHKKLKSLLGSEFEMKDIRTAEKIMGMEIKRD

SEQ ID NO: 195143 - protein, 817 aa, Glycine max
  Coding DNA Sequence Number=SeqID_78365
  Gene Ontology: Cellular component=membrane; Biological process=Golgi to plasma membrane transport
  Homolog annotation: Hit_ID=Q6ZLQ0; Match level="QueryCoverage=88%, HitCoverage=99%, E-value=0.0, Identity=52%"; Hit description =Putative ERD4 protein
  Pfam annotation: Domain name=DUF221; Domain location=290-707; Score =265.2; E_value=1.3e-76; Accession=PF02714.6; Description=Domain of unknown function DUF221
MDFTSFLTSLGTSFVIFLVLMIVFAFLSSRPGNNVVYYPNRILKGLDPLEGGYKSRNPFSWIKEALTSSERDVIAMSGVDTAVYFVFLTTVLSILVLSGVILLPVLLPLSVTDHGMKTQTTSNGTFSELDKLSMANITAKSSRLWGFFIACYWVSIVTFALLWRAYKHVSWLRAEALKSPDVKPEQFAIVVRDIPHVPQGQTRKEQVDSYFRDIYPETFYRSMIVTDNKVVNKIWESLEKYTKKLARAEAVYAGSKTTAKPEGTRPTNKTGFLGLVGKKVDTIEYCNEKINELEARLESEQKVTLREKQQDAAVVFFSSRVVAASASQSLHAQMVDTWSVFDAPEPNQLIWPNLKIKYFQRELRQYLVYFIVALTIFFYMIPITFISALTTLDNLVKYLPFIKPIVNIKALKTVLEAYLPQLALIIFLALLPKLLLFLSKFEGIPTESHAVRAASGKYFYFTVLNVFIGVTIGGTLFKAFKRIREHPTLDEISSLLAESLPGNATFFLTYVALKFFIGYGLELSRIVPLIIYHLKRKYLCKTEAELKEAWRPGDLGYGTRVPGDMLIVTIVFCYSVIAPVIIPFGALYFGLGWLVLRNQALKVYVPTFESYGRMWPHIHNRILASLILYQITMFGYFGTQKFYYTPLVLPLPILSLVFGFVCAKKFYPAFQHPALEVAANTLKEVPNMELIFGAYIPPSLRSEKIDGDRVEDALSQASRTTPEFVVGLTTFWHVLSQQPGPKWEGKLEAIKVGKQLLQGCITITLGGNCTPVFAPAEVSSGPAKLWSAPYNINICGSKRLHFSRKGDLLPPYHQYQY

SEQ ID NO: 195144 - protein, 205 aa, Glycine max
  Coding DNA Sequence Number=SeqID_78366
MASIHANVVPYLSFNHFQTPPSSCLVGSGIVQHGVSLSNYRRKVPCIKCEKKDDEEIQHVSVERPPYYSYLDSTSGQLEPASGARASILGQEYWPEGTASRMRAARAPAPTAESSTSPMSPSYGAKPGSRRKNYKTTPVTEQERLERDGPIAYYSEWVNAWKRDTSGKAILKHFEETGEDETTQLIEMFCHGTDREYRILIGTDV

SEQ ID NO: 195145 - protein, 330 aa, Glycine max
  Coding DNA Sequence Number=SeqID_78367
  Gene Ontology: Mol. function=signal transducer activity; Cellular component=membrane; Biological process=response to light stimulus
  Homolog annotation: Hit_ID=Q1SGZ1; Match level="QueryCoverage=99%, HitCoverage=64%, E-value=1e-132, Identity=67%"; Hit description =BTB/POZ; NPH3
  Pfam annotation: Domain name=NPH3; Domain location=87-330; Score =81.7; E_value=2.3e-21; Accession=PF03000.5; Description=NPH3 family
MDQVVLCNFMMFLVEPKIFEDITRFCYGVKLEITSLNVVSLRCAAEYLQMTENYGEGNLVAQTEAFLNEIFSNWPDSIKALETCEEVQLFAEDLHIVSRCIDSLAMKACSDPNLFNWPVPGRNCKQNQADHHAMWNGISSEKPSQRDGWCFTDTSHATIPNTSEADQRALLEEIVELLPNKRWVTSSKHLLRLLRTAMILSASLSCKENLEKRVGAKLDQATLVDLLIPNMGYSVATLYDIDCIQRILDHIMSIYQPASVSATPCIFEQGALIAGADALTPMTMVANLVDGYLAEVVSDTNLNLTKFQALDDGIYHAIDVYLKVRSFWIS

SEQ ID NO: 195146 - protein, 518 aa, Glycine max
  Coding DNA Sequence Number=SeqID_78368
  Gene Ontology: Mol. function=galactosyltransferase activity; Cellular component=membrane; Biological process=protein amino acid glycosylation
  Homolog annotation: Hit_ID=Q1SGZ2; Match level="QueryCoverage=92%, HitCoverage=70%, E-value=0.0, Identity=80%"; Hit description =Glycosyl transferase, family 31; Arginase/agmatinase/formiminoglutama se; Concanavalin A-like lectin/glucanase
  Pfam annotation: Domain name=Gal-bind_lectin; Domain location=195 -408; Score=145.7; E_value=1.3e-40; Accession=PF00337.12; Description= Galactoside-binding lectin
MKRLKTEPPSSRRFRLSHFLFGVGVLYLVFISCNFSQFMKVVSSLSGDETYNGIGSDKVATIGDAEDADLSKPFVSSVYKDAFHWRLVDGRDQDAPLRPKEEPMKEEDHGPESMKQISDGYGRITGEILRQRNRTGDLSVLERMADEAWTLGLKAWKELEQAGEKEVGESSIIEGRTESCPSWISMSRADLLKGDGLMFIPCGLAAGSSITVVGTPHYAHKEYAPMLARSRKGDGLALVSVSQFVVELQGLKSVEGEDPPKILHLNPRLRGDWSKRPVIEHNTCYRMHWGTAQRCDGLPSENAEEMLVDGYRRCEKWMRNDIVDSKESKTTSWFKRFIGRKQKPEVTWPFPFAEGRMFVLTLRAGVDGYHINVGGRHMTSFPYRTGFTLEDATGLVVKGDLDVHSVFATSLPTSHPSFSPQRVLEMSETWKASALPKHAVKLFIGVLSASNHFAERMAVRKTWMQAAAVKSSDVVVRFFVALGVTLSRDQSLLGYSTSYQEFHRTAFMEKRNTSFLGY

SEQ ID NO: 195147 - protein, 706 aa, Glycine max
  Coding DNA Sequence Number=SeqID_78369
  Gene Ontology: Mol. function=protein kinase activity; Cellular component=plastoglobule; Biological process=protein amino acid phosphorylation
  Homolog annotation: Hit_ID=UPI00006983A7; Match level="QueryCoverage =66%, HitCoverage=68%, E-value=6e-77, Identity=36%"; Hit description =possible protein kinase: ABC1 family protein
  Pfam annotation: Domain name=ABC1; Domain location=106-223; Score =151.3; E_value=2.5e-42; Accession=PF03109.7; Description=ABC1 family
  Pfam annotation: Domain name=APH; Domain location=120-361; Score= -6.3; E_value=0.016; Accession=PF01636.13; Description=Phosphotransfer ase enzyme family
  Pfam module annotation: Pfam domain module=ABC1::APH; Domain location= 106-223::120-361
MGLKLFQDAFCFLKCILIELYFILEGFRKFLRLIPEEDVDDASSQYNFGMVLKETLLNLGPTFIKVGQSLSTRPDIIGVEMSKALSELHDQIPPFPRTVAMKIMEEEFGCPLESFFSYISEEPMAAASFGQVYFARTTDGNNVAVKVQRPNLHHVVVRDIYILRLGLGLLQKIAKRKSDPRLYADELGKGFVGELDYTLEAANASKFLEVHSSFTFMNVPKVFPHLTRKRVLTMEWMVGESPTDLLSVTAGNSVGNVSGYSERQKLDAKRRLLDLVSKGVESTLVQLLETGLLHADPHPGNLRYTSSGQIGFLDFGLLCQMEKRHQFAMLASIIHIVNGDWASLVRALVDMDVVRPGTNIRLVTLELEQALGEVEFKEGIPDVKFSRVLGKIWTVALKHHFRMPPYYTLVLRSLASLEGLAIAADTNFKTFEAAYPYVVRKLLTENSAATRNILHSVLLNQRKEFQWQRLSLFLRVGATRKALRLVASNSETSLDHSTNKATDTIDVAYLVLRLLPSKDGVAIRRLLMTADGASLIKAMVSKEGKFFRQQLCKIIVDLLYQWMIKLFGQGITVTQYSRVVLANGPSNKESGLSPRSSLPTYDYNSIFRDRRLRVIFSKVLKSASRDKILMLRFSWASLLIIITASTLACHQLVVSLSEAYLGKIFDAPKRYAVSLKLGVLDLEQIWCQAVYVWGNTVRGTDAAINI

SEQ ID NO: 195148 - protein, 138 aa, Glycine max
  Coding DNA Sequence Number=SeqID_78370
MQSQMQSHKLVLPPELEVGPSAAHVSTKGSYVDPSGQNPDMDDSKKCGLYFDENPPCLVTLGRVYEGSITVHDIPLGNDQVKVGVEEVRDANARIPVPTQEGPEGLSKLVDRLDHDVDPLYLMTLAILQPFLKPLQVS

SEQ ID NO: 195149 - protein, 90 aa, Glycine max
  Coding DNA Sequence Number=SeqID_78371
  Subcellular localization annotation: CTP_CleavageSite=27; ConfidenceScore=5.07e-01
MVPNFYMLGSKVLSDKASLLAHQWAKRASTAKRSFSALSEKEESGKALASRPHAKCEISALSAADLKQMIGTDSRAYHSAYFGKRALEAA

SEQ ID NO: 195150 - protein, 73 aa, Glycine max
  Coding DNA Sequence Number=SeqID_78372
MHVGVEGVTVHVDPTIGKVDGPHRKKLRTYLGIFAQDRVDITFANWKKAPTTQKDLIWEDIQPKLLNLDPSSD

SEQ ID NO: 195151 - protein, 172 aa, Glycine max
  Coding DNA Sequence Number=SeqID_78373
  Gene Ontology: Mol. function=calmodulin binding; Cellular component =integral to membrane; Biological process=cell death
  Homolog annotation: Hit_ID=Q56BA4; Match level="QueryCoverage=94%, HitCoverage=29%, E-value=5e-46, Identity=58%"; Hit description=MLO1
MGVLTQVLCSYVTLPLYALVTQMGSTMKPTIFNENVATALMNWHHSARNHIKHNKGSTSNTPFSSRPGTPTHGMSPVHLLHKHPRHSDSPIVSPMAYNYENEQWGVEGIHSPNHHARDHDHDHGETMQMQQPTAPTADLPPSGLNPIRTQHEINIALSEFSFGRGHHTGSNN

SEQ ID NO: 195152 - protein, 146 aa, Glycine max
  Coding DNA Sequence Number=SeqID_78374
WGGDPVYPTVNYIQDPNEVIDYRGPDFHEPMPNMVAYLKEQGKLTSREEFDKIMAKEKTEQIEDEEDSDVDEGEGEEEKLSDYWSVLKSTPELCKSKIFLLSGISYYWDDYQSEPKPKKEGPLSLDEAMAESENLTDFLMDFEEEE

SEQ ID NO: 195153 - protein, 147 aa, Glycine max
  Coding DNA Sequence Number=SeqID_78375
MRRKETIQRHESDINSEVAVLVMREFQHRERLQMRVRKRLSESGSQKGFKVRELEGFQPQAIIIKDLTTSGAILHVNCMQAPSKPPVKLASSLAVKKPPSPLAISPCMGEPPVKLASLWQERAEKARLVVGLRHGGAGERCKDAAGT

SEQ ID NO: 195154 - protein, 49 aa, Glycine max
  Coding DNA Sequence Number=SeqID_78376
MSRDFMGQDDKGAEDDKMMLVSPCYQTLSLRDCERVFIRITNWVSPPVT

SEQ ID NO: 195155 - protein, 142 aa, Glycine max
  Coding DNA Sequence Number=SeqID_78377
  Subcellular localization annotation: CTP_CleavageSite=88; ConfidenceScore=5.14e-01
TASTRRPVGPKKSNRALGFPALVTSLCQSYRVPVPPARTCHRDIGITPTKTPSGPGEVQQGPGVSSSRIAPARYPVDSKKSNRVLELSSSNYWSLSPPARASGPLLIELSSRSTASPGRRTAKHHSSLGMASSGQQTHRHHL

SEQ ID NO: 195156 - protein, 106 aa, Glycine max
  Coding DNA Sequence Number=SeqID_78378
  Subcellular localization annotation: CTP_CleavageSite=76; ConfidenceScore=5.56e-01
MATTSSSVAQGNSPTSQVDVCKKEKNLKGKSCCLAKPGPESSMSSRAQRVISSFNEKIVSSALSARMALSQISLTRAKRENGAKRENGAKRAFKDKRPFLSLNYEE

SEQ ID NO: 195157 - protein, 99 aa, Glycine max
  Coding DNA Sequence Number=SeqID_78379
MEITKSLVSNNNNKKNKCTASRLVGPDGVGLLVLPRKVELKDDSSLLVASYHPLPAAFTKSLPNLGYCHIASQRYNDRGSSGWRGSNSMRQLDQDRKSD

SEQ ID NO: 195158 - protein, 980 aa, Glycine max
  Coding DNA Sequence Number=SeqID_78380
  Gene Ontology: Mol. function=ribonuclease P activity; Biological process=tRNA 5'-leader removal
  Homolog annotation: Hit_ID=Q2QZQ0; Match level="QueryCoverage=86%, HitCoverage=98%, E-value=1e-137, Identity=37%"; Hit description =Ribonucleases P/MRP protein subunit POP1 containing protein, expressed
  Pfam annotation: Domain name=Chromo; Domain location=877-926; Score =20.4; E_value=0.0038; Accession=PF00385.14; Description='chromo' (CHRromatin Organisation MOdifier
  Pfam annotation: Domain name=POP1; Domain location=28-186; Score =198.2; E_value=1.9e-56; Accession=PF06978.2; Description =Ribonucleases PMRP protein subunit PO
  Pfam annotation: Domain name=POPLD; Domain location=521-606; Score =23.9; E_value=1.4e-07; Accession=PF08170.2; Description=POPLD (NUC188) domain
  Pfam module annotation: Pfam domain module=Chromo::POP1::POPLD; Domain location=877-926::28-186::521-606
MVTDGTKKPQVSVPTPPPPPRKINVQKYAESRALELQSLQSIIENRVNSDYRSQRNKRRRTTAFDNQIARKGCRRKRQKLGIIDKALAESGLEENHLKKLPRCVRRRYELKKNPENGFCTSGDGTKRLRTHVWHAKRFAMTKLWGYHLPLCLQGRGKGSRALLKRLKQGVLVHDASYYTAVQLEGPEDSLMSVLRMVLEPYPATTPHPGNHDDSVLYSVTYGKAMLHQCGAPVSQPIAPVTYMWQPSSQQNMSTELDGRNHCTSFGQHDIGNDSNKHGVELSEKSGKMKHGSSFRCLWVWIHASAFEEGYDNLKIACQKEGQLAKLELIGLGTFQLLQKVLHGVGSISENYWQLKKHVPIEEESVSQIRNSSILRNEDYFSSCAMLSLNVKDPRELPWKKTVVPVESISTKTPSDAQEKKYKELAELGGILEENRDLSSLSRSKLVDSQFDIDDLWYATTRGLRPPVEDSVLSKEKHHERMVNFCLDDIDSGEANSSTKVQCSRSCPILLLKNDMKELIIGWSVILPLSWVKAFWIPLISNGAHAIGLQEKHWISCEMGLPFFPSDSPDCKAYSCLMEAKAAAFNKKEELRPPVIRHLRVPILPPWGIVRITFDKVINAMETHDLSTREDLTNANSLPNPCHGNFEIFNSDSGSNSFDGTVVRTGCMLTTFLNETKTGQLLLFPYAADGKARISKFINGELKLDPRHRSSDIYDHKLCFVRVHLRPFKEGCFEEGAVICAPYPSDISLWTSSCEKREEGLQMSQSAMRLYFKEHSSGKWGMQIPDDSIASKSQRWPIGFVTTASVQGSKSLVAEGFCEAVLLSHLREEQWKEMPMKKRREIYVLVRNLGSTAYRLALASIVLENQENDIDFFSGTLITPLAIIDTCWDIIKFGQRLVVLVQWKGLHLDDTSWEDWKTLKDTYYLENKVLFKGLVDDRPKDTDLEDTRSRTIRRTNPVSERLCLKQVANSVKGIMCWPARI

SEQ ID NO: 195159 - protein, 134 aa, Glycine max
  Coding DNA Sequence Number=SeqID_78381
MKKKETKRRKQVGEDGRDESRFQDGRRLQKKTRGAPTEENRNLLHAVTQFGFSSSSLFRKQNPTFFFMNPNSLFPFQISITFLIQSLSPRQSLHLPRKSSEILAEMRASSGFAYLGKGVGCRAPGSCLNNLTQK

SEQ ID NO: 195160 - protein, 102 aa, Glycine max
  Coding DNA Sequence Number=SeqID_78382
  Gene Ontology: Mol. function=hydrolase activity, hydrolyzing O -glycosyl compounds; Cellular component=cell wall; Biological process= carbohydrate metabolic process
  Homolog annotation: Hit_ID=Q8L9A9; Match level="QueryCoverage=63%, HitCoverage=22%, E-value=1e-29, Identity=83%"; Hit description =Probable xyloglucan endotransglucosylase/hydrolase protein 8 precursor
  Pfam annotation: Domain name=Glyco_hydro_16; Domain location=1-102; Score=-53.4; E_value=0.0013; Accession=PF00722.11; Description =Glycosyl hydrolases family 16
MVLQHHPRESIQTLTHIPAHQQRELFNCREGATIPLEENGAGPKRDELDFEFLGNKTGEPYLTETNVYKNGTGGREMRHMLWFDPTEDYHTYSILWNNHQVV

SEQ ID NO: 195161 - protein, 297 aa, Glycine max
  Coding DNA Sequence Number=SeqID_78383
  Gene Ontology: Mol. function=nucleic acid binding; Cellular component= chromatin; Biological process=DNA integration
  Homolog annotation: Hit_ID=Q1SIQ0; Match level="QueryCoverage=70%, HitCoverage=57%, E-value=8e-41, Identity=42%"; Hit description=Zinc finger, CCHC-type
MAPITSTTTNELKELMEFNNNFQFPIKLTATNYPSWYKQVHALLIVCDLEGYVTGKIVCPPATIGSGDVTAPNPIYSLWIRQDKLIYLAFLGSCNSEAQFVMVVADTSRDAWVALACAFSNRSQSRIMSIRERLSSITKGTSSVSIHLLSIRNIADELALIGHPIDDLEMVIHTLNSLGPTFREFTASIRTRDSPISFNELYDKLVDFEMYLQCEECLSTPIPVTTNVVQRYQHGQGASHHITNDLTNLTLKDDYHGNDNLQVANGNQLPITHIGSTTIPTNGKGPTNEGASSTRIE

SEQ ID NO: 195162 - protein, 120 aa, Glycine max
  Coding DNA Sequence Number=SeqID_78384
  Gene Ontology: Mol. function=catalytic activity; Biological process =cellular metabolic process
  Homolog annotation: Hit_ID=Q1SW50; Match level="QueryCoverage=99%, HitCoverage=37%, E-value=3e-24, Identity=46%"; Hit description =Lipocalin
MVLNSGWTRRATDEVSSTDVEYCKGRGKWYSMANMEANRVVWVFNSVEVMVVLPTTCLGLLLQLELNTSFVLLQEQMMGSRETQEYHWLGAMHVKEIVKAYVLLYETPVVASRYLCTNDI

SEQ ID NO: 195163 - protein, 834 aa, Glycine max
  Coding DNA Sequence Number=SeqID_78385
  Gene Ontology: Mol. function=transferase activity, transferring glycosyl groups; Cellular component=integral to membrane; Biological process=response to oxidative stress
  Homolog annotation: Hit_ID=Q9FL59; Match level="QueryCoverage=94%, HitCoverage=98%, E-value=0.0, Identity=79%"; Hit description =Anthranilate phosphoribosyltransferase-like protein
  Pfam annotation: Domain name=C2; Domain location=258-340; Score=71.0; E_value=3.9e-18; Accession=PF00168.20; Description=C2 domain
  Pfam annotation: Domain name=C2; Domain location=422-516; Score=87.9; E_value=3.1e-23; Accession=PF00168.20; Description=C2 domain
  Pfam annotation: Domain name=C2; Domain location=95-176; Score=85.3; E_value=1.9e-22; Accession=PF00168.20; Description=C2 domain
  Pfam annotation: Domain name=PRT_C; Domain location=679-834; Score =424.8; E_value=1.2e-124; Accession=PF08372.1; Description=Plant phosphoribosyltransferase C-terminal
  Pfam module annotation: Pfam domain module=C2::C2::C2::PRT_C; Domain location=258-340::422-516::95-176::679-834
VSSRDLGRNIKVFELLVTVIGIASVAFVHDINNGDETASSSQAAAKGNQEDYKLKDTKPELGEKWPHGGQRGGSGWIYSERATSTYDMVEQMFYLYVRVVKAKDLPPNPVTSNVDPYVEVKVGNYKGKTRHFEKKTSPEWKQVFAFSKEKIQSSVVEVFVRDKEMVARDDYIGKVEFDMHEVPTRVPPDSPLAPQWYRLENSRGEARSRGEIMLAVWMGTQADEAFPEAWHSDSASVKGEGVYNIRSKVYVNPKLWYLRVNVIEAQDVEPNDKSQPPQVFVKGQVGQQVLKTKLCPTKTPNPMWNEDLVFVAAEPFEEKLVITVENKASPGKDEVVARISLPLNKFEIRLDHRAVHSHWYNLERFGFGVLEGDKRNETKFSSRIHLRVCLEGAYHVLDESTMYISDTRPTARQLWKQPIGILEVGILSAQGLQSMKKNNAKGSTDAYCVAKYGQKWVRTRTITESFNPKWNEQYTWEVYDPCTVITFGVFDNCHLGGGGGGQNQGAKVDSKIGKVRIRLSTLEMDRIYTNSYPLLVLKTSGLKKMGELQLAIRFTCLSMAHIIYLYGHPLLPKMHYLHPFTVNQLDSLRYQAMNIVAVRLGRAEPPLRKEVVEYMLDVDSHIWSMRRSKANFFRIVSLFSGAISMSRWLGEVQQWKNPVTTILVHVLFFILICYPELILPTFFLYMFLIGIWNFRFRPRHPPHMDTKLSWAEAAHPDELDEEFDTFPTSKAQDVIRMRYDRLRSVAGRIQTVVGDIATQGERFHALLSWRDPRATSLFMFFCLIVAVALYVTPFKVVASIAGIFWLRHPRFRSKLPSVPSNFFKRLPSHADGML

SEQ ID NO: 195164 - protein, 169 aa, Glycine max
  Coding DNA Sequence Number=SeqID_78386
  Gene Ontology: Mol. function=RNA-directed DNA polymerase activity; Biological process=RNA-dependent DNA replication
  Homolog annotation: Hit_ID=Q1RTD3; Match level="QueryCoverage=71%, HitCoverage=19%, E-value=1e-19, Identity=41%"; Hit description=IMP dehydrogenase/GMP reductase
MELVDAPLVGWRFTWVQIGGHAMSRLDRTLISLGWLRLWPNATQFVLDWSISDHCPIILRHEKVEWGPKPFRFFNYYIIEPGFHDFMKRVYDSFQVQEVGVRSLEKFSEHRFRIQDLVKNIHNLKMDGMSLEVALERELLFIFGVCAYLNYLSCARHIGHYRTSNGACE

SEQ ID NO: 195165 - protein, 877 aa, Glycine max
  Coding DNA Sequence Number=SeqID_78387
  Gene Ontology: Mol. function=protein dimerization activity; Cellular component=nucleus; Biological process=regulation of transcription, DNA-dependent
  Homolog annotation: Hit_ID=Q1SGY6; Match level="QueryCoverage=99%, HitCoverage=97%, E-value=0.0, Identity=80%"; Hit description =Transcriptional factor B3; Auxin response factor; Aux/IAA_ARF _dimerisation
  Pfam annotation: Domain name=Auxin_resp; Domain location=238-321; Score=197.7; E_value=2.8e-56; Accession=PF06507.4; Description=Auxin response factor
  Pfam annotation: Domain name=B3; Domain location=114-216; Score=99.8; E_value=8.3e-27; Accession=PF02362.12; Description=B3 DNA binding domain
  Pfam module annotation: Pfam domain module=Auxin_resp::B3; Domain location=238-321::114-216
MAGEKRVLDSELWHACAGPLVSLPAVGSRVVYFPQGHSEQVAVSTNKEVDAHIPNYPSLPPQLICQLHNMTMHADVETDEVYAQMTLQPLNPQEQNEAYLPAELGTASKQPTNYFCKTLTASDTSTHGGFSVPRRAAEKVFPPLDFSQQPPAQELIARDLHGNEWKFRHIFRGQPKRHLLTTGWSVFVSAKRLVAGDSVLNEKNQLLLGIRRANRPQTVMPSSVLSSDSMHLGLLAAAAHAAATNSRFTIFYNPRASPSEFVIPLAKYVKAVYHTRVSVGMRFRMLFETEESSVRRYMGTITGIGDLDPVRWPNSHWRSVKVGWDESTAGERQPRVSLWEIEPLTTFPMYPSSFPLRLKRPWPPGLPSFHGMKDDDFGLNSPLLWLRDTDRGLQSLNFQGIGVNPWMQPRFDPTVLNMQTDMYQAAAAAAVQDMRSLDPSKQLSASLLQFQQPQNFPNRTAALMQAQMLQKSQPQQIFGNNQENQHSPQSQPQTQAHLQQHLQHQHSFNSQHHHHQQQQQQQQVVDNQQISSAVSTMSQLFSAPQPQSPPMQAISSLCQNFSNSNGNSVTTIVSPLHSILGSFPQDETSHLLNLPRTSSWIPIQNSSGWPSKRVAVDPLLSSGASHCVLPQVDQLGQPHSTMSLNAITLPPFPGRESSIDQEGSNDPQNHLLFGVNIDPSSLLMPNGMSSLKGVSGNNNSSTLPYQSSNYLNTTTGTDSSLNHGMTPNIGDSGFLHCPEDAGQGNPLNKTFVKVYKSGSFGRSLDITKFSSYHELRGELARMFGLEGELEDPVRSGWQLVFVDRENDVLLLGDGPWPEFVNSVWCIKILSPQEVQQMGNNGLELLNSVPNQRLSNGICDDYVSRQDPRNLSTGITTV

SEQ ID NO: 195166 - protein, 66 aa, Glycine max
  Coding DNA Sequence Number=SeqID_78388
  Homolog annotation: Hit_ID=Q93WZ2; Match level="QueryCoverage=62%, HitCoverage=4%, E-value=1e-14, Identity=80%"; Hit description =Bacterial-induced lipoxygenase
MRDLRAHIGHIHPDVGQLRILGNTYAYYNDLGDPDKGAQYARPVLGGSIEYPYPRKGRTGRPPKVS

SEQ ID NO: 195167 - protein, 763 aa, Glycine max
  Coding DNA Sequence Number=SeqID_78389
  Gene Ontology: Mol. function=transcriptional elongation regulator activity; Cellular component=mitochondrion; Biological process =regulation of transcription, DNA-dependent
  Homolog annotation: Hit_ID=Q1SGX3; Match level="QueryCoverage=99%, HitCoverage=99%, E-value=0.0, Identity=72%"; Hit description =Tetratricopeptide-like helical
  Pfam annotation: Domain name=PPR; Domain location=201-235; Score =20.7; E_value=0.0053; Accession=PF01535.11; Description=PPR repeat
  Pfam annotation: Domain name=PPR; Domain location=236-270; Score =24.7; E_value=0.00032; Accession=PF01535.11; Description=PPR repeat
  Pfam annotation: Domain name=PPR; Domain location=271-305; Score =31.0; E_value=4.2e-06; Accession=PF01535.11; Description=PPR repeat
  Pfam annotation: Domain name=PPR; Domain location=306-340; Score =42.0; E_value=2e-09; Accession=PF01535.11; Description=PPR repeat
  Pfam annotation: Domain name=PPR; Domain location=382-416; Score =37.7; E_value=4.1e-08; Accession=PF01535.11; Description=PPR repeat
  Pfam annotation: Domain name=PPR; Domain location=417-451; Score =50.1; E_value=7.4e-12; Accession=PF01535.11; Description=PPR repeat
  Pfam annotation: Domain name=PPR; Domain location=452-486; Score =24.0; E_value=0.00053; Accession=PF01535.11; Description=PPR repeat
  Pfam annotation: Domain name=PPR; Domain location=487-521; Score =36.3; E_value=1.1e-07; Accession=PF01535.11; Description=PPR repeat
  Pfam annotation: Domain name=PPR; Domain location=522-556; Score =15.3; E_value=0.11; Accession=PF01535.11; Description=PPR repeat
  Pfam annotation: Domain name=PPR; Domain location=557-591; Score =34.5; E_value=3.7e-07; Accession=PF01535.11; Description=PPR repeat
  Pfam annotation: Domain name=PPR; Domain location=592-626; Score =40.6; E_value=5.3e-09; Accession=PF01535.11; Description=PPR repeat
  Pfam annotation: Domain name=PPR; Domain location=627-660; Score =18.0; E_value=0.034; Accession=PF01535.11; Description=PPR repeat
  Pfam annotation: Domain name=PPR; Domain location=661-694; Score=7.4; E_value=0.98; Accession=PF01535.11; Description=PPR repeat
  Pfam annotation: Domain name=PPR; Domain location=695-729; Score =12.6; E_value=0.24; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=201 -235::236-270::271-305::306-340::382-416::417-451::452-486::487 -521::522-556::557-591::...
  Pfam module annotation: Domain location=592-626::627-660::661 -694::695-729
  Subcellular localization annotation: CTP_CleavageSite=49; ConfidenceScore=5.51e-01
MPLLRFNHYLLGKILASHFHANYFSSVALSLFSATNSVFSASYSTANLRDQTESKCSNFRNINDDLGKVGPGFQESLCFSASVSDGAEEEEGEEGEGSSDDDESLEFITSFHGKNDKQTQSIARVEIGDSEFRHPVVREVCRLITLSSAWNPNFEGRLRHLLRSLKPPLVCAVLRSQADERVALNFFYWADRQWRYSHHPVVYYTMLDVLSKTKLCQGARRVLRLMTRRGIECPPEAFGYVMVSYSRAGKLRNALRVLTLMQKAGVEPSLSICNTTIYVLVKGGKLEKALKFLERMQVTGIKPDIVTYNSLIKGYCDLNRIEDALELIAGLPSKGCPPDKVSYYTVMGFLCKEKKIEEHGHADDALAFLKEAQDKGFHIDKVGYSAIVHSFCQKGRMDEAKSLVIDMYSRGCNPDVVTYTAIVDGFCRLGRIDEAKKILQQMYKHGCKPNTVSYTALLNGLCHSGKSLEAREMINVSEEHWWTPNAITYGAVMHGLRREGKLSEACDLTREMVEKGFFPTPVEINLLIQSLCQNQKVVEAKKYLEECLNKGCAINVVNFTTVIHGFCQIGDMEAALSVLDDMYLSGKHPDAVTYTALFDALGKKGRLDEAAELIVKMLSKGLDPTPVTYRSVIHRYSQWGRVDDMLNLLEKMLKRQPFRTVYNQVIEKLCDFGNLEEAEKLLGKVLRTASKVDANTCHVLMESYLKKGVAISAYKVACRMFRRNLTPDLKLCEKVSKKLVLDGKLVEADNLMLRFVERGIQQK

SEQ ID NO: 195168 - protein, 95 aa, Glycine max
  Coding DNA Sequence Number=SeqID_78390
  Homolog annotation: Hit_ID=P93147; Match level="QueryCoverage=47%, HitCoverage=9%, E-value=2e-15, Identity=82%"; Hit description =Cytochrome P450 81E1
MCFPERKRGRLARTTSFLVKHSWNRVWEEMTTTRRELNHREMTWPYLLERALKDKLYEEKAKNAEERVGQGGEDLHAFLGATGLGLSLVDDHHFL

SEQ ID NO: 195169 - protein, 163 aa, Glycine max
  Coding DNA Sequence Number=SeqID_78391
  Subcellular localization annotation: CTP_CleavageSite=58; ConfidenceScore=5.51e-01
MTNTMVGLRPSLSLSIPLSYSFPSSSPLSLKPHPLLLSPKPHPLLTFANNNNNNNELREQRNTQQQQQQQQQQQQQPPNGSNEQEEKVNDWSNQRRPILGFNWRTLLDPDPDNVLALGLTGILTWASVQVLWQLLFISLAIFVAAIKYSFIAALLVFILIALL

SEQ ID NO: 195170 - protein, 67 aa, Glycine max
  Coding DNA Sequence Number=SeqID_78392
MVTALTSTVDGGVALHGNLLNAPRNLFAASSSSQQQWFVAEYENGELELARGREVGEVSNKIQKWLR

SEQ ID NO: 195171 - protein, 275 aa, Glycine max
  Coding DNA Sequence Number=SeqID_78393
MACSVPFNNKNLDISFFVFKPTIVIIDDLVHGLKAFSLTTESLGCVQSSIFRSIHGNMIIWYGAWQRRSSKEKEELTSTLRTLLGYPLSRLDRTSKTDTTDVVPIFIAEKSMLTSISSMAVLIEHSFLEAYGGESRDGSSTAKFSTGDIISLNSAVTTTNDLNDLCYAVLAILRSRFAKMEGITAGLCFKGQSKPRVVCIHVWKSLHFCYCWILNSDHRKWMMPYLERFSIDMKYDIFRVVYVSGDNVVDLNCISTHQMLENGNESSRQGQVMQN

SEQ ID NO: 195172 - protein, 108 aa, Glycine max
  Coding DNA Sequence Number=SeqID_78394
  Gene Ontology: Mol. function=structural constituent of ribosome; Cellular component=ribonucleoprotein complex; Biological process =translation
  Homolog annotation: Hit_ID=O22860; Match level="QueryCoverage=56%, HitCoverage=89%, E-value=3e-27, Identity=93%"; Hit description=60S ribosomal protein L38
  Pfam annotation: Domain name=Ribosomal_L38e; Domain location=19-86; Score=148.2; E_value=2.2e-41; Accession=PF01781.8; Description =Ribosomal L38e protein family
MCECFEIAVNACVVLSTQPKQIHEIKDFLLTARRKDARSVKIKRSRDVVKFKVRCSKYLYTLCVFDPEKADKLKQSLPPGYKPTIIRYPAVFCDNFWWMEVEELNNSN

SEQ ID NO: 195173 - protein, 166 aa, Glycine max
  Coding DNA Sequence Number=SeqID_78395
  Subcellular localization annotation: CTP_CleavageSite=19; ConfidenceScore=5.27e-01
MASTSALRSSGAKNCSKTRATAIAAAPNATRNCSATEVPVVDGGRSTAIAATVDNYAYDHPYEGLAMAFEKVFVEMKMLYLGGGENYFPRCLVTFQCMWDELLLMVKLGYSRPTMSEMVGMDVLYQKLSSNLSVVVVVSRHVSWKCLVGPQPNVGGYQRWLMGMSL

SEQ ID NO: 195174 - protein, 117 aa, Glycine max
  Coding DNA Sequence Number=SeqID_78396
  Subcellular localization annotation: CTP_CleavageSite=28; ConfidenceScore=5.14e-01
ARALLLSAAHTISVILTLESRGMRRYPSANEPVDTRRFTSSSAQTIFVILTLESRDMRRYPSANEPVDTWRFTSSSAQTIPVILTLESRDMRRYPSGYPFKLSFAISKTQSMIARRD

SEQ ID NO: 195175 - protein, 189 aa, Glycine max
  Coding DNA Sequence Number=SeqID_78397
  Homolog annotation: Hit_ID=Q2HRX8; Match level="QueryCoverage=87%, HitCoverage=31%, E-value=1e-11, Identity=27%"; Hit description=IMP dehydrogenase/GMP reductase
  Pfam annotation: Domain name=DUF1723; Domain location=69-117; Score =13.7; E_value=0.012; Accession=PF08330.1; Description=Protein of unknown function (DUF1723)
DTGADIPADTGAQAAEDEHEGFPGAPSDPSVLTQYADHVACSVCTGEERPELKLSFHGRKAHSLGRPVPAIEGLIARTGLSPLITSSFHLPVGELTITLDDISSILHLPVVGDLHAFQPLHVDDAVQMLVDLLMVSVEAARAETGQCRGPYAGHWTASARAYLLGCTLFAKKSATNVHVVYLEALRDLS

SEQ ID NO: 195176 - protein, 575 aa, Glycine max
  Coding DNA Sequence Number=SeqID_78398
  Gene Ontology: Mol. function=RNA-directed DNA polymerase activity; Cellular component=nucleus; Biological process=RNA-dependent DNA replication
  Pfam annotation: Domain name=Exo_endo_phos; Domain location=2-232; Score=0.1; E_value=0.012; Accession=PF03372.13; Description =EndonucleaseExonucleasephosphatase family
MIISWNLRGLNKASKIREVSSRLFLLKPHIVVMLEIRVKNNKAGNVRDKLKLKGKYLDNYVKHNNGRIWVYWDDNIVDIQEVNCTAQLIHCKVYDATGYFMQWLTAIYGFNYLEQCTDLWHDLEAINKTQQGPWCLIGDFNNVLKTNDRVGGKMVCEKEYKDLRTMMDNTGLAEMDSKGDYYTWSNKQSENIIYSRIDRILGNTEWFSKNLNLSLTNMTPGISDHAMLCLRDDSVPVKRKARFKYANCVSGMDNFTETVANSWNSARRGGPPMKMLWHKLKKLQPVINNLSKPLIGIKVKLQEAREKLTHAQMELTLDRLNKDKIDRTNDCTEAVIKWTEMEEQMLQQRAKIRWLRLGDGNNAYFHASLKAKYNQTSIKKLYMNDGNFVTTQKEIEDEIMRFYGDLMGREEPNLDSVDINIMRKGCQLNFDQRKYLIGRITDEEIDKALKSIGDLKAPGIDGYGAKFFKDAWSIIKSDFTDAIREFFEKGKMYEPINTSLVILIPKNQEAKYARDYRPISCCTTIYKVISKVLTTRLSRVIKSIVHQSQAAFVPGQKIHDQILLAYELIQGYERK

SEQ ID NO: 195177 - protein, 117 aa, Glycine max
  Coding DNA Sequence Number=SeqID_78399
MRCGVVRSVEGRFRWVEEIECTWKAPPTNAAVQAIDVSILKDKGTRYAAEFRDHEGQVLAVATKNCTQCYMLQQLWRHCVSTFKSAELSLQQVMYETGTRVGKRSNAGHEIISLRNI

SEQ ID NO: 195178 - protein, 180 aa, Glycine max
  Coding DNA Sequence Number=SeqID_78400
  Gene Ontology: Mol. function=hydrolase activity; Cellular component =cytosol; Biological process=protein amino acid phosphorylation
  Homolog annotation: Hit_ID=Q9SY39; Match level="QueryCoverage=95%, HitCoverage=71%, E-value=1e-53, Identity=54%"; Hit description =Putative hydrolase
MATFNGFVDGTPSESALIFLGTGCSSMVPNLMCLLQPSDPPCPVCVQSLSIPPERNPNYRCNTSLLIDYGAAAANGGDRKYILIDVGKTFRETVLSIAEKFPYLVQKKRKEGAEIRRVAQIDWNIIADDCNQQFFASGLKFTPLPVMHGEDYICLGFLFGEKNRVAYISDVSRFPASTEY

SEQ ID NO: 195179 - protein, 372 aa, Glycine max
  Coding DNA Sequence Number=SeqID_78401
  Gene Ontology: Mol. function=RNA-directed DNA polymerase activity; Cellular component=exocyst; Biological process=RNA-dependent DNA replication
MEYLHRSLQELRYTPDFNFHAKCEKLNIISLSFADDVLMFTKGDKISVDLLMQAFMNFSKSTDLVINPSKCKVYFGAVESCIKEEIKHITAFQEGSLPFRYLGVPLTGKKLSVNHYMSLIDKIVARITHWSAKLLSYAGRLQLIRSTTYAITNYWMTCFPFPKKVIQKINVICRSFLWTGGTTISRKSPISWKQVCTPKNQGGLNLINLEIWNAVTMIKLLWNVCSKKDSLWIKWINCYYMKNGDVMSMGIKDSCSWILKGILKQRQKIQSLTSWSTLLQKDRFVSKIMYNELQDVSSRVPWRKLFFSNLARPRAKFVFWTAYHGRLATKVRMMKFELLSDTKCNFCDHLETIDHLLFECAEMKDVWIQILE

SEQ ID NO: 195180 - protein, 106 aa, Glycine max
  Coding DNA Sequence Number=SeqID_78402
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=2e-08, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=49; ConfidenceScore=5.22e-01
MIDPLNESISCFLIRVDPWRATRPRLCSATRPRLCRTTRPHLQRTTRPRLQRVMYLHLQRTTRPRLQRTTCPRLQRTTRPRLQRATRPHPQRTTRPHLQRTACPRL

SEQ ID NO: 195181 - protein, 115 aa, Glycine max
  Coding DNA Sequence Number=SeqID_78403
MKHPFSMHPLMVRKGRIVKHKDFYIEHLTSPAKQKLGGLDKFPALILFQAGELDKLAALILVLARGLDKLATLLLVRATTLDTKQPLSPTSWLEAWGAYVLSGVHKMNMASDVVL

SEQ ID NO: 195182 - protein, 398 aa, Glycine max
  Coding DNA Sequence Number=SeqID_78404
  Gene Ontology: Mol. function=nucleic acid binding; Cellular component= intracellular; Biological process=DNA integration
  Homolog annotation: Hit_ID=Q9FFX3; Match level="QueryCoverage=37%, HitCoverage=36%, E-value=2e-56, Identity=70%"; Hit description =Arabidopsis thaliana genomic DNA, chromosome 5, P1 clone:MAC12
GTEIQLGLAVESQKATLSVKRRLACEQLIYFTQAYHCLSGCDINQGHGRKQIRFIKWKFLEAKAAAYYYHGLILDKGSEPSIHIGSVSCFLAAEELLAESKKACLSFCLAPPVTRAPPLWGAMKFLHQKIPEVASRKSQMYGYLWEQENLAEAREREETLPTTLSEKEKSAVTIWLKLENLYMTKSLANRLFLKYKLYIFKMMPRKTLEDYIDDFNKIILDLENIEIKMDEKDQALLLLRSLPIPLCDCSWLIGVNLPGVYSPHFPNRWDLSWKPKLTSRLNLELSLILDRKDMGATSKIIRLLEHSFITQQEYVEKMLMRFNMENCKEVLILLAQHFKLSAKDSPNTDEEVAKMENVPYVSVVGSLMYAMIYTRSDLAYALSVVSRHMGKPENNTRR

SEQ ID NO: 195183 - protein, 338 aa, Glycine max
  Coding DNA Sequence Number=SeqID_78405
  Gene Ontology: Mol. function=binding
  Homolog annotation: Hit_ID=Q53K35; Match level="QueryCoverage=88%, HitCoverage=11%, E-value=1e-72, Identity=45%"; Hit description=HEAT repeat, putative
MSYKGGAVTVTDHYLVSSPPLDFLVFRVEGIRGNEEVKIVILSAIASWAVRSTDIIQESLVSFLVSGLKEKETLRKGFLRSLHAICKNEDAILKMLPLFGPLVQLVKTGFTKAVQRLDGMYALLLVVTIAAVDIKAEETLVKEKIWALISQNEPSVVPISMVITQLKIVNSITQASKLSIEDSMACVDLLEVLLVEHLQRTLSNFSVRLMLQLMISFMCHPRWDIRRMTYDVARKIITSAPQLSEDLFLEFSKYLTLIGEKHLALKISDTDISLDPQVLFIPSVEVLVKALLIMSPAALKHAPESFFRIILCSHHPCVVGGAKRDAVWKEVTQVRTFS

SEQ ID NO: 195184 - protein, 161 aa, Glycine max
  Coding DNA Sequence Number=SeqID_78406
  Homolog annotation: Hit_ID=Q9FFX3; Match level="QueryCoverage=72%, HitCoverage=33%, E-value=4e-28, Identity=48%"; Hit description =Arabidopsis thaliana genomic DNA, chromosome 5, P1 clone:MAC12
MGCTYSVYRKKKSSFPEVVVFVPSTRIPVQSDLQRMVKGVIPRDLADKLTSLRNQIVLIAEDTGGSAIAELRRALKEYLSVLIGLTKKEYGPEGLIDFKWKNLEDGRQDSSISNTWFEVLSSVHLMAMLTLSDADSLMIPKDPSGSGFRVVSSGFVPIHKL

SEQ ID NO: 195185 - protein, 78 aa, Glycine max
  Coding DNA Sequence Number=SeqID_78407
MEEDFLFFEQQPSYLDPGLLFYVLRVETPKVSVMQAPPFSVGSDRPFFTVTDAGLKFDGQFGGKKVELKERKGNIGIF

SEQ ID NO: 195186 - protein, 162 aa, Glycine max
  Coding DNA Sequence Number=SeqID_78408
MEEKEHTRKLKNKGKGSTLEEKLRNLGRRSFVRLKSEKVNAQRSKATLKSIVLLHASPSSWNTATLAPAPLQHCTLATCNTATLGSSSDTPSTSGQVSMLLAIVVGGSYVECILPVTMAAPSRSVTFSPSSMATSVVSSFLPATPMKKETPSVNTSRRDPLW

SEQ ID NO: 195187 - protein, 152 aa, Glycine max
  Coding DNA Sequence Number=SeqID_78409
  Gene Ontology: Mol. function=hydrolase activity, acting on ester bonds; Biological process=lipid metabolic process
  Homolog annotation: Hit_ID=Q9M8Y5; Match level="QueryCoverage=81%, HitCoverage=33%, E-value=5e-52, Identity=82%"; Hit description =Putative GDSL-motif lipase/acylhydrolase
MHHVGEKIGSEPTLPYLSRELDGERLLVGANFASAGIGILNDTGIQFINIIRITRQLQYFEQYQQRVSALIGPEQTQRLVNQALVLITLGGNDFVNNYYLVPFSARSRQFALPNYVVYLISEYRKILVVLLSFTSFSVAVICYTTIISIIPF

SEQ ID NO: 195188 - protein, 91 aa, Glycine max
  Coding DNA Sequence Number=SeqID_78410
  Subcellular localization annotation: CTP_CleavageSite=42; ConfidenceScore=5.18e-01
MAHGGVCATKVSWSPAQDGPCKSVRQITMRDKGGRWRRTQVVVGEGGAMEVTPLLCNVVRSNVLFEEGGGGEVGALEKMNVIKLQGLPPCF

SEQ ID NO: 195189 - protein, 663 aa, Glycine max
  Coding DNA Sequence Number=SeqID_78411
  Gene Ontology: Mol. function=solute:hydrogen antiporter activity; Cellular component=integral to membrane; Biological process =regulation of pH
  Homolog annotation: Hit_ID=Q1HDT2; Match level="QueryCoverage=95%, HitCoverage=80%, E-value=1e-135, Identity=38%"; Hit description =Cation/H+ exchanger
  Pfam annotation: Domain name=Na_H_Exchanger; Domain location=4-325; Score=5.7; E_value=0.00039; Accession=PF00999.11; Description =Sodiumhydrogen exchanger family
  Subcellular localization annotation: CTP_CleavageSite=63; ConfidenceScore=5.02e-01
MTESTQFIMRNLGVMGFMFFLFMYGVRMDPTLLRKSGKLHVSTAFISITIPMVTAFVVALCMRKNMDKEMALIPSLGSISGYLGITAFPVLYHILKEFNLLNSDMGRSALSIALIGDSFGMLCIMAFEASSQGETKMINTLWPAMIWINNNTPEGHPVQQSFVVAIFLGALVMGFLTDMFGIAIANGPVFLGLVIPDGPRVGATIVQKTETIMADILLPFSFIMVGSYTDFYAMSASGWSSLEPLIVMVITGYVLKFFSTWIVLHFWRMPLREGLTLSLTLSLRGHIELILFVHWMDKNILHIPDFTLLVLMTTILTATFAPLINILYDPTKPYMVNQRRTIQHNPPDEELRIVLCILDTETINGFIRLLDISNPNSSSPLSISVVRLAELVARANPLFLDHEKQRVPPNYQWTNTINALTQHQQHKGMLMKLHFFTAVTPKQTMFRDICELALEQEASLIILPFKSSSDVHNHSVNSQVLNTAPCSVAIFVDKGLPDINNIGSSSTSFRRSQYRFAVLFLGGGDAREALVYADRMVANQDVSLTVIRFLSRNFKGYNEIEKKLDDGIVTWFWVKNEINQRVVYREVLVSNGEETIEEIQAMNDGAFDLLIVGRKHGINPILLTGLSEWSESDELGLIGDYVSSADFFGSASVLVVQQQILRG

SEQ ID NO: 195190 - protein, 113 aa, Glycine max
  Coding DNA Sequence Number=SeqID_78412
MVFTGLARQSSIGKSAYNGVDDSLNLLSSVWFCLTQVWEEVSNTFFHRLSTNLPGRKASSMDCSATSRFRFLIWTTIHPNMSMNLWSDSSSACCKLVRAQKLYDMIGWLHTKS

SEQ ID NO: 195191 - protein, 71 aa, Glycine max
  Coding DNA Sequence Number=SeqID_78413
MVVGQYKALVLGEFGWLSFREVTPQVCVCVGIGVSDWSRLCGKQIMWGRPLWLSGQSLLDGRRIGRGSDIG

SEQ ID NO: 195192 - protein, 109 aa, Glycine max
  Coding DNA Sequence Number=SeqID_78414
MRMSNKDEACGTLSRSRQREGGDDGACGTLCRSPENAHLQQAVVFPGSFSVAPLLPQRPLLPLLKLLTSNSSYVEFLSCSQYARTSLFAPQAATSFTSYWEKSKSHIQD

SEQ ID NO: 195193 - protein, 140 aa, Glycine max
  Coding DNA Sequence Number=SeqID_78415
  Homolog annotation: Hit_ID=Q5EEQ0; Match level="QueryCoverage=87%, HitCoverage=77%, E-value=3e-36, Identity=69%"; Hit description=Zinc finger protein
MEDDGSNSTRRMSSRTRKAALARLDALENDNAGFEIADANNDDDDASLDEEDQFYIQKKQSKGTKRKTRQAKALEARRAPRTFLELLHEANLESLPPHVPSYWKAAVGPPSSSSRCHFCTVCAFSANYTYVKMCTMIPVA

SEQ ID NO: 195194 - protein, 68 aa, Glycine max
  Coding DNA Sequence Number=SeqID_78416
MSETRLQGMSWSCSTISMKRTATVREEVWKRAEELEQHAQREEPTWRPGLARIWQLSAHLWLSLHLAA

SEQ ID NO: 195195 - protein, 106 aa, Glycine max
  Coding DNA Sequence Number=SeqID_78417
  Gene Ontology: Mol. function=RNA-directed DNA polymerase activity; Biological process=RNA-dependent DNA replication
MVSSHGMEPVSAKVEAIIQWPTPHSQRALRDASVVEMGVVLSQQGHPIAFFIKPFSPKLLLALTYVHKFFAITGAVRKWCQYFLGHSFTILTDHKSLKELIVGLLA

SEQ ID NO: 195196 - protein, 419 aa, Glycine max
  Coding DNA Sequence Number=SeqID_78418
  Gene Ontology: Mol. function=binding
MVIEFVQFKDRLQHSSQYLVARVETPILQLKQNADNIEEEEGILQNLKCGIHFLELSKEVGSKSLTFNEDLQSRPWWTPTSEKNYLLGPFEGISYYPREILTKDRETSLKRVIEKKSLLPRMIYLSIKSASASIKEHVEVNGSVTPDITSELKLLLECYAQFLGFSLTEAIEVVMGFSNGESSCVVSDSNLIDWLNFTVFLNAWSLSSHELVQPDGNGCRPRIWNILDSMLEKYILENVKSIEPQLCSPWSVMELLMQLVTEPLAWHGLVIQSCLRSCFPSGKKKKKSGSAYQSSANLAHAITDSVMHLFHVLEVVLKWITEWNKRPEDEHLENILLLLRRDGHNDGPGKVFHILETFISSVNDVELGDRISQSLKSWSPADVARKMMTGKLKVLTEFSAICGSKLKLFKSMKQQIAQL

SEQ ID NO: 195197 - protein, 161 aa, Glycine max
  Coding DNA Sequence Number=SeqID_78419
  Gene Ontology: Mol. function=RNA-directed DNA polymerase activity; Cellular component=chromatin; Biological process=RNA-dependent DNA replication
  Homolog annotation: Hit_ID=Q8H7X6; Match level="QueryCoverage=68%, HitCoverage=15%, E-value=4e-21, Identity=39%"; Hit description =Putative retroelement
MVCPEGSLLDIIFINQNLMIALQEIEFGEPVHTTQFVKELINCRNGKTVFDGYHIECVIINTNCQVLSRFLTRRTREENGLLVGRDGGSVVGVWNRVANWVMRVEILGGRDRERKIDAKTGRKSLEEKLEELNSSLSTHLRLASDLRLSAKKAHEEALRHA

SEQ ID NO: 195198 - protein, 89 aa, Glycine max
  Coding DNA Sequence Number=SeqID_78420
  Homolog annotation: Hit_ID=Q2R2A3; Match level="QueryCoverage=54%, HitCoverage=5%, E-value=2e-11, Identity=50%"; Hit description =Ubiquitin carboxyl-terminal hydrolase family protein, expressed
MAWVLLDREFCPKKFQFFRTSTFTADIKLRIQKKLQVPDVEFSKRRDIYGAWEQYLGLEHDDNAPKKSYAVNQVDVQLEVQYQQKLCAS

SEQ ID NO: 195199 - protein, 521 aa, Glycine max
  Coding DNA Sequence Number=SeqID_78421
  Homolog annotation: Hit_ID=Q9M670; Match level="QueryCoverage=46%, HitCoverage=63%, E-value=3e-13, Identity=25%"; Hit description=Small heat shock-like protein
MGRNRGYPIPDGYGDGTINLNPSDIRYGYGDILGSRDKELGKQYPYPSRPASLSCLDMYRYCCESFPRENVKITYVASSRTVRITGERPLQGNKWHKMDQSYPIPDYCEPEALQGKFEIPILTLTMPKKITSQVAPKQQEVGTSQEKGEAKPTENVQDTTPPQPTITTSKVEEPIEEKKSVLPPSPDLKAQQKKDSQILSEPIKDQKLKEELVPKPTPPPRVATMQTYEKSQKGQEVVESKPTTTMLTKVKTAERSQKGEEEFESKSKPTMLTKVKTAERAQKGEEEFEAKPTATMLTKVNTAERPQKGEEEFEAKPTPTIITKVKTSERPQKDEEEFEAKSTPTMLTKVKTSEGPQKGEEERESRPAITNVTRKLSVKEQWEENKSKEKSVEDVEKERISKKEVKDEPSELTKPEKDKEEEEDFEEKETKTEKLLAKEAESSVPKVQKKKEKQSSSRSDSKREGKSEENAMEKVGPMSQVFTKIAEGILNEEEKKIVANIGAAVLVITALGYYVSYRFAS

SEQ ID NO: 195200 - protein, 103 aa, Glycine max
  Coding DNA Sequence Number=SeqID_78422
MLNELKAIASTPHVKIKFPTLMGEIITIKEDQKQARQCYVESLKPYLTSGGSSQVMSMDDGSPIRTPTIYKASMGDQDNIFDVDLRDDTINKGPKPIEELVKL

SEQ ID NO: 195201 - protein, 57 aa, Glycine max
  Coding DNA Sequence Number=SeqID_78423
MRPRKACKVEAQCGGGQEAIACNFSWSTMTQVGGLNEWMDPGYRYGGISLKHTKTNL

SEQ ID NO: 195202 - protein, 106 aa, Glycine max
  Coding DNA Sequence Number=SeqID_78424
MAREARKEAPSVPVKDIPYSLVPSKKKKERYFACFLDIFKKLETIPDGDGVGGNKSDGVVVVVVGMTMAVSGGTKVVVVTTLVKVVVVDMMEMVATMTVVVKTDLF

SEQ ID NO: 195203 - protein, 56 aa, Glycine max
  Coding DNA Sequence Number=SeqID_78425
MAIAREVAAVTRLGIEWDGAGQERFKTITSSYYRGGDTKDTSRSSEKNSIEEEIET

SEQ ID NO: 195204 - protein, 48 aa, Glycine max
  Coding DNA Sequence Number=SeqID_78426
MSAPQRQDEGWTPSVPQSSGSMRQSLPLKSYLTYKKESTRDQVNKSKN

SEQ ID NO: 195205 - protein, 206 aa, Glycine max
  Coding DNA Sequence Number=SeqID_78427
LRLSAIRQPLILQFKAAFHCDKDAIEIPGFYQHQWLPNYLEIVEFKYDGETYEIQVRQHKGKLYFADGLTRLRTELQIYESVTINFLACDHPAKFDLHFTPPLDQQKCKRRRATRKHIWTYEITQSMLGAPYPLQLSTSVTQCLIHCGDHMTILRRFGPPLQWNVVVLDKGIGDKYVTLPWYKFLQEGDFSHGDELSFYYRRAEKI

SEQ ID NO: 195206 - protein, 105 aa, Glycine max
  Coding DNA Sequence Number=SeqID_78428
  Gene Ontology: Mol. function=nucleic acid binding
MKKKKRRLMRRKRRARDKERHLARFLDIFKKLEITLPFGEALKQMPLYAKFLKDMLTKKNRYIHSDIIVVEGNCSVVIQRILPPKHKDPGSVTIPCDVRLFSPIS

SEQ ID NO: 195207 - protein, 105 aa, Glycine max
  Coding DNA Sequence Number=SeqID_78429
MKDWGNFLHRLQRSSWCGGSTASNGSSWWPSVVMGGEEGGVRIWVAFGEEERGKIVFFTLKNGANARSAQFPLGFKLCLARPSRLERHKKLLFSKSQRSVVEKLS

SEQ ID NO: 195208 - protein, 263 aa, Glycine max
  Coding DNA Sequence Number=SeqID_78430
MPLSPSWAPSHIVIPPPILLGEEGGVVVFEAFPPTVLIVEGGAHPTQANLVAPRRGRAMVGVVEDLKEIALVDGGMGVVVYRGIHDGMHLGSHEEEFSNVLHSQPSSTPSSKNTAAGTVPQSNTTDRATEFELSFVCLDKKVQSFMEESLNLGSSQWKGAENQTMEAKVHNDGTMSRRQVPHVPSSIFNQLGYACGVVPLENPLSVVVHYGYATAPHDKLLEHRGMARLERGVESYGSAMVARERQPAAFASLGTATNPKEPC

SEQ ID NO: 195209 - protein, 72 aa, Glycine max
  Coding DNA Sequence Number=SeqID_78431
MVGCGFQGNNAVNEVIELLSEMKVSRSKLGDSLFYTIHISLGAEQSEEKIEESQEHAKDAAIAVGRHVSLLM

SEQ ID NO: 195210 - protein, 219 aa, Glycine max
  Coding DNA Sequence Number=SeqID_78432
MGVEEEEENGCHGDEKEEEGGFDYARIETGNSRIFTSNYGFLSRHYAASNYGFLSRHYATWTSRLTFDSRLEMKKLKSEKGDNPRSPVGSSYGDCAKRASIACKKPNHAGSLSFNGDFSPWRCSGRQRRIGDGRHHPQGNKPWKKELHHQECASNKKLEEDALMEEKKERRGEHKIEGIKEGEKWNFEVCLIRLSFIKVTTSVTHASIYRLGSFLEKLS

SEQ ID NO: 195211 - protein, 87 aa, Glycine max
  Coding DNA Sequence Number=SeqID_78433
MSMRIPPERMAEKVQAVEEDGEEVREVADNGEDDVRASNNDVGVEKWVPRSRSDNNLTSLKFEMVTSWFSSFLEGSAETVAKEWWES

SEQ ID NO: 195212 - protein, 134 aa, Glycine max
  Coding DNA Sequence Number=SeqID_78434
  Gene Ontology: Mol. function=isomerase activity; Cellular component =intracellular; Biological process=proteolysis
  Homolog annotation: Hit_ID=Q1RTJ9; Match level="QueryCoverage=98%, HitCoverage=40%, E-value=1e-15, Identity=39%"; Hit description =Cyclin-like F-box; F-box protein interaction domain
MFGFGYDPSSDKYKVVAIALTMLSLDVSQKTEIKVYSTGDSSWRNLKGFPVLWTLPKVGGVYPSGTLNWVVIKGKETIHSEIVIISVDLEKETCRSLFLPDDFCFVDTNIGAFRDSLCVWQDSNTHLGLWQMKE

SEQ ID NO: 195213 - protein, 106 aa, Glycine max
  Coding DNA Sequence Number=SeqID_78435
MKADMEAMKEQMATMMEAMISMKKIMEANAVIVAATSAVAKVNPMLPSGLKQMNHPTSIMAHISQTMGETHEIPHHNLADFEPCLGYATEGQAIGGIPLQNTLEGP

SEQ ID NO: 195214 - protein, 65 aa, Glycine max
  Coding DNA Sequence Number=SeqID_78436
MVTYILQLDSMNLFVKARAWFNPITQGMAILIANTSSTFHRDERLGNTHAMHGKWKNARVTHEQT

SEQ ID NO: 195215 - protein, 144 aa, Glycine max
  Coding DNA Sequence Number=SeqID_78437
MLTSKISFYGYGRFHQQTLLPRGENTETFSSLTSYPELRRSEFLIGGYVGARASLLSTTPPFVAMTQELVARGDTLRLSAPRHSVIPSVIDEQRPIWSSAPFPEMSAFSDGDFSSLASYQELRRSEFLIGGYVGARALLLSAAT

SEQ ID NO: 195216 - protein, 80 aa, Glycine max
  Coding DNA Sequence Number=SeqID_78438
MEERLHAIEGGGSYGFADMQYQYNSDMAPDKMQLENLSKRDNESFKEYAQRWRDLAAQVVPPMMEKDDNNDNKHAASVQL

SEQ ID NO: 195217 - protein, 60 aa, Glycine max
  Coding DNA Sequence Number=SeqID_78439
MEGWCLILDVLWVDVVADLRVAFVVDWVFLVGGWWVMGRTDIGRVVILLGRILVHRIIRG

SEQ ID NO: 195218 - protein, 91 aa, Glycine max
  Coding DNA Sequence Number=SeqID_78440
  Gene Ontology: Mol. function=hydrolase activity, acting on ester bonds; Biological process=lipid metabolic process
  Homolog annotation: Hit_ID=Q9M8Y5; Match level="QueryCoverage=84%, HitCoverage=21%, E-value=2e-33, Identity=79%"; Hit description =Putative GDSL-motif lipase/acylhydrolase
MEYMYIVKLVVEHAGFVTSKVACCGQGPYNGLGLCTPASNLCPNRDIYAFWDPFHPSERANRLIVQQILSGTSEYMYPMNLSTIMALDSKN

SEQ ID NO: 195219 - protein, 379 aa, Glycine max
  Coding DNA Sequence Number=SeqID_78441
  Gene Ontology: Mol. function=protein binding; Cellular component=SCAR complex; Biological process=cortical actin cytoskeleton organization and biogenesis
  Homolog annotation: Hit_ID=Q1SAW4; Match level="QueryCoverage=97%, HitCoverage=98%, E-value=1e-172, Identity=83%"; Hit description =PIROGI-related
MAVPVEEAIAALSTFSLEIYMACNLMLRFQNNAFQELEVFMDEQPEVQGPGVWVSTERGATESPIEYSDVSAYRLSLSEDTKALNQLNALTQEGKEMASVLYTYRSCVKALPQLPDSMKQSQADLYLETYQVLDLEMSRLREIQRWQASASSKLAADMQRFSRPERRINGPTISHLWSMLKLLDVLVQLDHLKNAKASIPNDFSWYKRTFTQVSGQWQDTDSMREELDDLQIFLSTRWAILLNLHVEMFRVNNVEDILQVLIVFVVESLELDFALLFPERHVLLRVLPVLVVLVTSSEKDSESLYKRVKINRLINIFKNEAVIPAFPDLHLSPAAIVKELSTYFPKFSSQTRLLTLPAPHELPPREAQEYPPIFIFFYR

SEQ ID NO: 195220 - protein, 150 aa, Glycine max
  Coding DNA Sequence Number=SeqID_78442
  Gene Ontology: Mol. function=two-component response regulator activity; Cellular component=nucleus; Biological process=two -component signal transduction system (phosphorelay)
  Homolog annotation: Hit_ID=Q1S7Z3; Match level="QueryCoverage=78%, HitCoverage=83%, E-value=3e-23, Identity=47%"; Hit description =Response regulator receiver
  Pfam annotation: Domain name=Response_reg; Domain location=29-143; Score=81.0; E_value=3.8e-21; Accession=PF00072.14; Description =Response regulator receiver domain
MESKKQWNEGANSSISMVNYMIDDKETKISALIVDDDAIIRKIHKTMLERLFNIEAKTVRDGKEAVDLCRSGENFDIIFMDKEMPIMDGHEATKHLRAMGVKSIIVGITTRADGKDKEEFLASGSNHCFEKPLDQAKVEKVLQEHGNFSI

SEQ ID NO: 195221 - protein, 314 aa, Glycine max
  Coding DNA Sequence Number=SeqID_78443
  Homolog annotation: Hit_ID=Q1SAW3; Match level="QueryCoverage=81%, HitCoverage=27%, E-value=1e-132, Identity=91%"; Hit description =Cytoplasmic fragile X mental retardation protein interacting protein
  Subcellular localization annotation: CTP_CleavageSite=59; ConfidenceScore=5.16e-01
MDFMQTAPWLGLLPGADGQIVTSQDGGDSPVVSLFKSTAAAMVSYPGCPSPTSFHIMSKQAEAADLLYKANLNTGSVLEYALAFASAALDKYCNKWSAAPKTGFIDITISKDFYRIYSGLQILTVLGYLEESAQVPSNSHERLGDSIAWGGCTIIYLLGQQLHFELFDFSYQILNIAEVEAASVMQTHKNSQFAVQGWEALLEAMKKARRLNNHVFSMLKARCPLEEKTACAIKQSGAPIHRIKFDNTVSAFETLPQKDTKYGVRFEQTVGQYLACSYGTRSNLSSEPYEKIQTKILLSDYSFSGAQSVGYNCH

SEQ ID NO: 195222 - protein, 519 aa, Glycine max
  Coding DNA Sequence Number=SeqID_78444
  Gene Ontology: Mol. function=protein binding; Cellular component =microtubule organizing center; Biological process=microtubule cytoskeleton organization and biogenesis
  Homolog annotation: Hit_ID=Q1SAW3; Match level="QueryCoverage=85%, HitCoverage=39%, E-value=1e-171, Identity=73%"; Hit description =Cytoplasmic fragile X mental retardation protein interacting protein
MANTNKSESELQSSQHGGEESKANIFYPRAVAPTAAQVHCLQFLIYEVVSGGNLRRPGGLFGNSGSEIPVNDLKQLETFFYKLGFFLHILDYSATVATLTDLGFLWFREFYLESSRVIQFPIECSLPWMLVDCVLESPNSGLLESVLMPFDIYNDSAQQALVLLKQRFLYDEIEAEVGRKGKLGRVKIREGWEDLCGGIQKIEWGQGGGRTLNEPAFLCVFFSILRVVCKFLPLLTSVYTGSRDELLDPSFLFASDNAEKYAVQPIRLNMLLKMTRVKVLGECCLSNWFNPTQLGLVKMISLTLTLPHSHLLGRMINLRSLITERMNKVFRENIEFLFDRFECQDLCAIVELEKLLDVLKHSHELLSRDLSVDSFSLMLNEMQENISLVSFSSRLASQIWSEMHSDFLPNFILCNTTQRFIRSSRTVPVQKPSVPSSKPSFYCGTQDQYARWVCSKCRSIGKNPSLTLARDSANIEYISGGQVSSYELAFGVDLDSNPHSKMVSEHILDPFKGPRTKFF

SEQ ID NO: 195223 - protein, 44 aa, Glycine max
  Coding DNA Sequence Number=SeqID_78445
MFNQPFQDFRQCWMMTLLSKNIGACCFYRVLHSFDLLEVTLFLV

SEQ ID NO: 195224 - protein, 440 aa, Glycine max
  Coding DNA Sequence Number=SeqID_78446
  Gene Ontology: Mol. function=ubiquitin-protein ligase activity; Cellular component=ubiquitin ligase complex; Biological process =protein ubiquitination
  Homolog annotation: Hit_ID=Q1SAW5; Match level="QueryCoverage=97%, HitCoverage=98%, E-value=1e-164, Identity=69%"; Hit description=U box
  Pfam annotation: Domain name=Arm; Domain location=182-225; Score=0.5; E_value=10; Accession=PF00514.13; Description=Armadillobeta-catenin -like repeat
  Pfam annotation: Domain name=Arm; Domain location=226-267; Score =12.3; E_value=0.36; Accession=PF00514.13; Description=Armadillobeta -catenin-like repeat
  Pfam annotation: Domain name=Arm; Domain location=268-308; Score =24.9; E_value=0.00029; Accession=PF00514.13; Description =Armadillobeta-catenin-like repeat
  Pfam annotation: Domain name=Arm; Domain location=348-389; Score =15.5; E_value=0.14; Accession=PF00514.13; Description=Armadillobeta -catenin-like repeat
  Pfam annotation: Domain name=U-box; Domain location=62-134; Score =73.3; E_value=7.9e-19; Accession=PF04564.6; Description=U-box domain
  Pfam module annotation: Pfam domain module=Arm::Arm::Arm::Arm::U-box; Domain location=182-225::226-267::268-308::348-389::62-134
MAKREQRLRGVSASELKEKLRELVKSIVDSDDYTLEAADEAIATLSSLKHLKSPIPDDFPLPPQFRCPISTQLMSDPVILSTGQTYDRPFIQRWLNEGHRTCPQTQQVLSHTILTPNYLVRDMILLWCRDRGIDLPNPAKDLDEVVTNADRNHLNSLLRKLQLSVPDQKEAAKELRLLTKRMPSIRTLVGESSDTIPLLLSPLAAASTDPDLHEDLITTVLNLSIHDDNKKSFAEDPALISLLIDALKCGTIQTRSNAAAAIFTLSAIDSNKHIIGESGAIKHLLELLDEGQPLAMKDAASAIFNLCLVHENKGRTVRDGAVRVILNKMMDHILVDELLAILALLSSHPKAVEEMGDFDAVPLLLGVIRESTSERSKENCVAILYTICFSDRTKLKEIREEEKANGTLTKLGKCGTSRAKRKANGILERLNRSPSLTHTA

SEQ ID NO: 195225 - protein, 65 aa, Glycine max
  Coding DNA Sequence Number=SeqID_78447
MASTNFLFPEGNSMEHEMKLQRLNQNEESDKRKRGIVRKVSLSIQEGSDNEDLDDEEDDSQEIRD

SEQ ID NO: 195226 - protein, 256 aa, Glycine max
  Coding DNA Sequence Number=SeqID_78448
  Gene Ontology: Mol. function=nucleic acid binding; Cellular component= ribonucleoprotein complex; Biological process=regulation of alternative nuclear mRNA splicing, via spliceosome
  Homolog annotation: Hit_ID=Q41498; Match level="QueryCoverage=95%, HitCoverage=93%, E-value=2e-97, Identity=73%"; Hit description =U1snRNP-specific protein, U1A
  Pfam annotation: Domain name=RRM_1; Domain location=184-251; Score =41.6; E_value=2.6e-09; Accession=PF00076.12; Description=RNA recognition motif. (a.k.a. RRM, R
  Pfam annotation: Domain name=RRM_1; Domain location=33-103; Score =22.5; E_value=0.0012; Accession=PF00076.12; Description=RNA recognition motif. (a.k.a. RRM, R
  Pfam module annotation: Pfam domain module=RRM_1::RRM_1; Domain location=184-251::33-103
RKMSEVNATPEIPQNNTIYINNLNEKIKIDGMLFVSCLMLLDAELKKSLNAVFTQFGKILEVLAFKTLKHKGQAWVVFEDASSASNALRQMQGFPFYDKPMRIQYAKTKSDIIAKADGTFVPREKRKRHDEKAKKRKDQHDSNLAGMGLNPAYAGAYGAAPAIAYPGGAKSMVPEAPAPPNNILFIQNLPNDSTPMMLQMLFLQYPGFKEVRMVETKPGIAFVEYGDEMQSTVAMQTLQGFKITPQNPMLITYAKK

SEQ ID NO: 195227 - protein, 225 aa, Glycine max
  Coding DNA Sequence Number=SeqID_78449
MGLLSKSKTMPKRESHFLKLVHPGGFVELHANPILASEVMSKNPRHCVTRPDFFQYPWIVVRPESILTPGNVFYIVPCHTIRHKLKSTNFTANTLLPNQSSLDSHREAKTSNSNKIRCFQKQSSCVKLPREGNKHSKGGNWDQSYVRDRPVYYSSDYTSRYSGKVKARSPSGRFNHSEQIPKLKPCLKNDKTHSARSRRNLKVRFQCSDDNANSANFTTKFYRYS

SEQ ID NO: 195228 - protein, 510 aa, Glycine max
  Coding DNA Sequence Number=SeqID_78450
  Gene Ontology: Mol. function=binding; Cellular component=chloroplast; Biological process=transport
  Homolog annotation: Hit_ID=Q0H3C6; Match level="QueryCoverage=80%, HitCoverage=78%, E-value=1e-159, Identity=68%"; Hit description =Violaxanthin de-epoxidase
  Pfam annotation: Domain name=VDE; Domain location=227-424; Score =539.4; E_value=3.8e-159; Accession=PF07137.2; Description =Violaxanthin de-epoxidase (VDE)
  Subcellular localization annotation: CTP_CleavageSite=54; ConfidenceScore=5.00e-01
MATWGAHSMLLSHGEGTGTPKVCVKAGLTVRGDLRFHRTRGFKYAPSVVVLKVLATARKPTRLRLLRPYCSVRGQHDHGKGYFSPTNSQIPRQHILKFAADRMLAFLKDWSNLRITAVAGILVSVLMIIPPADAVDALKTCACLLKDCRIELAKCLSNPSCAANIACLQTCNNRPDETECQVSLALYIKFMPAPLFMSPNPAHEAFIFFLFFQIKCGDLFENSVVDEFNECAVSRKKCVPKKSDVGEFPAPNPDVLVNSFNIAEFSGKWFITSGLNPTFDTFDCQLHEFHTESNKLVGNLSWRIRTPDAGFITRSAEQRFVQDPSYPGILYNHDNKYLHYQDDWYILSSKIENKSDDYVFVYYRGRNDAWDGYGGAVVYTRSAVLPESIVPELEKASKSVGRDFSKFIRTDNTCGPEPSLVERLEKKVEEGEETIVREVEQIEEEVEKVGKTEATLFQKLAEGFKMFQEDEENFLRGLSKEEMEILDGLKMEAGEVEKLFGRALPIRKLR

SEQ ID NO: 195229 - protein, 608 aa, Glycine max
  Coding DNA Sequence Number=SeqID_78451
  Gene Ontology: Mol. function=protein serine/threonine kinase activity; Cellular component=integral to membrane; Biological process=protein amino acid phosphorylation
  Homolog annotation: Hit_ID=Q1SAX0; Match level="QueryCoverage=85%, HitCoverage=96%, E-value=0.0, Identity=69%"; Hit description=Protein kinase
  Pfam annotation: Domain name=Pkinase; Domain location=310-576; Score =135.5; E_value=1.5e-37; Accession=PF00069.15; Description=Protein kinase domain
  Pfam annotation: Domain name=Pkinase_Tyr; Domain location=307-576; Score=61.1; E_value=3.2e-16; Accession=PF07714.7; Description =Protein tyrosine kinase
  Pfam module annotation: Pfam domain module=Pkinase::Pkinase_Tyr; Domain location=310-576::307-576
MTLYLLNSTRLTEKFWLLCLQRYAASQWANLTSVVALPAYSPLVSPAPNDPPQGTCVLKFNTSQYVPFDECGDVNEEIDKWGDDGFPTTLCCRNALTVLSNALASQALNSGGQVFISQDQLQSCAQSFNPQQGVSLNSCGFQSLYLGSSKCSNLVLQDVRKLQQYQDALDKCSHFDHPFGESCADCTGAILSLRDGLHNQVANNNNNHTELAICEVAAIVAVAAGKPNDPVVDKVLRCLPPSASGSDKRSLWKPLLSVPVVILAILLVVIMVKCLSKKKFRRQANLKEIVAWSGLYWFCKREIENAMNYGGEKICLGRGSTGQVYRGVLPSGQLVAIKHLTKSNTSESFTREVEGLSRLRHPNLVCLFGSCIEGDERYLVYEFCANGNLAQHLLRRDSHLTWETRVRILRDCSYALKYLHHHIEGCVVHRDIKLTNILLNEKYQAKLSDFGLAKVMGITESKVFTDVRGTIGYMDPEYMSNAKLTCASDVYSFGIVALQILSGQKVIELDLDARDQLTRKARDVSMGKRPLSDFEDPRLNGKVDKADFEAILQIAVLCVAKSSKGRPTIELVFEELDKVCGDTETRMKQKKDESSSTTSTPSSKSAPL

SEQ ID NO: 195230 - protein, 399 aa, Glycine max
  Coding DNA Sequence Number=SeqID_78452
  Gene Ontology: Mol. function=protein serine/threonine kinase activity; Cellular component=membrane; Biological process=protein amino acid phosphorylation
  Homolog annotation: Hit_ID=Q1SAX1; Match level="QueryCoverage=77%, HitCoverage=50%, E-value=1e-158, Identity=89%"; Hit description =Protein kinase
  Pfam annotation: Domain name=Pkinase; Domain location=44-318; Score =131.3; E_value=2.7e-36; Accession=PF00069.15; Description=Protein kinase domain
  Pfam annotation: Domain name=Pkinase_Tyr; Domain location=44-318; Score=127.1; E_value=4.9e-35; Accession=PF07714.7; Description =Protein tyrosine kinase
  Pfam module annotation: Pfam domain module=Pkinase::Pkinase_Tyr; Domain location=44-318::44-318
MTNKKSKESDVKKQKADDPNQFDTSKIQAQNFTFRELAIATKNFRQECLLGEGGFGRVYKGTIPATGQVVAVKQLDRNGVQGSKEFLVEVLMLSLLNHDNLVKLAGYCADGDQRLLVYEFLPGGCLEGRLLERKPDEPVLDWYSRMKIASNAAKGLWYLHDKANPSVIYRDLKSANILLDNDNNAKLSDYGLAKLAGKDKTNIVPTRVMGNYGYSAPEYVRTGNLTLKSDVYSFGVVLLELITGRRAIDTTRPHDEQNLVSWAQPIFRDPKRYPDMADPSLENNFPEKDLNQVVAIAAMCLQEETAARPLMSDVVTALSFLSTTPPEVVPAAKSAAAPENEAGSVKDRDSSSSDEGSSSEVEENVTAQNQSTRHQTEQGVLLQIKPQEQHQIKEWNRFF

SEQ ID NO: 195231 - protein, 168 aa, Glycine max
  Coding DNA Sequence Number=SeqID_78453
  Gene Ontology: Mol. function=RNA-directed DNA polymerase activity; Cellular component=spliceosome; Biological process=RNA-dependent DNA replication
MRMFRWMCGKTRQDKIRNEAIRERVGVTPIVEKMVENRLRWFGHVERRPVDSVVRRVDQMERRQTIQGRGRPKKTIREVIKKDLELNDLDRSMLTPKEAFRMISHKFHGKGPGKMKQEKRMKQYHEELKMKQIKSLDTPSLSVERMREVQARLQTSCDTLYLDIYINK

SEQ ID NO: 195232 - protein, 272 aa, Glycine max
  Coding DNA Sequence Number=SeqID_78454
  Gene Ontology: Mol. function=nucleic acid binding; Biological process= DNA integration
  Homolog annotation: Hit_ID=Q1S7C5; Match level="QueryCoverage=63%, HitCoverage=14%, E-value=8e-19, Identity=32%"; Hit description =Integrase, catalytic region
  Subcellular localization annotation: CTP_CleavageSite=70; ConfidenceScore=5.68e-01
MAFTNNNSSLPPPPPPPLVPTLAPHSPILNFSPLKITTTTLLALPIVSGSNMINRSSLGFNQLLQKHFFLASSIAQPHGICGIDCMSTFNPLRMQRRSNCIVNFCSSSLESHSIIAYILHIQSLINSFASIGDLISRSAHINLILDGLPDEYRTICTFLNNSCDPLSLDDVTPMLLAEECSIEKCHKKNLGSLNFAEGLNSNSTFEAQICHKFGHKASHLMRIMKLAKYRLKAQVEKNKGSSGEGQSPRVEKDEGPEAETLSRLLIVAEGPS

SEQ ID NO: 195233 - protein, 258 aa, Glycine max
  Coding DNA Sequence Number=SeqID_78455
  Gene Ontology: Cellular component=cytoskeleton
  Homolog annotation: Hit_ID=Q8S8M5; Match level="QueryCoverage=99%, HitCoverage=95%, E-value=7e-67, Identity=51%"; Hit description =Protein ABIL1
MTFDEVSMEHNKSFIFALQELKNLRPQLYSAADYCEKSYLNSDKNKYYAARALVNAVDHLGTVAYKLSDILEKQTFDVSTMDLKVSTLNQRLLTCHMYTDKEGLRQQQLLAFIPRHHKHYILPSTPISKTLSWHLASETKFTLKKQASRTSKNAKDSKFSAKTSGVFHLLGSEGSTRMKTSAAQPHLANGVPTSGAATQTLGATSRDALKRSKPLTAYGSFDDRNGREAVQVHTRSKSVLSSFLVKQAAAKLKAGSVL

SEQ ID NO: 195234 - protein, 727 aa, Glycine max
  Coding DNA Sequence Number=SeqID_78456
  Gene Ontology: Mol. function=identical protein binding; Cellular component=cellulose and pectin-containing cell wall; Biological process=negative regulation of enzyme activity
  Homolog annotation: Hit_ID=Q84TR6; Match level="QueryCoverage=98%, HitCoverage=94%, E-value=0.0, Identity=60%"; Hit description =Subtilase
  Pfam annotation: Domain name=PA; Domain location=326-417; Score=36.5; E_value=9e-08; Accession=PF02225.12; Description=PA domain
  Pfam annotation: Domain name=Peptidase_S8; Domain location=77-543; Score=90.2; E_value=6.1e-24; Accession=PF00082.12; Description =Subtilase family
  Pfam annotation: Domain name=Subtilisin_N; Domain location=1-71; Score=55.6; E_value=1.7e-13; Accession=PF05922.7; Description =Subtilisin N-terminal Region
  Pfam module annotation: Pfam domain module=PA::Peptidase _S8::Subtilisin_N; Domain location=326-417::77-543::1-71
MDKSHMPKVFTSYHNWYSSTLIDSAATPSILYSYDNALHGFSVSLSQEQLETLKQTPGFISAYRDRETTLDTTQSYTFLSLNHSHGLWPASNYAQNVVVGVIDSGIWPESESFKDHGMETQTPPKWKGKCEGGQNFDSSLCNSKLIGATYFNKGLLAAHQADATKIGADSVRDTVGHGTHTASTVAGNYVNGASYFGYAKGTARGIAPRAKIAVYKVAWAQEVYASDILAGLDKAIADGVDVISISMGLNMAPLYEDPVAIAAFSAMEKGVVVSASAGNAGPLLGTLHNGIPWVLTVGASNTERVFGGTLILGNGKRFSGWTLFPASATVNGLPLVYHKNVSACDSSQLLSRVARGGVVICDSADVNLNEQMEHVTLSGVYGAVFISSDPKVFERRKMTCPGLVISPRDGENVIKYARGTPRASATIKFQETYLGPKRAPTVASYSSRGPSSECPWVLKPDVVAPGSSILAAWIPDVPAARIGPNVVLNTEYNLMSGTSMACPHASGVVALLKNAHPEWSASAIRSALTTTANPLDNTGKPIEESGDWPQRASPLAMGAGLIDPNRALDPGLVYDASPQDYVNLLCAMNLTQAQIMAITRSKAYSNCSRASYDLNYPSFVAFYADKSVKVETKFRRIVTYVGDGPAVYTARVSSYNGTAISVSPNRLVFKNKHEKRKFTLSFKSQMDKDYDVAFGSLQWVEETGRHLVRSPVVLVPRNVAFNFQTRI

SEQ ID NO: 195235 - protein, 152 aa, Glycine max
  Coding DNA Sequence Number=SeqID_78457
  Homolog annotation: Hit_ID=O82347; Match level="QueryCoverage=58%, HitCoverage=36%, E-value=9e-33, Identity=70%"; Hit description =Expressed protein
MSLLIFSPETSFVPKIVHNPNPKPSKLHNLKLITRGKTIGLKVSCKVKYQKTSNNTMDDIVFKDPLNTFVGIENYKSIFWALGFHGRMFFKALWIDLSRVWQPAEDVIMVRWTVDGIPRGPWESCSRSRFDGTSEYKLDKNGLSYDTDTIRK

SEQ ID NO: 195236 - protein, 126 aa, Glycine max
  Coding DNA Sequence Number=SeqID_78458
MVSTKELETCMEFYEKNLFDHQESMQKMLETVQISIESLTLIERIFHFCPLMAPTFEIEKQKQNNFLNWRVPLKNKEVVCYYYRWMVKPLRGKGTTCRTTIAEGILDNKSFTILEANSTQVHLMIQ

SEQ ID NO: 195237 - protein, 69 aa, Glycine max
  Coding DNA Sequence Number=SeqID_78459
MDKVSKDRVNWDSVWGNWIGNWFGNLVERAWRSSLHHFYTSNDDVNLTRSGSFDTGYEVLDDATSSEGR

SEQ ID NO: 195238 - protein, 123 aa, Glycine max
  Coding DNA Sequence Number=SeqID_78460
MGDSQENNKGKSRDKDNYVSWTMEDTNELLHLLVDAMNRGLRDANGSLSKKNVERIILPQLNAKTKFPKTYSHYLSRMKWFRNQYNMMSTLMRNNSGFGWDPIGKTFTAHEDICGKMLIIRRT

SEQ ID NO: 195239 - protein, 339 aa, Glycine max
  Coding DNA Sequence Number=SeqID_78461
  Gene Ontology: Mol. function=DNA binding; Cellular component=nucleus; Biological process=regulation of transcription, DNA-dependent
  Homolog annotation: Hit_ID=Q9M2Y9; Match level="QueryCoverage=90%, HitCoverage=98%, E-value=2e-62, Identity=45%"; Hit description =AtMYB84
  Pfam annotation: Domain name=Myb_DNA-bind_2; Domain location=13-70; Score=-7.1; E_value=0.06; Accession=PF08914.1; Description=Rap1 Myb domain
  Pfam annotation: Domain name=Myb_DNA-binding; Domain location=14-62; Score=51.2; E_value=3.5e-12; Accession=PF00249.21; Description=Myb -like DNA-binding domain
  Pfam annotation: Domain name=Myb_DNA-binding; Domain location=68-113; Score=40.4; E_value=6.2e-09; Accession=PF00249.21; Description=Myb -like DNA-binding domain
  Pfam module annotation: Pfam domain module=Myb_DNA-bind_2::Myb_DNA -binding::Myb_DNA-binding; Domain location=13-70::14-62::68-113
MGRAPCCDKANVKRGPWSPEEDTKLKSYIEEHGTGGNWIALPQKIGLKRCGKSCRLRWLNYLRPNIKHGGFSEEEDNIICSLYVTIGSRWSIIAAQLPGRTDNDIKNYWNTKLKKKLLGKQRKEQQAQARKVFNQKQEIKRESEDLMLPVGVIFRTPYYWPEQQHSWHIPVTNNASIQYSNLNYNNQTSSFIKHFPSNNIVTATTMNSQHSSRDISLIQNQLHDLHPSTVSMVTTDTCHTSNVLQGFGNFSMASDLACVNQQQQIDGSMRVFYGLETMDVATNGSTNTSTSTESISWGDISSLVYSPLLVSDYEACQQRLLMPQDVTFEESSYFAMQTQ

SEQ ID NO: 195240 - protein, 160 aa, Glycine max
  Coding DNA Sequence Number=SeqID_78462
  Gene Ontology: Mol. function=hydrolase activity, hydrolyzing O -glycosyl compounds; Cellular component=vacuole; Biological process =carbohydrate metabolic process
  Homolog annotation: Hit_ID=Q8LST3; Match level="QueryCoverage=85%, HitCoverage=80%, E-value=2e-23, Identity=55%"; Hit description =Chitinase
MCCYMCNYCTAAESACSNAGDIVVYWGQGESEGTLKETCNSGLYKIVNIAFLAKFGAWWRRSLLRCAAPQCPFPDQHQNGAVSTGLFDFVWVQFYNNGPCQFESTDPTKFQKSWNQWVLSIRSRKIYVGLPASPSPATPVSGFVPTRTLITQVWGSNALG

SEQ ID NO: 195241 - protein, 83 aa, Glycine max
  Coding DNA Sequence Number=SeqID_78463
  Gene Ontology: Mol. function=oxidoreductase activity; Cellular component=nucleus; Biological process=rRNA processing
  Homolog annotation: Hit_ID=Q1SAX7; Match level="QueryCoverage=89%, HitCoverage=37%, E-value=2e-35, Identity=90%"; Hit description =Nucleotide binding protein, PINc
  Pfam annotation: Domain name=Fcf1; Domain location=1-72; Score=130.7; E_value=3.9e-36; Accession=PF04900.3; Description=Fcf1
MYRHRIAKDPRFERILCTHKGTYADDCLVERVTQHKCYIVATCDRDLKRRIRKIPGVPIMYITKHKYSIERLPEATIGGGRSS

SEQ ID NO: 195242 - protein, 193 aa, Glycine max
  Coding DNA Sequence Number=SeqID_78464
MTKTGKRLTYAAAASGNITYEFGIYFCHVPVNEQVNEVVNDNGTLEVDEVYVSDEDVTYQQLREDSSSEYNPIGEDANLSDVDDLSDFDEIVGVIGIVHSNSGKDEIYEERGLNSNSVVAATEDVQAENTSAAQNEIVEVVHPNTQPIQRTAENKAQKTNHYPYLLEGLCAAWVAEAPCSMHRSYVRKSAPLG

SEQ ID NO: 195243 - protein, 313 aa, Glycine max
  Coding DNA Sequence Number=SeqID_78465
  Gene Ontology: Mol. function=protein dimerization activity; Cellular component=nucleus; Biological process=regulation of transcription
  Homolog annotation: Hit_ID=Q8RVH8; Match level="QueryCoverage=99%, HitCoverage=91%, E-value=1e-101, Identity=61%"; Hit description =Aux/IAA protein
  Pfam annotation: Domain name=AUX_IAA; Domain location=66-313; Score =188.4; E_value=1.7e-53; Accession=PF02309.7; Description=AUXIAA family
MSKPLLGIAEEEGQSNVTLLVSSSATMESVCLNSSKLKERNYMGLSDCSSVDSSAPSFSDETKSNLNLKATELRLGLPGSQSPERDSDLCLRSSIQFDEKPLFPLHPATDEHHSSSKPAVLGNKRGFSDVMSGFAEEKLLVSSEVNTILPPRPSSNVGLKPSSMLENVGAQQQAKELATVKVGHERSHAVNESRPNLNDSTNNNSSAPATKAQVVGWPPIRSFRKNSLVTTSKNVEEVDGKVGPGALFVKPFCQDPVTAYVDVMSGSCGSHGNLGGEVLNETKLKDLLHGSEYVLTYEDKDGDWMLVGDVPWE

SEQ ID NO: 195244 - protein, 107 aa, Glycine max
  Coding DNA Sequence Number=SeqID_78466
  Gene Ontology: Mol. function=translation elongation factor activity; Cellular component=eukaryotic translation elongation factor 1 complex; Biological process=translational elongation
  Homolog annotation: Hit_ID=Q6SZ89; Match level="QueryCoverage=89%, HitCoverage=80%, E-value=2e-23, Identity=40%"; Hit description =Translational elongation factor 1 subunit Bbeta
  Pfam annotation: Domain name=EF1_GNE; Domain location=53-107; Score =17.9; E_value=5.6e-05; Accession=PF00736.9; Description=EF-1 guanine nucleotide exchange domain
MAVTLYDLSSASGLKKLDQWYKHIDALLRISGVSGEGSLVAAPPTADTKATGKSSVMLDVKPWDDETDMKKLEEAVRSIEMEGLLFGASEFTIVGLGDQGNQRNCKF

SEQ ID NO: 195245 - protein, 36 aa, Glycine max
  Coding DNA Sequence Number=SeqID_78467
MNLATMFGGCANERDLGRRRCEGDALVHNHDVVLSS

SEQ ID NO: 195246 - protein, 111 aa, Glycine max
  Coding DNA Sequence Number=SeqID_78468
MTFMGLRKKVENGEIGEQRYAITSRGSRDCYAITSRGSRLVGGGCMNCVRQWHSWGSVKKWRMENWRTVLRNNFAGLQTRWWRMHEQRQAMTFMGLRKKVENGELANSATQ

SEQ ID NO: 195247 - protein, 135 aa, Glycine max
  Coding DNA Sequence Number=SeqID_78469
MENRSNRLNSTPHMQDLSSILTPEHLNGLQWRRHDGRHSHGGIAEITGFFFLCGRSWADPTQPYPLFYSKAQRENATQNAARDQERHPTPNNDPARSSHRAPCNDDPAACMHDPAAMSTDARPRDGEDPVKATPH

SEQ ID NO: 195248 - protein, 46 aa, Glycine max
  Coding DNA Sequence Number=SeqID_78470
MTFGSNLKSPVSFRRDLLLDAIKEISVVTFLPRQGNWAMGTPWFLT

SEQ ID NO: 195249 - protein, 111 aa, Glycine max
  Coding DNA Sequence Number=SeqID_78471
MNREHLANANGEIALACVEPYLAITVGESHVDYTASPDGGSSWWCVAIPIGDTVLSPSYVAYIATTSDDTSLSPPLPPVAMAASALPPVSMAGHTQEQTPSVISFETDPIP

SEQ ID NO: 195250 - protein, 67 aa, Glycine max
  Coding DNA Sequence Number=SeqID_78472
MLSLFMMRLNIRSEIGFKASCRCSQVAHALLVHDETKHKSTCNDTQYLQNFILNASKKLKRGRKTFV

SEQ ID NO: 195251 - protein, 900 aa, Glycine max
  Coding DNA Sequence Number=SeqID_78473
  Gene Ontology: Mol. function=protein-tyrosine kinase activity; Cellular component=cellulose and pectin-containing cell wall; Biological process=protein amino acid phosphorylation
  Homolog annotation: Hit_ID=Q9SIX4; Match level="QueryCoverage=94%, HitCoverage=94%, E-value=0.0, Identity=49%"; Hit description =Putative LRR receptor protein kinase
  Pfam annotation: Domain name=DUF1191; Domain location=300-486; Score=- 119.1; E_value=0.019; Accession=PF06697.3; Description=Protein of unknown function (DUF1191)
  Pfam annotation: Domain name=LRRNT_2; Domain location=26-63; Score =18.5; E_value=0.01; Accession=PF08263.3; Description=Leucine rich repeat N-terminal domain
  Pfam annotation: Domain name=LRR_1; Domain location=122-144; Score =15.4; E_value=0.21; Accession=PF00560.23; Description=Leucine Rich Repeat
  Pfam annotation: Domain name=LRR_1; Domain location=146-168; Score =12.5; E_value=1.3; Accession=PF00560.23; Description=Leucine Rich Repeat
  Pfam annotation: Domain name=LRR_1; Domain location=170-192; Score =16.9; E_value=0.071; Accession=PF00560.23; Description=Leucine Rich Repeat
  Pfam annotation: Domain name=LRR_1; Domain location=194-216; Score =13.4; E_value=0.82; Accession=PF00560.23; Description=Leucine Rich Repeat
  Pfam annotation: Domain name=LRR_1; Domain location=218-239; Score =17.9; E_value=0.035; Accession=PF00560.23; Description=Leucine Rich Repeat
  Pfam annotation: Domain name=LRR_1; Domain location=241-264; Score =10.9; E_value=2.6; Accession=PF00560.23; Description=Leucine Rich Repeat
  Pfam annotation: Domain name=LRR_1; Domain location=266-285; Score =4.2; E_value=47; Accession=PF00560.23; Description=Leucine Rich Repeat
  Pfam annotation: Domain name=LRR_1; Domain location=289-311; Score =14.9; E_value=0.3; Accession=PF00560.23; Description=Leucine Rich Repeat
  Pfam annotation: Domain name=LRR_1; Domain location=313-336; Score =8.1; E_value=8.8; Accession=PF00560.23; Description=Leucine Rich Repeat
  Pfam annotation: Domain name=LRR_1; Domain location=339-361; Score =5.5; E_value=26; Accession=PF00560.23; Description=Leucine Rich Repeat
  Pfam annotation: Domain name=Pkinase; Domain location=502-794; Score=- 33.1; E_value=1.4e-06; Accession=PF00069.15; Description=Protein kinase domain
  Pfam annotation: Domain name=Pkinase_Tyr; Domain location=514-794; Score=-76.0; E_value=8.3e-08; Accession=PF07714.7; Description =Protein tyrosine kinase
  Pfam module annotation: Pfam domain module=DUF1191::LRRNT_2::LRR _1::LRR_1::LRR_1::LRR_1::LRR_1::LRR_1::LRR_1::LRR_1::LRR_1::LRR _1::Pkinase::Pkinase_Tyr; Domain location=300-486::26-63::122 -144::146-168::170-192::194-216:...
  Pfam module annotation: Domain location=:218-239::241-264::266 -285::289-311::313-336::339-361::502-794::514-794
MGIVWFGFLLLLLSQVTLEQIEPLSSAEERESLLELRASLGLRSKEWPRKPDPCLIWVGITCQNGRVVGINISGFRRTRIGRRNPQFAVDALANFTLLQTFNASNFVLSGPIPDWFGLSLPSLRVLDLRFCSIVDAIPSTLGNLTNLTGLYLSDNNLIGNVPGTLGQLLALSVLDLSRNSLTGSVPASFAFLSNLSSLDLSANFLSGAVPTGIGTLSRLQYLNLSNNGLASLPAQLGGLASLVDLDLSENSFVGVGLPLDLTGLRNLRRMILANSMLSGVLPGRLFSDSLQFLVLRQNNFSGSLPVELWSLPRLSFLDVSANNFSGLLPNSSSAANNATVAVLNISHNKFYGGLTPALRRFAFVDLSSNYFEGKVLDFMRNVSLDINCLQNATNQRSTVKCASFYAERGLSFDNFGRPNTTKPPAAAKSSGKSNKTKIILAAVLGGVGLIAILVFLLVLLLLCARKRGNSNQRGNGVGPAPVGSSPPNPGVPIDFPNVGDSFTYHQLLQATGDFNDANLIKHGHTGDFFNGVLESGIPIVIKRIDTRSAKKEAYLSELDFFNKVSHQRFVPLLGHCFENENEKFLVYKRTPNGDLSNCLYYKNTSEDGTSQSLDWITRLKIATGAAEALSYLHHECVPPIVHRDIQASSILLDDKYEVRLGSLSEVCAQEADIHQSKITRFLRLPQSSEQGTSGSSTSICAYDVYCFGKVLLELVTGKLGMSAASEAEVKEWFDQILPCISMYDKELVTKIVDPSMVVDEDFLEEIWAISIVARSCLNPKPSRRPPMRYVLKALENPLKVVREENSSSARLRATSSRGSWNATLFGSWRQSSSDVTVTPAASGTKLERASSLKLSGTTGSQSQGSFHNGGGEISSSRRRHSKEIFPEPSGVHDVERLELQ

SEQ ID NO: 195252 - protein, 59 aa, Glycine max
  Coding DNA Sequence Number=SeqID_78474
MNDKEVVQEYYSTNSNDNTPPKNLDDTAETSTPLHLKTYTLAKLLYVTRWNRAPPPSCF

SEQ ID NO: 195253 - protein, 869 aa, Glycine max
  Coding DNA Sequence Number=SeqID_78475
  Gene Ontology: Mol. function=structural molecule activity; Cellular component=coated pit; Biological process=ER to Golgi vesicle -mediated transport
  Homolog annotation: Hit_ID=Q1S9H2; Match level="QueryCoverage=99%, HitCoverage=100%, E-value=0.0, Identity=86%"; Hit description =Adaptin N terminal region, putative
  Pfam annotation: Domain name=Adaptin_N; Domain location=25-526; Score= 500.4; E_value=2.1e-147; Accession=PF01602.10; Description=Adaptin N terminal region
  Pfam annotation: Domain name=Gamma-COP; Domain location=601-867; Score=380.5; E_value=2.6e-111; Accession=PF08752.1; Description =Coatomer gamma subunit appendage doma
  Pfam module annotation: Pfam domain module=Adaptin_N::Gamma-COP; Domain location=25-526::601-867
MAQPLVKKDDDRDDEADYSPFLGIEKGSVLQEARVFNDPQLDARRCSQVITKLLYLLNQGETFTKVEATEVFFAVTKLFQSKDTGLRRMVYLMIKEISPSADEVIIVTSSLMKDMNSKIDMYRANAIRVLCRITDGTLLSQIERYLKQAIVDKNPVVASAALVSGIHLLQTNPEIVKRWSNEVQEAVQSRAALVQFHALGLLHQIRQNDRLAVSKLVTSLTRGTVRSPLAQCLLIRYTSQVIHESGHTQSGERPFYDYLESCLRHKSDMVIFEAARAITELNGVTSRELTPAITVLQLFLSSTKPVLRFAAVRTLNKVAMTHPMAVTNCNIDMESLISDQNRSIATLAITTLLKTGNESSVDRLMKQITNFMSDIADEFKIVVVEAIRSLCLKFPLKYRSLMNFLSNILREEGGFDYKKAIVDSIVILIRDIPNAKEAGLLHLCEFIEDCEFTYLSTQILHFLGIEGPKTSDPSKYIRYIYNRVHLENAIVRASAVSTLAKFGAAVDALKVRDRATLYLNTLGGDGSVVETDKDVKDFLFGPFDVPLVNLETSLKNYEPSEEAFDINSVPKEVKFQPLAEKKAPGKKPTGLGAPPSGPPSTADAYERMLSTIPECANFGKLFKSSAPVELTEAETEYAVNVIKHIFDRHVVFQYNCTNTIPEQLLEDVIVTVDASDADEFSEVFSKPLRSLPYDSPGQTFVAFEKPEGVPTVGKFSNVLKFIIKEVDPTTGEAEDDGVEDEYQLEDLEIVAADYVLKVGVSNFRNAWESLGPDFERVDEYGLGPRESLAEAVNTVINLLGLEPCEGTEEVPPNSRSHTCLLSGVFTGNIKVLVRLSFGLDGPKDIAMKLSVRSEDETVSDTIHEIVASG

SEQ ID NO: 195254 - protein, 134 aa, Glycine max
  Coding DNA Sequence Number=SeqID_78476
MQFQFQSHMQSQGLALPLEPEVGPSVARASTKESCVDPLGNDPNTDFMRDQQPFTTSLCAMIKSRFGVEKVRDADAPILVPTEEGALGSMKSADRPNHDVDDPLYLMTLTISQLFLKSLQVMCDVVGCYRVWGD

SEQ ID NO: 195255 - protein, 477 aa, Glycine max
  Coding DNA Sequence Number=SeqID_78477
  Gene Ontology: Mol. function=signal transducer activity; Cellular component=heterotrimeric G-protein complex; Biological process =signal transduction
  Homolog annotation: Hit_ID=Q8LJQ7; Match level="QueryCoverage=94%, HitCoverage=100%, E-value=0.0, Identity=73%"; Hit description=G protein beta subunit
  Pfam annotation: Domain name=WD40; Domain location=100-138; Score =19.7; E_value=0.011; Accession=PF00400.22; Description=WD domain, G -beta repeat
  Pfam annotation: Domain name=WD40; Domain location=142-180; Score =18.3; E_value=0.028; Accession=PF00400.22; Description=WD domain, G -beta repeat
  Pfam annotation: Domain name=WD40; Domain location=191-230; Score =34.8; E_value=2.9e-07; Accession=PF00400.22; Description=WD domain, G-beta repeat
  Pfam annotation: Domain name=WD40; Domain location=238-278; Score =33.9; E_value=5.4e-07; Accession=PF00400.22; Description=WD domain, G-beta repeat
  Pfam annotation: Domain name=WD40; Domain location=283-321; Score =44.6; E_value=3.4e-10; Accession=PF00400.22; Description=WD domain, G-beta repeat
  Pfam annotation: Domain name=WD40; Domain location=333-368; Score =14.8; E_value=0.31; Accession=PF00400.22; Description=WD domain, G -beta repeat
  Pfam annotation: Domain name=WD40; Domain location=406-444; Score =23.8; E_value=0.00061; Accession=PF00400.22; Description=WD domain, G-beta repeat
  Pfam module annotation: Pfam domain module=WD40::WD40::WD40::WD40::WD4 0::WD40::WD40; Domain location=100-138::142-180::191-230::238 -278::283-321::333-368::406-444
MSVTELKERHLAATETVNSLRERLKERRLSLLDTDIAGYARSQGRSPVTFGPTDLVCCRTLQGHAGKEISKLTISKGGSGYLHLGGISSATTPSPLVQLGQPRRLALTRLKEVYSLDWTSEKNRIVSASQDGRLIVWNALTSQKTHAIKLPCAWVMTCAFSPTGQSVACGGLDSVCSLFNLNSPTDRDGNLAVSRMLSGHKGYVSSCQYVPDEDTHLITGSGDQTCVLWDITTGLRTSVFGGEFQSGHTADVLSISINGSNSRMFVSGSCDSTARLWDTRVASRAVQTFHGHQGDVNTVKFFPDGNRFGTGSDDGTCRLFDIRTGHQLQVYHRQHGDNEAAHVTSIAFSMSGRLLFAGYTNGDCYVWDTLLAKRPKRSIECLRVGIKMKSSVRHYLIHDLALRVVLNLGSLQNTHEGRISCLGLSADGSALCTGSWDTNLKIWAFGGYRRTLQLSKIDLLHLPQTAVKNDGVTDKGS

SEQ ID NO: 195256 - protein, 435 aa, Glycine max
  Coding DNA Sequence Number=SeqID_78478
  Gene Ontology: Mol. function=protein serine/threonine kinase activity; Cellular component=membrane; Biological process=protein amino acid phosphorylation
  Homolog annotation: Hit_ID=Q1S9G6; Match level="QueryCoverage=76%, HitCoverage=73%, E-value=1e-163, Identity=82%"; Hit description =Protein tyrosine kinase, putative
  Pfam annotation: Domain name=Pkinase; Domain location=123-394; Score =135.2; E_value=1.8e-37; Accession=PF00069.15; Description=Protein kinase domain
  Pfam annotation: Domain name=Pkinase_Tyr; Domain location=123-394; Score=130.2; E_value=5.7e-36; Accession=PF07714.7; Description =Protein tyrosine kinase
  Pfam module annotation: Pfam domain module=Pkinase::Pkinase_Tyr; Domain location=123-394::123-394
MAASATSTGGALPELTNRTPLLGLKLYVLLLIVALIVIATVVLILVFVRRSRSSKKRKMRVKHSSGAIPLVSKEIVEVNTLELKIDPKKKEVEMEESASVESPNIGWGRWYSLKELENATEGFAEQNVIGEGGYGIVYKGILMDGSVVAVKNLLNNKGQAEKEFKVEVEAIGKVKHKNLVGLVGYCAEGAQRMLVYEYVDNGTLEQWLHGDVGPASPLTWDIRMKIAVGTAKGLAYLHEGLEPKVVHRDVKSSNILLDKKWNAKVSDFGLAKLLGSEKSYVTTRVMGTFGYVSPEYASTGMLNEGSDVYSFGILLMELITGRSPIDYSRPPGEMNLVDWFKGMVASRHGDELVDPLIDIQPSPRSLKRALLVCLRCIDLDVSKRPKMGQIVHMLEADDFPFRSELRTNREKDPAASSKIPYPTRHVEPADKSSWR

SEQ ID NO: 195257 - protein, 50 aa, Glycine max
  Coding DNA Sequence Number=SeqID_78479
MRGFYFRHPKTLKPDDAQDSSLLGRDNRVQYHVETSWLSRFITFKALKFC

SEQ ID NO: 195258 - protein, 48 aa, Glycine max
  Coding DNA Sequence Number=SeqID_78480
  Homolog annotation: Hit_ID=Q1SI48; Match level="QueryCoverage=79%, HitCoverage=7%, E-value=3e-11, Identity=87%"; Hit description=AMP -dependent synthetase and ligase
MVHGVGAIEFIICHSEVSIALAEEKKIPELFKTFPNATKYLKRSNSEL

SEQ ID NO: 195259 - protein, 352 aa, Glycine max
  Coding DNA Sequence Number=SeqID_78481
  Gene Ontology: Mol. function=O-sialoglycoprotein endopeptidase activity; Cellular component=chromosome, telomeric region; Biological process=proteolysis
  Homolog annotation: Hit_ID=O49653; Match level="QueryCoverage=95%, HitCoverage=95%, E-value=1e-180, Identity=90%"; Hit description =Glycoprotein endopeptidase - like protein
  Pfam annotation: Domain name=Peptidase_M22; Domain location=26-304; Score=234.4; E_value=2.5e-67; Accession=PF00814.15; Description =Glycoprotease family
MKRMIALGFEGSANKIGVGVVTLDGTILSNPRHTYITPPGQGFLPRETAQHHLQHVLPLIKSALETAQITPHDIDCLCYTKGPGMGAPLQVSAIVVRVLSLLWKKPIVAVNHCVAHIEMGRIVTGADDPVVLYVSGGNTQVIAYSEGRYRIFGETIDIAVGNCLDRFARVLTLSNDPSPGYNIEQLAKKGEKFIDLPYVVKGMDVSFSGILSYIEATAAEKLKNNECTPADLCYSLQETLFAMLVEITERAMAHCDTKDVLIVGGVGCNERLQEMMRTMCSERGGRLFATDDRYCIDNGAMIAYTGLLEFAHGASTPLEDSTFTQRFRTDEVKAIWREANLAKLNGLAEKST

SEQ ID NO: 195260 - protein, 520 aa, Glycine max
  Coding DNA Sequence Number=SeqID_78482
  Subcellular localization annotation: CTP_CleavageSite=41; ConfidenceScore=5.51e-01
MQPVSATGLRRHVQTSLVQHHRSAKRNGRTKQPVSPPCYKSSMQVAPYNHVNPISSLEFKGWITESSRNPKTSRELLKVLNRIWSLEEQHASNISVVKALKMELELSWAQVKELQQEKQLNKRDMENLMEQIAEEKLVRKNKEHDKIKAAIQSVMQEIEDERRLRKHSESLHRRLARELSEVKSSFSGSLRDLEKERKTRILLENLCDDFAKGIRDYEYEVRSLMPNNAEKGQVKGDSLDRLIHLSEAWLDGRKQMKLAQAGHDLPEIDSSIVDKLGVDIETFLHAKRSFNSSTKEPMQIYPCLHSLDNNNKIEEVHKEKKGMNNSARKQVVQSKEITEDCSELQAHVMKSMLSCDENESWFVERKSSESTALFNTPGASTVGEATQGQPESNTLLWTKKMNSSHVVRNSSLSSEGNDNKVYPESIFREDSFVHSAVTGNGSPVKQWKSTLIIPDFDKSESCSKLPTKDNNTLMAKLLEARLERQKSRSRASISKREVSDENHGNVSGSCNGINTLIFCQ

SEQ ID NO: 195261 - protein, 1093 aa, Glycine max
  Coding DNA Sequence Number=SeqID_78483
  Gene Ontology: Mol. function=protein kinase activity; Cellular component=nucleus; Biological process=protein amino acid phosphorylation
  Homolog annotation: Hit_ID=Q9FLH0; Match level="QueryCoverage=78%, HitCoverage=81%, E-value=0.0, Identity=43%"; Hit description =Putative nuclear matrix constituent protein 1-like protein
MELSTPNSSSKHLSITPGSRVLRNPLSDEQIWKRLRDAGFDEESIKHKDKAALIAYIAKLEAEKAEVVVWNFVVLGETVDSGQNSFGPPPTLYYSDISNFLFILVHIYDHQHHMGLLILEKKDLASKYEQVKALAESSELMHKHDSTMNKSALTESKKREESLKKTVSIKDACIASLEKALHELRTESAETKVAAESKFVEARQLIDEAQKKFTEAEAKVRAAESLQAEAKRYHNVAERKLHDVEAREDNLRRQIISFKSDCDEKDKEMIIERQSLSERQKGLQQEQERLLQSQSLLNQREEHFLSRSQELNRLQRELEDTKVKFEKEHEALYDEKTTLKLKEATLIQQEEELAKWKSELSKKEQELLEFQAKLSNRESDKTQKVVASQEAALRTKKYNLEVELQMQRKLVENEIEEKRRAWELKEVDLKHCEDQILERQHELEVLSRSLSEKEKDLKDLSSALEEKDQRLSAAEKDFELNKVLLQKEKDHVEQAKQDVQKSLESLEDKIRQVDMEKEKLEAMKSETGDLSILEVKLKEEIDLVRSQKLELLAEAEKLKAEKAKFEAEWELLDEKKEELREEAEFIAKEREAVSTFIRNERDQLREEKENLHNQYNQDLGFLASEREKFMNKMAHEHAEWFGKMQQERADFLREIELQKQELNNLIEKRREEVESYLKEREKAFEEEKNTELQYINALKEKAAKELEQVSLEMKRLQTERAEINLDRERRNREWAELTNCIEELEVQRDKLQKQRELLHADRIEIYAQTEELKKLEDLKAVSDDNAITEMLKSDMESNQKKISARKNLKHQSLTHGGDRISNGFDTPLVQKSTVSPPSPVRFSWIKRCTELIFRNSPERPLERNEDFLMGSDTGNVSNLKKHLENDEPLGNIGKRQEIGFALEEPKVIVEVPSLDDARRSEIESEAKDVNGKSALLIPDGHRAGRLKRRRGNMTDKVGNPFVDVGQNKKSRAEEQTNEKVQSGVSKVQQVLTSSNQTQGNTEETRVVIMVDKVIHVSEVTSEKLDVLPILSQEPRDNFPSPTLGADQCNLHGETIDQSNYKTRQEDVLPCASSVLGSTEEISKGNNEQVSEHC

SEQ ID NO: 195262 - protein, 82 aa, Glycine max
  Coding DNA Sequence Number=SeqID_78484
MNDLNLPTATSQNHVDFGWPVAENRITGVNCGSESTAALADDVASKNDGHTLTHMPSFNFSKLFNSITILFWIIVTDEYDVI

SEQ ID NO: 195263 - protein, 135 aa, Glycine max
  Coding DNA Sequence Number=SeqID_78485
  Homolog annotation: Hit_ID=O82343; Match level="QueryCoverage=31%, HitCoverage=7%, E-value=2e-12, Identity=76%"; Hit description =Expressed protein
MASTVLLPNTSLFVTGISPFSLGIQLNQMKQFKIEVEEEVEQVVAVVAVAEDFNSDLFDPGMVMDSSSSDYSRSASSSDADFGFAFNDSNFSDRILRIEIMGDPVEARPDSEGCTTIADWARHRKRRREDIKKDN

SEQ ID NO: 195264 - protein, 102 aa, Glycine max
  Coding DNA Sequence Number=SeqID_78486
  Gene Ontology: Mol. function=3'-5'-exoribonuclease activity; Biological process=RNA processing
  Homolog annotation: Hit_ID=Q9SP08; Match level="QueryCoverage=65%, HitCoverage=27%, E-value=5e-20, Identity=73%"; Hit description =Exonuclease RRP41
MASNTHSPPFEILIGGPEDFSLWTEPPFANGQPKDSVGGPDVTVGILPKLDKVTLLQMDSKLPIDILENVMQLAIEGCKAIANYIREILLANTKQLEYRRGV

SEQ ID NO: 195265 - protein, 400 aa, Glycine max
  Coding DNA Sequence Number=SeqID_78487
  Gene Ontology: Mol. function=isomerase activity; Cellular component =cytoplasm; Biological process=carbohydrate metabolic process
  Homolog annotation: Hit_ID=Q6Z3M0; Match level="QueryCoverage=75%, HitCoverage=88%, E-value=1e-107, Identity=64%"; Hit description =Putative Aldose 1-epimerase
  Pfam annotation: Domain name=Aldose_epim; Domain location=102-384; Score=193.3; E_value=5.9e-55; Accession=PF01263.10; Description =Aldose 1-epimerase
MRSCIILLLLFASKTWCRFRLGIPNSGLFKELLNLSEFVQYLLSFSVVNLTSFKDMLRCVPGVSWIPLLSSGIGMYQIWEAYKAVWDYRAATEITKDWNGIHQIVLRTPRGASAQVSLHGAQVTSWRNEHGEELLFTSSKAIFKAPKAIRGGIPICFPQFGNCGSLELHGFVRNRMWAIDDNPPPLPANDSSGKSFIDLVLKSSEEDMKCWPYSFEFHLRVSLTTDGDLTLISRVRNINGKPFSFSFAYHTYLLVSDIRTRNFILSLLINTHINNDSEIRIEGLETLDYLDNLFQKERFTEQGDAITFESEVDRVYLSSPNIIAVLDHERKRTFVIRKDGLPDVAVWNPWEKKSKSMSDFGDEDNRETCELEAGRGMDWAAAALDCAVKFLQRPSRSGQK

SEQ ID NO: 195266 - protein, 141 aa, Glycine max
  Coding DNA Sequence Number=SeqID_78488
MVATTPQPRINLESLFDFNGNNNHEFRFIVDDNNHRFRFIIVECYVSNEKSGRTPCRQNLPLNFSPLHVSERSTATLILQRAPVVRVGGGSAVSVRQFKRSIALFLKNPSRSPTKLPCLKFQRCKKGGGKAIAARMTKYSI

SEQ ID NO: 195267 - protein, 475 aa, Glycine max
  Coding DNA Sequence Number=SeqID_78489
  Gene Ontology: Mol. function=protein dimerization activity; Cellular component=nucleus; Biological process=regulation of transcription, DNA-dependent
  Homolog annotation: Hit_ID=Q68AN1; Match level="QueryCoverage=94%, HitCoverage=95%, E-value=1e-136, Identity=60%"; Hit description=BZip transcription factor
  Pfam annotation: Domain name=MFMR; Domain location=1-187; Score =356.1; E_value=5.7e-104; Accession=PF07777.2; Description=G-box binding protein MFMR
  Pfam annotation: Domain name=bZIP_1; Domain location=329-393; Score =92.4; E_value=1.4e-24; Accession=PF00170.11; Description=bZIP transcription factor
  Pfam annotation: Domain name=bZIP_2; Domain location=329-383; Score =35.2; E_value=2.2e-07; Accession=PF07716.5; Description=Basic region leucine zipper
  Pfam module annotation: Pfam domain module=MFMR::bZIP_1::bZIP_2; Domain location=1-187::329-393::329-383
MGNSEEEKSTKTEKPSSPVTVDQANQTNQTNIHVYPDWAAMQAYYGPRVTMPPYYNSAVASGHAPHPYMWGPPQPMMPPYGPPYAAIYPHGGVYTHPAVPIGPHTHSQGVPSSPAAGTPLSIETPPKSSGNTDQGLMKKLKEFDGLAMSIGNGHAESAEPGGENRLSESVDTEGSSDGSDGNTSGANQTRRKRSREGTPTTGETAKVFNFAISLTNVADSKMGFIVITDMIQYRISMYLVLMVVLFCTVQADGEGKTEMQGSPISKETAASNKMLAVVTAGVAGTIVGPVVSSGMTTTLELRNPSSVHSKASAPQPCPVLPAETWLQNERELKRERRKQSNRESARRSRLRKQAETEELARKVESLNAENATLKSEINRLTESSEKMRVENATLRGKLKNAQLRQTQEITLNIIDSQRATPISTENLLSRVNNNSGSNDRTVEDENGFCENKPNSGAKLHQLLDTSPRADAVAAG

SEQ ID NO: 195268 - protein, 93 aa, Glycine max
  Coding DNA Sequence Number=SeqID_78490
MEEITCLGHSWTPLRTVSEDEFENHLLSLNMKEKFIIHLEAQWRGRIKNQILEDDDAVHNGFGTEGDDDDVWAEMTRCLGSKTMSITMGVSIR

SEQ ID NO: 195269 - protein, 142 aa, Glycine max
  Coding DNA Sequence Number=SeqID_78491
MTEGLGEAVGEYSMCLHVSKGEEGMRKEIILAVGFDEWSRGRWKGEILMQKLESNELKRLRENWHYQLIAAKVLRSHQRTRRNKNKISFQEKKNNKEVISFSFIFCSTILDSVDDLIREAEREAYYSVLRAFRGQSVVGLSW

SEQ ID NO: 195270 - protein, 63 aa, Glycine max
  Coding DNA Sequence Number=SeqID_78492
MADNRQQMHRRHLQSPSTHLQKLERCLRPMVDQQATKSEAKAQDIKEALLGGNLVPFKFLLVI

SEQ ID NO: 195271 - protein, 171 aa, Glycine max
  Coding DNA Sequence Number=SeqID_78493
MNEWSNGLGHRSVYGFLEPQSIHNAKDRRGQCEEYIEKWLKESQRQLYIGAYLNDRLTYFKVGGYNSEHYINIILIFQCNAYKKLNTTADGKVPKTGPQWLELKTHIQRGGYECGYYVMHWMWNIIGAELKSDWSVWFGDGSALDPEAITTLRKKWVAYFLKLRTIQCTKL

SEQ ID NO: 195272 - protein, 539 aa, Glycine max
  Coding DNA Sequence Number=SeqID_78494
  Gene Ontology: Mol. function=drug transporter activity; Cellular component=membrane; Biological process=multidrug transport
  Homolog annotation: Hit_ID=Q1S7F1; Match level="QueryCoverage=96%, HitCoverage=89%, E-value=0.0, Identity=73%"; Hit description=Multi antimicrobial extrusion protein MatE
  Pfam annotation: Domain name=MatE; Domain location=14-174; Score =135.8; E_value=1.2e-37; Accession=PF01554.9; Description=MatE
  Pfam annotation: Domain name=MatE; Domain location=235-398; Score =163.9; E_value=4e-46; Accession=PF01554.9; Description=MatE
  Pfam module annotation: Pfam domain module=MatE::MatE; Domain location=14-174::235-398
AMEEIKAIGRISCPTAITGLILYSRAMISMIFLGYLGEMELAGGSLSIGFANITGYSVISGLAMGMEPICGQAYGAKQWKILGLTLQRTVLLLLSTSIPISFMWLNMKRILLWSGQDQEIASVAQTFITFSIPDLFLLSLLHPLRIYLRTQSITLPLTYCSAISVLLHVPLNFLLVVHLKMGIAGVATAMVLTNLNLILFISSFVYFSGAYKASWVSPSVDCIKGWSSLLSLAIPTCVSVCLEWWWYEFMIMLCGLLVNPKATIASMGILIQTTSLVYVFPSSLSLGVSTRVGNELGAKNPRKARVSMIVSLFCALALGLAAMLFTTLMRHQWGRFFTNDHEILELTSLVLPIAGLCELGNCPQTTGCGVLRGSARPTIGANINLGSFYLVGMPVAILLSFVAKMGFPGLWLGLLAAQASCAGLMFYVLCTTDWNVQVERAKELTKSSTTTTTAMTATIATTSCSTSPNCNYKLLPTLTKKEANMNKNAHVCLEEIVITSGGGGDELTKISSVETDPLIIPTTKHTQGFLPDFGTDPIP

SEQ ID NO: 195273 - protein, 108 aa, Glycine max
  Coding DNA Sequence Number=SeqID_78495
MARLDSIKIMSPSKREKAHNRDNNEMLMLRVEVFLGILSLATLLRYCREEGMKGGGDGKFNLFLLVCHKLCSVKKGEEEREKDTKGRGKKGHRRQKSPLTMTSSGSSQ

SEQ ID NO: 195274 - protein, 63 aa, Glycine max
  Coding DNA Sequence Number=SeqID_78496
MEEAPEPEIVAQALEVEMKPLSPFEAILLRKIDQIYSWKLKQNEAHNEYMENIVRGWKTLKRS

SEQ ID NO: 195275 - protein, 311 aa, Glycine max
  Coding DNA Sequence Number=SeqID_78497
MAVATLFGKLREYELELERLKDEEFDKKKKGLALKQMITKDDDKGDDKKLKGQSKNEFKIFKIESRTLQDSREKLISRIKIQEIKISRIKIEEIQIQESREGLIKISMKRVHLLGLLTENKRGYISCGSVLVEGTSTRFKENKGGYILCGSLLVKGFLQGHLIQQEANLCLTANIDEDETKSNEVYDLRNEKVDSEKFIEDSTCKCKSSNIASSSVSFIDVDDDSAMDNVVFNIPPLPPPHTAPKDDVLPVLFAIVYDSSNDDYVVVVVTMRYPAMVVECFSLRNNSWTFTERRMLEYLIIIIFPSVKGSS

SEQ ID NO: 195276 - protein, 109 aa, Glycine max
  Coding DNA Sequence Number=SeqID_78498
MSEEKVNTKGAQKKLMTKHQRSTKRDSSYWEYIDALHSVQNSMGEDSWLLVHNHLLKELDKWSDEYINLLGSIDKFEKLKRSLLVDGLSIVTMDKWMDMRHEISHCIKV

SEQ ID NO: 195277 - protein, 195 aa, Glycine max
  Coding DNA Sequence Number=SeqID_78499
MKNSSNTNSYPLRVGALLAKWRWELMCENELLWCEVLVSKYGEWRGLEGALSDHSTPLWWRGLVDESGARIDQLWKSCYSWCELLVVLPLHPSDHFSQHVIQSVWSSLVWAYGTTGTISYLEEKLFAKRKLSIKHGITHGSGYKGDIGKRLLCFFCTTALEQGPVFWRIMDEDQILWKVLLITVCNVGIARNIYY

SEQ ID NO: 195278 - protein, 424 aa, Glycine max
  Coding DNA Sequence Number=SeqID_78500
  Gene Ontology: Mol. function=sucrose transporter activity; Cellular component=integral to plasma membrane; Biological process=sucrose transport
  Homolog annotation: Hit_ID=Q84RQ3; Match level="QueryCoverage=83%, HitCoverage=64%, E-value=1e-129, Identity=68%"; Hit description =Sucrose transporter 4 protein
MLGKDPRRTRVANAYYSLFMAIGNILGYATGSYSGWYKIFTFALSPACTISCANLKSAFFLDIAFIAVTTYISIMAAHEVPLNSSEAAHAEAGAGESGSAEEAFMWELFGTFKYFTTPVWIILSVTALTWIGWFPFTLFDTDGWVERFMVVIQIKALVYDTGVRMGALGLLLNSVVLALTSLFMERLCRKRGAGFVWGISNIMMTVCFLAMLVVTYVANNMGYIGKDLPPTGIVIAALIIFTILGFPLAITYSVPYALISTHIESLGLGQGLSMGVLNLAIVVPQLTSSVRHVDVMCSDGSYVGGDVIIVSLGSGPWDQLFGGGNSPAFAVAAVSALISGLIAVLAIPRSGAQKARSHCYYFLKQALGTIFVYDPDDGDLPHCKLVLLVQDVLFEVNCKEVKASSMGSKVPSWATFFPTKTSCC

SEQ ID NO: 195279 - protein, 249 aa, Glycine max
  Coding DNA Sequence Number=SeqID_78501
  Gene Ontology: Mol. function=transporter activity; Cellular component= outer membrane; Biological process=transport
  Homolog annotation: Hit_ID=UPI00006B5F4D; Match level="QueryCoverage =85%, HitCoverage=20%, E-value=1e-38, Identity=38%"; Hit description =putative outer membrane receptor protein
  Pfam annotation: Domain name=Plug; Domain location=47-154; Score =67.7; E_value=3.8e-17; Accession=PF07715.5; Description=TonB -dependent Receptor Plug Domain
MKKNQCKIGALAMILIAEFGFAQNRDSLSAKEQSIKEVVVVAFGKQKKEEITGSVQSLKTKDIANLQNGNILQGIGGKVAGVQVVSSGQPGSQPVIRMRGIGSINASSDPLIVLDGIPYNGNLNSIPGSDIESISFLEDASSNALYGSRGANGVIIVNTKRGKSKGLHIEADIRTGVNFRSVEDYSVYTSPQDYYTAYYNRARIGEIARLTQPGAVPSGTNPHEVGIAALTSLRYNAYNVPFSQMIGQD

SEQ ID NO: 195280 - protein, 117 aa, Glycine max
  Coding DNA Sequence Number=SeqID_78502
MQEQRKPLTKTVVVVANGSTATMNANSREGRHDNEKKTKERSAVIVTTITTIDCGSNSDDGYVGSDDDCHRCDHSVVVVVAIVTTRKVMLVVAAVDNHDGDYSGGHDSCDGNGWWSW

SEQ ID NO: 195281 - protein, 267 aa, Glycine max
  Coding DNA Sequence Number=SeqID_78503
  Gene Ontology: Mol. function=RNA-directed DNA polymerase activity; Biological process=RNA-dependent DNA replication
  Subcellular localization annotation: CTP_CleavageSite=24; ConfidenceScore=5.22e-01
MINFQKSEIFFSSSTPQSSIQTISSRLGKDFGSASTIGHPKICQRPDELQKMMSSFWWGSRNQSRKGINWLQRDKLTMKKEFGRGNEVEYWKQSIHKPLVPVVAQLSPRILGFIYKSPWVVYQYVKDSSLEELIAHLSVVSAHENEWHIFIACVKAKEIWIAANLWDVIRGKIDSTDSYNDLIFSLLEHLQPHDSNMNHTNTLPPQVAATYVWNPPHTGSLKCNLDVALFIDQNKFGIGFCMRDDQGTFIKARTELYPGTPTAHEAE

SEQ ID NO: 195282 - protein, 141 aa, Glycine max
  Coding DNA Sequence Number=SeqID_78504
MYKDNWTQPWPMGLKIYPEVHENHRAFFNSSSPILLEPLAHGSSDRIQGTNRLRILCPNTLEDTSFVAQVEGTSTWVVILRTREGTSLVDQFKWRVHPLGCSKRIREGTSFVDLWLVKDFTRFKEISKTVGCLGTGCRHRL

SEQ ID NO: 195283 - protein, 111 aa, Glycine max
  Coding DNA Sequence Number=SeqID_78505
  Gene Ontology: Mol. function=transcription regulator activity; Cellular component=nucleus; Biological process=regulation of transcription
  Homolog annotation: Hit_ID=Q1SCX7; Match level="QueryCoverage=61%, HitCoverage=26%, E-value=4e-14, Identity=61%"; Hit description=Helix- loop-helix DNA-binding
AEKNELREEKLVLKADKERIEKQLKALPVAPAGFMAPPVAAAAAAYQAGVNKMAVYPNYGYIPMWQYLLNLAVTAERHGVEGDVMGPVSRGALVMKVRWQVVVVGVTVNDE

SEQ ID NO: 195284 - protein, 438 aa, Glycine max
  Coding DNA Sequence Number=SeqID_78506
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=Q7XJN4; Match level="QueryCoverage=83%, HitCoverage=82%, E-value=1e-160, Identity=80%"; Hit description =Glycerol-3-phosphate dehydrogenase
  Pfam annotation: Domain name=ApbA; Domain location=102-246; Score= -28.4; E_value=0.048; Accession=PF02558.6; Description=Ketopantoate reductase PanEApbA
  Pfam annotation: Domain name=NAD_Gly3P_dh_C; Domain location=285-429; Score=202.1; E_value=1.3e-57; Accession=PF07479.4; Description=NAD -dependent glycerol-3-phosphate deh
  Pfam annotation: Domain name=NAD_Gly3P_dh_N; Domain location=100-262; Score=179.0; E_value=1.2e-50; Accession=PF01210.13; Description=NAD -dependent glycerol-3-phosphate deh
  Pfam module annotation: Pfam domain module=ApbA::NAD_Gly3P_dh_C::NAD _Gly3P_dh_N; Domain location=102-246::285-429::100-262
  Subcellular localization annotation: CTP_CleavageSite=82; ConfidenceScore=5.66e-01
MAALSEAPFFSSKPHSTNLPPTKFHTFPSKPISLTFRSTYTPCFANASPSLPQDPDPGTDSDPDPTRDRRRIVRVAWEKIVRWSRSWRSKANTDVLQRTNKVVVLGGGSFGTAMAAHVANRKAELEVIMLVRDPQVCLSINERHCNCKYFPDHRLPENVVATMDAKSALLGADYCLHAVPVQFSASFLESVAEYVDPGLPFISLSKGLELNTLRMMAQIIPHALRNPRQPFVALSGPSFALELMDKLPTAMVVASKDKKLANTVQQLLASNIDADVQLVISDNSSDVTGVEIAGALKNVLAIAAGIVEGMNLGNNSMAALVSQGCSEIRWLATKMGAKPTTITGLSGTGDIMLTCFVNLSRNRTVGVRLGSGEKLENILSSMNQVAEGVSTAGAVIALAQKYNVKLPVLTAVARIIDNELTPKKAVFELMSLPQVEEV

SEQ ID NO: 195285 - protein, 179 aa, Glycine max
  Coding DNA Sequence Number=SeqID_78507
GAEDEVSLCVLLGFSSYRQQKVFTDNHSGISARQRDSKVSMTDRVSAEDDGAEDDVSLCVLSGFSSYRQQKVYTDNHSSISARQRDSKVSMTDLVSAEDDVNLRVLTGIQQKVYTENHSGISARQRDSKVSMTDLVSAEDDGAEDDVSLYVLSGFSSYRQQKVCTDNHSGIFACQRDSK

SEQ ID NO: 195286 - protein, 76 aa, Glycine max
  Coding DNA Sequence Number=SeqID_78508
MSKKGSAAVHMILVRGQGAHRRAKILFLLFGYAIFEGCVILKEKIGRAVWFGANGFLRRQRLLGFSRLLFHRSSAP

SEQ ID NO: 195287 - protein, 224 aa, Glycine max
  Coding DNA Sequence Number=SeqID_78509
  Gene Ontology: Mol. function=solute:hydrogen antiporter activity; Cellular component=integral to membrane; Biological process =regulation of pH
  Homolog annotation: Hit_ID=Q1SA42; Match level="QueryCoverage=94%, HitCoverage=29%, E-value=8e-39, Identity=41%"; Hit description =Na+/H+ antiporter-like protein, putative
MNINELFESVDILNISEHHANFNVCLHTPPHIVSDGIWGGHITEAPPLRSSFSLFLLQVIVIYTVTRALHFPIKKLGLPSIISQMMVGLIIGPSLNILEEDKIMLFPYGSQDTLATIASLGHVLFVFENGVKMDFSITTRIGKKEWVIALVGLLLPLLIGYTQLEIISTLLTQVIASVLNDLQILNSELGRLALSSALVGDILSNILIISTVVFDVNQQVDGIG

SEQ ID NO: 195288 - protein, 390 aa, Glycine max
  Coding DNA Sequence Number=SeqID_78510
  Gene Ontology: Mol. function=solute:hydrogen antiporter activity; Cellular component=integral to membrane; Biological process =regulation of pH
  Homolog annotation: Hit_ID=Q1S3D8; Match level="QueryCoverage=96%, HitCoverage=46%, E-value=3e-94, Identity=47%"; Hit description=WD-40 repeat
MSLAILLNCKGVVEVAMYSSALDKNDLEPDIYTVVITTIMITNSIVHLMVKRLYDPSRKYVGYQKRNIFNLKPDSNLRILVCIHKQYHTIPIIRALDLCTPTPEYPTTVDVLHLIELVGRSSPIFVSHKMKKGVLSHTRNSYSENVILSFKIYEDEKKGATTINPYTAISPPTLMHEDVCFLALDKVASIIILPFHRKWSINGKIEHEDKTIRSLNCKVMEKAPCSVGILVSRFVHQRDSPLRLAMIFLGGNDDREALCLANRAAKDSSVNLVVYHITTNNKDEIQDVDTMLDHAMLKDAKKECSNLKTVIHKEIIVEDGAQISSILRQMIDEHDFFIVGRRHGIVCPQTKGLQGWSEFSELGLIGDFLASTDLECKSSVLVVQQQQLFH

SEQ ID NO: 195289 - protein, 52 aa, Glycine max
  Coding DNA Sequence Number=SeqID_78511
MWYLTTAEKLKTGLKALLDDKDYVLDEDNVEVQQMAKPSKILQLLAWTWCCD

SEQ ID NO: 195290 - protein, 108 aa, Glycine max
  Coding DNA Sequence Number=SeqID_78512
MGGVYKFDETAGGYNKMQTYKGMLLDPARILRNHQGVGGLTVEFIDCFKVDVSNEITKASNEMTERYLKNLGIKYVDHEWIMVGEPATRNPEKMEEDVEAEAQHEFVP

SEQ ID NO: 195291 - protein, 321 aa, Glycine max
  Coding DNA Sequence Number=SeqID_78513
  Gene Ontology: Mol. function=metal ion binding; Cellular component =nucleus; Biological process=metal ion transport
  Homolog annotation: Hit_ID=Q1GYV1; Match level="QueryCoverage=66%, HitCoverage=51%, E-value=1e-39, Identity=41%"; Hit description =Rhodanese-like protein
  Subcellular localization annotation: CTP_CleavageSite=69; ConfidenceScore=5.63e-01
MEAHPNAAMLRTRTIIPSPPPSLALSKRLPSPSPSPSPLPLLSPSVILSEPVKPSFHRFPLFSNPHTLRTMTLSKFRGFPRPRPLAKSLEATVPTPGVVSYPSDATQRVSGGIILAPEGINGSICGTRESVEEVLTFVESDDRLKGLRRVESPVSPEEEAIHHGHSATSPLAAGEDAPFRWDHVRVKLKKEIVTLGMPTVSPIERVGKYIGPEEWNALISNPDTVVIDVRNNYETRIGKFKGAVDPCTTSFREFPSWVDEHFQLTETDDREHPKVEVNSVQPAEKEMDNKRQHMPRVAMYCTGGIRCEKATSLLLSKGFKE

SEQ ID NO: 195292 - protein, 100 aa, Glycine max
  Coding DNA Sequence Number=SeqID_78514
MAMGRVGYGYCLPNPLPRLLNISPYPYPILDGFEFIVPSPYPSDFKWRGGFGFGVGMSLVIPYPYPYPTFGYRGKPEPEPIPGQLGYYPSKSGRIRAGTT

SEQ ID NO: 195293 - protein, 139 aa, Glycine max
  Coding DNA Sequence Number=SeqID_78515
MVGVCTQVVLSACRIMPFAWYLEELGQFVYVDEVFQQTHLRKDIGQFVNDRSRRTHHTQGSSSSAEDAAEMNRLREELHLSKEEMCVFQSVVLQFLPREAGTLFINNNNLTNSRTMQITNRGTLFMTILTTDLASQNYY

SEQ ID NO: 195294 - protein, 134 aa, Glycine max
  Coding DNA Sequence Number=SeqID_78516
MPRHPAAAVLDLDTCGRVGSQVGPVGGIGDVKFGDAEGAEVKLREGGVVDEVEESGGDNEHKEEDEDEDAEGTAAYAAEVATLPFGLEGGGQHELSRRRWWRFGVGVPVTGGFLHMAGWKPTYTPQLFLQLCNT

SEQ ID NO: 195295 - protein, 648 aa, Glycine max
  Coding DNA Sequence Number=SeqID_78517
  Gene Ontology: Mol. function=nucleic acid binding; Cellular component= nuclear pore; Biological process=DNA integration
  Homolog annotation: Hit_ID=Q1RWN2; Match level="QueryCoverage=99%, HitCoverage=83%, E-value=6e-73, Identity=39%"; Hit description =Peptidase S8 and S53, subtilisin, kexin, sedolisin; Integrase, catalytic region; Zinc finger, CCHC-type
  Pfam annotation: Domain name=rve; Domain location=159-299; Score =27.5; E_value=3e-05; Accession=PF00665.16; Description=Integrase core domain
  Pfam module annotation: Pfam domain module=RVT_2::rve; Domain location=422-529::159-299
MTIVNKMRIHGDKKEDIIVVEKILRSMTPKFNFVVCFIEEAHDIEELSIDELQKDEEAMIMAINKNISNTMRINSTKEEESECRTNLNKDNGEKTNFVEKEEEVSFLMMMFSDLDETLCNTVKFGDNSTVFVLGKRTVTLQTKENSSHTISNVLFVPDLKTNLLSMGQLQEKGYEISFKDGDDAWLWHFLYGHLNFSGLKILWQKNMVIGLHQIIAPSEVYEECVAHGIKRQLTAAYTPQQNGVCERKNRTIMNVVRSLLTRSGVPKTFWPKAVNWSIHILNRSPTLIVQNMTPEEAWSGQRPSVDHFRIYGNQSKAYKLYNPITKKIIVSRDVIFDEERQQPAENDQQIPPENVADTSGSPTMASDDERPQRVRKRHAWMTDYEVTRIHQSEDPLIHFALFSDCDPTTFEEAIKESKWQKAMVEEIATIERNNTWELINLPKGHKTIGVKWVYKTKLKENGDVDKYKARLVAKGYNDAAMFDKFKKSTMIEFDMIDLGMLYYFLGIEHTYEVGLKLVRDPEGRKIDNTLYKQIVGSLMYLTATRPDITHLVSLISRYMECPREMHLLAAKRIFRYLQGTVGFGLFYKKGEKTDLVGFTDSDYAGDQDDRKCTSGYVFMIGSRAVLWSSKKQPIVTLSTTEAEFIVAT

SEQ ID NO: 195296 - protein, 75 aa, Glycine max
  Coding DNA Sequence Number=SeqID_78518
MLMENFLRSKEYWQVVSDGIPVSEASMAMTDAQKIEIEGMHLKDLEAKNYLFQAIDCPILEPSFARIHLRKFGIL

SEQ ID NO: 195297 - protein, 73 aa, Glycine max
  Coding DNA Sequence Number=SeqID_78519
MLKIKPCLDFLNPPFKLKPGSGLPLLRVSIDRDPEEGTSFKWKNPNPDSGDPEEGVLEQGARREGNNNRLSTG

SEQ ID NO: 195298 - protein, 174 aa, Glycine max
  Coding DNA Sequence Number=SeqID_78520
  Gene Ontology: Mol. function=nucleic acid binding; Biological process= regulation of transcription
  Homolog annotation: Hit_ID=Q69XQ3; Match level="QueryCoverage=89%, HitCoverage=53%, E-value=3e-40, Identity=55%"; Hit description=KH domain-containing protein / zinc finger protein-like
  Pfam annotation: Domain name=KH_1; Domain location=137-174; Score =14.9; E_value=0.022; Accession=PF00013.19; Description=KH domain
  Pfam annotation: Domain name=zf-CCCH; Domain location=6-28; Score =2.6; E_value=0.59; Accession=PF00642.15; Description=Zinc finger C -x8-C-x5-C-x3-H type (and similar)
  Pfam annotation: Domain name=zf-CCCH; Domain location=67-93; Score =34.1; E_value=4.8e-07; Accession=PF00642.15; Description=Zinc finger C-x8-C-x5-C-x3-H type (and similar)
  Pfam module annotation: Pfam domain module=KH_1::zf-CCCH::zf-CCCH; Domain location=137-174::6-28::67-93
MSNLIMSYLSCSTAGCPFGEGCHFLHYVPGGYNAVAHMMNLTPAAPPASRNVAALPPVPNGSAPPAVKTRICNKFNTAEGCKFGDKCHFAHGEWELGKHIAPSFDDHRTMGPTGVGRLAGRMEPPPGPAASFGANATAKISVEASLAGAIIGKGGVNSKQICRQTGAKTFNSRA

SEQ ID NO: 195299 - protein, 75 aa, Glycine max
  Coding DNA Sequence Number=SeqID_78521
MDSWNIVEARGSPNCGSSEKSALWVLEWMQMDESFVSLLYGVLDEKAMRMKVTMTLLLGTHNHYKGDLIKNAKRT

SEQ ID NO: 195300 - protein, 140 aa, Glycine max
  Coding DNA Sequence Number=SeqID_78522
  Gene Ontology: Biological process=embryonic development
  Homolog annotation: Hit_ID=Q01417; Match level="QueryCoverage=99%, HitCoverage=98%, E-value=2e-53, Identity=66%"; Hit description=18 kDa seed maturation protein
  Pfam annotation: Domain name=LEA_1; Domain location=8-49; Score=20.0; E_value=0.00092; Accession=PF03760.6; Description=Late embryogenesis abundant (LEA) group 1
MQGGKKAGESIKETATNIGASAKAGMEKTKATVQEKAARQHNTAAKQSATTAGHMGHGHHTTGTGTGTATYSTTGEYGQPMGAHQTSAMPGHGTGQPTGHVTEGVVGSHPIGTNRGPGGTATAHNTRAGGKPNDYGYGTG

SEQ ID NO: 195301 - protein, 293 aa, Glycine max
  Coding DNA Sequence Number=SeqID_78523
  Gene Ontology: Mol. function=transcription factor activity; Cellular component=nucleus; Biological process=regulation of transcription, DNA-dependent
  Homolog annotation: Hit_ID=Q9FK12; Match level="QueryCoverage=68%, HitCoverage=64%, E-value=5e-32, Identity=39%"; Hit description =Similarity to pathogenesis-related genes transcriptional activator
  Pfam annotation: Domain name=AP2; Domain location=99-163; Score =128.3; E_value=2.2e-35; Accession=PF00847.10; Description=AP2 domain
MEARFSEQKVVVTYKHVKPGILNAAAPKVVRISVMDPYATDEEDEDEGLVNHPRMKKFVNEIRIVEKKSSTNSESAGVNRTNVSLRQHCKGKTGGSLEEKKLRGIRQRPWGRWAAEIRDPVKRRRVWLGTYDTAEEAAMVYDKAAITFRGSNARTNFIKPPSRDVVLTNETEARVTVSGENDSSEGSSHFPSPTSVLKLQPVEIMLEEFSETDLLSKEESSSQDSFLFLDSHSPSIDCYFNFETLPPVFLGETSVTQQPVFHGNFSDISHLVNEDFQSWNWDIDSYFSDPLSL

SEQ ID NO: 195302 - protein, 197 aa, Glycine max
  Coding DNA Sequence Number=SeqID_78524
MADKKRKERNEGNRQRPKSKKKRPNTQQKERGPCLPSSLQKQLDCLNPTTSFDSIDSDDYNDNDVHEYKEERAEEDDDYSNENALSDDSGEEDDGRHTRMLQAITSMPSEAFQGSYGINLSNFSVLRLSRFTGSRETHGGVVLHGGTGIMLVPVDVSKRVPHFVAGDALGLGVPFRPLILRQSVGCLVQIATARHRQ

SEQ ID NO: 195303 - protein, 320 aa, Glycine max
  Coding DNA Sequence Number=SeqID_78525
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum; Biological process=fatty acid biosynthetic process
  Homolog annotation: Hit_ID=P48631; Match level="QueryCoverage=99%, HitCoverage=95%, E-value=1e-145, Identity=70%"; Hit description =Omega-6 fatty acid desaturase, endoplasmic reticulum isozyme 2
  Pfam annotation: Domain name=FA_desaturase; Domain location=73-279; Score=196.2; E_value=7.6e-56; Accession=PF00487.14; Description =Fatty acid desaturase
MGDTMKRVPIEKPPFTLSQIKKAIPPHFFQRSVLRSFSYLIYDLTIAFCLYYIATDYFHNLPHPLTFLAWPIYWAVQGFTLAGLWVIAHDCGHHAFRDYQLLDDNVGLVLHSALLVPYFSWKYSHRRHHSNTGSLERDEVFVPKQKSSIKWLSKYLNNPPGRVFTLAVTITLGWPMYLTFNVSCSKRACLGGLCLWISNACGQWVLVTILQHTHAALPHYNFSEWDWLRGALATVVDRDYGILNKVLHNITGTHVVHHLFSTMPHYHAMDATKAIKPILGEYYRFDETPFVKAMWREARECIYVEPDTENKGVFWYNNKL

SEQ ID NO: 195304 - protein, 158 aa, Glycine max
  Coding DNA Sequence Number=SeqID_78526
MVCNGVGRRKGVRFVEKLIELDEEGGGGWGGKGERDICEKPLNPQNYVCTAEGKVIKVEGECVTLNGNGYLRGSGVAVENTIVIHHHLECSCWQRQQIEELGHSRLDEVGILELDGVEDPAVVGVGDGGFWEENEVAGRGPRRLSLNLSSWSLAKATA

SEQ ID NO: 195305 - protein, 69 aa, Glycine max
  Coding DNA Sequence Number=SeqID_78527
MCEEEGVTNGDAEGLYLSQLVCEQSALSSGGEVWEDIWLTLHRIGTIPIMAEYSPGCLMPQGLRFVVLL

SEQ ID NO: 195306 - protein, 848 aa, Glycine max
  Coding DNA Sequence Number=SeqID_78528
  Gene Ontology: Mol. function=DNA-directed DNA polymerase activity; Cellular component=nucleus; Biological process=DNA replication
  Homolog annotation: Hit_ID=P48631; Match level="QueryCoverage=44%, HitCoverage=97%, E-value=0.0, Identity=93%"; Hit description=Omega-6 fatty acid desaturase, endoplasmic reticulum isozyme 2
  Pfam annotation: Domain name=DNA_pol_E_B; Domain location=568-779; Score=269.5; E_value=6.9e-78; Accession=PF04042.6; Description=DNA polymerase epsilon subunit B
  Pfam annotation: Domain name=FA_desaturase; Domain location=89-340; Score=350.2; E_value=3.4e-102; Accession=PF00487.14; Description =Fatty acid desaturase
  Pfam module annotation: Pfam domain module=DNA_pol_E_B::FA _desaturase; Domain location=568-779::89-340
MGAGGRTAVPPANRKSEADPLKRVPFEKPQFSLSQIKKAIPPHCFQRSVLRSFSYVVYDLTIAFCLYYVATHYFHLLPGPLSFVAWPIYWAVQGCILTGVWVIAHECGHHAFSDYQLLDDIVGLILHSALLVPYFSWKYSHRRHHSNTGSLERDEVFVPKQKSSIMWYSKYLNNPPGRVLTLAVTLTLGWPLYLAFNVSGRPYDRFACHYDPYGPIYSDRERLQIYISDAGVLAVCYGLFCLAMAKGLAWVVCVYGVPLLVVNGFLVLITFLQHTHPALPHYTSSEWDWLRGALATVDRDYGILNKVFHNITDTHVAHHLFSTMPHYHAMEATKAIKPILGEYYRFDGTPFVKAMWREARECIYVEPDQSTQSKVLAKSKETNNWSEASVPAMGMERVQCAYASLDEAFEIGKETYQGQQYSQIYFARLHLMRTLLYSLIPHWKPNSPVCTVLGLEEGKECVIVGTLYKHMKLKPCILDEYSKERSVVPLVKPHNFIHPDDHLVLEDESGRVKLSGYIISPSEYVTGIVVALLGKETGAGDFLVQDVLQAGLPPQIEFPLKSREDKYVVLVSGLSVGSSSSNPLQFQLLIDHITGHLGDEKEQSIASQIAQVVFAGNLIEIPHRLLNGQNLASKDLSRMAEPIKELDILLSQIAAGLPLDIMPGPSDPANFSLPQQSLHRCLFPGSSTYNTFRSCTNPHCFELDNVRFLGTSGQNVDDLEKYSEAKDKLEFMERTLRWRHLAPTAPNTLGCYPYTDKDPFFIESCPHVYFIGNQDKFETRVIKGSEGQLVRLVCVPKFSETGVAVMVSSKSHTLNVNLDMVRFWKFVHGAVIGVSWDISQELKIEADS

SEQ ID NO: 195307 - protein, 438 aa, Glycine max
  Coding DNA Sequence Number=SeqID_78529
  Gene Ontology: Mol. function=protein phosphatase type 2C activity; Cellular component=protein serine/threonine phosphatase complex; Biological process=protein amino acid dephosphorylation
  Homolog annotation: Hit_ID=Q8LFQ7; Match level="QueryCoverage=81%, HitCoverage=95%, E-value=1e-120, Identity=59%"; Hit description =Protein phosphatase 2C-like
  Pfam annotation: Domain name=PP2C; Domain location=91-375; Score =62.5; E_value=1.3e-15; Accession=PF00481.12; Description=Protein phosphatase 2C
MDTAIATEAKVQHVTRKSSDELLRKFAEAGSNEAGKNKRRKKKKRESECDCDSPMNGGAAVVERRSLLPPKVTRRPVRRYARMSKDGDDDDDGVDESTSSVEDSLLWRRDLLKHSCGEFSFAVVQANEVIEDHSQVEIGSDAIFVGVYDGHGGPEASRGLLAYMVLALAGIAQDNGNISEEILRGAVTATEDGFMKLVHRSYMIKPLIASIGSCCLVGVIWKGTLYIANLGDSRAVVGSLGRSNKIIAEQLTREHNACREEIRQELRSLHPQDSQIVVMNRGTWRVKGIIQFSLDPSFPRFHMPEPITQPVLTAEPSLCSRVLQPHDKFLIFASDGLWEYMTNQQAAEIVQKNPRNGVARKLVKAALKEAANKRKMKYKELQKIEKGNRRIFHDDITVIVVFIDHELLGKKITVPELSIRGFIDSAGPSNFKSVQEFM

SEQ ID NO: 195308 - protein, 375 aa, Glycine max
  Coding DNA Sequence Number=SeqID_78530
  Gene Ontology: Mol. function=DNA binding; Biological process =regulation of transcription
  Homolog annotation: Hit_ID=Q40880; Match level="QueryCoverage=97%, HitCoverage=99%, E-value=1e-101, Identity=55%"; Hit description=NAM protein
  Pfam annotation: Domain name=NAM; Domain location=23-151; Score =321.5; E_value=1.5e-93; Accession=PF02365.6; Description=No apical meristem (NAM) protein
MDNYYHQHHHPHFDNSNNNEPHLPPGFRFHPTDEELITYYLLKKVLDSSFTGRAIVEVDLNKCEPWELPEKAKMGEKEWYFYSLRDRKYPTGLRTNRATEAGYWKATGKDREIYSSKTCSLVGMKKTLVFYRGRAPKGEKSNWVMHEYRLEGKFAYHYLSRSSKDEWVISRVFQKNTTGGGSTVSAAAAATSGGSSKKTRMTTSNTSSNMSLCPEPGSPSSIYLPPLLESSPYAAASTTTATPAAAAFNDHESCSFNSAVSNNNQREHVSCFSTISAAAFDHLVPPPEPPLDPFARFHCNNNNVGVGVSTFPCLRSLHDNLNLPFFFSPMGHVSSADVASFGAVTNWPAPEEQRMADGGSGMGIVPSELDCMWGY

SEQ ID NO: 195309 - protein, 96 aa, Glycine max
  Coding DNA Sequence Number=SeqID_78531
MKKNEEQLRKKEREKRKLAEQALHEVDRSSNCASGGNDNDDGDSDNDEVNGGGDNRGNDNNNSAGNDASGGGGNSSGCGDTGGGDISHSCNIPFFS

SEQ ID NO: 195310 - protein, 85 aa, Glycine max
  Coding DNA Sequence Number=SeqID_78532
GRTLEEELVPFNPEIKAICHKNNASQKKQKQQERQTRQRARGASSYQQSTTLPFILEEPTISIPPLISKKPQMEEEDPLRVTLED

SEQ ID NO: 195311 - protein, 151 aa, Glycine max
  Coding DNA Sequence Number=SeqID_78533
  Homolog annotation: Hit_ID=Q1T097; Match level="QueryCoverage=83%, HitCoverage=12%, E-value=2e-30, Identity=44%"; Hit description =Transposase family tnp2, putative
MGTSSKLLHGAREKTINNGVYVKGIIKGGEDDCYGIIQHIYELEYNALSYPKKVVVFYCDWFDPSRKRQMYYVQYPTTQTGKHGWCVVIKTKPRGHMEFDDVEDDVPYQEGSPSHTNEVIKSEDIFAWQDVESDHEEVDEPEEPPQHVQEE

SEQ ID NO: 195312 - protein, 196 aa, Glycine max
  Coding DNA Sequence Number=SeqID_78534
  Gene Ontology: Mol. function=transferase activity
  Homolog annotation: Hit_ID=Q03520; Match level="QueryCoverage=74%, HitCoverage=58%, E-value=4e-08, Identity=25%"; Hit description =Tetrachloro-P-hydroquinone reductive dehalogenase
  Pfam annotation: Domain name=GST_C; Domain location=71-165; Score =34.6; E_value=3.4e-07; Accession=PF00043.15; Description=Glutathione S-transferase, C-terminal domain
MFRYIERIAVVSSGVESISASSREVVEWMQKIHDWDPKFFTLSHIPEKYRLYVSKFIRQVAIARMSESPELASDYHRKLKEAYETEEKLKEADVLRRSKEHLVILLDEVERQLSETPYLAGQEFTMADVMLIPVLVRLKLLDLENEYITGRPNIAEYWILVQQRPSYKKVIGMVMLGAGKRRDACQNGQSAKDLLA

SEQ ID NO: 195313 - protein, 436 aa, Glycine max
  Coding DNA Sequence Number=SeqID_78535
  Gene Ontology: Mol. function=RNA-directed DNA polymerase activity; Cellular component=intracellular; Biological process=RNA-dependent DNA replication
MMKVNYRLMRQPQRRLNPTMKEEVCKEVLKLLEVGLVYPISSSAWVSLVQVVPKKGGITVIFNDKKDLNTTRIVTSWKMCIDYCKLNDASWKDQFLFPFMDQMLERLAEQKFYCFLDGHSRYNQIAVVPKDPENTIFTCLFSAFAYRRMSFRLFNAPATFQRCMLAINLILWKNALKFSWILFQCLEKRHFMVKEGIFLGHYISSKGIEVDKAKIDVIEKLPPINLKGIRSFLGHVGDYVVGAVLGQQRNKIFYSMYYDSKVLNNAQLNYATTKKELLTIVYALEKFISYLIDYKVTIFTYHATIKYLLTKADSKPRLIKWCQRTGGISKRHEMSLHNILKVEVFYCWGIDFVGPLPSSHSNFGPVEYVSKHVEVVATKKNDDKTVIMFLNKNICSHFGVPRGLINDGGSHFCKCTTTKGLRHYNVRHKVDSPYHP

SEQ ID NO: 195314 - protein, 100 aa, Glycine max
  Coding DNA Sequence Number=SeqID_78536
MGIVESQNLKKELDNTKQETTKMKQSRKNTKGRIFKLGRGKQDESSLCRCSSPCGNNDGNNDNHNNDVHVVIGSSDGGDDNGSGKNSVGVITTVEPFKNK

SEQ ID NO: 195315 - protein, 93 aa, Glycine max
  Coding DNA Sequence Number=SeqID_78537
  Gene Ontology: Mol. function=nucleotide-sugar transporter activity; Cellular component=integral to membrane; Biological process =nucleotide-sugar transport
  Homolog annotation: Hit_ID=Q8LGE9; Match level="QueryCoverage=87%, HitCoverage=24%, E-value=9e-36, Identity=84%"; Hit description=CMP -sialic acid transporter-like protein
  Pfam annotation: Domain name=Nuc_sug_transp; Domain location=1-93; Score=-166.8; E_value=0.017; Accession=PF04142.6; Description =Nucleotide-sugar transporter
MARLLADDFRGGFENGPWWQRIFNGYTITTWMVVLNLGSTGLLVSWLMKHADNIVKVYSTSMAMLLTMILSLFLFNFKPTLQDTHSFFAVALV

SEQ ID NO: 195316 - protein, 163 aa, Glycine max
  Coding DNA Sequence Number=SeqID_78538
  Gene Ontology: Mol. function=nucleotide-sugar transporter activity; Cellular component=integral to membrane; Biological process =nucleotide-sugar transport
  Homolog annotation: Hit_ID=Q654D9; Match level="QueryCoverage=92%, HitCoverage=44%, E-value=5e-55, Identity=71%"; Hit description =Putative CMP-sialic acid transporter
  Pfam annotation: Domain name=Nuc_sug_transp; Domain location=72-163; Score=-178.5; E_value=0.097; Accession=PF04142.6; Description =Nucleotide-sugar transporter
MGVEVEEEEKKKMQWYFVASLLTVLTSSQGILTTLSQSNGEYKYDYATVPFLAEVFKWWVVSPFQLAVSSLLLWRECKKSPLPKMTTEWKTVSLFPIPSVIYLIHNNVQFATLTYVDTSTYQIMGNLKIVTTGILFRLFLGRRLSNLQWMAIVLLAVGTTTSQ

SEQ ID NO: 195317 - protein, 139 aa, Glycine max
  Coding DNA Sequence Number=SeqID_78539
MAFVEILNLSKRPFNFSLTIISDLFNLREKKFQEHAEAEKEINMNMIEEHGGGENNGTLSHLHLLNASLAELSMLLVLLSLFYFSSDECIEYHEESQEKTKDEVAVTKTCIARSQGKRREKHEPKHGRKPLSSRFQTTG

SEQ ID NO: 195318 - protein, 56 aa, Glycine max
  Coding DNA Sequence Number=SeqID_78540
MVRGNRAMKERIREAQRVFKGYIGKQIWFSSKGVVRDKLEFGMLKHGHVSFQILTR

SEQ ID NO: 195319 - protein, 234 aa, Glycine max
  Coding DNA Sequence Number=SeqID_78541
MSIVYSHAVKYSRGETRMNPEMDSNIGQHCHQQNSGLMRYRSAPSSLLTSLVNNNNNNNGYVNGESFRSEHNHHHHQQQQQQHYPPSTSSEMENMLAKLISSNNSEPLQMKEEAGDSVSQPPQQHNGYSYGSSPQMMYQTQQIQGLPIPNGSLGASGSAFDGSFSAVNSLASQNSTQPKMGASTNCNNLIRQKSSPAGFFSNYSVDNGKKKMGGNEIPGKNLRKKGIRVSCKKY

SEQ ID NO: 195320 - protein, 167 aa, Glycine max
  Coding DNA Sequence Number=SeqID_78542
  Gene Ontology: Mol. function=oxidoreductase activity
  Homolog annotation: Hit_ID=Q9C936; Match level="QueryCoverage=82%, HitCoverage=47%, E-value=1e-50, Identity=62%"; Hit description =Putative oxidoreductase; 38288-39393
MLALLIFCSKDEEAFKECLVEIINKDEEAFKEAIFAALQELFDLPLQTKILNVSKKPYHGYVGQYPMVPLFESMGIDDANVYENVESMTNIMWPHGNPSFRHIIRKMILESLGVEKYLDEHMNSTNYLLEVMKYKGPQTSDTKVGLTTHSDKNIVTILYQNEVEGLE

SEQ ID NO: 195321 - protein, 81 aa, Glycine max
  Coding DNA Sequence Number=SeqID_78543
MRVHDTIALILLKSGLSINTLRSVGSCSKSTLIHIIGRLIILKAKKEVLEKTRRCKKQQPYRELGKAWFGWVTSVKAFYTS

SEQ ID NO: 195322 - protein, 137 aa, Glycine max
  Coding DNA Sequence Number=SeqID_78544
  Homolog annotation: Hit_ID=Q1STQ3; Match level="QueryCoverage=71%, HitCoverage=55%, E-value=6e-16, Identity=47%"; Hit description =Bromodomain
  Pfam annotation: Domain name=Bromodomain; Domain location=71-137; Score=18.1; E_value=4.5e-05; Accession=PF00439.15; Description =Bromodomain
MAKLGVAANGFILEIAICYEISLNSYFFLRTSTVYSANLHVKGRNVESKGLHSVPVSGAPVILQSGIPLPDKRTLELILDKLQKKDTYGVFADLVDPKELPDYHDVIKHPMDFATMRKKLGNESSYTTLEQFENAQM

SEQ ID NO: 195323 - protein, 166 aa, Glycine max
  Coding DNA Sequence Number=SeqID_78545
  Gene Ontology: Mol. function=DNA binding; Biological process=DNA integration
MDGSVELDPRLDDDERATPNEDTSNADMFVWTASNMPNIDPKFHSYKLSVCRKVMNTTWLANMAMVKKGNEKWWMCMDYIDLNKACPKNAYPLTNIDRLVDGRLIDKVFKKKIGKNLEVYVDDMVIKGIEADPNKSRAVIYMRNPSNLKEAQWLADRFAFLARFLP

SEQ ID NO: 195324 - protein, 47 aa, Glycine max
  Coding DNA Sequence Number=SeqID_78546
MVMLRRMVGFVGDGKGFCRQCRRQRLKGWSTVDVVLYCIIESRCFGA

SEQ ID NO: 195325 - protein, 83 aa, Glycine max
  Coding DNA Sequence Number=SeqID_78547
MVRPFIATTLVDGTRRHPFVEGLMEVHLPLSWKGLTMDKYNGTMDLEKHLDVYVNQGPTLSWFTKLPPSSIDSFNTLVARLNT

SEQ ID NO: 195326 - protein, 68 aa, Glycine max
  Coding DNA Sequence Number=SeqID_78548
MTLGRKLMSFSKPVAPPSTNLAVVIDTEKATQSISLIGGDREGVAKGIGGELRRRRRDKLHGGCCNPV

SEQ ID NO: 195327 - protein, 1723 aa, Glycine max
  Coding DNA Sequence Number=SeqID_78549
  Gene Ontology: Mol. function=nucleic acid binding; Cellular component= nucleosome; Biological process=nucleosome assembly
  Homolog annotation: Hit_ID=Q7XJP0; Match level="QueryCoverage=99%, HitCoverage=99%, E-value=0.0, Identity=54%"; Hit description =SNF2/SWI2 family global transcription factor
  Pfam annotation: Domain name=Helicase_C; Domain location=1540-1627; Score=27.8; E_value=3.8e-05; Accession=PF00271.21; Description =Helicase conserved C-terminal domain
  Pfam annotation: Domain name=PHD; Domain location=417-487; Score =38.4; E_value=2.6e-08; Accession=PF00628.19; Description=PHD-finger
  Pfam annotation: Domain name=SNF2_N; Domain location=292-788; Score =70.2; E_value=6.6e-18; Accession=PF00176.13; Description=SNF2 family N-terminal domain
  Pfam annotation: Domain name=TPR_1; Domain location=825-858; Score =17.4; E_value=0.044; Accession=PF00515.18; Description =Tetratricopeptide repeat
  Pfam annotation: Domain name=TPR_2; Domain location=825-858; Score =17.6; E_value=0.044; Accession=PF07719.7; Description=Tetratricopepti de repeat
  Pfam annotation: Domain name=zf-C3HC4; Domain location=1410-1457; Score=22.7; E_value=0.00071; Accession=PF00097.15; Description=Zinc finger, C3HC4 type (RING finger)
  Pfam module annotation: Pfam domain module=Helicase_C::PHD::SNF2 _N::TPR_1::TPR_2::zf-C3HC4; Domain location=1540-1627::417-487::292 -788::825-858::825-858::1410-1457
MGRQKSKPQRAGGIILETNAAAETELDKQNVIEGGKETKGDSSGIDKPYFVEVDRCGWLSSEHLDISEVVLSDLNLREGFSGFELSEDFYRDQQYLLRFQVCNVSNVLGRIKLGHWPVIPYTDIHLEFVRRVTIDHVETYTVLLSGIFDGPDEGVTGLLHLASLKFVTLRPVLGARLSEEISSLRIRVEVLKSAFDACESLLDSSRQLWKKSMVNVMSWLRPEIMTSEVRYGFGTCMKMEVDPQIEMADDTCKARKHARFDPAGFCEAIKPSKSEPMLKDDIPELLPKLRPYQRRAAFWMVEREKAVEESRGERERNLFHSPLCIPVDFLDTSSQISQMFFNPFSGSISLCPETSSPYVFGGILADEMGLGKTVELLACVFAHRRQASGSDILIDLEPQANGDQKVTLKRLKRERVECICGAVSESLKYEGLWVQCDICDAWQHADCVGYSPKGKSLKSKQGCESKTFKTTIAVRDGEYVCQMCSELIQATESPIASGATLIICPAPILPQWHDEIIRHTHQGSLKTCIYEGVRDTSFSNTSLMDIGDLASADIVLTTYDVLKEDLSHDSDRHEGDRHFLRFQKRYPVIPTLLTRIYWWRVCLDEAQMVESNTTAATEMALRLHSKYRWCITGTPIQRKLDDLYGLLRFLKASPFDRYRWWTDVIRDPYEKEDVGAMEFTHKIFKQIMWRSSKEHVADELELPSQEECLSWLTLSPVEEHFYQRQHETCVRDAHEVIESLRSDILNRKGPDSVSLNGSSDPLITHTEAGKLLNALLKLRQACCHPQVGSSGLRSLQQSPMTMEEILMVLISKTKIEGEEALRKLVIALNALAAIAAIQNDFSQATLLYSEALSLAEEQSEDFRLDPLLNIHIHHNLAEILPLVPNFALISPSKGKQFSGTSKFKMTKRHLSVKVEHCHEKRQKISGCDDVNVTVLSEPSDVAFSHSENDLNEDQEFDSLSAINSLIAECEDSKQKYLSVFSSKLSTSQQEFQNSYTQLKKKKGKNAISVAYTGQKKKVCNAYHDSRTDQDTFWWLEALHHAEQNKDFSTELIRKIEEAISGTSNNSKSSRVTARITIKKVAEQCNTVRTDINNILFLVMNNVLVCSFRSISSLKYQIQTALDQLEASRKMLLDRLLEIDQTMEKPKEEDIERVGKCRNCQPNCDGPPCILCELDELFQDYEARLFVLKNERGGIISSAEEAVDFQKKNFALNHFLSKLSQSNHSSTVSDIGHEESKKRNVGQRVVVSKSASELELILGVLKNYCKSRLGRDSVSAATKHLHVFEGMRKEFGHARSLALAQAMYLRAHDEIKMAVSRLHLRANEDDKSLDALGENELAAASSNFSHDKFMSLTMLSQIKGKLRYLKGLVQSKQKLQFESPTSSSFTRETTATPNSTEEKDALLSKSDDETCPICQEKLGKQKMVFQCGHVTCCKCLFAMTEKRLQNSKLHNWVMCPTCRQHTDFGNIAYAVDAQHESSDPSVLHPIDSSEKFEASISVKGSYGTKIEAVTRRILWVKANDHRAKVLVFSSWNDVLDVLEHAFAANNITYIRMKGGRKAHVAISQFRGKQNGTKKCEGSTPKSIQVLLLLIQHGANGLNLLEAQHVVLVEPLLNPAAEAQAISRVHRIGQKNKTLIHRFIVKDTVEESIYKLNRSRSNHSFISGNTKNQDQPVLTLKDVEALLSRAPLTMPESDENPNRDTNLRHLPPSVAAAVAAERRLNEQRT

SEQ ID NO: 195328 - protein, 184 aa, Glycine max
  Coding DNA Sequence Number=SeqID_78550
  Homolog annotation: Hit_ID=Q9FLD2; Match level="QueryCoverage=44%, HitCoverage=57%, E-value=1e-10, Identity=51%"; Hit description =Arabidopsis thaliana genomic DNA, chromosome 5, TAC clone:K18I23
  Subcellular localization annotation: CTP_CleavageSite=99; ConfidenceScore=5.14e-01
MARVYLNLVLTRGHSSDMKGSLYVADAHMLATSSLSMSNKANNPFVLPCQTLVSHSSVRDLSFKVSISWPYHASCIVQRQKNSNNSGFVVVGCAKWGLEAEMKPQEDDEEKGRSRMARFRHKCGERKGVVALLEWLEREAIMGEDVGKEPTDYNRRAQIFDRSSQVFQALKELNNDVFPQEYSK

SEQ ID NO: 195329 - protein, 115 aa, Glycine max
  Coding DNA Sequence Number=SeqID_78551
  Subcellular localization annotation: CTP_CleavageSite=51; ConfidenceScore=5.40e-01
MAASPTTFDMPPTSPSATCSSEPHDALQLHSSFPSMSASDRKLCHCLERRRAAMEMMTTTCWWRWQNQSHSKTGGFVANNVCGCNNSTDPTLRLRTPPNRNRSKQHSCCFRILSI

SEQ ID NO: 195330 - protein, 259 aa, Glycine max
  Coding DNA Sequence Number=SeqID_78552
  Gene Ontology: Mol. function=methyltransferase activity; Cellular component=intracellular; Biological process=protein kinase C activation
  Homolog annotation: Hit_ID=Q1S5Y9; Match level="QueryCoverage=99%, HitCoverage=46%, E-value=1e-121, Identity=83%"; Hit description =Tetratricopeptide-like helical
  Pfam annotation: Domain name=PPR; Domain location=116-150; Score=0.7; E_value=6.2; Accession=PF01535.11; Description=PPR repeat
  Pfam annotation: Domain name=PPR; Domain location=152-186; Score=0.5; E_value=6.6; Accession=PF01535.11; Description=PPR repeat
  Pfam annotation: Domain name=PPR; Domain location=218-252; Score=1.5; E_value=4.9; Accession=PF01535.11; Description=PPR repeat
  Pfam annotation: Domain name=PPR; Domain location=81-115; Score=45.0; E_value=2.6e-10; Accession=PF01535.11; Description=PPR repeat
  Pfam module annotation: Pfam domain module=PPR::PPR::PPR::PPR; Domain location=116-150::152-186::218-252::81-115
MYEKMREAKIKITEVAMVGAISACAQLRDIRMSNTLTGHLEEGCCDRTHIVSTALIHMHSKCGNINLALSEFTTMRYRDVYTYSAMIAAFAEHGKSQDAIDLFLKMQKEGLKPNQVTFIGVLNACGSSGYIEEGCRFFQIMTGVFGIEPLPEHYTCIVDLLGKAGQLERAYDLIKQNASSADATTWGSLLATCRLYGNVELGEIAARHLFEIDPEDSGNYVLLANTYASKDKWEHAQEVKKLISEKGMKKKPSGYSSIQ

SEQ ID NO: 195331 - protein, 131 aa, Glycine max
  Coding DNA Sequence Number=SeqID_78553
MKVRYFLVCHTLASRRGYLSVALALISAINRKKDEGVNTPSTTANAPPNHNPPLETTSTFNHPHFSHQAFLTNIIENQEPKSFSQAMKSIEWCDAMAKEIQTLESNNTWSLCSLAEGKSPISCKWVYKIKY

SEQ ID NO: 195332 - protein, 232 aa, Glycine max
  Coding DNA Sequence Number=SeqID_78554
  Gene Ontology: Mol. function=nucleic acid binding; Biological process= DNA integration
  Homolog annotation: Hit_ID=Q1RWN2; Match level="QueryCoverage=91%, HitCoverage=16%, E-value=3e-80, Identity=71%"; Hit description =Peptidase S8 and S53, subtilisin, kexin, sedolisin; Integrase, catalytic region; Zinc finger, CCHC-type
MAESSFLQPSIPKFDGHYDHWSMLMENLLRSKEYWSLIEDGIEVAPANSTAEQRKAADDSKLKDLKAKNYLFQAIDRTILETILNKETARDIWTSMRQKFQGSTKVKRAQLQALRREFEILSMKDNETVNEYFSRTLAIANKMTAHGESMGQTKVVEKVLRSMTSKFNYVVCSIEESNDVTALTIDELQSSLLVHEQRMQYTLEKDEEQALKVSSAGRGGNRGRGRNGGRGR

SEQ ID NO: 195333 - protein, 78 aa, Glycine max
  Coding DNA Sequence Number=SeqID_78555
  Gene Ontology: Mol. function=kinase activity; Cellular component =plastoglobule
  Homolog annotation: Hit_ID=Q8H2L4; Match level="QueryCoverage=58%, HitCoverage=11%, E-value=4e-09, Identity=50%"; Hit description=ABC1 family protein kinase-like protein
MQPQELDTEIVVATTTGTATNATAVAANVVVDERQMNALFLGVVRLLYFDRYTRLLAPNLNMLQDQRISIASNRRSRV

SEQ ID NO: 195334 - protein, 89 aa, Glycine max
  Coding DNA Sequence Number=SeqID_78556
MGHEDEENDDDDNNNNDNDDDDNNNNDDDDDNGGDHVQTMLSTVKVPVKNSSTSAIFYFCPVGAASPRFVVTSPGSRGRVKNSPTSGNS

SEQ ID NO: 195335 - protein, 961 aa, Glycine max
  Coding DNA Sequence Number=SeqID_78557
  Homolog annotation: Hit_ID=Q10LU7; Match level="QueryCoverage=98%, HitCoverage=88%, E-value=1e-11, Identity=28%"; Hit description =Expressed protein
MSGESAPKPKPRLVLCPKCWQLLPESPDYDVYKCGGCGTTLQAKKRRNRAVNSESNTHETDAAPRNALNRESSTRETDAAPGNALNSESRMHETGAAPTNALDTKAHDKKYSNGEQLVSYQENGFKENATNSSSGECSLNGSGGSDQIEDGECNGEQLVTSQENGFGEKSTSSSSREGSLNGNDGRDQIEDGECNAEQPLISRENGLMAKASSSSSEECSLNGNDGRDQIENGECNGEQIEQLNLPDEELGNEMDSHKLSDMRRHTVSYNGCSDEVTYFEIEALAELIAESSVENAKNTNLQLQGEELSNGNVPLEGAVKHLISTFDKDGNDEKLAPGLQKSEVDIAGNDFEAEEELNNGNLLLEGAEKDLFSGLDREEVNNDNSALVGANPEVDINGSNEAGSEELNNRNLLLEVTEEELNECASDGGDPKHDQSGLVGAKSEVDNTRNASIPQRLSTEEGRISRAYPRELEEGTSGYHASSKAVHHSFDCVRSVDTFDNTEVINPGFETSGTLGGLSKSSTIQSYHAYDGSISSNDGVDEQFPNQYLDSFENTYTVANGVSEGGSRKGKGLVNSMLRGDLETQRQSYFREGRPRIPRDNRRNLNEVSETTRHGHAHWMRTKKDEFPLRVPHHRSGSLSGYESGSTSNQMHDELYCSSSYRSPDSFDDPDQEKMKLLRMWQCSAELPPRDLYQHEELCRPNQGHSCCSPCHSYPSSPQWLMTSNLPAHAHETNSYDQRHRPEVKKYFWEKPSLTRRHYRPVAGGAPFVTCHKCLKLLQLPADFLLFKRVYHQLKCGACQEVLKFSLQNRSHIVSYAPNALEPPSSSSNLDDRNEVIDGSNPHSVSHADHISYSDDYGHSVGKSYSSEGDPVSAAPLHPLHDSAYDKQTVSSGTLEPITEKDKNASRSPTTSKAPVETDEQAVNSSNNVSSELEAHSQPKSSPLHRLMGYTSPSQVIRGIP

SEQ ID NO: 195336 - protein, 424 aa, Glycine max
  Coding DNA Sequence Number=SeqID_78558
  Gene Ontology: Mol. function=nucleic acid binding; Cellular component= chromatin; Biological process=DNA integration
  Homolog annotation: Hit_ID=Q1RWN2; Match level="QueryCoverage=92%, HitCoverage=30%, E-value=1e-163, Identity=68%"; Hit description =Peptidase S8 and S53, subtilisin, kexin, sedolisin; Integrase, catalytic region; Zinc finger, CCHC-type
  Pfam annotation: Domain name=rve; Domain location=151-314; Score =184.1; E_value=3.5e-52; Accession=PF00665.16; Description=Integrase core domain
MPVMGKGNLKLYIGGLVQVVTEVYYLPGLMNNLLSIGQLQQKNLTIVFSNDLCKVYHENRGLIMSTQMSVNRMYIIHASVLTPMCMKVTNMSQSQLWHHRYGHLNYKGLRVLAKKEMVKGLPEIEETEEICEDCIIGKQHRDSIPKTANWRANEKLQLVHSDICGPINPTSNGGSRYFMTLTDDFSRKTWTYVLTEKANALAIFKQFKAVAEKETNCQIKCLRTDRGGEFTSTAFNDFCSENGIKRQLTAAYTPQQNGVSERKNRTIMNMVRSMLAGMKVPKRFWPEAVLWATYVLNRSPTMSVKDITPEEAWSNVKPSVHHFKVFGCLAYAHVTDTQRKKLDPKSIKCVNLGISEESKAYKLYDPVAKKIIVSRDVIFDETKGWEWDGKSQKLQSIDVEESVDPSVAEDVNAHGDSSDNESPL

SEQ ID NO: 195337 - protein, 80 aa, Glycine max
  Coding DNA Sequence Number=SeqID_78559
GPYDRKQTKEIEFAVLKREDGVAKGWVAGEYAYGVVGDGSGGWKVSCVKAREDNNEGRRRNIDVVGMELLLKLLAIEDLG

SEQ ID NO: 195338 - protein, 422 aa, Glycine max
  Coding DNA Sequence Number=SeqID_78560
  Gene Ontology: Mol. function=GPI anchor binding; Cellular component =anchored to membrane
  Homolog annotation: Hit_ID=Q8GUI4; Match level="QueryCoverage=83%, HitCoverage=80%, E-value=1e-133, Identity=63%"; Hit description =Uncharacterized GPI-anchored protein At1g61900 precursor
  Subcellular localization annotation: CTP_CleavageSite=90; ConfidenceScore=5.19e-01
MVGSTTLSQTAITESASHSTLESHSSNHLQGPVRLDSHVGTMFPKPSPLGSPQPFLPLAPSPLAPFTNTTIPKLSGLCTLNFTTAESLISVAAIDCWEVFAPFLANVICCPQLEATLTILIGQSSKHTNVLALNGTDAKHCLADVEQILMGQGATNNLKQICSIHSSNLTEASCPVKNVNDFYDMVDTTKLLTACEKIDPVKECCYQICQNAILEAAKAIASKGSDILEIDAAHVQPEHSSRVNDCRNVVLRWLASKLEPSHAKKVLRGLSNCNVNKVCPLVFPDTKQVAKGCVDEIRNKTACCNAMESYVSHLQKQSFITNLQALDCAETLAMKMKRSNITADVYGLCHISLKDFSLQEAGCLLPSLPSDATFDSVSGISFLCDLNDNIPAPWPSTSQLTSSSCNKSINIPALPAAASSQS

SEQ ID NO: 195339 - protein, 73 aa, Glycine max
  Coding DNA Sequence Number=SeqID_78561
MESSKLTSTVKTAKINEDVLNANNGSTQQQQHGENNHKTKKKKAQCERIAERYSTYERGGNVQPGRGAFLNFK

SEQ ID NO: 195340 - protein, 133 aa, Glycine max
  Coding DNA Sequence Number=SeqID_78562
MSKEVDMNDENEHEAGVNEKKYVDCSEVFNTSQMFATQDDVLRWARSVTYEIEFVAKLWNAPMMGRWSKKATSSSVMVTSHTGRWKLLVSFCHPLTKADINPQSPISNEHTIKELNLVAAIIPSISEVDLQNF

SEQ ID NO: 195341 - protein, 136 aa, Glycine max
  Coding DNA Sequence Number=SeqID_78563
MAAVGVSSGLILYGSYDLYALYDPCNTYGSANPYEAYRSSDPFASYNSYIMVRNRGLRCALDRVIGRALRRGDNLDSDDVFQRQMPTISAHRQGKLSLLLRMLLTWMMQLKSYSNMLKKLLMMLRVFQADLVTHQY

SEQ ID NO: 195342 - protein, 377 aa, Glycine max
  Coding DNA Sequence Number=SeqID_78564
  Gene Ontology: Mol. function=zinc ion binding; Cellular component =cytoplasm; Biological process=signal transduction
  Homolog annotation: Hit_ID=Q9FHT1; Match level="QueryCoverage=99%, HitCoverage=88%, E-value=1e-150, Identity=58%"; Hit description=Zinc finger protein-like
  Pfam annotation: Domain name=zf-ZPR1; Domain location=1-82; Score =11.6; E_value=1.2e-10; Accession=PF03367.4; Description=ZPR1 zinc -finger domain
  Pfam annotation: Domain name=zf-ZPR1; Domain location=176-329; Score =168.5; E_value=1.6e-47; Accession=PF03367.4; Description=ZPR1 zinc -finger domain
  Pfam module annotation: Pfam domain module=zf-ZPR1::zf-ZPR1; Domain location=1-82::176-329
MIPELDFEIPPEAQRGSLSTVEGILMRAADELQALQEERKKVAPETAEAIDQFLVKLRACAKGESAFTFILDDPAGNSFIENPFAPSSDPSLTIKFYERTPEQQASLGYLVGSTHIEGTHDQAPERGEVTADQVRREPHGSIGATAGHRAIAQSNSSEIAEALFRYTAPEEVMTFPTSCGACAARYIPYFQEVIVMASTCDSCGYRNSELKPGGRIPEKGKKITLNVKNVNDLSRDVIKSDTASVKVPELDLELASGTLGGIVTTVEGLITKISESLERVHGFTFGDSLDEQRKNKWIDFKARLNKLLSLEEAWTLILDDALANSFVAPATDDLKEDNQLSFEEYERSWEQNEELGLNDIDTSSADAAYESTNTTKT

SEQ ID NO: 195343 - protein, 155 aa, Glycine max
  Coding DNA Sequence Number=SeqID_78565
  Gene Ontology: Mol. function=lyase activity; Biological process =alkaloid metabolic process
  Homolog annotation: Hit_ID=Q9SG92; Match level="QueryCoverage=85%, HitCoverage=49%, E-value=2e-37, Identity=57%"; Hit description =Putative alpha-hydroxynitrile lyase
MVVKAEKAMSVREESGDSRGTIDPLKQHFVLVHGVGGGGWCWYKIRCLMENSGFKVSCIDLKSAGIDQSDVDSVLSFDDYNQPLMDLLSALPENEQVILVGHSAGGLSVTQACHKFAKKIRLAVYVAATMLKLGFLTDEDLKHVSPVHQISFSAH

SEQ ID NO: 195344 - protein, 244 aa, Glycine max
  Coding DNA Sequence Number=SeqID_78566
  Homolog annotation: Hit_ID=Q1T1F7; Match level="QueryCoverage=56%, HitCoverage=29%, E-value=2e-13, Identity=36%"; Hit description=IMP dehydrogenase/GMP reductase
  Pfam annotation: Domain name=DUF1723; Domain location=88-137; Score =41.0; E_value=4.2e-09; Accession=PF08330.1; Description=Protein of unknown function (DUF1723)
MVWCHWRRSCCRATHWRLYPNGGGPIVLSLLQSYRDHCVGHVWIRWECPKLKLVNHNAQALTSPTHLQVKAYVEWSRLSALATTWYPIENRSLVNAFFERWHQETSSFHFPVKEMNITLDNVSCLLHLLVTCRAIDHVLSLFDREAMKILLMTHLGIPTETKVAAATHADLINGMIFANMSLTHVHVAYLKYLMVLDACHNVCASFQCWLLRETQGLCGGGPNSHQMEGIERYWVCPFDQEEIG

SEQ ID NO: 195345 - protein, 124 aa, Glycine max
  Coding DNA Sequence Number=SeqID_78567
MGETHEVPRDCTIADFEPHLEYVTKGQAFGGIPLPNTLRGPQYHPQPHLQPLHFAVGRLPPTMVENEKFDHIEERLKAIERGRDYPFADMAKLCLVPDIVIPPKFKVSDFNKYKWTTCLKNHLK

SEQ ID NO: 195346 - protein, 34 aa, Glycine max
  Coding DNA Sequence Number=SeqID_78568
MGLGCAYSTGAPAEEAERITKRGSAELQDKCLGY

SEQ ID NO: 195347 - protein, 49 aa, Glycine max
  Coding DNA Sequence Number=SeqID_78569
MEVQQSGGKPFGVSKIGFFPQRGYVMRDKDGRTFLEKELPGECIGNNGE

SEQ ID NO: 195348 - protein, 1244 aa, Glycine max
  Coding DNA Sequence Number=SeqID_78570
  Gene Ontology: Mol. function=nucleic acid binding; Cellular component= cytoplasm; Biological process=transcription-coupled nucleotide -excision repair
  Homolog annotation: Hit_ID=Q9ZV43; Match level="QueryCoverage=99%, HitCoverage=99%, E-value=0.0, Identity=60%"; Hit description =Putative SNF2/RAD54 family DNA repair and recombination protein
  Pfam annotation: Domain name=DEAD; Domain location=412-612; Score= -38.3; E_value=0.0097; Accession=PF00270.19; Description=DEADDEAH box helicase
  Pfam annotation: Domain name=Helicase_C; Domain location=790-868; Score=87.8; E_value=3.2e-23; Accession=PF00271.21; Description =Helicase conserved C-terminal domain
  Pfam annotation: Domain name=ResIII; Domain location=408-606; Score= -39.3; E_value=0.091; Accession=PF04851.6; Description=Type III restriction enzyme, res subunit
  Pfam annotation: Domain name=SNF2_N; Domain location=414-737; Score =373.9; E_value=2.6e-109; Accession=PF00176.13; Description=SNF2 family N-terminal domain
  Pfam module annotation: Pfam domain module=DEAD::Helicase _C::ResIII::SNF2_N; Domain location=412-612::790-868::408-606::414-737
MEEEEDRILLSSLGVKSANPEDIERDVLEKATRNDLVTVTEVEGSAKEERSDLPENVDPSANDKAEIRQKLRAVQFEIDAVASAVERLSNVEDNEECSDAGEDGPGRGTAEGESDGNSNLQRALAADRLRSLEKTKAQLEKELLDLFKDDDSKSAEHEELVLSLVKEERKSKRKVKEDKKLNKSAGKRPKKVSFDEDADFDAVLDAASAGFVETDINGGGRNRRTHFLLLMVQERDELVRKGILTPFHKLEGFERRFQQPETSTSHNAAEEENDGDLASASIERAARSMSEAARSRPTTKLLEPEAAPKLDAPTIPFRRLKKPLKSSKPLDVELNKDSKRKKRRPLPGRKWTKRVSCEDSHPEESENTNGCLDSSSCENLEEQDVELDDQESSYVTLEGGLKIPDNIFEALFDYQKVGVQWLWELHCQRAGGIIGDEMGLGKTVQVLSFLGALHFSGMYKPSIIVCPVTLLRQWKREAKKWYPKFHVELLHDSAQDSAPRKKRAKSEETDYESNSKSDSDYEKSVASKSTRKWESLINRVMRSESGLLITTYEQLRILGEQLLDIQWGYAVLDEGHRIRNPNAEVTLVCKQLQTVHRIIMTGAPIQNKLTELWSLFDFVFPGKLGVLPVFEAEFSVPISVGGYANASPLQVSTAYRCAVVLRDLIMPYLLRRMKADVNAQLPKKTEHVLFCSLTSEQVSAYRAFLASTDVEQILDGHRNSLYGIDVMRKICNHPDLLERDHAFNDPDYGNPERSGKMKVVAQVLNVWKEQGHRVLLFTQTQQMLNIFENFLTTSGHIYRRMDGLTPVKQRMALIDEFNDSSEIFIFILTTKVGGLGTNLTGANRVIIFDPDWNPSTDMQARERAWRIGQKRDVTVYRLITRGTIEEKVYHRQIYKHFLTNKILKNPQQKRFFKARDMKDLFTLNVDGETGSTETSNIFSQISEEVNVIGTYKENKDKYKHSQTAELVSEDVAVGNDDKSERGSLRGKGKEKVEHEHSNGVGEETNILKSLFDANGIHSAMNHDLIMNAHDEEKIRLEEQASQVAQRAAEALRQSRMLRSHDSVSVPTWTGRSGTAGAPSSVKRKFGSTVNPQLVNNSKASDELPNKGTNKINGFAAAGASAGKALSSAELLAQIRGNQEKAIGAGLEHQFGVSSSSTNQPRSGDVRSSRATENSSVQPEVLIRKICTFIQQRGGSSDSASIVQYFKDRIPSKDLALFKNLLKEIATLHKGSNGSYWVLKPDYQF

SEQ ID NO: 195349 - protein, 313 aa, Glycine max
  Coding DNA Sequence Number=SeqID_78571
  Gene Ontology: Mol. function=catalytic activity; Biological process =cellular metabolic process
  Homolog annotation: Hit_ID=Q6ZJE8; Match level="QueryCoverage=97%, HitCoverage=99%, E-value=3e-72, Identity=43%"; Hit description =Putative NADPH HC toxin reductase
  Pfam annotation: Domain name=3Beta_HSD; Domain location=12-270; Score= -89.0; E_value=2e-06; Accession=PF01073.9; Description=3-beta hydroxysteroid dehydrogenaseisomerase family
  Pfam annotation: Domain name=Epimerase; Domain location=11-244; Score= 5.0; E_value=1.5e-06; Accession=PF01370.11; Description=NAD dependent epimerasedehydratase family
  Pfam annotation: Domain name=NAD_binding_4; Domain location=13-228; Score=-66.7; E_value=0.00026; Accession=PF07993.2; Description=Male sterility protein
  Pfam module annotation: Pfam domain module=3Beta_HSD::Epimerase::NAD _binding_4; Domain location=12-270::11-244::13-228
MESSEGIRCKVCVTGGASYIGSCLVKKLLQKGYTVHSTLRNFKDESKIGLLRGLPHANDERLVLFEADIYKPDEYEPAIQGCEIVFHVATPYEHQSDSLLFKNTSEAAIAGVKSIAKYCIKSGTVRRLIYTASVVAASPLKDDGSGFKDFIDETCWTPLNLSMGTLHQWYTDSKTQAERELLSYGSGENGGGLEVVQDNEAAYQSLKFLEELDGKIPIVHVEDVCEAHIFCAENPSINGRFLVASSYASSAEIANYYLQAYPEFNLNHKYLEGPKRDIKWASRKLTDNGFVYKNDLKMILDDCIRCARRMGDL

SEQ ID NO: 195350 - protein, 42 aa, Glycine max
  Coding DNA Sequence Number=SeqID_78572
LGESYAMDDSSQLLQAASDFVHYPAMIPPGTFSIVSLSQSSS

SEQ ID NO: 195351 - protein, 160 aa, Glycine max
  Coding DNA Sequence Number=SeqID_78573
  Gene Ontology: Mol. function=transition metal ion binding; Biological process=cytoskeleton organization and biogenesis
ESIDEEDPRPTSSNGACIKTHPRSDGYNINKYSFYTKSQDDKSTMQNSGVSLRAESQHFASVDDDNPRLASMPYFGVIEEIWELNYVKFIVCVFKYLNKLSYENKPFIMAEFYVQDPCDERHMATPPSSPPPPPPESAMHSPSTSKKTHDSNHWLLNQSL

SEQ ID NO: 195352 - protein, 208 aa, Glycine max
  Coding DNA Sequence Number=SeqID_78574
  Gene Ontology: Mol. function=sequence-specific DNA binding; Cellular component=nucleus; Biological process=regulation of transcription
  Homolog annotation: Hit_ID=Q6R7N3; Match level="QueryCoverage=70%, HitCoverage=39%, E-value=4e-29, Identity=49%"; Hit description =Putative WRKY transcription factor 30
  Pfam annotation: Domain name=WRKY; Domain location=128-171; Score= -4.6; E_value=0.0026; Accession=PF03106.6; Description=WRKY DNA -binding domain
MEESTKRKHTSLIHELIQGKELTKQLSNHLVSSSPMSHQTNELFVEKILLSYEKALTMLNWGSIMGEAKTTSGNIMDSHCSFTNGGSPRSEVVDRELEHKAALKKRKTMPRWTEQVKICSRRGLEGSLDDGYSWRKYGQKDILRAKFPSYVSGARGMLPSVHWRNLTLLSSGTTCCKVSCWMWVWQLMCPHSEVNAITCKLANCKSNS

SEQ ID NO: 195353 - protein, 662 aa, Glycine max
  Coding DNA Sequence Number=SeqID_78575
  Gene Ontology: Mol. function=ATP-dependent helicase activity; Cellular component=intracellular; Biological process=RNA processing
  Homolog annotation: Hit_ID=Q1KL58; Match level="QueryCoverage=98%, HitCoverage=49%, E-value=1e-136, Identity=41%"; Hit description =Dicer-like 2 spliceform 1
  Pfam annotation: Domain name=Ribonuclease_3; Domain location=262-381; Score=71.9; E_value=2e-18; Accession=PF00636.16; Description=RNase3 domain
  Pfam annotation: Domain name=Ribonuclease_3; Domain location=456-568; Score=85.5; E_value=1.7e-22; Accession=PF00636.16; Description=RNase3 domain
  Pfam annotation: Domain name=dsrm; Domain location=595-661; Score =37.8; E_value=3.7e-08; Accession=PF00035.15; Description=Double -stranded RNA binding motif
  Pfam module annotation: Pfam domain module=Ribonuclease _3::Ribonuclease_3::dsrm; Domain location=262-381::456-568::595-661
MELEQHYEYQVSVNDIVLAIRSELDSEIVDTLSGTSFDVKRGKLLVNLRHLEPIQLSPEKVQSCRRFQTTLFRILLNRDVTKLTSVSDDFSLGDNPEIDFLLLPATVKHQRPSNSIIDWKPVLSVPFSSEIYTPHNGSIYIIYTTDGTKKLNGNSTLNQGLKGITTYKEHFKKRHGIELGFEHQSLLHGRNLFKVENYLLKTRQKTEKGKNMSSVDLPPEGLLVAFNLKRMLLDHFTPNDIPISKVLQAITAKGCEEAYDYDYLETLGDSYLKYIVSQQLFKTNQNDREGALSDKRKNIISNDVLFKYGCTRPLPGFIRKDKFDPKQWDVPGDKSNSILLLKQKLDSSRTRVYVRKTREIDLGIIADVVEALIGAFISTEDEKAALSFINWIGINVDTNIMPYENERHISIIAPEELVKAKLLKSRLNYSFKDPYLLVEALTHSSGKRPEIRTCYERLEFLGDAVLDYVITMHFYKEYSNDKFSAEFFTNMRSISVNNECYALSAIKAKLDEHILCDSVVKNNIAQTMEGVKNLSLESTFGWELETYFCQVLADVIESIAGAIFVDSGYKKEVVFQSIKPLLEPLVTPETARRHPISELHELCQKKGYKMKVYPPVRVNGETSVTIEVKTNGITYKNNPPAKASNNDTARKLAAKDVLKQIK

SEQ ID NO: 195354 - protein, 145 aa, Glycine max
  Coding DNA Sequence Number=SeqID_78576
MSKEVDMNGENGEEPGVNEENGEEPGVFQHIDRSNALNTSKVFATRDDVCIGLALLRMILILWRSGKYRARKKDLVRTVIGSRKCGCLFKLRAKPVVGGEGWKTKLMCGSHNHALAKSLIGHPYVDRLTNVGSSCLRIIKNGRLN

SEQ ID NO: 195355 - protein, 113 aa, Glycine max
  Coding DNA Sequence Number=SeqID_78577
  Homolog annotation: Hit_ID=Q9LIL7; Match level="QueryCoverage=91%, HitCoverage=23%, E-value=2e-15, Identity=41%"; Hit description =Arabidopsis thaliana genomic DNA, chromosome 3, BAC clone:F4B12
MMISGRLLSKDIIYSFTDEPCVKAVISSIDGRLQSLEASDRDECETALESLGHMGSSIQGATLLLSGSSPAARHVINAAFERQGPTGHGSLKEHIAKVKIAEIAFMVQLCNLL

SEQ ID NO: 195356 - protein, 93 aa, Glycine max
  Coding DNA Sequence Number=SeqID_78578
MTYTRQRTKKRKEPLGVEDAAAPKTKRGQVRGSSSLRGKEQMIEVEDNAVLEESEKELQGIDFGDSEEEVEGHALLLDNEDYDCIGEGAEQNE

SEQ ID NO: 195357 - protein, 234 aa, Glycine max
  Coding DNA Sequence Number=SeqID_78579
  Gene Ontology: Mol. function=structural constituent of ribosome; Cellular component=ribonucleoprotein complex; Biological process =translation
  Homolog annotation: Hit_ID=Q9ASV6; Match level="QueryCoverage=79%, HitCoverage=68%, E-value=2e-29, Identity=45%"; Hit description=30S ribosomal protein S20, chloroplast precursor
  Pfam annotation: Domain name=Ribosomal_S20p; Domain location=71-218; Score=12.0; E_value=0.0003; Accession=PF01649.8; Description =Ribosomal protein S20
  Subcellular localization annotation: CTP_CleavageSite=65; ConfidenceScore=5.96e-01
MAASVSCSWLTLPSQMRKLSLTSSSSSLSISNSASLSFSRNLSHPLFSQGNCLSLSTVQRRASVVCEAAPKKVDSAVKRARQAEKRRVYNKARKSEIKTRTKKEKGNKKVTRIGKCGPFMYSRSRSITSVIQLTQAQSTLTEYKIPKTVKKPDILTDDVLEALEVLKKKQDAQAEEILSIEKLIGEAYSIIDKAVRVGTLHRNTGANRKSRLARRKKAVEIHHGWYTPTPEASV

SEQ ID NO: 195358 - protein, 470 aa, Glycine max
  Coding DNA Sequence Number=SeqID_78580
  Gene Ontology: Mol. function=protein serine/threonine kinase activity; Cellular component=phragmoplast; Biological process =protein amino acid phosphorylation
  Homolog annotation: Hit_ID=Q9LW99; Match level="QueryCoverage=97%, HitCoverage=72%, E-value=1e-177, Identity=73%"; Hit description =Protein kinase MK6
  Pfam annotation: Domain name=Pkinase; Domain location=1-316; Score =174.8; E_value=2.1e-49; Accession=PF00069.15; Description=Protein kinase domain
  Pfam annotation: Domain name=Pkinase_C; Domain location=334-383; Score=51.3; E_value=3.2e-12; Accession=PF00433.14; Description =Protein kinase C terminal domain
  Pfam annotation: Domain name=Pkinase_Tyr; Domain location=4-294; Score=-77.9; E_value=1.1e-07; Accession=PF07714.7; Description =Protein tyrosine kinase
  Pfam module annotation: Pfam domain module=Pkinase::Pkinase _C::Pkinase_Tyr; Domain location=1-316::334-383::4-294
MKKLKKSEMLRRGQVEHVKAERNLLAEVDRNCIVKLYCSFQDDEYLYLIMEYLPGGDMMTLLMRKDTLTEDEARFYVGETILAIESIHKHNYIHRDIKPDNLLLDRYGHLKLSDFGLCKPLDCSALEEKDFSVGQNVNGSTQSSTPKRSQQEQLQHWQMNRRTLAYSTVGTPDYIAPEVLLKKASKFHQVVGLSGHKLSPLKQGFGFKPCGWKKVIGRGDPTKGGQSSSPAEISHQQSWWSLGAIMYEMLVGYPPFYSDDPMLTCRKIVNWKTYLKFPEEARLSPEAKDLISKLLCNVNQRLGSKGADEIKAHPFFKGVEWDKLYQMEAAFIPEVNDELDTQNFEKFDESDSQNQSSSRSGPWRKMLSSKDLNFVGYTYKNFEIVNDYQVPGIAELKKKQSKPKRPTIKSLFDCESETSEGSDTDTSANDQPAQGKLFEALATPVRGISSSQQESSSQVLTRPNHKIYAV

SEQ ID NO: 195359 - protein, 47 aa, Glycine max
  Coding DNA Sequence Number=SeqID_78581
MYRTEPLLGRTFSEDNHDQAPTMASIDASWTRQCNNWFPEIQIQHGE

SEQ ID NO: 195360 - protein, 163 aa, Glycine max
  Coding DNA Sequence Number=SeqID_78582
MAILELNDLITMMVAIIGKLRENDLELGRLKDEEVDKKNNELALKISTSHHEASDEDPSVNLVDANMNLLVKKFSKFMKKKGKDKGNFQKKSTKKSDFITPKSYTSWDDNDASSSSEEEEENLCLMVDIDEDETKSNVDRRSQLWRESSGLNNMTVVQLDLVS

SEQ ID NO: 195361 - protein, 143 aa, Glycine max
  Coding DNA Sequence Number=SeqID_78583
  Gene Ontology: Mol. function=DNA binding; Cellular component=oxygen evolving complex; Biological process=DNA integration
MKGVFEMSMMGELFYFIVLQIKQLESGIFINQSKFQANPKESHLVVLKRILMYIKGALKVGLWYSKGASISLFGYSNLDYAGCKVDRKATSGTSPLLRRTLVSWHSKKQTCVALSIAEVEYVAFGSCFVPLDEATTRGFWYLP

SEQ ID NO: 195362 - protein, 54 aa, Glycine max
  Coding DNA Sequence Number=SeqID_78584
MADIAGLAEAAGARFSSLELIGQGSFGDVYKGITECIVLASVFDDKVFLMYKLH

SEQ ID NO: 195363 - protein, 181 aa, Glycine max
  Coding DNA Sequence Number=SeqID_78585
  Homolog annotation: Hit_ID=Q60CZ4; Match level="QueryCoverage=82%, HitCoverage=40%, E-value=1e-50, Identity=66%"; Hit description =Uncharacterized plant-specific domain TIGR01589 family protein
MGMPDVGPFQNNFCIHTMSTQELQSPAQASRESQSEQPKNHTTDAPVTDSVSASASSNDSKKISRQDIDLVQNLIERCLQLYMNKDEVVKKHFARAKIDPGFTTLVWQKLEEENTDFFRAYYIRLKLKRQILLFNHLLEHQYHMMKYPLPTKIPLAPIQNGVHPMPGKFLPHIVFSSHVMQ

SEQ ID NO: 195364 - protein, 719 aa, Glycine max
  Coding DNA Sequence Number=SeqID_78586
  Gene Ontology: Mol. function=ion channel activity; Cellular component= integral to membrane; Biological process=ion transport
  Homolog annotation: Hit_ID=O65717; Match level="QueryCoverage=99%, HitCoverage=98%, E-value=0.0, Identity=62%"; Hit description=Cyclic nucleotide-gated ion channel 1
  Pfam annotation: Domain name=Ion_trans; Domain location=131-400; Score=57.7; E_value=3.8e-14; Accession=PF00520.21; Description=Ion transport protein
  Pfam annotation: Domain name=cNMP_binding; Domain location=501-601; Score=36.5; E_value=9.2e-08; Accession=PF00027.19; Description =Cyclic nucleotide-binding domain
  Pfam module annotation: Pfam domain module=Ion_trans::cNMP_binding; Domain location=131-400::501-601
MSAVWFEDWKSESSFSPEQEDSIDSGNHKRRPSVGTVLKSIGRRLESGSEKMKNLRRASAVHPVSDGQKKLPPRKKILDPQGPVLQKWNKIFVITCVLAVSVDPLFSYIPVINNEEKCVHLDGALQITASVLRTFFDLFYILRIIFQFKTAFIPPSSRVFGRGELIDDPVAIMKRYLTSHFIIDILSIIPLPQVIVLAINRNSKTSDPFVAKDLLKYSVLIQYVPRLLRMYPLFKEVTRTSGILTETAWAGAAFNLFLYMLASHVVGANWYMLSVESELRCWRRELRNASLYHRKYMSCVDRNPNVFTLLNRTCSLVDPDTIKDPNTFNYGIFFDALDSRVVESTTDFPQKFFYCFWWGLRNLSSLGQNLKTSTDVSEIAFAIFIAIFGLVLFSLLIGNMQKYLQSTTVRVEEMRVKRQDAEQWMSHRMLPENLRERIRKYEQYQWQENRGVEEEALIRNLPKDLRRDIKRHLCLTLVKKVPMFEKMDEQLLDAMCDRLKPVLYTEKSYIVREEDPVDEMLFIMRGKVSTMTTNGGRTGFFNSMFLKAGDFCGEELLTWALDPNSSSNLPISTRTVETISEVEAFALTADDLKFVASQFRRLHSKQLQHAFRQGLIIYIMFYSSQWKTWAATFIQAAWRRYWKKKIERSLREAEDELQDALANEEESSLSLGATIYASRFAANALRNLRENSRHNRMQQRLLPLLPPKPAEPDFTSQKH

SEQ ID NO: 195365 - protein, 636 aa, Glycine max
  Coding DNA Sequence Number=SeqID_78587
  Gene Ontology: Mol. function=ion channel activity; Cellular component= integral to membrane; Biological process=ion transport
  Homolog annotation: Hit_ID=O65717; Match level="QueryCoverage=97%, HitCoverage=84%, E-value=0.0, Identity=59%"; Hit description=Cyclic nucleotide-gated ion channel 1
  Pfam annotation: Domain name=Ion_trans; Domain location=81-349; Score= 53.9; E_value=5.2e-13; Accession=PF00520.21; Description=Ion transport protein
  Pfam annotation: Domain name=cNMP_binding; Domain location=463-558; Score=49.9; E_value=8.4e-12; Accession=PF00027.19; Description =Cyclic nucleotide-binding domain
  Pfam module annotation: Pfam domain module=Ion_trans::cNMP_binding; Domain location=81-349::463-558
MKNWRRDSDILPVTVSDGKRTMKKIFDPQEPLLQKWNKIFVIMCILSVALDPLFFYIPVINEDKKCLHLDGASKITVCVCVLRTFFDLFYILRIIFQFKTGFKTPFSRVFGRDELIHDPVPIMKRYLTSHFIIDILSIIPLPQVIFLAIPNLKSPDPLVVKDLLKYSVLILYVPRLWRIYPLYQEVKKTIGIFTEKAWAGATFNLFLFTLASHMVGAVWYMLSIESEVWCWRRELKNASLFHEEYLSCGHGDQNVFQLLNKTCSFIDPDKIIDKNTFNFGIFFDALDSGVVESTTDLHQKFFYCFWWGLRNLSSLGQNLKTSINVIEIAFAIFIAIVGLVLYSLLIGNMQKYLHQYTQSKNFIEEKKRNFIEEKKRVKRRHEIELWMSHRMLPEDLKQRIRRFEHYKWQENSGVDEEALIRNLPKDLRRDTKRHLCLALVRRVPMFGLMDQQLLGAMCDRLKTVLYDKHSCIVCEGDPLDEMVFIMSGKVYSVTTNGGGSGFLKAGDFCGEELLTWALDPNSSSNLPISTRTVQTMSEVEAFALMADDLKFVVSQFRHLHSKQLQQVFRQGLIIYIMFYSSQWRRWAATFIQAAWRRYWKKKIERSLREAEDELQDAFANEEGSSLSLGATIYASR

SEQ ID NO: 195366 - protein, 695 aa, Glycine max
  Coding DNA Sequence Number=SeqID_78588
  Gene Ontology: Mol. function=triacylglycerol lipase activity; Biological process=lipid metabolic process
  Homolog annotation: Hit_ID=Q5ZBH3; Match level="QueryCoverage=88%, HitCoverage=89%, E-value=1e-124, Identity=41%"; Hit description =Lipase class 3 family protein-like
  Pfam annotation: Domain name=Lipase_3; Domain location=392-531; Score= 105.9; E_value=1.2e-28; Accession=PF01764.16; Description=Lipase (class 3)
  Subcellular localization annotation: CTP_CleavageSite=6; ConfidenceScore=5.10e-01
MAYTAVAMPTSPAATSATMDIAKEHNGLRRSQSSKELCTRSIMRRSYSDNHLCCSINRIQATSVPPKLKSNRSMGISPFQFSGSMLPNSLRSFLFDPETSKDVSVEEKVVSIEENMVESSKEEIANRANWVERLMEIKKHWRNRLPKESMDPDAICNENTYDECECDGDGDDNVCVVGEDEDEQEVTYDCDSFSNFLVQVPWSDTKLYSQLAFLCNMAYVIPQIKAKDLRRYYSLQFITSSLEKKVEVAKLKVKLDQDSTRVPIDDSDVSEKGKDSIKKPQIKLAYDIAASAASYVQLRAKDLLHRAAKSRDTQQTENEDSNGRGDSPREELESTSRGYKSEVAAYVAASTMTAVVAAGEKEKQEAANDLQSLHSSPCEWFVCDDPGNYTRCFVIQGSDSLASWQANLFFEPTKFEDTDVLVHRGIYEAAKGIYKQFMPEIMEHLKRHGDRAKLQFTGHSLGGSLSLLVHLMLLTNKVVSPSTLRPVVTFGSPFVFCGGQQIINELGLDESQIHCVMMHRDIVPRAFSCNYPNHVAVVLKRLNSSFRSHPCLLKNKLLYSPLGKIFILQPDEKTSPPHPLLPRGSAFYALDNTKGGYSPSVLRTFLNQPHPIDTLSDPTAYGSEGTILRDHDSSNYLKAINGVLRKHSKITVGRMRKQRINQLWPLLTSPSPHSWSHEQNLERCSLRTKEIVTGV

SEQ ID NO: 195367 - protein, 127 aa, Glycine max
  Coding DNA Sequence Number=SeqID_78589
  Gene Ontology: Mol. function=oxidoreductase activity; Cellular component=intracellular; Biological process=auxin mediated signaling pathway
  Homolog annotation: Hit_ID=Q5ZBH8; Match level="QueryCoverage=77%, HitCoverage=28%, E-value=1e-39, Identity=79%"; Hit description =Putative auxin-induced protein
  Pfam annotation: Domain name=Aldo_ket_red; Domain location=1-125; Score=-120.5; E_value=0.027; Accession=PF00248.11; Description =Aldoketo reductase family
MVNGNTVIVNGSPEYVRSCCEGSLQRLGASYIDLYYQHPVDTTVPIEDTMGVLKKLVQEGKIRYIGLSEASLVTIRRAHAVHPITAVQMECSLWTREIEQDIVPLCRLKLYLTSLQAEFVDYPVIIS

SEQ ID NO: 195368 - protein, 240 aa, Glycine max
  Coding DNA Sequence Number=SeqID_78590
  Gene Ontology: Mol. function=DNA binding; Cellular component=oxygen evolving complex; Biological process=DNA integration
  Homolog annotation: Hit_ID=Q1SD84; Match level="QueryCoverage=99%, HitCoverage=19%, E-value=6e-88, Identity=80%"; Hit description =Integrase, catalytic region
MVRILLSLATNLDWPLHQLDVKNAFLNGDLEEEIYMNSPPGFEHRFGTKVCKLEKSLYGLKQSPRAWFETFTQSVKKQGYSQGQADHTLFTKFSSKGKIAALVYVDNIILTGDDEVELARLKKNLAAEFEIKDLGSLRYFFGMEVARSKRGIVVSQQKYILDLLEETGMSDCRLADTPMDPNGKLWEKGSVFVDVGRYQRLGRVCYRQKIYFRILHLCVGKSSDLEKQKTRCCCQKQCRS

SEQ ID NO: 195369 - protein, 163 aa, Glycine max
  Coding DNA Sequence Number=SeqID_78591
  Gene Ontology: Mol. function=metal ion binding; Cellular component =integral to membrane; Biological process=ubiquitin cycle
  Homolog annotation: Hit_ID=Q1PFR9; Match level="QueryCoverage=78%, HitCoverage=42%, E-value=2e-30, Identity=52%"; Hit description=Zinc finger family protein
  Pfam annotation: Domain name=PHD; Domain location=104-149; Score=1.6; E_value=0.039; Accession=PF00628.19; Description=PHD-finger
  Pfam annotation: Domain name=zf-C3HC4; Domain location=105-146; Score= 22.5; E_value=0.00073; Accession=PF00097.15; Description=Zinc finger, C3HC4 type (RING finger)
  Pfam module annotation: Pfam domain module=PHD::zf-C3HC4; Domain location=104-149::105-146
HLLIISSTLEFSAPPQHGLRVFGIITSSIVGPAIIFVIAIACYASLKYRRGNTARIAAAQRSEPSAISPQPSIATMGLDDSTIESYQKLVLGESRRVPGPNDGCCTICLSEYKTKDTIRCIPECAHCFHAECIDEWLRMNSTCPVCRNSPSHPSTAQVMASDP

SEQ ID NO: 195370 - protein, 46 aa, Glycine max
  Coding DNA Sequence Number=SeqID_78592
MSCMFLTYLVTYCLICTRGGRLAVLRRVEDSTSLKRYVDQDNNYNQ

SEQ ID NO: 195371 - protein, 139 aa, Glycine max
  Coding DNA Sequence Number=SeqID_78593
  Gene Ontology: Mol. function=protein serine/threonine kinase activity; Cellular component=cytoplasm; Biological process=protein amino acid phosphorylation
  Homolog annotation: Hit_ID=Q9LDN6; Match level="QueryCoverage=98%, HitCoverage=20%, E-value=2e-68, Identity=90%"; Hit description=MAP kinase
  Pfam annotation: Domain name=Pkinase; Domain location=1-124; Score= -43.4; E_value=5.6e-06; Accession=PF00069.15; Description=Protein kinase domain
  Pfam annotation: Domain name=Pkinase_Tyr; Domain location=1-124; Score=-150.2; E_value=0.003; Accession=PF07714.7; Description =Protein tyrosine kinase
  Pfam module annotation: Pfam domain module=Pkinase::Pkinase_Tyr; Domain location=1-124::1-124
ANILLTDNGDVKVADFGVSAQLTRTISRRKTFVGTPFWMAPEVIQNSEGYNEKADIWSLGITAIEMAKGEPPLADLHPMRVLFIIPRENPPQLDEHFSRYMKEFVSLCLKKRPSAKELLRHRFIRNARKSPKLLERIRY

SEQ ID NO: 195372 - protein, 423 aa, Glycine max
  Coding DNA Sequence Number=SeqID_78594
  Gene Ontology: Mol. function=protein serine/threonine kinase activity; Cellular component=cytoplasm; Biological process=protein amino acid phosphorylation
  Homolog annotation: Hit_ID=Q9LDN6; Match level="QueryCoverage=98%, HitCoverage=59%, E-value=1e-83, Identity=43%"; Hit description=MAP kinase
ERPKYQIKEDQTTPRNAPRGMGEASDTIKVAKDLRGDETNQPSGQGKTLRSSGWDFSIGGSQGTGTFRSVSRPPQFRDKKTEVSDHQLNQRKIPESGYQGESGNKSALNELLETSFGKDLGVPYHDEHPDNHLENDEFSGNGSGTVVIRSPKGPQPSMFRDQSSQSSSSYASFEDVSTSGTVVVLHSQHDDSDSPQTPRSRLGLNSRNSNASLEDSATNLVEAKAAIQGGLRKVNVRERFALGKLNNDVQDSKRDQMSSSSDSSSIFFRPSREYFDAPKAFSRSHYSIDDEESAKIISSSVPLSVLLIPSLKEAIADDPDGSIVQIVINALVNMESTKPQSCDVFVKKLLQQLASSKESSFKDLQELAGQIFSKTKSSEETRNAESDNKKQNKEVHSNSNLSPLARFLLSRWQGQTSRDLNPA

SEQ ID NO: 195373 - protein, 104 aa, Glycine max
  Coding DNA Sequence Number=SeqID_78595
MEKDKEPIVSHEDLLALVFLSQCYEDLLGMVVEHSLESDHVLPFYLNQLQKEKVNSNMLLPKMIESSNAVSSSSAAKTVKRSSVTKMIEGSSAVSSSSASSLVC

SEQ ID NO: 195374 - protein, 127 aa, Glycine max
  Coding DNA Sequence Number=SeqID_78596
MALCRRPYGYSKVDKEDPEDIIHRRAQFLIHKVLEKADSRRKPSCLRIRISKLKVKIGKRLRRLRRRILSGVSAARLGFHGHILNSCAEEDDSAISVCCQLRFFIALTCGGKRSFAKMNCQVWKRAG

SEQ ID NO: 195375 - protein, 325 aa, Glycine max
  Coding DNA Sequence Number=SeqID_78597
  Gene Ontology: Mol. function=RNA binding; Biological process =regulation of transcription, DNA-dependent
  Homolog annotation: Hit_ID=Q49KC7; Match level="QueryCoverage=80%, HitCoverage=95%, E-value=5e-79, Identity=48%"; Hit description =Transposase
LPDLNDLPSVEMDFDMSVEKEEDGMADDTEDASLHGVMSDGQEEEANAKTEFPINANATLNKQQRFLSNEERRSVCRLLLNSVYNGKLKEGTTKNIATFYYVSRRVIQRIWRQLRETKETLHKKTKNCGRKRIGLDIERIREIPLSKQTTLRSLSHALEINKTSLIRFHKNGIIRRHSNAIKPFLKDENMKSRLRFCLSKPDNQTIPHNPMFKSMHNIVFIDEKWFYMTKNSMNYYLAVGEEEPHQTCRSKNFICKVMILCAMARPRFNSNSNETFDVKIEKWSIEDRGETIFIQQDNAPCHIDEDDNDFHQAASEGGFDIRSVS

SEQ ID NO: 195376 - protein, 272 aa, Glycine max
  Coding DNA Sequence Number=SeqID_78598
  Gene Ontology: Mol. function=nucleic acid binding; Cellular component= cytoplasm; Biological process=regulation of mRNA stability
  Homolog annotation: Hit_ID=Q2PEV8; Match level="QueryCoverage=69%, HitCoverage=72%, E-value=9e-94, Identity=56%"; Hit description =Putative DNA binding protein
  Pfam annotation: Domain name=RRM_1; Domain location=162-234; Score =61.4; E_value=3e-15; Accession=PF00076.12; Description=RNA recognition motif. (a.k.a. RRM, R
  Pfam annotation: Domain name=RRM_1; Domain location=68-140; Score =44.3; E_value=4.2e-10; Accession=PF00076.12; Description=RNA recognition motif. (a.k.a. RRM, R
  Pfam module annotation: Pfam domain module=RRM_1::RRM_1; Domain location=162-234::68-140
  Subcellular localization annotation: CTP_CleavageSite=61; ConfidenceScore=5.26e-01
MMQQPGPGMAPPTMGQQPPQQYQQPPPQQQQPYVMMPPQAQAPQAMWAPSAQPPPQQQPASADEVRTLWIGDLQYWMDENYLYTCFAHTGEVTSVKVIRNKQTSQSEGYGFIEFNSRAGAERILQTYNGAIMPNGGQSFRLNWATFSAGERSRHDDSPDYTIFVGDLAADVTDYLLQETFRARYNSVKGAKVVIDRLTGRTKGYGFVRFSDESEQVRAMTEMQGVLCSTRPMRIGPASNKTPTTQSQPKELMLSRSRVSRGSVIPEPGTDFS

SEQ ID NO: 195377 - protein, 339 aa, Glycine max
  Coding DNA Sequence Number=SeqID_78599
  Subcellular localization annotation: CTP_CleavageSite=53; ConfidenceScore=5.54e-01
MNEQTGGLGSSTPSNVPMKRKQGRPHKVDSGVQGMNMPVMPSSSKSDVAPQVRMTERTEIPIPVPVLNPETQIHSSVPSSGQSNKQPFEAELQVPVSVDLVLPTELYSGLSVSLGNQSAPVVTPMSDLSKIDSSISTGGIMPKGMSKPGPESQPASILSGFEGDKIIKQDGKLHEVDASRQAKESSADGGAIKDYQITSEPINSVPTVENTEKELPTGQQSMPSVYELNKLIADEPKHSVIEINQIPVSAERESMPPELKNNTVDNFMQKQGSPETGTQEDTKTKLAIETIPTVDTTNSNGRPSTDIANVPDVGSNHAPGLSHPSILNDRAHVPSESKL

SEQ ID NO: 195378 - protein, 631 aa, Glycine max
  Coding DNA Sequence Number=SeqID_78600
  Gene Ontology: Mol. function=zinc ion binding
  Homolog annotation: Hit_ID=Q3TAD1; Match level="QueryCoverage=55%, HitCoverage=64%, E-value=5e-26, Identity=26%"; Hit description =Activated spleen cDNA, RIKEN full-length enriched library, clone:F830020B15 product:...
  Homolog annotation: Hit description=chemokine (C-X-C motif) ligand 16, full insert sequence
  Pfam annotation: Domain name=zf-MYND; Domain location=287-328; Score =35.9; E_value=1.4e-07; Accession=PF01753.9; Description=MYND finger
MDLHLKSLFDRFQEQFGSGPGLGPGSGTCMMKVDGIAPNFIKSIYKASAALYRTEPWKRLRPGHLFGVRVGKDSDWPGKKQPFPCVQFIGGDGGDVGFYMFRTENDAKKMTGSRETIHSPNVELLRVTYEVDSLMFPSNRKMIKSLSLEASGSDRFPVIDVARCTPSGDLRFRNPSIEELRFVYAFMKAISLVHSLLQVDRESGPKYSTVVCFEPFIETVDVQWPPEVAKGGYDLVAVTVSHPPGQAYDEKSNSASAGSTPTKYVEPPREDTFNDTKAYSSTGLRQCAMCEKEVYGEQSICCGRCRAVVYCSSICQKQHWNDTHKSMCGLYKAMMEREEELAIMIFMFPCSADQPCKWLESLGIHQKGMWRRKCSCYSHCSFGLLPVKGGLQELWGGIDEFEYPHDSPFNNHFISSPFLLSGWPEYYNLRSLPLSSPVADILSHPLTVYHILTTLNISSKNLILKGKEVIVHYLGPEGELDWMPAFAEVGHLLNGLGNVQIVMVGPEVPTNLSGTTSGIGSRVRVNLVRGVYQVEASYLPSPHVVIALNSRLESYSSWGGALDLIKSIGVPAFFTDQSEVSCVNAKQVLRNAGLHITHPVTPNPFRSPVKNLTASSNLPSYSNGFVFGVNT

SEQ ID NO: 195379 - protein, 121 aa, Glycine max
  Coding DNA Sequence Number=SeqID_78601
MHMHVGVKKVQELADDDAGSYNFKRVIKGLRYWYGSIRRQCFMILKLSYLIEPCQYHMQTLIIACNNLQLTSTLKILPFNTEINTLILKQDVLDLLIWCSKQPSFEHSPTYESFFRMSQKR

SEQ ID NO: 195380 - protein, 166 aa, Glycine max
  Coding DNA Sequence Number=SeqID_78602
  Homolog annotation: Hit_ID=Q84LL8; Match level="QueryCoverage=48%, HitCoverage=45%, E-value=5e-13, Identity=46%"; Hit description=Salt tolerance protein 4
MEGTTWLNFWNCETIRKFSKVENKNALDANKPKNGGSTIRGGAGKGTATKRLTIASDKSQHKRVLSHPVLVSCVEKQREAEIQGSAVDIEALDFEPEDDDLMDEEGAPDAETSLPQPKLKFTFTAVVAPKKTKGCEFRQDTDASCDTRLSDSDSLTIEGGLGPQRC

SEQ ID NO: 195381 - protein, 296 aa, Glycine max
  Coding DNA Sequence Number=SeqID_78603
  Gene Ontology: Mol. function=protein serine/threonine kinase activity; Cellular component=membrane; Biological process=protein amino acid phosphorylation
  Homolog annotation: Hit_ID=Q9LJU5; Match level="QueryCoverage=87%, HitCoverage=69%, E-value=2e-94, Identity=63%"; Hit description =Receptor protein kinase-like protein
  Pfam annotation: Domain name=Pkinase; Domain location=78-296; Score =107.4; E_value=4.3e-29; Accession=PF00069.15; Description=Protein kinase domain
  Pfam annotation: Domain name=Pkinase_Tyr; Domain location=78-294; Score=81.1; E_value=3.5e-21; Accession=PF07714.7; Description =Protein tyrosine kinase
  Pfam module annotation: Pfam domain module=Pkinase::Pkinase_Tyr; Domain location=78-296::78-294
  Subcellular localization annotation: CTP_CleavageSite=50; ConfidenceScore=5.29e-01
MGCFPCCKSEAESSSSNASAGKISKGRRTFKSLASVMSHKTGSSRQRRIDAEIRKYGSAKNDVKVFTYAQLAEATNNYNSDCLVGEGGFGNVYKGFLKSVDQTVAVKVLNREGAQGTREFFAEILMLSMVQHPNLVKLVGYCAEDQHRILVYEFMSNGSLENHLLDIGADKEPMDWKNRMKIAEGAARGLEYLHNGADPAIIYRDFKSSNILLDENFNPKLSDFGLAKIGPKEGEEHVATRVMGTFGYCAPEYAASGQLSTKSDIYSFGVVLLEIITGRRVFDTARGTEEQNLIDW

SEQ ID NO: 195382 - protein, 95 aa, Glycine max
  Coding DNA Sequence Number=SeqID_78604
  Gene Ontology: Cellular component=mitochondrion
  Homolog annotation: Hit_ID=Q8RUB8; Match level="QueryCoverage=81%, HitCoverage=20%, E-value=1e-10, Identity=54%"; Hit description =Putative drought-inducible protein 1OS
  Subcellular localization annotation: CTP_CleavageSite=62; ConfidenceScore=5.16e-01
MAWERNFSLRQRSGRVLRSSTKVRMLGKLCAAASLETTREKARRSRWKSGVRAAARQMSRMRSDLVSDLRRWRALRVFCFKVRRVEEFGERMEVE

SEQ ID NO: 195383 - protein, 195 aa, Glycine max
  Coding DNA Sequence Number=SeqID_78605
  Gene Ontology: Mol. function=protein binding; Cellular component =endoplasmic reticulum; Biological process=retrograde protein transport, ER to cytosol
  Homolog annotation: Hit_ID=UPI000051A041; Match level="QueryCoverage =95%, HitCoverage=92%, E-value=1e-38, Identity=38%"; Hit description =PREDICTED: similar to Der1-like domain family, member 2
  Pfam annotation: Domain name=DER1; Domain location=12-163; Score =188.8; E_value=1.3e-53; Accession=PF04511.5; Description=Der1-like family
MAQAVEEWYKQMPVITRSYLTAAVVTTIGCSLDLLEENSFRGRTADFFYMLLFGATVLTGIVLLGGMIPYLSESFAKIIFLSNSLTFMMVYVWSKQNPFIHMSFLGLFTFTAAYLPWVLLGFSVLVGASAWVDLLGMIAGHAYYFLEDVYPRMTGRRPLKTPSFIKALFADDPVVVARPANVRFAPPPAEELHQD

SEQ ID NO: 195384 - protein, 152 aa, Glycine max
  Coding DNA Sequence Number=SeqID_78606
  Homolog annotation: Hit_ID=Q9FK90; Match level="QueryCoverage=22%, HitCoverage=7%, E-value=1e-13, Identity=88%"; Hit description=Zinc finger protein-like
MVKGMLQRKVIGKGERVLEDGQRAEWSTTDTRSLVENHFRSVKHNVALIPYNSVLLFCCQLLNVHTVVRGTMKYSLLVKFNHVVVVTLWRSHHANKSNDLNGGAQVWSSKMAYNDTNVWQNLNHVKLCKNCNAEAEYSWILQSSSILRWPKF

SEQ ID NO: 195385 - protein, 84 aa, Glycine max
  Coding DNA Sequence Number=SeqID_78607
MVNERHTIGVSDTKKIKVESGKWGNSLNHKWENLLTSSDDGRRSSFANRRESGEIQTLTKLSTVLFKASERHHFNRPARFRVNQ

SEQ ID NO: 195386 - protein, 259 aa, Glycine max
  Coding DNA Sequence Number=SeqID_78608
  Gene Ontology: Mol. function=deaminase activity; Cellular component =cellular_component; Biological process=purine ribonucleoside monophosphate biosynthetic process
  Homolog annotation: Hit_ID=Q1RV97; Match level="QueryCoverage=96%, HitCoverage=65%, E-value=9e-93, Identity=68%"; Hit description =Adenosine/AMP deaminase
MECELTKALIGKGAINFSEVEHIILKYNRSVEEVFKLFDLIHILTTDHNTVARITREVIEDFASENVVYLELRTTPKRNDSVGMSKRSYVEAVLKGLRSITSVDVDFIPHCEDSKTLFTPAPAIDGHARKRIFVRLLLSIDRRETTEAAMDTVKLALEMRPYGVVGIDLSGNPSIGDWYISLIQDSSVAMTTYLPALKFAREQGLYVTLHCGELPNSKEIKNMLDFRPQRIGHACFFEDEHWRQLKSSNIPVRLFCQPY

SEQ ID NO: 195387 - protein, 248 aa, Glycine max
  Coding DNA Sequence Number=SeqID_78609
  Gene Ontology: Mol. function=RNA-directed DNA polymerase activity; Biological process=RNA-dependent DNA replication
MEMERRHEVELIKITNDHDQLEAYVRCPQGDEQSTHTLPKRTQGESYPRRTGNTSNNLSISHKHRPTRRTARWHPFVECIMEASIPLGILTLRPSKFVDSLCKNSPDSIDELRERANGYIQMEEISIFRNKVHQARQKLNKCKVNAKADSYKSDKRHRLDKPASLQRAQMKPPKSGSDATKYYRYHRGISHNTKDCWALMDKIEELIQAWYLAQFVKRLDNHQAEARPRGHQQEQHRNWEADRRRMED

SEQ ID NO: 195388 - protein, 540 aa, Glycine max
  Coding DNA Sequence Number=SeqID_78610
  Gene Ontology: Mol. function=pseudouridine synthase activity; Biological process=RNA processing
  Homolog annotation: Hit_ID=Q1SBD2; Match level="QueryCoverage=99%, HitCoverage=99%, E-value=1e-116, Identity=70%"; Hit description =Pseudouridine synthase
  Pfam annotation: Domain name=PseudoU_synth_2; Domain location=220 -456; Score=-7.9; E_value=2.4e-05; Accession=PF00849.12; Description =RNA pseudouridylate synthase
  Subcellular localization annotation: CTP_CleavageSite=45; ConfidenceScore=5.09e-01
MTVASMLFAGGCRILAVPAAARAIRIPRAALSSHHNKHAPSWGCRSSHNSNTALAGEAEFSTTDAGNLTATSSSDSFPKYDRLLPCPSHKNPPRIEHLVISEGGPVLELICKALDLPPLYVSDLIQFGAVYYALVCPQPPPNATEEQIRVFKEVTEPSVLRKRASIKGKTVREAQKTFRVTHVDQFVEPGTYLRVHVHPKRFPRSYEIDWRSRIIAVAESYVVLDKPAGTSVGGTTDNIEESCATFATRALGMTTPLMTTHQIDNCTEGCVVLARTKDYCSIFHGKIREKKVKKLYLALAASPLPTGIITHYMRPINMAPRLISEVFSSLQEKPRPGFMPSLVYYSIMMCQWMRHLYQKLNVETSVCYVTWVKSLQKRVLYRGFNLVGLLTADFIKGWHLCQLEVLECRKIPWPTTAIQDKYCVEDCGWPSQDYAYECKINLLTGKTHQIRAQFAAYKAPLIGDSMYMPAAIADVSNPGLNPFGKYKKDFSSESEKETAVVNWMAQHGKEPSVAIGLQACQISWDDDEHFYEAGLPWWRC

SEQ ID NO: 195389 - protein, 103 aa, Glycine max
  Coding DNA Sequence Number=SeqID_78611
  Gene Ontology: Mol. function=DNA binding; Biological process=DNA integration
MVIKSRSIHQHVANMEEIFGEPSKYGDGGKFLGFMITHQGIKANLNKCTAILEMRSPTNIQEVQKLNGRLASLSRFLPKLAEKAKPFYKLLKETEPLSWDETC

SEQ ID NO: 195390 - protein, 210 aa, Glycine max
  Coding DNA Sequence Number=SeqID_78612
LKEPRDFEELHKNPSSPDQIPAHVKSSFMENFIDYHGPHTHPNPPPPNLEEILVDVDYHGPHTHPNPPPSNLEEILADIDYHGPHTHPNPPPPNLEEIPADIDYHGPHTHPNPPPPNLEEILVNIDYNGPHTHPNPPPQNLEEIRADIDYHGPHTHPNPPPPNLQEILADIDYHGPHTHPNPPPPNLEEILTDVDYHGPHTHPNPPPPYF

SEQ ID NO: 195391 - protein, 336 aa, Glycine max
  Coding DNA Sequence Number=SeqID_78613
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O24078; Match level="QueryCoverage=87%, HitCoverage=77%, E-value=1e-124, Identity=73%"; Hit description =Protein phosphatase 2C
  Pfam annotation: Domain name=PP2C; Domain location=80-325; Score =324.0; E_value=2.7e-94; Accession=PF00481.12; Description=Protein phosphatase 2C
  Subcellular localization annotation: CTP_CleavageSite=54; ConfidenceScore=5.88e-01
MSCSVAVPTSPVFSFYNNNNVNSNSIPSTTPSCSSPPSSPLLKRRRPAKLDIPVASLAFGLSPAAAPSPARDAVVEVDGRGFSVFCKRGRRHHMEDRFSAAVDLHGQPKQAFFGIFDGHGGTKASEFAAHNLEKNVLDEVVRRDECDIKEAVKHGYLNTDSEFLKEDLNGGSCCVTALIRNGNLVVSNAGDCRAVISRGDMAEALTSDHKPSREDERDRIETQGGYVDVCRGVWRIQGSLAVSRGIGDRNLKQWVIAEPETKVIKIEPQHDLLILASDGLWEKVSNQEAVDIARPLCVGNNRQQPLLACKKLVELSVSRGSLDDISVMIIKLQNYI

SEQ ID NO: 195392 - protein, 56 aa, Glycine max
  Coding DNA Sequence Number=SeqID_78614
  Subcellular localization annotation: CTP_CleavageSite=15; ConfidenceScore=5.39e-01
GGMAPSYFNMPSSSSSSSGAGPRPRGPPGFAIGAGFDVPSGFGGDPTLTIATDPLF

SEQ ID NO: 195393 - protein, 117 aa, Glycine max
  Coding DNA Sequence Number=SeqID_78615
  Homolog annotation: Hit_ID=Q8SB40; Match level="QueryCoverage=61%, HitCoverage=8%, E-value=4e-07, Identity=43%"; Hit description =Putative ribosomal protein
MVFMAMLIWVGVFPSTSSSTSWAQLGDDDAHHLLNVWRAHGLVLRSEKEIMNKSEEEYMRKIIERQKQREADNSSRQIHRRKVIDQGREKGHQRLFTNYFAENPIYTDVKFWQRFQM

SEQ ID NO: 195394 - protein, 106 aa, Glycine max
  Coding DNA Sequence Number=SeqID_78616
MVTYYNLRVLFRLYSFHVFIITLVVLLLLSAGIDTTIPELGFLVAPAFEFLALIRKKEKCTCAAVLLILQLSLVTLGGKESEGVSLSPFMDIMKDWVAELTDSFIQ

SEQ ID NO: 195395 - protein, 157 aa, Glycine max
  Coding DNA Sequence Number=SeqID_78617
  Homolog annotation: Hit_ID=UPI000034EE59; Match level="QueryCoverage =87%, HitCoverage=16%, E-value=9e-42, Identity=59%"; Hit description =transcription factor
  Pfam annotation: Domain name=C2; Domain location=6-90; Score=17.4; E _value=0.007; Accession=PF00168.20; Description=C2 domain
MAKIWIEVCLISARGVRGSPSLWKRQWYAVGWVDPKSKYCTKVDASGNANPVWRTKFALQVDNSEPDLALHVEVYSRDPVFLTEKLHGSATVVLREFLTKEVHNNSEEVGSYQLRKNKSNKPSGFVDVSIRVSEDKEELNFHPQVCFEAVKEGANGM

SEQ ID NO: 195396 - protein, 112 aa, Glycine max
  Coding DNA Sequence Number=SeqID_78618
  Gene Ontology: Mol. function=4-aminobutyrate transaminase activity
  Homolog annotation: Hit_ID=Q94FS9; Match level="QueryCoverage=52%, HitCoverage=11%, E-value=1e-11, Identity=57%"; Hit description=Gamma- aminobutyrate transaminase subunit precursor
  Pfam annotation: Domain name=Urease_gamma; Domain location=29-101; Score=-43.9; E_value=0.0096; Accession=PF00547.9; Description=Urease, gamma subunit
MSSNVIVGYNNTDLVLSLVKIVFPDKLRLEKLDLHNAGYLAQKRLACGLRLNYVETVAQKLDLFILRHKYYACLWTFQIGTMFGCDKYNIKPDLVSLAKALSSAYLPIGAVL

SEQ ID NO: 195397 - protein, 551 aa, Glycine max
  Coding DNA Sequence Number=SeqID_78619
  Homolog annotation: Hit_ID=Q9FNF3; Match level="QueryCoverage=33%, HitCoverage=34%, E-value=7e-35, Identity=40%"; Hit description =Arabidopsis thaliana genomic DNA, chromosome 5, P1 clone:MOP9
  Pfam annotation: Domain name=DUF125; Domain location=348-518; Score =54.7; E_value=3e-13; Accession=PF01988.9; Description=Integral membrane protein DUF125
  Subcellular localization annotation: CTP_CleavageSite=20; ConfidenceScore=5.15e-01
MFRFDGASKSESARNPPIIPASNLQNPSIPQGSNANWLTSLFTWKKGGKTSDAPLEHSGAGSAEQRNSTLNSNDEPTSLEIGPSKGPLADTSDIKNVKSTSNIKHGHGGMNSLISSTNDLSSIQSGTKGAGDLMNGVQSDVQNSVDFLAEKQLLAGNQIFGKEEKKNASVDIIRTDNAEVMLSAATTTETIEREPEFLASTTVGSQVLKESPKDGDKTPEIVKNGYYYSLGQGAQSPLQSSGSAVLANGVASNKQNSGIDVILPSKPNIILLDNVKKEIEKGIHHPTGNENKGGDVILDVERGAFESTTSHTADNIPAEDAIITELQTQVQNGEQPRDEVGEPQGWEILKSIVYGGLVESITSLGIVSSAVSSGATPLNIIALGFANIIGGLFILGDNLIDLKKDNSGEDQMQTNAQNRYQESLGRRENFLLHAVVAVLSFLIFGAVPLVIYGLLINKNYHTEVKLATVAATSIVCIILLAIGKVYTSKAPKSYIKTVLYYVTLAISASGVSYIAGNLIKDFLEKLNQPESGFAITMPISDTSMGSAWMSY

SEQ ID NO: 195398 - protein, 75 aa, Glycine max
  Coding DNA Sequence Number=SeqID_78620
MGGNKRNRRREKWIKGLAHERRLSDKVGSHCPWTIMDSKLEWVMEGSLLFRGCNWWQVKWFGNCGALNATSKDWT

SEQ ID NO: 195399 - protein, 65 aa, Glycine max
  Coding DNA Sequence Number=SeqID_78621
  Subcellular localization annotation: CTP_CleavageSite=31; ConfidenceScore=5.72e-01
MPWRFFIVLCSFFVVLRSSTGLSSSSQLRIRRSKSSTFFDHPKRSLMVQRLNVSLLSKTKRSLMV

SEQ ID NO: 195400 - protein, 67 aa, Glycine max
  Coding DNA Sequence Number=SeqID_78622
MSSTALLFEYWIGNMQNRSRFEAKSGSSGILVDYFDSLVKLPAIVVQKAEKYTLTIVAWSSCSDIKT

SEQ ID NO: 195401 - protein, 229 aa, Glycine max
  Coding DNA Sequence Number=SeqID_78623
  Homolog annotation: Hit_ID=Q9LDU3; Match level="QueryCoverage=18%, HitCoverage=8%, E-value=4e-09, Identity=69%"; Hit description =Arabidopsis thaliana genomic DNA, chromosome 3, P1 clone: MJK13
MSCCVTFSVMDSSSWSLICWVSYCNSSGGREEELRDVRGADPKYCLMVAPAPAARTRPGYGFGSMGFGSLRFLDRRVYDKVLKPRILDTLRAHHVSQISTGLGQKGSMNPICAKVQNLQTKTVNKTIKNGAREWDSVMYRSFLRCDDPKGVVECGTIRKYRTRSHKVKDKTRIQKTGENLETSLSLMNKRYKEENKVPKGCDGNLIDPSSYRDIMCDEKSKDIAEGIAK

SEQ ID NO: 195402 - protein, 227 aa, Glycine max
  Coding DNA Sequence Number=SeqID_78624
  Gene Ontology: Mol. function=metal ion binding; Biological process =protein amino acid phosphorylation
  Homolog annotation: Hit_ID=Q1PFR9; Match level="QueryCoverage=66%, HitCoverage=53%, E-value=4e-22, Identity=37%"; Hit description=Zinc finger family protein
MDILKVLFHFFIFFHVTYASDDCKYYSWCSDNNILIRFPFQIEGHQHPYCGGYPGFKLTCTNDSKTVIKLPYTGKFIVRNINYLRQQIQVYDPDNCLPKRLLSLNLSGSPFVAASLRNYTFLRCPTRNAGSQFIPIDCLSNSTSFVSAILSVNLPNPLPESCHVIKKLTFPVSRPGPYEEIFRDDLSGDLRLTWHAPDCRYCESQEALCGFESINSDQVRCFFDYQT

SEQ ID NO: 195403 - protein, 311 aa, Glycine max
  Coding DNA Sequence Number=SeqID_78625
  Gene Ontology: Mol. function=DNA binding; Cellular component =chromatin; Biological process=DNA integration
  Homolog annotation: Hit_ID=Q1SAI8; Match level="QueryCoverage=71%, HitCoverage=15%, E-value=9e-78, Identity=62%"; Hit description =Integrase, catalytic region
MTADAGILLSYFNSSTKNHNIVVGNGHLIPVVGHGSTNLPPPHPPFVLQSVLHAPKLIKNLISIRKFTTDNMVSISFYPFGFSVNDLQTGTRLMRCDSVGDLYPLFSNSQATSPKHSAFTTMSHDIWHNRLGHPGDTIINSLRRNKFIDCNKACKTFCSSCPLGKHAKLPFYDSLSYIFLPFDIIHSDLWTSPIANSSGHRYYVLFLDDYSKFLWTFPIARKSQNLAPQNPQPDPTSHITQSRPTPHVAPTLQQPPPTSSPILASPTSRGPVMQSYPARALDRKLQVDWARDAREGLRVLMSLRVDFGPMG

SEQ ID NO: 195404 - protein, 75 aa, Glycine max
  Coding DNA Sequence Number=SeqID_78626
MASSEGLDAIQVRLYLLEFPVLGLCGRFNETYHYLSLPGGLTEVPPDEPELGGIWTQLLNASYEHLQIAEPYLLP

SEQ ID NO: 195405 - protein, 190 aa, Glycine max
  Coding DNA Sequence Number=SeqID_78627
MELEKAQAVKEKFKSTAVRIRKENAELRDVNIATAKALEQETKRARKEEYGRNKFRGALWGSNSELKLRREERDQSQVEGMILKDELKTCLRSKRSLSQRLSETETNMLAIISKYKEELDLATAHEHKVVDEYAQVYTEKEARGRVIDSLHREAMMWMDREDTITKRAPRHPYRTRSKSRTMGDLEEVQE

SEQ ID NO: 195406 - protein, 599 aa, Glycine max
  Coding DNA Sequence Number=SeqID_78628
  Gene Ontology: Mol. function=phosphotransferase activity, alcohol group as acceptor; Biological process=protein modification process
  Homolog annotation: Hit_ID=Q9ZPY9; Match level="QueryCoverage=98%, HitCoverage=99%, E-value=0.0, Identity=58%"; Hit description =Expressed protein
  Pfam annotation: Domain name=PI3_PI4_kinase; Domain location=294-551; Score=282.3; E_value=9.1e-82; Accession=PF00454.17; Description =Phosphatidylinositol 3- and 4-kinase
  Pfam annotation: Domain name=ubiquitin; Domain location=121-192; Score=22.3; E_value=0.0015; Accession=PF00240.13; Description =Ubiquitin family
  Pfam annotation: Domain name=ubiquitin; Domain location=42-113; Score= 61.6; E_value=2.5e-15; Accession=PF00240.13; Description=Ubiquitin family
  Pfam module annotation: Pfam domain module=PI3_PI4_kinase::ubiquitin:: ubiquitin; Domain location=294-551::121-192::42-113
MSSAGVSTLSVVPTEPLLSPMAFPFPIPSHLSLEDKSIFIYLSFSGSLTPIRVMEWDTIESVKFKIQRSESLPFLTNKQKLVYAGRELARSDSLLKDYGVTDGNVLHLIIKLSDLQVISVKTSCGKEFTFQVERGRDVGYIKRRIARREKQFDDPEEQELVCNGERLEDQRLIDEICCKHNDAVVHLFVRKKHVKVQRRPLELSIVAKDLINKKKNDVNGNTNRRSYDVGKEDTIRKSDVIQRAVPRKPPDRDFILEPVIINPKIELAPAIWNMVNSTYDGLGSGKYPIRSAEGTGGAYFMIDSAGQKYVSVFKPIDEEPMALNNPRGLPLSLDGEGLKKGTRVGQGAFREVAAYVLDHPLSGRRSLFGDGKGFAGVPPTLMVKCLHKSFNYPREFTPKIGSLQMFTENSGSCEDMGPGAFPVKEVHKITVLDIRLANADRHAGNILISKEEDNNQSVLIPIDHGYCLPTSFEDCTFEWLYWPQARQPYSPETIDYIKSLDAEEDIALLKFHGWDLPVECARTLRISTMLLKKGVERGLTPFAIGNLMCRESLNKESVIEEIVQAALDSVLPGTSEATLLDAVSQIMDLRLDEIVRARL

SEQ ID NO: 195407 - protein, 651 aa, Glycine max
  Coding DNA Sequence Number=SeqID_78629
  Homolog annotation: Hit_ID=UPI00006A1A2E; Match level="QueryCoverage =81%, HitCoverage=94%, E-value=7e-24, Identity=22%"; Hit description =UPI00006A1A2E related cluster
  Pfam annotation: Domain name=VHS; Domain location=8-154; Score=-39.4; E_value=0.067; Accession=PF00790.9; Description=VHS domain
MDTEEGAHGKGTQVVSLIEKATNSTAPEVDPRLLKAIKTVVRYSDSELRLATQTLMDLMKRDHSQVRYLALLIIDELFMRSKLFRALVVENLDQLLSLSVGFRRNLPLPAPPAVASVLRSKAIEFLEKWNVTFGLHYRQLRLGYDYLKNTLRLQFPNIQANLERIQQERRERERRSKEILLSKYESLKENSPSIKGPILSTMDEIDECLEILHAKQESVSDDILDNEELGDFCSLELQQLRLEALKEGEKVYEDSDNKVVFDTLRELYKLLVTKHLVSIQECISVLVRVEVADNRFRDSILKEFVDIQNRLKSVKNKCEEAGCSLLNSSKHDEEDFWEEGNVVSMEISSSATNNKNKHLDVASTSHKMSNDNLGLHNKESNDSGTDTLLHRGREVEPNSPRSKLQAEAPVVRWSSYLDNWGSNRVFMANQRGLELESHWGRVDNDAVIPADKIAELNVHAMPYEEKQIEIQPCLTPLRKGGLCQRRDLKVCPFHGPIIPRDDEGRPLNQNSSEDMNMDLKTDLVEQLAKQAEKNVRERDQEVAKKREIDKQLLKRAKLAKVREHNEAVLRDAALASTSRSATLGEDGEATNEDKLSARDKKQSLASMLRKKVTSKDRIAQKLLSSRARVTADRQHVSCEDAKYREAFPNQW

SEQ ID NO: 195408 - protein, 272 aa, Glycine max
  Coding DNA Sequence Number=SeqID_78630
  Gene Ontology: Mol. function=zinc ion binding; Cellular component =nucleus; Biological process=ubiquitin-dependent protein catabolic process
  Homolog annotation: Hit_ID=Q6KAC3; Match level="QueryCoverage=86%, HitCoverage=78%, E-value=1e-119, Identity=76%"; Hit description =Putative Ubiquitin ligase SINAT5
  Pfam annotation: Domain name=Sina; Domain location=66-251; Score =359.3; E_value=6e-105; Accession=PF03145.7; Description=Seven in absentia protein family
MESSSIESSTVSSMTMMEEDEHPHQFSSISKLHSNGPTTTSVHDLLECPVCTNSMYPPIHQELGDIRCLALEKIAESLELPCRYISLGCPEIFPYYSKLKHEAICNFRPYNCPYAGSDCSVVGDIPCLVAHLRDDHRVDMHSGCTFNHRYVKSNPMEVENATWMLTAFQLGMAPVYMAFLRFMGDEREARNYSYSLEVGGNGRKLTFEGSPRSIRDSHKKVRDSHDGLIIYRNMALFFSGGDRKELKLRVTGRIWKEQQNPEGGVCIPNLCS

SEQ ID NO: 195409 - protein, 312 aa, Glycine max
  Coding DNA Sequence Number=SeqID_78631
  Gene Ontology: Mol. function=oxidoreductase activity; Cellular component=membrane; Biological process=metabolic process
  Homolog annotation: Hit_ID=Q2QLP7; Match level="QueryCoverage=57%, HitCoverage=59%, E-value=3e-50, Identity=55%"; Hit description =Oxidoreductase, short chain dehydrogenase/reductase family protein, expressed
  Pfam annotation: Domain name=KR; Domain location=7-182; Score=-85.3; E_value=0.021; Accession=PF08659.1; Description=KR domain
  Pfam annotation: Domain name=adh_short; Domain location=5-170; Score =79.9; E_value=7.8e-21; Accession=PF00106.15; Description=short chain dehydrogenase
  Pfam module annotation: Pfam domain module=KR::adh_short; Domain location=7-182::5-170
MSDRKIVLVTGCAKGGIGYEYCKAFAERNCHVVASDISTRMQDMSDLESDPNIETLELDVSCDQSVSSAVATVISKHGHIDILINNAGIGSTGPLAELPLDAIRKAWEINTLGQLRMTQHVVPHMAMRRSGSIVNVGSVVGYVSTPWAGSYCASKAAVQAMSNSLRLELRPFGVNLVLVLPGSVRSNLGRANLERLGNYEWKLYKDFKEVIEERARASQGDKATDGRVFARHVVKKVLGPKPPKQIVFGHMTGLFALLSWSPLWTKELNLSDDGGEEIISQAVDKSNEKKGEGNPEDELGKLAQQNEEVSQT

SEQ ID NO: 195410 - protein, 271 aa, Glycine max
  Coding DNA Sequence Number=SeqID_78632
  Homolog annotation: Hit_ID=Q2HT09; Match level="QueryCoverage=32%, HitCoverage=51%, E-value=4e-11, Identity=37%"; Hit description=Acid phosphatase/vanadium-dependent haloperoxidase related
  Pfam annotation: Domain name=DUF1442; Domain location=107-271; Score=- 47.3; E_value=0.00048; Accession=PF07279.2; Description=Protein of unknown function (DUF1442)
MRLKPRQTGKRESATPWQMATEVERAVQRAEWEEGIPPDANKSLKSHFLSMKKFRKTFMDCAISHASSPDTKVGLAASVATKGLIRSFAFAVTLSRATPKPPWFRRGCKALTFTLVGVQQEGSNEFVSALAAGMKAKLIVEVASRASPSTIALAAAARQTGGRLVSILPVPVLDESQEVIKNSGLKDQVEFRTEDPSKILPYCENIDFSLVDCKDENYASEISKHPIGKGIEVTVLCKNDETDKRVGVRENRSRISRSKWVAKFDEESREE

SEQ ID NO: 195411 - protein, 458 aa, Glycine max
  Coding DNA Sequence Number=SeqID_78633
  Gene Ontology: Mol. function=transferase activity; Cellular component= chromatin; Biological process=DNA integration
  Homolog annotation: Hit_ID=Q1SX87; Match level="QueryCoverage=99%, HitCoverage=33%, E-value=0.0, Identity=76%"; Hit description =Polynucleotidyl transferase, Ribonuclease H fold
MWVLRHKYKSDGSFERYKARLVGDGKTQAQGVDCDETFSPMVKPATIRAVLSIAVSKSWPIHQMVVKNAFLHGHLNETVYMHQPMGFRDKNHPNHVCLLKKSLYGLKQALHAWYQRFADFVATIGFSHSKSDHSLFIYKNGSDTAYILLYVDDIILTTSSDCLRKSFMTLLGSEFAMKDLGPLSFFLGIAVTRHAHGLFLSQKQYVTKIIERAGMFNCSATNDAPFNDPTKYRSLAEALQYLTFTRPDISYVVQHICLHMHAPTNEHMGALKRIIRYLQGTLSHGLHLYKSTIDRLISYTDADWGGCPDTRRSTSGYCVFLGDNLISWSSKQQPILSNSNVEAKYRGVANVVSDSCWIRNLLLELHCPIEKATLVYCDNVSVIYLSDNLVQHQRTKHIEMDIHFIREKVARGEVRVLHVPSRYQIADIFTKGLPRVLFNDFRDSLSIREPPASTEGEC

SEQ ID NO: 195412 - protein, 149 aa, Glycine max
  Coding DNA Sequence Number=SeqID_78634
  Gene Ontology: Mol. function=transcription coactivator activity; Cellular component=nucleus; Biological process=regulation of transcription, DNA-dependent
  Homolog annotation: Hit_ID=Q9AVE8; Match level="QueryCoverage=96%, HitCoverage=81%, E-value=1e-23, Identity=41%"; Hit description =Putative transcriptional coactivator
  Pfam annotation: Domain name=DEK_C; Domain location=5-60; Score=35.5; E_value=1.8e-07; Accession=PF08766.1; Description=DEK C terminal domain
  Pfam annotation: Domain name=PC4; Domain location=72-146; Score=18.5; E_value=1.5e-05; Accession=PF02229.6; Description=Transcriptional Coactivator p15 (PC4)
  Pfam module annotation: Pfam domain module=DEK_C::PC4; Domain location=5-60::72-146
METETRRKVEEMVLDILKKSNIEEATEFTIRVAASERLGIDLSDSPSRHFVRTVVESYLLSVAANEISKDAEKKENEDIAAKNDDDVKKGDVVAVPKLKRDDPERVICQLSSRRNLAVKHFKGTTLVSIREFYMKDGKLLPGSKASGRY

SEQ ID NO: 195413 - protein, 112 aa, Glycine max
  Coding DNA Sequence Number=SeqID_78635
MEQDRWFELIDHAIQKLVHDNTNKVQESLHNNDAQYQHALSHLLSVSQLKGEEILEQFEASSSSEPVASITQETESENEDAGESKGSENDEIIKELKKVKRQNFMTHCLKTL

SEQ ID NO: 195414 - protein, 112 aa, Glycine max
  Coding DNA Sequence Number=SeqID_78636
MEPSKGNIKGRRKTSEQNKETRSYFTWNLEMKCVLAEARNFLFKAISNWDDIVELCAKDRTTDRGVEIVMDVDEVMSTRENEVELMGLEDANVSIDLEELDYGSKRRGQSLS

SEQ ID NO: 195415 - protein, 387 aa, Glycine max
  Coding DNA Sequence Number=SeqID_78637
  Gene Ontology: Mol. function=nucleic acid binding; Biological process= regulation of transcription, DNA-dependent
  Homolog annotation: Hit_ID=Q93YB6; Match level="QueryCoverage=99%, HitCoverage=67%, E-value=5e-54, Identity=36%"; Hit description=PBF68 protein
  Pfam annotation: Domain name=zf-CCHC; Domain location=351-368; Score =17.7; E_value=0.0012; Accession=PF00098.13; Description=Zinc knuckle
MVDLQEECSCHRGSYKKDGRKDKFISFCILLNIYCLLFWLKRKHVARLEPNGKQNGDASNSAVDVALEPNGKQNGDASNSVVDVAPLEPHGKQNGDASNSVVDVAALEPVVPIEVIRLDGKNFQSWARQMELLLKQLKVDYVLDEPCPNPTLGESAKAEDIATAKAAERRWLNDDLTCHRNILSHLSDPLYNLYANRKLSAKDLWEELKLVYLYEEFGTKRYHVKKYLEFQMVEEKAVIEQIRELNGMADSIAAAGMFIDDNFHVSAIISKLPPSWKDFCIKLMREEYLPYRKLMERIQIEEEYRYGVKRVVEHSNSMEGYHQAYNGGHRRADYKPLGMCRNRSEINARSVPCSVCGKRGHLSKHCWRRNDKQTNERKSEEDERIPT

SEQ ID NO: 195416 - protein, 168 aa, Glycine max
  Coding DNA Sequence Number=SeqID_78638
MDPNIVNTAITSRRRKREEYKKIILLVAACVVHMRCIVALDETHILVTVSPDERPRYRNRKNDVSTNVLAACGPDLREIKGIWTTRVTEVGKDRATGHGAEAAMDADEAMSRETNEVEFMGLGATTTIDLEEPSSNTKEKRQGSTSSGTHSFSQDKYWRKRRNNSFFG

SEQ ID NO: 195417 - protein, 102 aa, Glycine max
  Coding DNA Sequence Number=SeqID_78639
STVAGRVCPCAELEISELGRTVEGCASGIVCFYLADPIYAFSTSHKPSPKLCCPNHCNQSPPLMCQSSSAPRVRSPLVPLRLCLCGSLSLFSVSYCSVSGVK

SEQ ID NO: 195418 - protein, 230 aa, Glycine max
  Coding DNA Sequence Number=SeqID_78640
  Gene Ontology: Cellular component=chloroplast thylakoid membrane
  Pfam annotation: Domain name=Methyltransf_11; Domain location=99-195; Score=10.9; E_value=0.0046; Accession=PF08241.2; Description =Methyltransferase domain
  Subcellular localization annotation: CTP_CleavageSite=12; ConfidenceScore=5.11e-01
MRVVRFAGTMTRRQASSTRRGGLSRILHSKSKSSPLLSISLVLFGAILLILYACSGSGVLGGRKDVVSRVEGDFSCTFEVSSAIPVLKNAYGGSMKNVLHVGPESCSVVAKFLREGETEAWGVEPYDIEDADRNCKALVQKGIVRVADIKFPLPYRAKSFSHVIVSDALDYLSPKYLNKSLPELARVSADGIIIFAGYPGQRRAKIAQLSKFGRPSFSPYFSYANERHRW

SEQ ID NO: 195419 - protein, 92 aa, Glycine max
  Coding DNA Sequence Number=SeqID_78641
  Homolog annotation: Hit_ID=Q1T693; Match level="QueryCoverage=69%, HitCoverage=7%, E-value=6e-14, Identity=43%"; Hit description =Integrase, catalytic region; Zinc finger, CCHC-type; Peptidase aspartic, catalytic
MFLSVRWSGGKQQRLVAVTGGRGWWRRRALHMKFDHMVTTIIKSHDTNTMMVNLNKVAETSGSAKIRAHDNFNSKGRGNFRGKGQGNYRGRG

SEQ ID NO: 195420 - protein, 298 aa, Glycine max
  Coding DNA Sequence Number=SeqID_78642
  Gene Ontology: Mol. function=RNA-directed DNA polymerase activity; Cellular component=chromatin; Biological process=chromatin assembly or disassembly
MPQAIQTPEQQTHLAKLLGYDYIIQYKAGSNNVVIDVLSRIPNNHLFSLSLPNFEFEEQLGKSLLGNSSYHELSEQIFFHGKIWLPTNSQFTFLLLEEFHKTPLGGHMGVAKTLHCLEASFFWPCMPPSHGFTTILVVVDRFSKGVHLGALPPHYTASKVVVLFMDIVSKLHKFPHNLVFDRDSLFPTQWFNFLALAKWSYNTSVHFGTGLSPFKADDSLLTTRATIYASLQCHLSKAQVAMKHHVNVNSRGVLFSITTRASNGLAASTSVKATTVDGSGVVGSEVAAGGADDGGDEQ

SEQ ID NO: 195421 - protein, 254 aa, Glycine max
  Coding DNA Sequence Number=SeqID_78643
  Gene Ontology: Mol. function=RNA-directed DNA polymerase activity; Cellular component=chromatin; Biological process=chromatin assembly or disassembly
MEGPTLCWYQWMRRNNFLTSWPAMLQALESRFAPSFYDGPQGALFKLSKRGSVNEYLIKFESLANRIVGLAPPFLLSCFVLGLNPKLQYEVQALKPFSLPQVAILAKLQEDKLLDLHRYSRAQSHLPSPMNLLLSSSAAPTPRFPIKRLSPEEMVVFRDKGLCYHCEEKWVIGHRCKPRLHLFIVNEKNLSHSDPSIAVDASLAALSFDDLPNNPSQLSLNTHSGMLAIEMFCIYGHILHHHVTILVDGKSTHI

SEQ ID NO: 195422 - protein, 124 aa, Glycine max
  Coding DNA Sequence Number=SeqID_78644
  Gene Ontology: Mol. function=transcription factor activity; Cellular component=nucleus; Biological process=regulation of transcription, DNA-dependent
  Homolog annotation: Hit_ID=Q38Q39; Match level="QueryCoverage=88%, HitCoverage=68%, E-value=3e-07, Identity=34%"; Hit description =Ap2/EREBP transcription factor
  Pfam annotation: Domain name=AP2; Domain location=1-28; Score=-7.3; E_ value=0.0037; Accession=PF00847.10; Description=AP2 domain
MAARAYDVAAYCLKGRKAHLNFPDEVDSLPLPSSRSARDIQAAAAQAARMMKASGNDEKSGIASDDGDSCGDDFWGEIELPELMDGECCWGCPAGASSWTSSGDLAEWPEEELSPQQPLFMACL

SEQ ID NO: 195423 - protein, 423 aa, Glycine max
  Coding DNA Sequence Number=SeqID_78645
  Gene Ontology: Mol. function=transporter activity; Cellular component= integral to membrane; Biological process=transport
  Homolog annotation: Hit_ID=Q1RV90; Match level="QueryCoverage=97%, HitCoverage=99%, E-value=1e-154, Identity=70%"; Hit description=Tpt phosphate/phosphoenolpyruvate translocator, putative
  Pfam annotation: Domain name=DUF6; Domain location=279-415; Score =13.4; E_value=0.011; Accession=PF00892.11; Description=Integral membrane protein DUF6
  Pfam annotation: Domain name=TPT; Domain location=270-415; Score =186.3; E_value=7.7e-53; Accession=PF03151.7; Description=Triose -phosphate Transporter family
  Pfam annotation: Domain name=UAA; Domain location=100-421; Score= -139.4; E_value=0.0019; Accession=PF08449.2; Description=UAA transporter family
  Pfam module annotation: Pfam domain module=DUF6::TPT::UAA; Domain location=279-415::270-415::100-421
  Subcellular localization annotation: CTP_CleavageSite=39; ConfidenceScore=5.52e-01
MISSMKCTASSLTCSAFSNRKLPIARPQLVTLPTINNVEQNMGPSQLCSQKPLYLSSTENLALVRRRRVTECQAYEADRSRPLEINIELPAEEAAQRFKIGVYFATWWALNVVFNIYNKKVLNAFPYPWLTSTLSLAAGSLMMLVSWATRVAEVPKVNLDFWKALFPLWTVFQNLDHDSWCINFVKVAVAHTIGHVAATVSMSKVAVSFTHIIKSGEPAFSVLVSRFLLGEAFPMPVYLSLLPIIGGCALAAVTELNFNMIERTLDDVSGFMGAMISNLAFVFRNIFSKKGMKGMSVSGMNYYACLSIMSLLILTPFAIAVEGPKVWAAGWQTAVSQIGPNFVWWVAAQSVFYHLYNQVSYMSLDQISPLTFSIGNTMKRISVIVSSILIFHTPVQPINALGAAIAILGTFLYSQVHSPLPLN

SEQ ID NO: 195424 - protein, 84 aa, Glycine max
  Coding DNA Sequence Number=SeqID_78646
MAFTSLPSPRREEKALTQPRWYRWIGGSVCMNDLCYRVEDKCLIRRMCLFALLNWKCYDGTSPRPLLHDLHLCPFGLLHLITLL

SEQ ID NO: 195425 - protein, 321 aa, Glycine max
  Coding DNA Sequence Number=SeqID_78647
MEQEGHQWIVHPHEEEEEIMEDGALIRKQTVSHNKGNFITDELTFSSSSSSSSSSNGSEHSNGVCSVVTAPPDGYPVQKEEEVAEIGGVGENCNHVNGDIVDYAAVGLAQVAEFAGTETNGEAISGVVMSQNKNSVYFDEQQGMWKCHHCTWTKRFDSPWTVPNWNLKGYPDLMTIKTRIQHGPCFVCETKDDEVNGLNGVQNGDASVSVHLTNLGEREFDVQADQLVFQNSLCSEISDQCMKTVDNKLPSTTEISHLHNSSDIQATAITNFPEETSTKEAPILIEEIDEQLEEFDVEAVLAKQETHDLFCPNCRSCITKR

SEQ ID NO: 195426 - protein, 67 aa, Glycine max
  Coding DNA Sequence Number=SeqID_78648
SSEESSKAAEEEGAEMGGMCVRDEEKEVKFAMVSSTVGQRKELYKAGKEGRKQKMQGKSDSDALMKS

SEQ ID NO: 195427 - protein, 426 aa, Glycine max
  Coding DNA Sequence Number=SeqID_78649
  Gene Ontology: Mol. function=nucleic acid binding; Cellular component= intracellular
  Homolog annotation: Hit_ID=Q9FIR7; Match level="QueryCoverage=96%, HitCoverage=96%, E-value=9e-88, Identity=45%"; Hit description =Arabidopsis thaliana genomic DNA, chromosome 5, P1 clone:MXC17
  Pfam annotation: Domain name=DUF1671; Domain location=78-405; Score =51.6; E_value=4.4e-13; Accession=PF07910.3; Description=Protein of unknown function (DUF1671)
MAEFIREARCERKILERHANTHFDNDDGNYRSPSVSGLHFDATSGDCKSWCGGRNNGAWKMDEKISCLVDLQRRGEFHKVERGLMALLRNCLESDGENSRSILSGYVDHFQSIPFEDVGWGCGWRNIQILSSHLLAQRPEAREAMYGGSGFVPDIPSLQRWLEVAWERGFDAPGSDQFNHAIYGSKKWIGATECAALLRSFGLRVRVVDFGPKESESLYLSVPSSSVGAKELVRINDARKRKAPNTHGPMDRYMSRAVAQASCSQDAKPCSSLIRIRDTVDKESSGDRVLNSTERQNEGHRVLMDFVWNYFSHKDTVQFGQRRVLISDKTPLYFQHDGHSRTIVGIQVKYQQSGIPQYSLLVMDPGHRTAALERSLREKVGWQKFIKRGVHTLKKQQYQLCYVDPGIASEEEMEKLKTIDSVFLEF

SEQ ID NO: 195428 - protein, 353 aa, Glycine max
  Coding DNA Sequence Number=SeqID_78650
  Gene Ontology: Mol. function=metal ion binding
  Homolog annotation: Hit_ID=O23280; Match level="QueryCoverage=83%, HitCoverage=83%, E-value=7e-45, Identity=40%"; Hit description=RING -H2 finger protein RHF1a
  Pfam annotation: Domain name=zf-C3HC4; Domain location=29-69; Score =4.2; E_value=0.058; Accession=PF00097.15; Description=Zinc finger, C3HC4 type (RING finger)
MCGSASVSNSVSTYGKFCREVMCIFEECCAVISKCPGLRSLNPVTCCKHEYHLHCIIEWSQRSKECPICWQSLALKDPASQELLAAVEDEKCMRSRNIANSRAPLGQLNESHDDSCSDDSDFDDQIMKRLVSAARRAHFVQRQERKRSPSAGPSEALGVNSSMHVSEVQTTLTTSSSGGSLPASGVPSTVSIQPPALNTTPESARRPNTSEISFPESFKSKFSAASARYKESISKSTLGLKEKLLAHNVSVKELSKGVQREMNAGIAGVARMIERLDLSSKRSSAPLIAVHSVATSDFPSSGKSVEENGIGGSPSKENGGAVHDVSSDVPPLVTNMQSFRTKTPPFLQVNPNL

SEQ ID NO: 195429 - protein, 149 aa, Glycine max
  Coding DNA Sequence Number=SeqID_78651
  Homolog annotation: Hit_ID=Q9C8A3; Match level="QueryCoverage=38%, HitCoverage=3%, E-value=1e-15, Identity=54%"; Hit description=Acetyl- CoA synthetase, putative; 45051-31547
MVVEVKDYIVEGRCRRRPFVLCVVLACVARWCGAPSSLVRGASAVVALEFAVAVITHVVVALEFAWCRWSHWSSHVAVRACVAHPIFMRKSDEKIKLWLFLPGRHSSVVETAQTAVSGLRVVASGLWLAPGDSEEVAAALSQALRNCVE

SEQ ID NO: 195430 - protein, 209 aa, Glycine max
  Coding DNA Sequence Number=SeqID_78652
MGESHVKHFHLIIGKENTLNQKKSSKITVLLNCGYDGAMAVWHHGFLGKCHQIAVALRVSYGGRHNLNSGGGMAVMAEDTFFFLKFLQHRLGRVGVTRPNTLTRFSHENGMSNASTNSNMRTPVRPAAPRELQRDDDMSDDGDGKLQCDDSTSTTHQRRRRPAPARHASEHHAQDERTATATATVCDSNVPSSKWLKIVKVLYFVDSCM

SEQ ID NO: 195431 - protein, 147 aa, Glycine max
  Coding DNA Sequence Number=SeqID_78653
  Homolog annotation: Hit_ID=Q337D0; Match level="QueryCoverage=92%, HitCoverage=94%, E-value=4e-54, Identity=71%"; Hit description =Expressed protein
MEVYGNSMVAAPSNVIYLSSILGQGGPIPGHRCNWKCENEHVCGNMYRCKLTGLTHICDKNCNQRILYDNHSSLCLASGQIFPLTPEEEQAVRGVRRKLDMENSPSDSCGFKRRRDAQFHPSPFERSFSAVSPICSQGLCTRHVYDT

SEQ ID NO: 195432 - protein, 154 aa, Glycine max
  Coding DNA Sequence Number=SeqID_78654
  Gene Ontology: Mol. function=ribonuclease P activity; Cellular component=nucleus; Biological process=tRNA processing
  Homolog annotation: Hit_ID=Q6AWV1; Match level="QueryCoverage=99%, HitCoverage=100%, E-value=4e-51, Identity=62%"; Hit description =Probable ribonuclease P protein subunit 2
  Pfam annotation: Domain name=RNase_P_Rpp14; Domain location=7-118; Score=70.9; E_value=4.2e-18; Accession=PF01900.9; Description=Rpp14 family
MVGFRNRYMVMEVFLNPNRDKGGDDSVIVTQFNVSKAVRDSILVNFGECGLASSLGSFQVKYVNPITNVCIIRASREQYQKVWSAITMVTNIGNCPVMFNLLDLSGSIRACKNAALKCEESKFEQYKLMLGDRFSSDHTHRMNTYLDRIKVLEH

SEQ ID NO: 195433 - protein, 285 aa, Glycine max
  Coding DNA Sequence Number=SeqID_78655
  Gene Ontology: Mol. function=molecular_function; Cellular component =anchored to membrane; Biological process=biological_process
  Homolog annotation: Hit_ID=Q9FLU2; Match level="QueryCoverage=83%, HitCoverage=94%, E-value=1e-100, Identity=70%"; Hit description =Thaumatin-like protein
  Pfam annotation: Domain name=Thaumatin; Domain location=33-251; Score= 285.3; E_value=1.2e-82; Accession=PF00314.8; Description=Thaumatin family
  Subcellular localization annotation: CTP_CleavageSite=44; ConfidenceScore=5.53e-01
MPIVMTSWKFPSFLAILFTLLSYSFSSIFTITNNCSHTIWPGTLSGAGSPPLPTTGFRLDSGQMMKLTSVPGWSGRIWARTGCTFDATGIGKCQTGDCGGRLECDGNGAAPPTSLFEITLGKGNDQDYYDVSMVDGYNLPLLVQPRGVYGTGVCNATGCVTDINRGCPKELQVVGGDAYQDGVVGCKSACEAFGSDQYCCSGEFANPTTCQPSYYSTLFKQACPKAYSYAFDDATSTFICKAFEYDIIFCPNGNKVKKPNGAFPPPPPSIGWPDQKFQQQQRLRH

SEQ ID NO: 195434 - protein, 33 aa, Glycine max
  Coding DNA Sequence Number=SeqID_78656
MHLGHFIQYRESLQTIALNKPERPVSNKDKYGF

SEQ ID NO: 195435 - protein, 47 aa, Glycine max
  Coding DNA Sequence Number=SeqID_78657
MDGSRPIFDSIVMAPKKLLTKRARKDATGEGFSVAPQAEIEFDGHCF

SEQ ID NO: 195436 - protein, 233 aa, Glycine max
  Coding DNA Sequence Number=SeqID_78658
  Gene Ontology: Mol. function=mismatched DNA binding; Cellular component=cytoplasm; Biological process=maintenance of fidelity during DNA-dependent DNA replication
  Homolog annotation: Hit_ID=Q9LVW1; Match level="QueryCoverage=57%, HitCoverage=16%, E-value=1e-26, Identity=47%"; Hit description=DNA mismatch repair protein MutS2-like
MVKNMVKSQNVSNPERPRFNTQWKKFSVFGEIKLEVIINYTMSGSYSSERLASGRSNAINIAERLGLPSVVVDTARMLYGSASAEIDEVITDMERLKQEYQELLDEARHYLRHSRGLYNSLLNTRRKIIEYSTNLRFKKMRDVSEAAAMARSILHKKVRELDASAKQPSQNNKTISSSNLSATNKSQTVAENKEPTIADKSASSVKVFNRSRSDKSGPPKVVIWYMSLPSGNR

SEQ ID NO: 195437 - protein, 45 aa, Glycine max
  Coding DNA Sequence Number=SeqID_78659
MELYMQHLADQQAANHRGQVGAEVPGDEDSTEEDSDMADVMDFFL

SEQ ID NO: 195438 - protein, 55 aa, Glycine max
  Coding DNA Sequence Number=SeqID_78660
MEFDEVNLKPTYKVLWGVPGHERGEGFYGNVIKTELVVVMMKAPVPNSTVNEAIN

SEQ ID NO: 195439 - protein, 145 aa, Glycine max
  Coding DNA Sequence Number=SeqID_78661
MVTAHDAHYGQYQVVVNGYYHVPGRGGWFGYLWLFVPNLGDFQKRHVVGTFFAIAIYFLSSKLRRVVSSLFSYLRKGMGPKPGSDMKMNAIRSGIVVLGALAFGYLSIQIGFKPYLEKAQNQNALYESDPSSQEESSSAFPERTS

SEQ ID NO: 195440 - protein, 634 aa, Glycine max
  Coding DNA Sequence Number=SeqID_78662
  Homolog annotation: Hit_ID=Q2RAK5; Match level="QueryCoverage=43%, HitCoverage=58%, E-value=3e-98, Identity=61%"; Hit description =Expressed protein
  Pfam annotation: Domain name=DUF231; Domain location=117-273; Score =122.5; E_value=1.2e-33; Accession=PF03005.6; Description=Arabidopsis proteins of unknown function
  Pfam annotation: Domain name=KR; Domain location=339-508; Score= -22.3; E_value=4.7e-06; Accession=PF08659.1; Description=KR domain
  Pfam annotation: Domain name=adh_short; Domain location=337-504; Score=112.4; E_value=1.3e-30; Accession=PF00106.15; Description =short chain dehydrogenase
  Pfam module annotation: Pfam domain module=DUF231::KR::adh_short; Domain location=117-273::339-508::337-504
MLENLRNKRLVFAGDSIGRNQWESLLCMLSSGVPNKESIYEVNGSPITKHKGFLVFRFKHYNCTVEYYRAPFLVLQSRPPPRTDRKIRTTLKLDEMDWYSMKWRDADILVLNTGHWWNYEKTIRGGCYFQEGVEIKLEMKVEEAYKRSIKTVLNWIQSSVNPKKTQVFFRTYAPVHFRGGDWRKGGNCNLETLPELGSSLVPNDNWSQFKIANSVLSAHTNTSEVLKLKILNVTQMTAQRKDGHPSIYYLGPNAGPAPPHRQDCSHWCLPGKLRKWYPFPKHTIDLVQFRGRIIITDSPMGDANFAFFVLFLLPVFLLAVLYFLVRPRPVKIPIKNRHVFITGGSSGIGLALAHRAAAEGARVSILARSPDKLEEARNAIRLATGMEVAAFAADVRDFEAVKRAVDDAGPIDVLLLNHGVFVALELDKMELSEVKFTMDVNLMGTLNLIKAALPAMKNRNDPLPASIALVSSQAGQVGIYGYVAYSASKFGLRGLAESLQQEVIEDNIHVSMIFPPDTDTPGLAEEGVVMHRAECGTEEDAEQDENKGRRWKTSSKNKRRPELTKIITASSGSMKADEVAQKALDGIKCGDFIVSCNFEGIALSLATAGLSPQRSFLMAFLEVVAAGILRIVAL

SEQ ID NO: 195441 - protein, 150 aa, Glycine max
  Coding DNA Sequence Number=SeqID_78663
  Gene Ontology: Mol. function=mismatched DNA binding; Cellular component=cytoplasm; Biological process=mismatch repair
  Homolog annotation: Hit_ID=Q9LVW1; Match level="QueryCoverage=58%, HitCoverage=9%, E-value=9e-28, Identity=73%"; Hit description=DNA mismatch repair protein MutS2-like
MHLVIIHDKTLLKTRVIVITGPNTGGKTICLKTVGLAAMMAKSGCRLTKALNSDFESNVGLYVLASESAQIPWFDSVFADIGDEQSLSQSLSTFSGHLKQISHPWWNGVTDFFANHHRQFVKGNPPWWHHKAQWCVYMAEFWPLPSAHEI

SEQ ID NO: 195442 - protein, 134 aa, Glycine max
  Coding DNA Sequence Number=SeqID_78664
MAIVGSDVEALGHYGLTMALLVDHDPHELTTGRLKRRGERRHHPLENKPWKEKLNHQGRALDKKLREESSMEEENERERKKVARKIEGRKGKKLNFEVCHTSFSFIKVTTNVTHASIYSLGSFLEKLVLHLFNS

SEQ ID NO: 195443 - protein, 210 aa, Glycine max
  Coding DNA Sequence Number=SeqID_78665
  Gene Ontology: Mol. function=mismatched DNA binding; Cellular component=cytoplasm; Biological process=maintenance of fidelity during DNA-dependent DNA replication
  Homolog annotation: Hit_ID=Q9LVW1; Match level="QueryCoverage=84%, HitCoverage=26%, E-value=5e-21, Identity=31%"; Hit description=DNA mismatch repair protein MutS2-like
VKTAIQHARRSIPVSGYEARAIVALLQCAEIVQGDLKAVIKEDKDWHNRFMPLTEVARQQVQVIERKVIPVYFTIFHTVGSGDTGCIRDVQQLIESIIRNEKSETSTLEVNNIDGRWCVRVDSGQKTSFKGLLLSSGSGVGSTIEPLSAVPLNDELQRARSLVVKAEADVLLALTKKMQLDLDDIEKTLNSLVELDVEFAYWFSFQWSSS

SEQ ID NO: 195444 - protein, 127 aa, Glycine max
  Coding DNA Sequence Number=SeqID_78666
  Homolog annotation: Hit_ID=Q8HVY3; Match level="QueryCoverage=82%, HitCoverage=7%, E-value=9e-44, Identity=84%"; Hit description=DNA -directed RNA polymerase beta'' chain
MDYVGIRLANPYLATPGATVHDHYGKIIFEGDILVTFILEKPRSGDITQGLPKVEHVLEVRLIDPISMNLEKRVDTWNGCITKILGIPWGFLIGDELTIVQSHIFLQVFKKRLEFYQKPLSGGTYIG

SEQ ID NO: 195445 - protein, 122 aa, Glycine max
  Coding DNA Sequence Number=SeqID_78667
MTGERISPYIQTILLKRQPSRVNQALYLVLEGHVGAHVGIGVPGHLGVEVTTWVSPSFFLAPPVLDLLLLGDAKAHGCVFQERKMHGVATNVYSRKTSEKPERRGLRTLSVKGSGVVFTHGE

SEQ ID NO: 195446 - protein, 366 aa, Glycine max
  Coding DNA Sequence Number=SeqID_78668
MGWPSCDRTAPMPAPEASVSTIKESQSPIITISKQSYDVLQLLESSLCFRGPFQLWFVEPAIVEWQGPSPKLLLSLSLTPHGSDILSEVGKSNFENHWAPPNSSNISSTIGIGTRPCINKGQKEACARSDYATLQHGFHLKLDLLLLKMGILVGSVVGVQNRCLNLWSKFSISRNSKVEKNVTAPMVTFQLILVTHHDLEWVGGRPMRHTISKAVLPTRAYKLIWAGNGPSASPSSLLTSGGSSEGLSSSSTIKRKNLEEYSSGDNLLKGMDRECDGMGNKADEGKGARGREEGGPWDPGRSEPREHKGTQAMTTANRSWTSIGTMLRPNPPSLDDEKKEMILSQMGSLWTMLVMEVDFPCVLPSS

SEQ ID NO: 195447 - protein, 229 aa, Glycine max
  Coding DNA Sequence Number=SeqID_78669
  Gene Ontology: Mol. function=RNA-directed DNA polymerase activity; Cellular component=chromatin; Biological process=chromatin assembly or disassembly
  Pfam annotation: Domain name=zf-H2C2; Domain location=43-81; Score =18.7; E_value=0.0012; Accession=PF09337.1; Description=His(2)-Cys(2) zinc finger
MKKSIDKKNYVLTQDLILMNNRIWLPKGINFIQTLLQEYHNTHIGGHMGIKKTLARLRDNYVWSEMHEDVRKFILTCIVCQQTKYEAKKPAGLFCPLAIPSRLWEDLSLDFIVVDRFSKGIHLGMLTTNYITLTIAALFMEIVGKYHGMPQSLVSDRDPLFVSREAVFISLRKKLLKSQERVKATIDAHQRDVNFELGEWVMVRLRPYRQSSAAKVSNSKLAKRFYGPF

SEQ ID NO: 195448 - protein, 80 aa, Glycine max
  Coding DNA Sequence Number=SeqID_78670
  Homolog annotation: Hit_ID=Q1RYI2; Match level="QueryCoverage=74%, HitCoverage=9%, E-value=4e-07, Identity=43%"; Hit description =Ribonuclease H
MEKGFKIRLALYWVGPGLNMTSRAGTVSSQPSSAPFLISEQTFIQDFPEEHLESFWSVPLPNYFEQRIRSGGSKHILRCY

SEQ ID NO: 195449 - protein, 140 aa, Glycine max
  Coding DNA Sequence Number=SeqID_78671
PSHATPLKLPLAFTFYEGLGFWKGLGLQESSCSHTLVLWECPKCRVSWYKVKDDDCSNEESTKKDPPTKKKLELCLEYMEKVKSIGLSESHHANRWGSKGLRGFAIVTMGHEERNQGYLYILNNNKVVDLHITAHKEFLQ

SEQ ID NO: 195450 - protein, 233 aa, Glycine max
  Coding DNA Sequence Number=SeqID_78672
MQSQMQSQGLELPPEAEVGPSVSRVSTKESCVDPLGLDPETADLDKCGLYVNKMKVGVEEVQDVDAHIPVPTQKVQLVGQALNIFLAWPTHLDKQGVEGSAKPVDMLDLDVNPLYLMTLSIPQLFLKFVGFNNNQGSKSKAAARWIIIKCNKDKGSTECRLGKSSYSVANRVAYWESRESDIYNYVANLGLGRFGQPYQQKRESELQPIAIKKAALLGNGGIMPNGLDFQLSG

SEQ ID NO: 195451 - protein, 378 aa, Glycine max
  Coding DNA Sequence Number=SeqID_78673
  Gene Ontology: Mol. function=nucleic acid binding; Cellular component= oxygen evolving complex; Biological process=DNA integration
MTKEIAAIEKNHTWEFTVLPDGVKPIGVKWVFKTKLDADGQVEKYKARLVEKGYAQKHGIDYTEVFAPVARLDTIRVILAIVAQFSWEVFQLDVKSAFLHGELNEHVFVLQPEGFIRKGEEEKVYRLKKALYGLKQAPRAWYNKIEAYFAQEKFDKCPSEHILLTKSQGGKILIVSLYVDDLIFTGSDKTMCNEFKHSMMLHFDMSDLGQMRHFLGIEVKQCTNGIFICQRSKFNKQIYDQSYHGTLTCSKESLTKQTVVALSTTEAEYVAATLCACQCVWLGRLLEKIGVKEKTKVVIMCDNNSTMQLSKHPVFHGRSKHIDVKFHFLRDLVNDGIVKLSFCSSQDQLTDILTKPLKLEQFEKLQAMLGVTSIDALV

SEQ ID NO: 195452 - protein, 114 aa, Glycine max
  Coding DNA Sequence Number=SeqID_78674
  Gene Ontology: Mol. function=oxidoreductase activity; Cellular component=intrinsic to endoplasmic reticulum membrane; Biological process=electron transport
  Homolog annotation: Hit_ID=Q9FLK4; Match level="QueryCoverage=88%, HitCoverage=22%, E-value=1e-30, Identity=60%"; Hit description =Dimethylaniline monooxygenase (N-oxide-forming)-like protein
MVSETKQSKSVCVTRARPSGLLLARVRKEGHKVVVLEQNHDIGGQWLYDPNVQEEDPLGRDPWLKMHSNIYESLTLTSPRQIMGSTNFLFLVKKGGDTMKFPSHTKFLSSHTDH

SEQ ID NO: 195453 - protein, 513 aa, Glycine max
  Coding DNA Sequence Number=SeqID_78675
  Gene Ontology: Mol. function=hydroxymethylglutaryl-CoA lyase activity; Cellular component=mitochondrial inner membrane; Biological process=metabolic process
  Homolog annotation: Hit_ID=Q2PF06; Match level="QueryCoverage=97%, HitCoverage=78%, E-value=3e-69, Identity=78%"; Hit description =Putative hydroxymethylglutaryl-CoA lyase
  Pfam annotation: Domain name=HMGL-like; Domain location=54-485; Score= 110.6; E_value=4.6e-30; Accession=PF00682.9; Description=HMGL-like
MGRNSMKFGMIDNSFYTSDYQYSPQNNNNNVQDMAYKFMKGIPNFVKIVEVGPRDGLQNEKNIVPTDVKIELIHRLASSGLSVIEATSFVSPKWVPQLADAKDVMQAVHNLGGIRLPVLTPNLKGFEAAIAAGAREVAVFASASESFSKSNINCSIEESLVRYRAVTRAAKQLSIPVRGVSLGTTVKLLLGDRLVMGLNLKTALLLMLVSVIKKRPWRRYGGMASRNFEKTPPNSGGVAGCVWQRHGGRHSHDGNSEREKEAKNRTAQQSSAARPAAVSSTRTATTQSNSTTHNARERPKQDSSEREDADDQATLTATEVFCSSPPFVRAAGGGVAAAWSYAGREGFEVEGPIPPSKVAYVAKELYDMGCFEISLGDTIGVGTPGTVVPMLLAVMAVVPAEKLAVHFHDTYGQSLPNILVSLQMGISAVDSSVAGLGGCPYAKGASGNVATEDVVYMLNGLGVKTNVDLGKLMLAGEFIGKHLGRPSGSKTAVKVISVGGDCCSGRFDSDVVG

SEQ ID NO: 195454 - protein, 348 aa, Glycine max
  Coding DNA Sequence Number=SeqID_78676
  Homolog annotation: Hit_ID=Q9ZPY4; Match level="QueryCoverage=77%, HitCoverage=60%, E-value=1e-29, Identity=34%"; Hit description =Expressed protein
VETLLASDLSKNSEEFHELMDVMEKHETMEIDCVGCSGSSKKADDFSLESDYSWIESDKAEPWWRTTDRDELASFVSQKSLNHIENCDLPPPQKKHLRGHPCAHVNNDKIKTASYDWEAKSRSFSNLTGHTPGSLDSRLMHKNHGHSTNEGLLYFASDKCSSHTPKHEDVKKSQQNFDGDPSKAQLMEALCHSQTRAREAEEAAKKAYAEKEDIVTLIFKQASQLFAYKQWLQFLQLETLCIQIKSKDQPISTLFPVALPWMSYEGRSSRKRKQKISNSKQGERKANSKCDITTYAVAFALGLSLVGAGLLLGWTVVTNYSNKNVWDDSLLRSKGNILKDITCGCGEM

SEQ ID NO: 195455 - protein, 188 aa, Glycine max
  Coding DNA Sequence Number=SeqID_78677
QGAVESGGRRHSRTSNWIKTRQLGSEESHGGGQTQGFEEESNGISVLTIDELHGSLLVHEQRMQGLQEEEHVLKAPHEEHTRQNTQEDRPIRGRGRGAYRGGRGRGRGCNNFMTRNNTWFLDLEDEHCKTVKLRNNMHMTVVAKGNVRLQINGITQKHPSLASEQIEEENFSQENLKNFVKHGAEEGN

SEQ ID NO: 195456 - protein, 63 aa, Glycine max
  Coding DNA Sequence Number=SeqID_78678
MRHHRRLRCEEESAPFRESEWTNFYAESGECHFEGANKLLQGGGVFEELELRLDYPVTGVVVA

SEQ ID NO: 195457 - protein, 104 aa, Glycine max
  Coding DNA Sequence Number=SeqID_78679
MKFTQTSADIHKIETKTEKREESGVNEPSEKLGDHGSRLFLCSVMDTTIHVEDLNDAVFAIISSYLRSLCQMVGKYMAMVGSTGNQAKEDFVYALGINTWQWAQ

SEQ ID NO: 195458 - protein, 179 aa, Glycine max
  Coding DNA Sequence Number=SeqID_78680
  Gene Ontology: Mol. function=histone-lysine N-methyltransferase activity; Cellular component=nucleus; Biological process =multicellular organismal development
  Homolog annotation: Hit_ID=Q6L463; Match level="QueryCoverage=60%, HitCoverage=57%, E-value=3e-31, Identity=58%"; Hit description=LOB domain protein 1, putative
  Pfam annotation: Domain name=DUF260; Domain location=15-115; Score =202.5; E_value=9.9e-58; Accession=PF03195.5; Description=Protein of unknown function DUF260
MGFHCEEKDSIHLQPCAACRMLRRRCDSKCVLAPYFPTNEVDKFAGVHRVFGASNVIKMIQMVEETKREDAVKAMVYEATARLRDPVYGSAGAIYQLQKMIEELKAQLESIKTRVSEQKDQLLSIRNNNVNACGHLDQYPFPVNVDPIFDHDHLMVSDPFDFPVEGGGWVFSNMSTPSL

SEQ ID NO: 195459 - protein, 102 aa, Glycine max
  Coding DNA Sequence Number=SeqID_78681
VCFNQIAAEYERVHYVGKNPSRCGRLSFSDQGSPVPQVTITKEMETISKRFEELDVCEKVNTKGARKKPMNRNQRSIKWHSDAILPRKGPVTRTMSKRLQED

SEQ ID NO: 195460 - protein, 41 aa, Glycine max
  Coding DNA Sequence Number=SeqID_78682
MWKRRGRAQTTTQACNIPELLIKTICQNSARALLAQWERVE

SEQ ID NO: 195461 - protein, 75 aa, Glycine max
  Coding DNA Sequence Number=SeqID_78683
MHDQRPCADVQGKRIFSTFSPLKKQPLEEELDNSMDSPSSLTLCQLVGVTRLKEIELDGECWVLKKSQGERKGIR

SEQ ID NO: 195462 - protein, 176 aa, Glycine max
  Coding DNA Sequence Number=SeqID_78684
  Gene Ontology: Mol. function=RNA-directed DNA polymerase activity; Cellular component=chromatin; Biological process=chromatin assembly or disassembly
MAVLVTQAVRNLANPCLYLIWSLKLFGQLGIGGLHRGLAVRPESDVDPITYIEVNIAFTASTVDVPAEYKGRPGGYLPYITSNGSQVLFEYTVDNLRLTVCLRMVGGAESKFGATHTEELTPKCTDEYGVPLRNETTQKVMVGSLGVTVDNHHDGGVSLRSRKTSNKIHGQVIPQG

SEQ ID NO: 195463 - protein, 256 aa, Glycine max
  Coding DNA Sequence Number=SeqID_78685
  Gene Ontology: Mol. function=sequence-specific DNA binding; Cellular component=intracellular; Biological process=regulation of transcription, DNA-dependent
  Homolog annotation: Hit_ID=Q8L4B2; Match level="QueryCoverage=87%, HitCoverage=96%, E-value=7e-38, Identity=39%"; Hit description =Nuclear transcription factor Y subunit C-9
  Pfam annotation: Domain name=CBFD_NFYB_HMF; Domain location=88-152; Score=84.2; E_value=3.9e-22; Accession=PF00808.13; Description =Histone-like transcription factor (CBFNF-Y) and archaeal histone
  Pfam annotation: Domain name=Histone; Domain location=82-155; Score =28.9; E_value=1.8e-05; Accession=PF00125.14; Description=Core histone H2AH2BH3H4
  Pfam module annotation: Pfam domain module=CBFD_NFYB_HMF::Histone; Domain location=88-152::82-155
MDQNQHVQPAQEAYGENQYQSNPVTTPTVLPTQTSDSSLSSSYPRQHPNDPQLEAMYELRQERLQQQLNNFWAKQCQEIQEATDLRTHSLPLARIKKIMKSDEDVKLVSAEAPVVFAKACEMFIMELTLRAWANVEEDQRKIIKKHDIASSISRADVFDFLIDTVPRPLENILDQQGFVGLPTSTVPTPLNDACYHNPPPQALVPGNPYGSPRIAVGMPILDQNHPGLQIHHFLTPMEPTPTPTPNPQNPSPSSDC

SEQ ID NO: 195464 - protein, 149 aa, Glycine max
  Coding DNA Sequence Number=SeqID_78686
  Gene Ontology: Mol. function=RNA-directed DNA polymerase activity; Cellular component=chromatin; Biological process=chromatin assembly or disassembly
GVTPDPEKIQVMTAWPTPTSPLDLRSFMVLTGFYRKFIRNYAATAAPLTTLLCKDKFMWNPEAQAVFQHLKTLMTQAPILAPDFTVPFTLETDASSTAIGAVLLQKSCPIAYFSRAHLRHHDRPPELEGVDVTGHSNSRAATLPCQASW

SEQ ID NO: 195465 - protein, 814 aa, Glycine max
  Coding DNA Sequence Number=SeqID_78687
  Gene Ontology: Mol. function=transferase activity, transferring glycosyl groups; Cellular component=chloroplast; Biological process =glucan biosynthetic process
  Homolog annotation: Hit_ID=Q9XGC0; Match level="QueryCoverage=99%, HitCoverage=68%, E-value=0.0, Identity=62%"; Hit description=Starch synthase isoform SS III
  Pfam annotation: Domain name=Glyco_transf_5; Domain location=700-814; Score=-96.4; E_value=0.00018; Accession=PF08323.2; Description=Starch synthase catalytic domain
  Pfam annotation: Domain name=SSIII; Domain location=204-348; Score =245.8; E_value=9.1e-71; Accession=PF07036.2; Description=Starch synthase III
  Pfam annotation: Domain name=SSIII; Domain location=374-529; Score =285.9; E_value=7.5e-83; Accession=PF07036.2; Description=Starch synthase III
  Pfam annotation: Domain name=SSIII; Domain location=542-689; Score =275.1; E_value=1.3e-79; Accession=PF07036.2; Description=Starch synthase III
  Pfam module annotation: Pfam domain module=Glyco_transf _5::SSIII::SSIII::SSIII; Domain location=700-814::204-348::374 -529::542-689
  Subcellular localization annotation: CTP_CleavageSite=79; ConfidenceScore=5.11e-01
MEMSMQLNCKTVFPYRGGYICSPCKAGWGVSFVRASADFSRKRQQKKVSVARTKGTSGKGFVPSKKNTRMKKGDTLTSVVSEVSGGDKKQTVEVNVDDTDKEGELEFSQEEKFEAVDRIDENVGDVGDLSLLDETVGELSLLDESNQATISVFDEDVEVLESWKEEFPYNGGVGIVEDSSEEGLLESAEIDENVKDTDTDGDITEEAVEESSSADDDRINEEAAGLLKLELEANQRRQEIERIAEEKLSQGIKLFVYPPVVKPDQDIELFLNKNLSTLSEEPDILIMGAFNDWKWKSFSIRLNKLHLKGDWWSCQLYVPKEAYKVDFVFFNGQNVYDNNDQKDFCIPVDGGMDALAFEDFLLEEKRKELEELARAQAERERQAEEQRRIEADRAAKEEDRARAKAEIGKMRETLPQLLKNAVKSVDNVWHIEPSEFKGKDLIRLYYNRSSGPLANANEIWIHGGHNNWKYGLSIVERLVKSVLKGGEWWYADVVVPDQALVLDWVFADGPPKKAVVYDNNRKQDFHAIVPGAIPDEQYWVEEEQLIYRKFQEERRLREDAIRAKAEKTAQMKAETKERTLKGFLLSQKHIVFTDPLDVQAGSTVTIFYNPSNTNLNGKPEVWFRCSFNRWSHRNGPLPPQRMLPAENGTHVKASFKVPLDAYMMDFVFSESEHGGVFDNKFGMDYHIPVFGSIAKEPPLHIIHIAVEMAPIAKTSFIAKAGKLLEIRIKNFYYLSCVVQKKVGGLGDVVTSLSRAVQDLNHNVDIILPKYDCLNLSNVKDFDYHKSYSWGGTEIKVWHGKVEGLSVYFLEPQNG

SEQ ID NO: 195466 - protein, 1282 aa, Glycine max
  Coding DNA Sequence Number=SeqID_78688
  Gene Ontology: Mol. function=DNA binding; Cellular component=nucleus
  Homolog annotation: Hit_ID=Q75LX0; Match level="QueryCoverage=40%, HitCoverage=80%, E-value=4e-80, Identity=38%"; Hit description =Expressed protein
MPLGSNSESAKVDLAMNQNALSSSDSHGRTLKPEEDKEVGEEGEEEDEDADADFNPFLKETLSQEASSSLSSEVDGLDGNVVTSGPSGGSGLSKVTTKEQIYTVVDTEHGEEEIILQSSSMISQSEINQEKHNDLTSATDGNGSRTELSNKTKSWSPVIDIDNEDAICMRTRARYSLASFTLDQLETFLQETDDDDDLQNADDEEEYKKFLAAVLQGGNGDGLLTHENENLDDDEDNDADFEIELEELLESDADDNATVKPRKEYDGAGRRPETRQNKRQKVSAQCEKKILKEVKRPLRPILPWLNGPLPSGKGLIPDATLSFQSSASGNGLVNGFTPQQIGQLHCLIHEHVQLLIQVFSLSVLEPSQKQVASQVQGLLFEMLHKRDEILALKRVPYPSVCFTPSFACSSVFDGGSKFIQAQCNIEYSPPQDAQNVWLSQSNQRSSEGLNRQRGFQVTESSFWVPFALCEIPFTAAQEFRKRYIESGSSDSPVQKEPLFPVSSPVAEANGEISRGTISRAVNAVSPSTGKQRPKKTLAAMLVESTKKQSIALVQKEVAKLAQRFLALFNPALFPHKPPPAAVVNRILFTDSEDELLALGIMEYNTDWKAIQQRFLPCKTKHQIFSLTWEQSYGSIKKETNIFVRQKNRCSSKASENPIKAVRRMKTSPLTAEEIACIQEGLKLYKCDWTLVWQYIVPHRDPSLLPRQWRIALGTQKSYKIDASKREKRRLYESNRRKSKALESWRAISDKEDCDAEIAGSECMYSEVVPYVHQAFLADWRPDTSTLTYPERISTTSGEGNVAHNAFSQEDIQFYRGTHDYGLSGKVPHQNGNQSALPSVSKLPQPFHTMSDLRNGMKGVPSTINPKKPVFDVTSSSKYYCRPYRSRRAHNAHLVKLAPDLPPVNLPPSVRVVSQTAFKGFQCGTSKVHPPGAGVAACRKDYSASQTPHGEKSENVHPVKGARPTLEDSVTGSQLERSETVEGESLVAEKGTRTDLQMHPLLFQVTEDGNAPYCPLKFSSGTSSSFSFFSGSQPQLNLSLFHSSQQQSHIDCANKSLKSKDSTLRSGGIDFHPLLQKSDDTQSPTSFDAIQPESLVNSGVQAIANRSSGLNDKSNELDLEIHLSSVSGREKSVKSRQLKAHDPVGSKKTVAISGTSMKPQEDTAPYCQHGVENLSAGSCELASSAPLVVSSDNITRYDVDDIGDQSHPEIVMEQEELSDSEEDIEEHVEFECEEMTDSEGEDGSGCEQALEVQNKGEKTYIFSCIVIAATSTFQIKIETERLV

SEQ ID NO: 195467 - protein, 247 aa, Glycine max
  Coding DNA Sequence Number=SeqID_78689
  Homolog annotation: Hit_ID=Q9FH56; Match level="QueryCoverage=18%, HitCoverage=11%, E-value=1e-07, Identity=53%"; Hit description =Similarity to elicitor-inducible receptor-like protein
MMSFYCVVSIFLFFCFPWSLWHRNHSLASLCIFTTTSLLLLHHQQSYHHHPQNHNNLSHNPTPNLNSKHKPPCSKPQQPQSQQSHHYHPQTSKLEIPIIKQPNMNSKHKSPRHVLKAALRQQQPCRVASLNFSKATLRTMLSKSSSTQVGALSHSQFKEFRKVVKACAIARLAKGNDDEENARCIADKNKVVVVVVVMVYDEWACVTRWVESEFDDVGGSQNDDIALEVACELVAKEVVVMVEGEVP

SEQ ID NO: 195468 - protein, 115 aa, Glycine max
  Coding DNA Sequence Number=SeqID_78690
MVVLYGETVKLAICWSPREPCARELRVKCVIVIMWLELGLDLDDDKGDEQKAQRSKNNSSESRTSQEFKNQEEFKTQEESLESRFKIQDSRSQESRSRFKTQDSRMKKRPNQDKY

SEQ ID NO: 195469 - protein, 158 aa, Glycine max
  Coding DNA Sequence Number=SeqID_78691
  Gene Ontology: Mol. function=binding; Cellular component =mitochondrial inner membrane; Biological process=transport
  Homolog annotation: Hit_ID=Q9FHX2; Match level="QueryCoverage=84%, HitCoverage=48%, E-value=1e-24, Identity=46%"; Hit description =Mitochondrial carrier protein-like
MATSLSAPPRPDPHCAYSSHYRRHEEHHVIRNHGPKGAHHTRRHEGPLVAKLPGTDAECSVRGPHRGDIGVAHDVQGNGVIKVVAVMYDGVSATMKRILKEEGQVGLTRVMGPRVLHNACFLALGYFAFETTRHLILREYLRRKELGERGTQVSISAG

SEQ ID NO: 195470 - protein, 116 aa, Glycine max
  Coding DNA Sequence Number=SeqID_78692
MRPPPTSLESCVVQFSILNPFSEPRELRFRSCILHPRASSTHEFGAMRSDCLVQFSILNPFRSRMNCVFLDATSTHEFGAMRSDCLVQFSILNRFSEPHELRFLSRILQPRVWSHA

SEQ ID NO: 195471 - protein, 256 aa, Glycine max
  Coding DNA Sequence Number=SeqID_78693
  Gene Ontology: Mol. function=oxidoreductase activity; Cellular component=glycerol-3-phosphate dehydrogenase complex; Biological process=fatty acid metabolic process
  Homolog annotation: Hit_ID=UPI00005EE942; Match level="QueryCoverage =99%, HitCoverage=93%, E-value=2e-86, Identity=62%"; Hit description =COG1250: 3-hydroxyacyl-CoA dehydrogenase
  Pfam annotation: Domain name=3HCDH; Domain location=157-255; Score =49.0; E_value=1.6e-11; Accession=PF00725.12; Description=3 -hydroxyacyl-CoA dehydrogenase, C-terminal domain
  Pfam annotation: Domain name=3HCDH_N; Domain location=7-155; Score =121.6; E_value=2.2e-33; Accession=PF02737.8; Description=3 -hydroxyacyl-CoA dehydrogenase, NAD binding domain
  Pfam annotation: Domain name=DAO; Domain location=5-242; Score=-37.1; E_value=0.0016; Accession=PF01266.14; Description=FAD dependent oxidoreductase
  Pfam annotation: Domain name=NAD_Gly3P_dh_N; Domain location=4-207; Score=-59.7; E_value=0.093; Accession=PF01210.13; Description=NAD -dependent glycerol-3-phosphate deh
  Pfam annotation: Domain name=NAD_binding_2; Domain location=3-97; Score=-76.9; E_value=0.021; Accession=PF03446.5; Description=NAD binding domain of 6-phosphogluconate dehydrogenase
  Pfam module annotation: Pfam domain module=3HCDH::3HCDH_N::DAO::NAD _Gly3P_dh_N::NAD_binding_2; Domain location=157-255::7-155::5-242::4 -207::3-97
MQSSDYAVLGAGLMGVGIATHFIRHGHEVLLYDPDPQRLAEATAVASGILAELSDVGQFDNDERDAALARLRVTGDLNDVARARLLIEAIPERLELKHALYEQLEGLIAHFWHPPHLIPLVEIVPGRATDPRHLAAVQVLLVGMALEAVLLERAAPGFVGNRLQFAVLREALHIVHSGIASAEVVDQVMRASLGRRYAMVGPLEAADMTGLPTVADIARHLFPELAIRRRDDGAGGTAAAARRYRPAQRSGILSLG

SEQ ID NO: 195472 - protein, 139 aa, Glycine max
  Coding DNA Sequence Number=SeqID_78694
MSCLAIITLISLCRSAVGVCHPDADERPRGPCPGVSGIDCGLCQSFGVPVAPSKAANHRGQVQIHECLYRFNLSQQGQGFTPFACPTPEQFGAEVAWPGDWPEAQAGEEPVGSIDEAEEARMDEEMTDLLGFLGGSGAT

SEQ ID NO: 195473 - protein, 100 aa, Glycine max
  Coding DNA Sequence Number=SeqID_78695
  Subcellular localization annotation: CTP_CleavageSite=39; ConfidenceScore=5.63e-01
TLDSMQRLTQSSAPFVPPGTTKSFTCGNFMVTRDSRQPRGAKLVSYADFRGPLFDDMRPFFGPCEVLGIHHQAVCEILGTTSHSHPRLSSTERSEISVIH

SEQ ID NO: 195474 - protein, 46 aa, Glycine max
  Coding DNA Sequence Number=SeqID_78696
MPPGSGTSLLRCPLTFRDIPTLAWTFFTDENPKSSIEVRGIQIRPA

SEQ ID NO: 195475 - protein, 122 aa, Glycine max
  Coding DNA Sequence Number=SeqID_78697
  Subcellular localization annotation: CTP_CleavageSite=39; ConfidenceScore=5.41e-01
PMNCVFVHVSSTFEFGAMRSDCLVQFSILNLFRSPMNCVFVHVSSTFEFGAMRSDCLVQFSILNLFRSPMNCVFVHASSTQEADPLDWEIKAEGVETRVVITERAGRTKSVSYLCFPLISDK

SEQ ID NO: 195476 - protein, 156 aa, Glycine max
  Coding DNA Sequence Number=SeqID_78698
  Subcellular localization annotation: CTP_CleavageSite=84; ConfidenceScore=5.42e-01
MNLLPSAVHASSTNESGDPGIYCLALFANSPFSTFIRSPMNSLPSAVHASSTHEPGAPRNYFLALFANSPFSTFIWSLMNLFPSAVHASSTNESGDTGIYYLALFANSPFSTFIRSPMNTLPSAVHALSTHESGAPRIYCQRFLPILHSPLLYGAP

SEQ ID NO: 195477 - protein, 230 aa, Glycine max
  Coding DNA Sequence Number=SeqID_78699
  Gene Ontology: Mol. function=4-coumarate-CoA ligase activity; Cellular component=peroxisome; Biological process=phenylpropanoid metabolic process
  Homolog annotation: Hit_ID=P31687; Match level="QueryCoverage=50%, HitCoverage=20%, E-value=1e-46, Identity=79%"; Hit description=4 -coumarate--CoA ligase 2
NSYDHDYEFELGTPLVVALAKNPAVEEYDLSSIRLVMSGAAPLGHQLEEVLRNRLPNAILGQGYGMTEAGPVLAMCLGFAKYPFPTKTGSCGTVVRNAELKVIHPLTALSLPPNHPGEICIRGQQIMKGTYILYGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 195478 - protein, 108 aa, Glycine max
  Coding DNA Sequence Number=SeqID_78700
  Pfam annotation: Domain name=zf-CCHC; Domain location=50-67; Score =21.9; E_value=0.00024; Accession=PF00098.13; Description=Zinc knuckle
MKYKGKGNIRKYIMEMSNLGIKTQNKKRKKTKGVTEGTSQQKKQNKDEEFSCYFCKKLRHMKKECPKYAAWRVKVACGANYQVMMKDSSLWVMARRLQWKLLELLDYS

SEQ ID NO: 195479 - protein, 76 aa, Glycine max
  Coding DNA Sequence Number=SeqID_78701
MEKYDKRNFKEKKEKKGYITWEDYVINSSSDSENKNISLGIMMKDYENGEEQSRYIDSNFSKHMACIKVYSYFSPR

SEQ ID NO: 195480 - protein, 76 aa, Glycine max
  Coding DNA Sequence Number=SeqID_78702
MKNVEERLKIFVKIPMETRAEQFSSSPLPLFIGKWGRCLPPSSPKRAQLAQASSARPSKLSSPRRARLLPPEATAF

SEQ ID NO: 195481 - protein, 141 aa, Glycine max
  Coding DNA Sequence Number=SeqID_78703
  Gene Ontology: Mol. function=translation elongation factor activity; Cellular component=intracellular; Biological process=translational elongation
  Homolog annotation: Hit_ID=Q43467; Match level="QueryCoverage=91%, HitCoverage=27%, E-value=4e-66, Identity=96%"; Hit description =Elongation factor Tu, chloroplast precursor
  Pfam annotation: Domain name=GTP_EFTU_D3; Domain location=41-140; Score=198.2; E_value=2e-56; Accession=PF03143.7; Description =Elongation factor Tu C-terminal domain
MTMITNSSSVPLAGDNVGLLLRGVQKTDIQRGMVLAKPGTITPHTKFSAIVYVLKKEEGGRHSPFFAGYRPQFYMRTTDVTGKVTAITNDRDEESQMVMPGDRVKMVVELIVPVACEQGMRFAIREGGKTVGAGVIQSIIE

SEQ ID NO: 195482 - protein, 53 aa, Glycine max
  Coding DNA Sequence Number=SeqID_78704
MARSRRSNFHCPCISHKAPTGIWGLGSKGATGKEVTPGGEVLFLGHWDRGWPD

SEQ ID NO: 195483 - protein, 216 aa, Glycine max
  Coding DNA Sequence Number=SeqID_78705
MMQKAFGDHWKIQIAFMHSDAEALEHTKKRDKGHQKDSVRKKGFYKSCPPPPPPPPPIMFQKSVFMKPRFNGSSNEAPSFNKELKRSFTSERTTPVGKKSHEKNKSKQGTLFRNNKFMGHASVPLVSQPAEKESLLVESNDDDDDDDTEIEDQDVEGGRTVAQNNDRGKGPPVIGGESSKIDGDEGPDVDKKADEFIAKRIESIERSRRSARNSSR

SEQ ID NO: 195484 - protein, 214 aa, Glycine max
  Coding DNA Sequence Number=SeqID_78706
  Pfam annotation: Domain name=Transposase_23; Domain location=93-163; Score=-5.4; E_value=0.0044; Accession=PF03017.5; Description =TNP1ENSPM transposase
  Subcellular localization annotation: CTP_CleavageSite=73; ConfidenceScore=5.38e-01
DVLTAAIGRPEHPGRVCATGAGVTIKQYFGPTPRTSRTSSSVTPKDLQMQSQFQLQMQSQGLVLSLELEVDPSAARVSTNESCVDPLGNNPDTGDSDKCGLYIEKNPHRLVALGRLYEGSTTVHNIPLLHDQVKVGVEEVRDANAPIPVPTEEVKLVGQTLNTFLAWATHLVNRLSEQGVVGPVKPADRLDHDVDDPIYLMTLTIPQFFLKLLQ

SEQ ID NO: 195485 - protein, 204 aa, Glycine max
  Coding DNA Sequence Number=SeqID_78707
MIESFQQQQQMSVLELYVEKDVAGGSMFHAANSVTSCGRNVSHHESELPRNISNLHDDEDDDDDDYLASNSYVEESFDEDDSDDGISDTDDEVTNIVEPVSIVHPTEGVPQIQNPFWNDAMHYNNINWSHPDEEDICGLDMPTTFNVGQELYVGMDFDSKDAVKNALKQYVMKVHQTFKVVETKSHKYIVCCPNNTEESPALFI

SEQ ID NO: 195486 - protein, 42 aa, Glycine max
  Coding DNA Sequence Number=SeqID_78708
MDFLCLVGTSAKPTKHRGRICQDSYHRTFLAMVVGKESVDCC

SEQ ID NO: 195487 - protein, 132 aa, Glycine max
  Coding DNA Sequence Number=SeqID_78709
MDNHLGISACHLTSRLGSTKIICADNHWCISARHLTSRVRMTEGGVVDKSGAFAPMYPPFVMRNSDLRSSFFCHVQITGRCLLMLRDSWVMIAKGGTKIVMQSYPARALDRKLQIDWARDPREGPRVLMSLR

SEQ ID NO: 195488 - protein, 77 aa, Glycine max
  Coding DNA Sequence Number=SeqID_78710
MLLGYLSKESCGIGIDGDPVLRGTMIRATWEYMSSVEGGQLGMVDLCVICGCGESTCTITRSPPSTTYDGYPIILQA

SEQ ID NO: 195489 - protein, 70 aa, Glycine max
  Coding DNA Sequence Number=SeqID_78711
MTIRGGDGETASSSGEEGGFTTRDCGLCMIINYPWNKLCSIGTKVGDGGVGVDDEGMSSVLALFLGSIFN

SEQ ID NO: 195490 - protein, 359 aa, Glycine max
  Coding DNA Sequence Number=SeqID_78712
  Gene Ontology: Mol. function=amino acid transporter activity; Cellular component=integral to membrane; Biological process=amino acid transport
  Homolog annotation: Hit_ID=Q98DA1; Match level="QueryCoverage=66%, HitCoverage=84%, E-value=4e-98, Identity=73%"; Hit description=Outer membrane lipoprotein
  Pfam annotation: Domain name=Lipoprotein_9; Domain location=40-275; Score=382.4; E_value=6.9e-112; Accession=PF03180.4; Description=NLPA lipoprotein
MHTRFVSAKNKLLLTVGALLVAGSVVAPFSVAQAADKTAVKVGIMSGEDEDVWREVIKQAAAKGLTVKTVIFNDYNQPNEALQNGEVDANAFQHQPFLNNQIKVNHYDIVRVGDTAVWPIGLYSKKVKSAAALKDGAVIGVPNDPSNEARGLVLLQQQGLIKLKPGVGIAATTADITDNPHHLKIKELDSGIIGRSVPDLDAAVVNTDWALKSGLTAADRIAQEPVKDNPYNNFIAVKKENASAPWVKTLVASYQNDAVKTVFDKVYKGTGETACAPDRRSARRDRRGSGTRSRGAAQQRGAFARRVAPFRPDTGAAQCLTDGAKRRNPWPDWAQRRRKIDADSLSQRAGAARRRRNRD

SEQ ID NO: 195491 - protein, 57 aa, Glycine max
  Coding DNA Sequence Number=SeqID_78713
MGPGAEGNEDKGYIGVCELNLKSGTWRYVAGVRRPWEHQVGCYCPKPSLTNPDPTRA

SEQ ID NO: 195492 - protein, 233 aa, Glycine max
  Coding DNA Sequence Number=SeqID_78714
  Homolog annotation: Hit_ID=Q8D1R7; Match level="QueryCoverage=99%, HitCoverage=33%, E-value=1e-74, Identity=61%"; Hit description =Putative glycosylase
  Pfam annotation: Domain name=LppC; Domain location=2-227; Score= -250.1; E_value=0.0093; Accession=PF04348.4; Description=LppC putative lipoprotein
MPRSSYGDRVGKAFAQEWQKLGGATVLQQRFGGVGELKQGINSGAGIALSGTPLTVQPDQPQGVAVAGLTIPAPQTSAPAPESASSSGSVDAVYIIATQDELQLIKPMIAMRTSSRNNIALYASSRSAQAGAGPDFRLEMDGLQFSDIPLLSGANPGLMQQAARSFNNDYSLVRLYAMGIDAWTLANQFNQMRQVPGFAIDGNTGKLSADTDCVINRKLAWNQYRQGQIVPVQ

SEQ ID NO: 195493 - protein, 237 aa, Glycine max
  Coding DNA Sequence Number=SeqID_78715
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-34, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGHLGTSTCAFKGLHILAFRGLHALAFRGLHALAFRGLHTLAFRGLHVLAFRGLHVLASRALHALAFRGLHALAIRGLHVLTLRGLPVLTSRGLHTLAFRGLHVLTFRGLHRATRPRLQRTTRLHALAFRGLHVLTFRGLHALAFRGLHVLAFRGLHVLTYRGLHVLAFKGLHVLTFRGLHVLAFKTLHALAFRGLHVLAFRGLHVLPFKGLHVLAIRGLRALAIRGLHALAIRGLH

SEQ ID NO: 195494 - protein, 256 aa, Glycine max
  Coding DNA Sequence Number=SeqID_78716
MEEGETLCAYSRFALLRPDPQELAAKFCIPGRFELNADGQSLKILRKNMTTLAHTWSILSISNLIPTSHTSDVTLDRAKLIYGIIMKMDMNVGGPRKARGKRSEAPSTSAPLEAPTPSSSPIPPSSSTQILVIPPAPPQMLYSMLQSIHRGKSIIMQSLQGLGLPSIMSMEEFETQVAWPGDQPSSSGGGGASAAQEPDTKEPPAPTPAEEETTPDQTPQPYLAPAHIPEDVAPVAEPEQLIQDSSAAPALDLNED

SEQ ID NO: 195495 - protein, 148 aa, Glycine max
  Coding DNA Sequence Number=SeqID_78717
MKVQPEEEAIVQLLCIPGQDFTRAAAKRRVRIIRTNMTTHTQIWMTLLLSNIPSSDRNNDLPLRKYQLTPSGPEEVHRALGFPVWFTGLWIAPARHPVDPKKSSRVLGFLALITGLCQFYEVPVAPNKVTRPPIKRAFIKKYCAPRQA

SEQ ID NO: 195496 - protein, 419 aa, Glycine max
  Coding DNA Sequence Number=SeqID_78718
  Gene Ontology: Mol. function=sequence-specific DNA binding; Cellular component=intracellular; Biological process=regulation of transcription, DNA-dependent
  Homolog annotation: Hit_ID=Q4KDK8; Match level="QueryCoverage=97%, HitCoverage=83%, E-value=1e-167, Identity=71%"; Hit description =Sensory box transcriptional regulator, LuxR family
  Pfam annotation: Domain name=GerE; Domain location=346-403; Score =80.8; E_value=4.3e-21; Accession=PF00196.10; Description=Bacterial regulatory proteins, luxR family
  Pfam annotation: Domain name=PAS; Domain location=188-298; Score =32.8; E_value=1.2e-06; Accession=PF00989.14; Description=PAS domain
  Pfam annotation: Domain name=PAS; Domain location=63-173; Score=17.8; E_value=0.0089; Accession=PF00989.14; Description=PAS domain
  Pfam annotation: Domain name=PAS_3; Domain location=211-301; Score =18.2; E_value=0.0017; Accession=PF08447.1; Description=PAS fold
  Pfam annotation: Domain name=PAS_4; Domain location=194-303; Score =9.6; E_value=0.023; Accession=PF08448.1; Description=PAS fold
  Pfam annotation: Domain name=PAS_4; Domain location=69-178; Score =11.5; E_value=0.015; Accession=PF08448.1; Description=PAS fold
  Pfam annotation: Domain name=Sigma70_r4; Domain location=345-393; Score=14.3; E_value=0.014; Accession=PF04545.6; Description=Sigma-70, region 4
  Pfam annotation: Domain name=Sigma70_r4_2; Domain location=339-391; Score=16.6; E_value=0.014; Accession=PF08281.2; Description=Sigma-70, region 4
  Pfam module annotation: Pfam domain module=GerE::PAS::PAS::PAS_3::PAS_ 4::PAS_4::Sigma70_r4::Sigma70_r4_2; Domain location=346-403::188 -298::63-173::211-301::194-303::69-178::345-393::339-391
YPLNRVADGETFTDVVVEVRQADDPDSFWVHRLRSLIITDAQGQPELLALILSDATEWASAEQRFEKTFNANPAPAVICRLSDLRYVKVNQGFLDMTGYQREQVMGRSVYELDVLEQAEHKDLAIQRLGEGATIPQMEAELKLPGGGSKLVVVAGQPLDINEDDCMLFTFTDLEPRRQAESALRESEERFAKAFRLSPVPTLLCTAHERRVLDVNEAFTRTTEYDTEALIGKTIDEIPFIDDPEANRRLFAALEKSGNVEGLDIRVRKKGSESIDCVASADAVSIHNAPCYLLVLMDITERKRSELELVSAIEEVMQDASWFSQTLIEKLANVKSINRPDQAGLTASDLTPRERDVLELICEGLPDKKIAARLNLALNTIRNHVATVYSKLGVHSRSEAIVWARERGLFTGGLAARNGK

SEQ ID NO: 195497 - protein, 235 aa, Glycine max
  Coding DNA Sequence Number=SeqID_78719
MTTLAQTWSVLSYYDLAPTSHTSDVNLDRARLIYGLVSRMDMDVGSFISQQISKIAQSSTSRLGFPALITALCDIQGMVSDTLIFESLSPAINLAYMKKNCWNPADPSITFPGTRRTRTRASTSTSEAPPPTQPPPQPSSQRPRPPPTSTSASLDMHGQMLRSIHIGQQLIMENMHRLSLHMQMDPPLITPEAYRQQVAWPGDQPSTDRGEEPSGAAEDPAVDEDLIADLASADW

SEQ ID NO: 195498 - protein, 55 aa, Glycine max
  Coding DNA Sequence Number=SeqID_78720
MAKRMDNSGRRMSCIEALSEGQLTKRTAFTFRLSEKLPCYGELNPQLVLPIGYLM

SEQ ID NO: 195499 - protein, 145 aa, Glycine max
  Coding DNA Sequence Number=SeqID_78721
MWAFLTSRQIDWAHLVRYRMHKTLRAKAPLPYPQLVTLFLRHFQIPLDDEPFIQVKRSFAIGAGAVTSFGYRKDRNGQWLKKDALPPQDERTPSPPQRDDSALMTEVLSELRGLRTYVGMDTHLTQLEEDVGYIRQSFNLPPPPS

SEQ ID NO: 195500 - protein, 102 aa, Glycine max
  Coding DNA Sequence Number=SeqID_78722
MQAQGLALPTEPEVGPLDARVSTKESCVDPSGNDPDTGESDKCGLYIEENPPRLVALGRVYEGSITVHNIPLLHDQVKVGVEEVKDAAAPIPVPTDKVNLVG

SEQ ID NO: 195501 - protein, 181 aa, Glycine max
  Coding DNA Sequence Number=SeqID_78723
MARTKKSGQMTSEVAKEIAYRIDSLEEQASHGSFVTHGRQDVLTVAIGGLEHPGRVHATRVDVTIKCYFGSASRESHTSSSMALEDLEQLTQKIRDQLEKLITQKVTQQLMMSFKKMQSQMHSQGLTLPPEVEVGPSAACVSTKKSCVDTSGQDPKMGDSDKCGLYVNDNPPQLITLGRVY

SEQ ID NO: 195502 - protein, 69 aa, Glycine max
  Coding DNA Sequence Number=SeqID_78724
MERARGGSTVERLLFPVLEFIQVVRRSDLRVETEGGFREKMRMRIMMSFLTVKGFSKEFYYFSFVVAGN

SEQ ID NO: 195503 - protein, 636 aa, Glycine max
  Coding DNA Sequence Number=SeqID_78725
  Gene Ontology: Mol. function=oxidoreductase activity, acting on NADH or NADPH; Cellular component=mitochondrion; Biological process=ATP synthesis coupled electron transport
  Homolog annotation: Hit_ID=Q43644; Match level="QueryCoverage=98%, HitCoverage=81%, E-value=0.0, Identity=78%"; Hit description=NADH -ubiquinone oxidoreductase 75 kDa subunit, mitochondrial precursor
  Pfam annotation: Domain name=DUF1982; Domain location=583-630; Score =65.1; E_value=2.2e-16; Accession=PF09326.1; Description=Domain of unknown function (DUF1982)
  Pfam annotation: Domain name=Molybdopterin; Domain location=235-555; Score=452.3; E_value=6.4e-133; Accession=PF00384.12; Description =Molybdopterin oxidoreductase
  Pfam module annotation: Pfam domain module=DUF1982::Molybdopterin; Domain location=583-630::235-555
MRCSSLGMKIKTDTPVAKKAREGVMEFLLMNHPLDCPICDQGGECDLQDQSMAFGSDRGRFTEVKRSVVDKNLGPLVKTVMTRCIQCTRCVRFATEVAGVQDLGMLGRGSGEEIGTYVEKLLTSELSGNVIDICPVGALTSKPFAFKARNWELKGTETIDVTDAVGSNIRIDSRGPEVMRIVPRLNELLRSSHFNLPKIGQCGEKAAQSPTSTEINEEWISDKTRFCYDGLKRQRLNDPMIRGSDGRFKPVNWRDALAVVAEIAHQVKPEEIVGIAGKLSDAESMIALKDFINRMGSNDVWGEGIGVNTNADFRSGYIMNTSIAGLEKADAFLLVGTQPRVEAAMVNARIRKTVRANQAKVGYIGPATDFNYDHKHLGTGPQTLLEIAEGRHPFFKTLSNAKNPVIIVGAGVFERKDQDAIFAAVETIAQKANVVRPDWNGLNVLLLHAAQAAALDLGLVPQSEKSLESAKFVYLMGADDVNLDKIPDDAFVVYQGHHGDKSVYRANFILPAAAFSEKEGTYENTDGCTQQTLPAVPTVGDSRDDWKIIRALSEVAGVPLPYDTIGAVRARISTVAPNLVNMDEREPATLPSSLRPTFSEKVDTTPFGTVVENFYMTDAITRASKIMAQCSAMLLK

SEQ ID NO: 195504 - protein, 790 aa, Glycine max
  Coding DNA Sequence Number=SeqID_78726
  Gene Ontology: Mol. function=protein binding; Cellular component =integral to membrane; Biological process=Notch signaling pathway
  Homolog annotation: Hit_ID=Q8GUM5; Match level="QueryCoverage=82%, HitCoverage=90%, E-value=0.0, Identity=58%"; Hit description =Nicastrin precursor
  Pfam annotation: Domain name=Nicastrin; Domain location=290-499; Score=359.0; E_value=7.4e-105; Accession=PF05450.5; Description =Nicastrin
  Pfam annotation: Domain name=Peptidase_M28; Domain location=290-488; Score=-52.5; E_value=0.031; Accession=PF04389.7; Description =Peptidase family M28
  Pfam annotation: Domain name=SPC22; Domain location=607-750; Score =64.4; E_value=3.7e-16; Accession=PF04573.3; Description=Signal peptidase subunit
  Pfam module annotation: Pfam domain module=Nicastrin::Peptidase _M28::SPC22; Domain location=290-499::290-488::607-750
  Subcellular localization annotation: CTP_CleavageSite=51; ConfidenceScore=5.34e-01
MALTVFSLFFFFLSFTFHLPSCFSGQSSSMESVPDLQNTMYASIDGYPCVRLMNLSGTIGCSNPGRDKVVAPIVRFENVDRIAEPSAVLVSLDEFPTLFTRISDDSSFASKVGGVLVEPSTDFQKKLKGFSPDQKFPQAQFALYHNTSYEWNPIGSGIMWKSYNFPVFLLTESGSKTLQEFVTKNEDTKKSYTSNVAEFDLVMQTVKSGTHDSESCLKEETCLPLGGYSMYWRKHGVNMVSTIRSDGLILSSKCKKIKHHVVPTVEMSYPGSVWSSLPPINISSLQRSKPILLTVASMDSASFFRDKSLGADSPISGLIALLAAVDALSHLDGLGDLSKQLVFAVFTGEAWGYLGSRRFLVELDMHSDAVHGLNQTLIETVIEIGSVGKGLSQGVKNFFAHTKGDSSATNQTVAALKRAQESLISENIKIASASASNPGIPPSSLMSFLEKNPAISGVVLEDFDSVFVNKFYHSHLDDLSNVNSSAVVAAASLIARTLYMLASETEDVQNSTLAAINVNVSLVEQLLGCLLDCDPGLSCELVKKYISPMSTCPSHYVGVILDEPSSAPYAGYINDVPRFIWNFLADRTSIPRENNISDCQHGCNGRDEVCVKAETDGKGVCVLSTTRYVPAYSTRLKFESGVWNVLPPNSSDKMGVVDPVWTESNWNTIAAEYETPKNSFNQISLWGGILPSKEHAKFWIHTSNKHRFIDQGSNLRGKEYNLTLHWHVMPKTSKMFADKIVMPSLTFSITDIEDVDHFSTPHPAPTNPMASSTITVSPGINSKHPNKYLE

SEQ ID NO: 195505 - protein, 152 aa, Glycine max
  Coding DNA Sequence Number=SeqID_78727
  Pfam annotation: Domain name=zf-CCHC; Domain location=81-98; Score =22.7; E_value=0.00018; Accession=PF00098.13; Description=Zinc knuckle
MELMRLHQHEENDIKRKGITLRASSSSIQEETDKEDLTKIEEDDGFRFFVKRFNKLLRNKRNKRKSNINPKKKEEDSSLAPKCYECDQPEHIRFDCPVFKRRMKKSNKRNFKEKKAYITWEDNDINSSSDSENKIINLGLMLKDYESGEGQS

SEQ ID NO: 195506 - protein, 207 aa, Glycine max
  Coding DNA Sequence Number=SeqID_78728
  Gene Ontology: Mol. function=transposase activity; Biological process= transposition, DNA-mediated
  Homolog annotation: Hit_ID=Q10CY9; Match level="QueryCoverage=62%, HitCoverage=17%, E-value=1e-09, Identity=26%"; Hit description =Expressed protein
MESTNVKNKSSGKRKMSSEDTRSYFAWNLEMERVLTNVLRDQRNLDNKGDGNWRAVTYSTAAQIFSKHFGVHLMRDNVKNHFKLWRTWYEIASDILIQSGFDWDSTKYMITVENEIAWNEYVKSHEEVKRFQFKVIPNWDDIVDLCSKDRATGLRAKNALDANDIMSKETNEEEAIHSVSFDLEGSSSATRKNIRSSKSGEKEGMIS

SEQ ID NO: 195507 - protein, 92 aa, Glycine max
  Coding DNA Sequence Number=SeqID_78729
MKEDLKKLRDMNKDDINSKANVLKGVEDEDDVYKRRHLVLQGQKNKVNLCYLDGQALMRNHDNKVKKKIKFSNVVKVLGDTSIGGEGCSISN

SEQ ID NO: 195508 - protein, 177 aa, Glycine max
  Coding DNA Sequence Number=SeqID_78730
  Homolog annotation: Hit_ID=Q9LE80; Match level="QueryCoverage=97%, HitCoverage=75%, E-value=3e-39, Identity=45%"; Hit description =Arabidopsis thaliana genomic DNA, chromosome 3, P1 clone: MJK13
MLGIFKEKLVKAPKELNNPASLNSCTKPKPSHEILKDFMPCNSSNAFSMCFGNDALLAYSPSNKPSIHHSLSMVNKQYGLSKGTNKAMFITEAYQTLRDRGPYPADQVLKELEGSLGFVIYDNKDGTIFVAFGSNGQIGLYWGVVAYSSIVIYENMELIKASCAKSLAPFPTGSVLL

SEQ ID NO: 195509 - protein, 41 aa, Glycine max
  Coding DNA Sequence Number=SeqID_78731
MEATASALLTLQLLMRVSACKTQRGKYNGHSVIAHLKPKII

SEQ ID NO: 195510 - protein, 217 aa, Glycine max
  Coding DNA Sequence Number=SeqID_78732
MAQSNSSRLGFLALITALCRSKGVASVRLVFERLSPVINLAYIRKNYWNPDDLIVTIRGAKRARARPVEAPSTSAAPPPARTSAAPSTPPSADFQRLEDMLRSIHQGQIVLLQSLQLVAPPDFIPSVEQFNEWVAWPGTQPPLHREDEGPTTQVPQQMEDESSETSTPEPLIRKKRVVETQEAAAISEKSLEATPKPLAPMADTTSPQQATNSSTLL

SEQ ID NO: 195511 - protein, 86 aa, Glycine max
  Coding DNA Sequence Number=SeqID_78733
  Gene Ontology: Mol. function=pepsin A activity; Biological process =proteolysis
  Homolog annotation: Hit_ID=Q9FGI3; Match level="QueryCoverage=68%, HitCoverage=13%, E-value=8e-16, Identity=61%"; Hit description =Similarity to nucleoid DNA-binding protein
MVFEYENGVQIVIPKERVLATVEGGVHCVGIANSDKLGAASNIIGNFHQQNLWVEFDLAHDHDDVVEIRRSKSEEEKESSTTVAMI

SEQ ID NO: 195512 - protein, 127 aa, Glycine max
  Coding DNA Sequence Number=SeqID_78734
  Gene Ontology: Mol. function=binding; Cellular component=kinesin complex; Biological process=DNA integration
  Homolog annotation: Hit_ID=O04181; Match level="QueryCoverage=79%, HitCoverage=62%, E-value=1e-36, Identity=62%"; Hit description=Krm protein
  Pfam annotation: Domain name=TPR_1; Domain location=61-94; Score =21.6; E_value=0.0028; Accession=PF00515.18; Description =Tetratricopeptide repeat
  Pfam annotation: Domain name=TPR_2; Domain location=61-94; Score =19.5; E_value=0.012; Accession=PF07719.7; Description=Tetratricopepti de repeat
  Pfam module annotation: Pfam domain module=TPR_1::TPR_2; Domain location=61-94::61-94
MTLGISASTVFAEDATTEAYPDNDPGGMLFLHGKLDEAEKLFLSAIEEAKEGFGEKDPHVASACNNLAELYRVKKAFDKAEPLYLEAINILEESFGPDDVRVGVAVHNLGQFYLGQRKLEEARVSYE

SEQ ID NO: 195513 - protein, 136 aa, Glycine max
  Coding DNA Sequence Number=SeqID_78735
  Subcellular localization annotation: CTP_CleavageSite=37; ConfidenceScore=5.43e-01
SSGRARLPEFFRMNHFFRKVPGRGFPGVFRKTFGYFRKNTSSGNFPENVLPELPEEPLTGLLKDFGVSLFRHFFRRTLVFSPLVFYPKVTILRGTNLFAEKKKKALARLAKKKLHAEEKKKLFRERRRSCFGREEA

SEQ ID NO: 195514 - protein, 224 aa, Glycine max
  Coding DNA Sequence Number=SeqID_78736
  Gene Ontology: Mol. function=glutamate-ammonia ligase activity; Cellular component=chloroplast; Biological process=nitrogen compound metabolic process
  Homolog annotation: Hit_ID=P52782; Match level="QueryCoverage=73%, HitCoverage=42%, E-value=4e-72, Identity=76%"; Hit description =Glutamine synthetase nodule isozyme
  Pfam annotation: Domain name=Gln-synt_N; Domain location=17-97; Score= 122.1; E_value=1.5e-33; Accession=PF03951.9; Description=Glutamine synthetase, beta-Grasp domain
MSLLSDLINLNLSDTTEKVIAEYIWIGGSGMDLRSKARTLPGPVSDPSKLPKWNYDGSSTGQAPGEDSEVIIYPQAIFRDPFRRGNNILITATTIPENTQDMILKVICDTYTPAGEPIPTNKRHDAAKVFSHPDVVAEETWYGIEQEYTLLQKDIQWPLGWPVGGFPGPQGCYFTHTNSYCPFHTLTQIISFNTYWDSKWNNDSNHLTMSNPVNNPTFLNLLEP

SEQ ID NO: 195515 - protein, 103 aa, Glycine max
  Coding DNA Sequence Number=SeqID_78737
  Subcellular localization annotation: CTP_CleavageSite=71; ConfidenceScore=5.34e-01
MTNEEQCRSRLWSQFGSASASFFSSFFFFSLISLQFLLSLKVQPLPQPPSHLFIGNEGTCPKPFRGPGELEASLGKPGPRKLPGMTLLPLLLGIFHILDQNVE

SEQ ID NO: 195516 - protein, 201 aa, Glycine max
  Coding DNA Sequence Number=SeqID_78738
MAHQGARPATAPGDDGGAQEDDDMADRQSWSSAPLPFQDYYSLFRLPETIKFVGMQRQSWSSALLPFQDYYSLLCLPETIKSVGTDNHGHLHLYLSKTITVFFAFQRQSSPLARRDNHGHLHLYLSKTITVFFAFQRQSSPLARRDNHGHLHLYLSKTITVFFAFQRQSSPLARRDNHEIVKSVGMQDNHGHPLSLSSRDD

SEQ ID NO: 195517 - protein, 162 aa, Glycine max
  Coding DNA Sequence Number=SeqID_78739
  Homolog annotation: Hit_ID=Q67UK6; Match level="QueryCoverage=68%, HitCoverage=53%, E-value=2e-19, Identity=47%"; Hit description=NHL repeat-containing protein-like
MVFKLELTKLSNDESNLEAMLCLDDGNKASAFPVASVPVATRPPSGSGGGSACEPRRHGPSRAPRRNRAFMKVREWSELAAGPRWKTFIRRFSRSRSGGSRHAAGKYQYDPLSYALNFDEGHNGDFGDDGYDGLRNFSTRYAAPPPIKSVSSDSNQDVAVLG

SEQ ID NO: 195518 - protein, 867 aa, Glycine max
  Coding DNA Sequence Number=SeqID_78740
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q2TSD5; Match level="QueryCoverage=98%, HitCoverage=98%, E-value=0.0, Identity=63%"; Hit description =Trehalose 6-phosphate synthase
  Pfam annotation: Domain name=Glyco_transf_20; Domain location=32-515; Score=775.5; E_value=3.1e-230; Accession=PF00982.11; Description =Glycosyltransferase family 20
  Pfam annotation: Domain name=Hydrolase_3; Domain location=563-837; Score=-74.7; E_value=0.0085; Accession=PF08282.2; Description =haloacid dehalogenase-like hydrolase
  Pfam annotation: Domain name=Trehalose_PPase; Domain location=564 -831; Score=315.4; E_value=1e-91; Accession=PF02358.7; Description =Trehalose-phosphatase
  Pfam module annotation: Pfam domain module=Glyco_transf_20::Hydrolase_ 3::Trehalose_PPase; Domain location=32-515::563-837::564-831
MVARSCLNLLDLVSGDTLNFPRTPRSLPRVMTDPVIMSDGDVKESNDDDLSFFSYDEDSIFWQLKDGLSPDADVVYVGSLKVDVDANEQEKVSLQLLEEFNCVPTFIPSDLYKQFHDGFCKQQLWPLFHYMMPVYPGNRHFDRSQWQAYVSANKIFADKVMEVLNPEDDYVWVHDYHLMVLPTFLRKRCSRVRLGFFLHSPFPSSEVYKTLPVRGEILKALLNADLVGFHTFDYARHFLSCCRRMLGLEHESKRGYIGLEYFGRTIFIKILPAGIHMGRLQSTLDHPSSSNKVREIHQQFKGKKLIVGVDDMDLFKGISLKFLAIEQLLQQYPEWQGELILIQILNPPSSSDKDVEDAKEDAYITAKRINERFGLEGYEPIIIIDCHVPFYEKAAYYALAECCIVNAVRDGLNLVPYRYTVCRQGSSKLDEALEIASDFPRVSALVVSEFIGCSPSLSGAIRVNPWDIDAVAEALNLAITMPDGEKQLRHEKHYRYVSSHDVAYWARSFEQDLVFSCKDHYSNRCWGIGFGLNFRILSLSPSFRRLSIDHIVPAYERCSCRAIFLDYDGTVVPEASIVKAPSPEVISVLNNLCSDVNNTVFIVSGRGKTSLSEWFDQCENLGIAAEHVHVYMGVSSSYGTAVVGCRVTVKFFKLMVFLFDLYHRWGKHTSWQMSHADTDFAWQKIAEPVMRSYMEATDGSSVETKESALVWHYRDADPDFGSWQAMELLDHLENVLANEPVVVKKGQHIIEVKPQGITKGSVAQEVLSSLTKKGKSPDFVLCIGDDRSDEDMFESILAEPYSANSFSAPQIFACTVGQKPSKARYYLDDTVDVMTLLEGLGAASGPKSRCSTETPFEKREVCFENDV

SEQ ID NO: 195519 - protein, 800 aa, Glycine max
  Coding DNA Sequence Number=SeqID_78741
  Gene Ontology: Mol. function=protein serine/threonine kinase activity; Cellular component=cell surface; Biological process =protein amino acid phosphorylation
  Homolog annotation: Hit_ID=Q1T003; Match level="QueryCoverage=74%, HitCoverage=88%, E-value=2e-73, Identity=31%"; Hit description =Protein kinase; Concanavalin A-like lectin/glucanase
  Pfam annotation: Domain name=Lectin_legB; Domain location=33-279; Score=225.8; E_value=9.4e-65; Accession=PF00139.10; Description =Legume lectin domain
  Pfam annotation: Domain name=Pkinase; Domain location=387-638; Score=- 3.3; E_value=2.3e-08; Accession=PF00069.15; Description=Protein kinase domain
  Pfam annotation: Domain name=Pkinase_Tyr; Domain location=387-638; Score=-12.1; E_value=1e-11; Accession=PF07714.7; Description=Protein tyrosine kinase
  Pfam module annotation: Pfam domain module=Lectin_legB::Pkinase::Pkina se_Tyr; Domain location=33-279::387-638::387-638
MASLSNILLMFCLLNLLAFPVSVHSAGEVPINVTKHFSFYNFSFSNNPRLVHDMKLLGSAKFSNEKGALQIPNESEEDIRHQAGRGIYSFPIRLLDPSTKTPASFQTTFSFQMNNSTASEQAAYGGSGLTFIIVPDEFTVGRPGPWLGMLNDACENDYKAVAVEFDTRKNPEFGDLNDNHVGINLGTIVSTKVINVSDVGLSLNDGSVHRAWITYDGPQRRMDIRLGRANQEDYDYPPKPLFSESMDLSPFLNEYMFVGFSASTGNHTQIHNILSWNFTSTSQAFLRLPSSETCQGKILLENSTASTEVPPTSHKSSKNEPPRSFLIFVAAVALALALFLGFYFISKHRRNAAKLNTSVEAELHMPRPPNKPRRFAFSQLSSSTRSFSEIELLGSDNRGEYYRGKLSNGSQVAVKRFSAQFLSTHGSDKKRLLKEIKGVSHVRHPNLLLVRGWCQDNHEIMVVYDFVPNGSLDKWLFGAGVLPWTRRFKVIKDVADGLSFLHTKQLAHKNLKCSSVFLDVNFRAVLGDFGFVLMGAESKHFESQVCQGADVFEFGVLVLEVIAGRVRDEKEEGNPEERNLLDYAWNLHQIDEKVKLVDRRMGSLINLEQAIRVLEIGLLCTLNENKGRPSMEQVVEFLLNMDKPIPELPRTRPVALFPYNSANTGLYMSKCCVEMHLSGQFVKSPVNAVVWECGKRLNVGYEVDSAAKISFGDTENDANTDVDIFDNVNQKAGLGGKEKAKSERGFRRARGKRKGNSKNTLECHVFNEKLSETVPLAMTELEGDSSDEVKHVFNNWYHNC

SEQ ID NO: 195520 - protein, 278 aa, Glycine max
  Coding DNA Sequence Number=SeqID_78742
  Gene Ontology: Mol. function=transcription factor activity; Cellular component=cytoplasm; Biological process=regulation of transcription, DNA-dependent
  Homolog annotation: Hit_ID=Q4WCK4; Match level="QueryCoverage=89%, HitCoverage=48%, E-value=2e-41, Identity=38%"; Hit description =DUF895 domain membrane protein
MGGVIGGLIPFILNYHRSEAASVNDGTYIGFMCFMSLGTLLSLAILPACKVVRDDGSRCTNMFYTDVSTECVEVLKLFSNWKVLLMVPAAWSSNCFYPYQFNDVNGALFNLRTRGLNSVFYWGAQMLGSVGIGYIMDFSFKRRRVRGMVGVIVVGVLGTVIWGGGLVNQLRYSSNDLPEKLDFEQSGSHFAGPFVLYFSFGLLDAMFQSLVYWVIGALADDSQILSRYSGFFKGIQSAGAAVAWQVDEHKENVPSHRRDCLHMKSFKRKGSGPLLLRL

SEQ ID NO: 195521 - protein, 209 aa, Glycine max
  Coding DNA Sequence Number=SeqID_78743
  Gene Ontology: Mol. function=zinc ion binding; Cellular component =vacuole, cell cycle-correlated morphology; Biological process =protein transport
  Homolog annotation: Hit_ID=P93043; Match level="QueryCoverage=45%, HitCoverage=9%, E-value=5e-42, Identity=83%"; Hit description =Vacuolar protein sorting-associated protein 41 homolog
  Pfam annotation: Domain name=Clathrin; Domain location=30-166; Score =3.7; E_value=0.0018; Accession=PF00637.10; Description=Region in Clathrin and VPS
MAAIKRKTQKIVPLDQKAMKDELWCNGCGHVIWRSRFQILEAVSLLADENGGNKDQICECDHLSYYVKKHVELYTDYDPKMLLPFLRSSQHYTLEKAYEICIKRDLLREQVFILGRMGNSKQALAVIINKLGDVEEAVEFVTMQHDDELWEELIKQCLHKPKMIGTYTSTDLESTYFYVGAYANTNFERMYFYIGVKANTDLEGLLSMS

SEQ ID NO: 195522 - protein, 95 aa, Glycine max
  Coding DNA Sequence Number=SeqID_78744
  Gene Ontology: Cellular component=membrane
  Homolog annotation: Hit_ID=Q7G4E6; Match level="QueryCoverage=78%, HitCoverage=22%, E-value=9e-09, Identity=32%"; Hit description =Integral membrane protein DUF6 containing protein, expressed
MSHTEFGGVIEGKIRMNTLKKWFTSSQAILSMLLSRVILVKGSFIGALITYRHIVAAICVAPFALYFERGLTKKFTWKVWFWLFINALMGYVGVL

SEQ ID NO: 195523 - protein, 46 aa, Glycine max
  Coding DNA Sequence Number=SeqID_78745
MTYTTYDVWSWPKASAQDPGRKISMQQGQEDILIARFPDPNYGVKT

SEQ ID NO: 195524 - protein, 419 aa, Glycine max
  Coding DNA Sequence Number=SeqID_78746
  Gene Ontology: Mol. function=endonuclease activity
  Homolog annotation: Hit_ID=Q1T6I5; Match level="QueryCoverage=96%, HitCoverage=82%, E-value=1e-162, Identity=70%"; Hit description =Calcium-binding EF-hand; Endonuclease/exonuclease/phosphatase
  Pfam annotation: Domain name=Exo_endo_phos; Domain location=28-293; Score=39.6; E_value=1.1e-08; Accession=PF03372.13; Description =EndonucleaseExonucleasephosphatase family
  Pfam annotation: Domain name=efhand; Domain location=384-412; Score =21.1; E_value=0.0039; Accession=PF00036.22; Description=EF hand
  Pfam module annotation: Pfam domain module=Exo_endo_phos::efhand; Domain location=28-293::384-412
MGRISRTKSYAIASSIVQENQQQTPPSITCTTFNILAPIYKRLNHEDQSCRESDYKACWLTRNQRILDWLLYERSSIICLQEFWIGNDEFVNLYDKRLGDAGYINLKLGRTNNRGDGLLIAVQKEYFTVVNHKELHFNDCGDRVAQLLHLELAFPFSQCQNSDVRHEILIVNTHLLFPHDSSLCLVRLHQVYKILQYVESYQKEYQLKPLPIMLCGDWNGSKRGHVYQFLRSQGFVSSYDAAHHYTDADAHKWVSHRNHLGNICAVDFIWLLNPDKYQKLLKTSWSEAVFGMFKSFFGPIIKSVEFIFGVPGGFTINVVVEQNYVTDNKLHLYQYLLRRASLTERDAFAFLKVDNEDCITYSGFCEALRQLNLIGHCHGLSAEETKDLWVQADINGNGVIDYKEFLEGKKMEGKKMEGK

SEQ ID NO: 195525 - protein, 280 aa, Glycine max
  Coding DNA Sequence Number=SeqID_78747
  Gene Ontology: Mol. function=DNA binding; Cellular component=nucleus; Biological process=regulation of transcription, DNA-dependent
  Homolog annotation: Hit_ID=Q1RWX0; Match level="QueryCoverage=88%, HitCoverage=31%, E-value=3e-71, Identity=62%"; Hit description=SBP
MKTLQQKLDVSLLSKQFRSASGGSICSSCETFALSHTSSSDLLVDIAWLLKDTTSENFDRVMTASQIQRYCHLLDFLICNDSTIILGKILPNLIILTESMKSNVVINRTSDVDIMQLLNHIHNARNAVYQKHPKSESIIVHSEMKGFILAQGCSQDNKLSVAINSQGIQSRADEKWGVLKVKSPTSNEKMERIPLLKRDIIMSMEELPERYGRRCLGRGFLTFRPAIFVLVSVAVCLGVCVAVLHPGRVVYYIGKLNPRLLICALPILSDVQRDLQLQVL

SEQ ID NO: 195526 - protein, 950 aa, Glycine max
  Coding DNA Sequence Number=SeqID_78748
  Gene Ontology: Mol. function=DNA binding; Cellular component=nucleus; Biological process=transcription
  Homolog annotation: Hit_ID=Q53J12; Match level="QueryCoverage=81%, HitCoverage=46%, E-value=0.0, Identity=54%"; Hit description=BAH domain-containing protein, putative
  Pfam annotation: Domain name=BAH; Domain location=172-287; Score =33.8; E_value=6.1e-07; Accession=PF01426.8; Description=BAH domain
  Pfam annotation: Domain name=TFIIS; Domain location=463-546; Score =46.7; E_value=7.9e-11; Accession=PF08711.1; Description =Transcription factor S-II (TFIIS)
  Pfam module annotation: Pfam domain module=BAH::TFIIS; Domain location=172-287::463-546
AEIHISLVAGAGGREATNLQSHSPHVASPSCDVIILPARAARTARPLPRVSGKHGCGARVLRGSRVSRVLRASGVELGGGFDGTRWGKCEAMHGRGGEKGKRTRHMWKSSTRGDSSLNADVSSSSSSSSSSVKSFSYLSLCGNELWVFDECVVYKYVSRAGIKMETTELDGRKISVGECALFKPSEDRPPFIGIIRCLTFGKEKKLKVGVSWLYRSIEVKLNKGGPLVAAPNEIFYTFHKDEIDAESLLHPCKVAFLRKGAELPSGISSFVCRRVYDIANKCLWWLNDQDYINDCQEEVDQLLYRTCVGMHAAVQPGGRSPKPMSSPTSTSQLKSVSDSVQNSTSSFPSHIKGRKRERADQSSEPAKRERSIKTEDGDSGHFRHDNILKTEIAKITEKGGLVDNEGVEKLVQLMVPEKNEKIDLASRALLAAVIAATDKLDCLSQFVQLRGLPVFDEWLQEVHKGKIGDGVGSRDGDKSVEEFLLVLLRALDKLPVNLQALQTCNIGKSVNHLRTHKNTEIQRKARGLVDTWKKRVEAEMNIKDAKSGSGPTVHWSAKSRSSVVGQGGNRHSGALSDVAMKSSVTQLSASKTASVKIVQGENTTRSASTSAFPGPAKSVPSPASATTNLKDGQPRIAAANGGSDLPMVNARDEKSSSSSQSHNNSQSCSSDHAKTGGHSGKEDARSSTAMSVNKISGGSSRHRKSINGFSGSTPSVGQRETGSSRNSPLHKNLTSEKISQPGLMEKALEGVSCKLIVKIPSQVRSPAQSASAGSFDDPTIMNSRASSPVLPEKHDQFDQSSKEKSDLYRANIVSDINTESWQSNDFKDVLTGSDEADGSPAAVTDEEHCQIGNDCKKTLEVPKAASSSSGNENKSGNLQDASYTSINALIEGVKYSEADDVGMNLLASVAAGEILKSELLTPAGSPERNTTAVEQSCTGNGVVKSSEENL

SEQ ID NO: 195527 - protein, 77 aa, Glycine max
  Coding DNA Sequence Number=SeqID_78749
  Gene Ontology: Mol. function=DNA binding; Cellular component=nucleus; Biological process=regulation of transcription
  Homolog annotation: Hit_ID=Q1SXG6; Match level="QueryCoverage=88%, HitCoverage=11%, E-value=4e-27, Identity=76%"; Hit description=No apical meristem (NAM) protein
  Pfam annotation: Domain name=NAM; Domain location=21-76; Score=-7.3; E_value=8.2e-07; Accession=PF02365.6; Description=No apical meristem (NAM) protein
MGAVVECYPQPRTAVLSLNTLPLGFRFRPTDEELIDYYLRSKINGNGDDVWVIREIDVCKWEPWDLPGIKYFFSLEI

SEQ ID NO: 195528 - protein, 136 aa, Glycine max
  Coding DNA Sequence Number=SeqID_78750
  Gene Ontology: Mol. function=GTP binding; Cellular component =intracellular; Biological process=small GTPase mediated signal transduction
  Homolog annotation: Hit_ID=Q0PZE6; Match level="QueryCoverage=62%, HitCoverage=40%, E-value=2e-30, Identity=74%"; Hit description=Small GTPase
MHCYCVYDEHADLREDRHYMADHPGLVPVTTEQGEELRKHIGATYYIECSSKTQQNVKAVFDAAIRMVIKPPQKQNEKRKKKPRGCFLGGDKGNPFSFTLAISISTILYFDIPLRSPLVAALLNPKSIQFSNQIFY

SEQ ID NO: 195529 - protein, 735 aa, Glycine max
  Coding DNA Sequence Number=SeqID_78751
  Gene Ontology: Mol. function=DNA binding; Cellular component=nucleus; Biological process=transcription
  Homolog annotation: Hit_ID=Q53J12; Match level="QueryCoverage=98%, HitCoverage=44%, E-value=1e-106, Identity=35%"; Hit description=BAH domain-containing protein, putative
MDLQQVSETILESKGKLNKKSVSTALGGLSESSVQEARDGDRSKQLQEVGRGVNADEIVDVKVSSVAEVKAEATEKLSHIAVEVDVQSDNCTTEVSTGGGQTAAILVQSDSARGKDENVLHSSAYSVDKVPEDLTEREFEKADDVDAENHSSQSKKQRNECESDALTMPEDRGLCSIVTGIAAEHVEENLETKEVHDQPAREELPKDSPSVLSQEMDKHLDSKGSKLIAMEAEEAEECTSTTADASSMSSAAVSDADAKVEFDLNEGLNADDGKSGEFNCSAPAGCLVSPVPFPASSMSCGIPAPVTVAAAAKGPFVPPEDLLRSKGEIGWKGSAATSAFRPAEPRKVMEMPLGALTTSIPDAPAGKQSRAPLDIDLNVADERILDDISSQTYARHTDSASLATDDHDPVCSKMSSPLRCSGGLGLDLNQVDEASDVGNCLSSNHKIDVPIMQVKPSLGGPPNREVNVHRDFDLNNGPSVDEVTTESSLFSLHARSSVPSQPLVSGLRVSTAEPVNFSWLPSSGNTYSAVTISSIMPDRGDHPFSIVAPNGPQRLLTPAAGGNPFGPDIYRGPVLSSSPAVSYASAPFEYPVFPFNSSFPLPSASFSSGSTTYVYPTSGNQLCFPAVNSQLMGPAGAVSSHYPRPFVVGLAEGSNSGSAETSRKWARQGLDLNAGPGGSDVDGRDGNSPLPSRQLSVASSQALAEEQVRVQLAGSVRKRKEPDGGWDGHNQSSWQ

SEQ ID NO: 195530 - protein, 127 aa, Glycine max
  Coding DNA Sequence Number=SeqID_78752
  Gene Ontology: Mol. function=GTP binding; Cellular component =intracellular; Biological process=small GTPase mediated signal transduction
  Homolog annotation: Hit_ID=Q0PZE6; Match level="QueryCoverage=69%, HitCoverage=29%, E-value=3e-24, Identity=66%"; Hit description=Small GTPase
  Pfam annotation: Domain name=Ras; Domain location=11-127; Score= -71.8; E_value=0.00068; Accession=PF00071.12; Description=Ras family
MAAATAPRFIKCVTVGDGAVGKTCMLICYTSNKFPTKVTQLLSCEASPLGLSDFASPYVDHQDYIPTVFDNFSANVVVEGITVNLGLWDTAAHNTPAFLAAIVISLNCLKYITPCIPIRRVIAKCKS

SEQ ID NO: 195531 - protein, 56 aa, Glycine max
  Coding DNA Sequence Number=SeqID_78753
MRGVAKQRKLVIKNIPDSGVMFTLEKGRQKRGFCSYVSSIEEEIRPAQFFQKGRIK

SEQ ID NO: 195532 - protein, 176 aa, Glycine max
  Coding DNA Sequence Number=SeqID_78754
MEDILKMEDHCKRWSEYLDSTQSRVSHSPPINCDFCGGEHCNDNCHLYSMNNSWWGQELLPYNQYEEEITPNLEGVLAEFMAYHASSKVHQNSMQNLEIHVGKSYSMENYQWEQELQPYNQYEEERSEVAKFVATSEENFVEVEAHEESLVEERDSREKDEEKMRRKHNNGRSAHK

SEQ ID NO: 195533 - protein, 278 aa, Glycine max
  Coding DNA Sequence Number=SeqID_78755
  Gene Ontology: Mol. function=transporter activity; Cellular component= membrane; Biological process=transport
  Homolog annotation: Hit_ID=Q13MQ2; Match level="QueryCoverage=99%, HitCoverage=50%, E-value=6e-83, Identity=57%"; Hit description=MFS efflux pump, outer membrane lipoprotein, NodT family
  Pfam annotation: Domain name=OEP; Domain location=126-278; Score =59.0; E_value=1.6e-14; Accession=PF02321.8; Description=Outer membrane efflux protein
MADAQQQAAIEQRNDALVSLEAEVARAYLQLRGAQAVLATLQQQINVAQQTWELTQSQQRNGLAPLTDVENARAQLASLNAQLPQYQAQERQAMNGLAVLLGKTPGALDNELMSSKALPALPKLVAVGIPSTLARRRPDIRQAEANLHAQTANIGVSVANLFPSLSLTGQLGVRNTDASYLDDWSSHFFSVGPALSIPIFQGGRLVSSVKLARAQQASAALDYRQTVLTALQDVENALVSYRADQQQVTALDETTGALQRAFDLASDSYKQGISTFLE

SEQ ID NO: 195534 - protein, 156 aa, Glycine max; identical to SEQ ID NO: 180172
  Coding DNA Sequence Number=SeqID_78756
  Gene Ontology: Cellular component=mitochondrion

SEQ ID NO: 195535 - protein, 401 aa, Glycine max
  Coding DNA Sequence Number=SeqID_78757
  Gene Ontology: Mol. function=sugar porter activity; Cellular component=integral to membrane; Biological process=carbohydrate transport
  Homolog annotation: Hit_ID=Q8LBI9; Match level="QueryCoverage=98%, HitCoverage=84%, E-value=1e-139, Identity=62%"; Hit description =Sugar transporter ERD6-like 16
  Pfam annotation: Domain name=MFS_1; Domain location=50-398; Score =9.6; E_value=0.00011; Accession=PF07690.6; Description=Major Facilitator Superfamily
  Pfam annotation: Domain name=Sugar_tr; Domain location=45-401; Score =80.4; E_value=5.5e-21; Accession=PF00083.14; Description=Sugar (and other) transporter
  Pfam module annotation: Pfam domain module=MFS_1::Sugar_tr; Domain location=50-398::45-401
MAIEQHKDVESGYLQEPFIQPEEVACKEVGSDKSVENGSIGMVLLSTLVAVCGSFTFGNCVGYSSPTQAAIREDLSLSLAEFSMFGSLVTIGAMLGAITSGRITDFIGRKGAMRISTGFCITGWLAVFFSKGSYSLDLGRFFTGYGIGLISYVVPVYIAEIAPKNLRGGLATTNQLLIVTGASVSFLLGSVIHWRKLALAERYNCWLGLNFEGLVPCICLLIGLCFIPESPRWLAKVGREKEFQLALRRLRGKDVDISDEAAEILDSIETLRSLPKIKLLDLFQSKHVRSVVIGVGLMVCQQFVGINGIGFYTAETFIAAGLSSGKAGTIAYACLQVPFTVLGAILMDKSGRRPLMMDQSLMLECAPIFAVAGVLIYIAAYSIGVGPVPWVIMSEVGSCKL

SEQ ID NO: 195536 - protein, 88 aa, Glycine max
  Coding DNA Sequence Number=SeqID_78758
MWEHVDEINTMIGSSGTLKKFENSKCGSQVGHENKKTKMDHYVNGFSNELQQYILNIVDVTPNGNCNYKIIAALLSQGRDSWSLVAKI

SEQ ID NO: 195537 - protein, 67 aa, Glycine max
  Coding DNA Sequence Number=SeqID_78759
MVGNWVVAQWWIWCGVEVHWVVAVVLLGGWVEVGCNDCGGLGEIEVTRVLLGRRRTCTASWASVRET

SEQ ID NO: 195538 - protein, 384 aa, Glycine max
  Coding DNA Sequence Number=SeqID_78760
  Homolog annotation: Hit_ID=Q48IW3; Match level="QueryCoverage=32%, HitCoverage=40%, E-value=2e-10, Identity=34%"; Hit description =Inosine-uridine preferring nucleoside hydrolase
  Pfam annotation: Domain name=IU_nuc_hydro; Domain location=23-366; Score=-77.3; E_value=2.7e-06; Accession=PF01156.9; Description =Inosine-uridine preferring nucleoside hydrolase
MEHVGALLRYDDWRLWLLLGPLHRPLWLSSHHVEAITVSPTGWANAATIDVIYDLLHMMGRDDIPVGLGDAFAMNQSDPIFPIVGDCKYVKAIPHGNGGLLDSDTLYGLARDLPRSPRRYTSENSVKFGAPRNTDHPELRQPLVMEIWESILQTMETGSKITVLTNGPLTTLAKVVSVKNISSRIEEVYVVGGHINRNVSDKGNIFSVPSNQYAEFNMFLDPLAAEIVFQSDVNITLIPLSIQHKASSFSSMLHWLRRTEKTPEAVFSKRVLLRLQRLKHIHHRYHHMDTFLGEILGAVVLANGHGPSNLNAKFELKPIKVLAQGDESIDGKMVVDEKHGKLVRILSHMSSKAYHKMFANSLGDWNQSARVGSFEDQRRKWSHP

SEQ ID NO: 195539 - protein, 505 aa, Glycine max
  Coding DNA Sequence Number=SeqID_78761
  Homolog annotation: Hit_ID=Q5HQB3; Match level="QueryCoverage=28%, HitCoverage=38%, E-value=2e-10, Identity=29%"; Hit description =Inosine-uridine preferring nucleoside hydrolase family protein
  Pfam annotation: Domain name=IU_nuc_hydro; Domain location=57-341; Score=-86.0; E_value=8.4e-06; Accession=PF01156.9; Description =Inosine-uridine preferring nucleoside hydrolase
MTASTDLPLPRHARCKPCAMENGRVERLHGGVTISANSWTNAGHAVNQVYDILYMMGQDDITVGMGGEGGILPNGTILPNVGGYLSIIEQGMTTTRGCRYRQAIPMGLRGLLDIDTNFGIRKAFLPQGRRKYTPLRQPTAQQVLIDKISTGPITLIMLGAHTNVAIFLMNNPHLKKNVEHIYIMGGSVGLRNQTGCFPQDAFTSCVPRQCDGCGNVYTNYKANPYAEYNIFCDPFATYQVIHSGIPVTLVPLDATNTIPYTKEFFDEFEKSQHTYEVQYCFKSVKMARDAWFGNQFYKNYFMWDSFATGVAISSMRNSNKRNKEENEFADMEYINITVFTSNKPYGISDGSNPFFDGLKVPKFNLKKDGVHSGHVQQGLRDPFCFVKNGKGRCQDGYTAEVNGPDSMKVLVATKAKPNREVRNPLNREYFKSFLNVLRQPQHAGRFNFTTQFPYYKEVTYMPDFQNKTLGKHVVFDMDMSVGDFLALFYLLKVDVEVINLKVFYT

SEQ ID NO: 195540 - protein, 117 aa, Glycine max
  Coding DNA Sequence Number=SeqID_78762
MFPLRFWVVVVLIMLTTLGVALDNVMAKPRRILLDTDVDLDDVFALIYLLKHNRSEFQLEIYNTNGGDNRNCDIGDNNNKSGDNNDDNGGRMVVGEVVMVIITTTSIMIVVILMVVW

SEQ ID NO: 195541 - protein, 69 aa, Glycine max
  Coding DNA Sequence Number=SeqID_78763
MKSDRHSTYYVMSTIVCDLTLMREQNLSCLRVHSIWSTFQECLTLMYLDWGQKESIRVKLIYECSERVW

SEQ ID NO: 195542 - protein, 303 aa, Glycine max
  Coding DNA Sequence Number=SeqID_78764
  Gene Ontology: Mol. function=transmembrane receptor activity; Cellular component=membrane; Biological process=defense response
  Homolog annotation: Hit_ID=Q8W2C0; Match level="QueryCoverage=99%, HitCoverage=46%, E-value=6e-65, Identity=43%"; Hit description =Functional candidate resistance protein KR1
  Pfam annotation: Domain name=NB-ARC; Domain location=70-301; Score= -45.9; E_value=2.3e-07; Accession=PF00931.13; Description=NB-ARC domain
LASSAIMFLSFTYDMFLNFRGSDTRFGFTGNLYKALHDRGFQTFIDDEKHWLSMRKVSKAKKERIVEFFSTKINRAPLHVADYPVGLEAQVLEVKKLFDIGTNDGVHMIGIHGIGGIGKSTLAGAVYNSITDNFDEKKIKLASVQQGIPMIKHRLQQKKVLLILDDVDKHQQLHDIVGRPDWFGPGSRIIITTHGVKRTYEVLDAVVTYASGLPLALEVIGSNLFGKSLQAWKSSSKQYKRILYNQIVEILKGDCMKNHTGVLVEKSLIKHSWDDTLTLHDLVEDMGKELVKQDIIQVLEDNT

SEQ ID NO: 195543 - protein, 185 aa, Glycine max
  Coding DNA Sequence Number=SeqID_78765
  Pfam annotation: Domain name=Transposase_23; Domain location=60-130; Score=-7.1; E_value=0.0068; Accession=PF03017.5; Description =TNP1ENSPM transposase
ASQGSFVPHGRQDVLTVAIGRQEHPGHVRAAGAEPEVGPSTARVSTKESYVDPSGNDPDTGDSDKCRLYIKENPPRLVALGRVYEGSTTIHNIPLLHDQVKVDVEEVKDADALILVLTEDVILVGQALNTFLVWPTHLVKRVVGPAKPADRPDHEVDDPLYLMTLTIPQLFLKPLQVMWDATMFR

SEQ ID NO: 195544 - protein, 342 aa, Glycine max
  Coding DNA Sequence Number=SeqID_78766
  Gene Ontology: Mol. function=metal ion binding; Biological process =metal ion transport
  Homolog annotation: Hit_ID=Q1SXE7; Match level="QueryCoverage=83%, HitCoverage=83%, E-value=3e-72, Identity=69%"; Hit description=PPAK motif; Heavy metal transport/detoxification protein
  Pfam annotation: Domain name=HMA; Domain location=58-119; Score=45.2; E_value=2.2e-10; Accession=PF00403.16; Description=Heavy-metal -associated domain
MGEEAKQEQVQPVAEAKPEEKKEEKAEEKPAEEKKEEKPEEKTEDEKKEEPKPPSPCVLFVDLHCEGCAKKIERYIMKMRGVEGVVIDMAKNEVTIKGIVEPQAICNTITKKTKRRASVISPLPEAEGEPIPEVVNSQVSGPVTVELNVNMHCEACAEQLKRKILQMRVVMEKGQIAKSAALDAGPHLAWHSFVKIGVQTAMTEFSTGKVLVTGIMDANKLVDYVYRRTKKQAKIVPQPEPEPEKKEEKPAEEETKPEEEKPPEEAKKEEGGENKEEKGGEESKEEAKKEENNVVVVPYNNIDDEGLKRMMYYYQYPPLSVIERIPPPQLFSDENPNACCIV

SEQ ID NO: 195545 - protein, 63 aa, Glycine max
  Coding DNA Sequence Number=SeqID_78767
MVVVMTEILGEYTAVLTRVTERLLPRHGISFGGLRRNLRFASSTTSSSDSTSFLLQKLEVCPK

SEQ ID NO: 195546 - protein, 135 aa, Glycine max
  Coding DNA Sequence Number=SeqID_78768
  Gene Ontology: Mol. function=metal ion binding; Biological process =metal ion transport
  Homolog annotation: Hit_ID=Q1SJ50; Match level="QueryCoverage=49%, HitCoverage=43%, E-value=2e-08, Identity=44%"; Hit description=Heavy metal transport/detoxification protein
  Pfam annotation: Domain name=HMA; Domain location=20-80; Score=40.9; E_value=4.4e-09; Accession=PF00403.16; Description=Heavy-metal -associated domain
MANMQIVPAYKTIVEAQYVEMMVPLYSYGCEKKIKKTLSNLKGIYSVNVDYYQQKVTVWGICNKYDVLETVRSKRKEAQFWNQEDNVVLEKSQSPSSSPPPPFPHKDFKPSLALTKVRSLSLKAWKKVFTRSYSF

SEQ ID NO: 195547 - protein, 176 aa, Glycine max
  Coding DNA Sequence Number=SeqID_78769
MWIVASGNRLPKVSNRLQGLKIEDRRLRWSLIVMAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 195548 - protein, 281 aa, Glycine max
  Coding DNA Sequence Number=SeqID_78770
  Homolog annotation: Hit_ID=Q9FJQ3; Match level="QueryCoverage=91%, HitCoverage=85%, E-value=3e-21, Identity=28%"; Hit description =Genomic DNA, chromosome 5, P1 clone:MQN23
MGSNDSFGDRIFKTRSHLADVTNRPAKRPFSLVSGDGGDLQFTKLIRLGVENLAKEKNQMQFGAQAHLNNVVLLQPKEKHPILLPFSDSHSFQDPIFPKEGMEEHNTLDLENFKFGEKGEGIVATDSAVESGGKVICDVENLGSPKRGTEQMPTISASNDSNFLGLKPCSSSVTEAADVKSCTCSFCSKAAYIWSDLHYQDAKGRLSAIKKSQKEAKMIIQKFSGLEDTIMHDQHRSEESLKLEFSLVHQWKSLFLEIQNMYTQESSQLVSFQCYHLHTWA

SEQ ID NO: 195549 - protein, 676 aa, Glycine max
  Coding DNA Sequence Number=SeqID_78771
  Gene Ontology: Mol. function=acyl-CoA dehydrogenase activity; Cellular component=peroxisome; Biological process=fatty acid metabolic process
  Homolog annotation: Hit_ID=O65201; Match level="QueryCoverage=98%, HitCoverage=97%, E-value=0.0, Identity=84%"; Hit description=Acyl -coenzyme A oxidase 2, peroxisomal precursor
  Pfam annotation: Domain name=ACOX; Domain location=516-673; Score= -1.3; E_value=4.7e-07; Accession=PF01756.9; Description=Acyl-CoA oxidase
  Pfam annotation: Domain name=Acyl-CoA_dh_1; Domain location=310-474; Score=14.2; E_value=7.3e-05; Accession=PF00441.14; Description=Acyl -CoA dehydrogenase, C-terminal doma
  Pfam annotation: Domain name=Acyl-CoA_dh_M; Domain location=166-225; Score=73.6; E_value=6.2e-19; Accession=PF02770.9; Description=Acyl -CoA dehydrogenase, middle domain
  Pfam module annotation: Pfam domain module=ACOX::Acyl-CoA_dh_1::Acyl -CoA_dh_M; Domain location=516-673::310-474::166-225
MQTPNCEAERRIQRLTLHLNPTALVAAKQLEMATCARGKLSVDTPSLSSYMRGKHVDIQEKVFDYFNANPRLQTPVEISKDEHRDLCMKQLTGLVREAGIRPLRYVVDDPAKYFAILEAVGSVDMSLGIKMGVQYSLWGGSVLNLGTKKHKDKYFDGIDNLDYPGCFAMTELHHGSNVQGLQTVATFDIITDEFIINTPNDGAIKWWIGNAAVHGKFATVFARLKLPTYDKKGLSDMGVHAFIVPIRDMKTHQPLPGIEIHDCGHKVGLNGVDNGALRFRSVRIPRDNLLNRFGDVSRDGKYTSSLPTVNKRFAATLGELVGGRVGLAYSSVSVLKVAATIAIRYSLLRQQFGPPNQPEVSILDYQSQQHKLMPMLASTYAFHFATTNLVEKYSQMKKTHDDELVADVHALSAGLKAYVTSYTAKSLSICREACGGHGYAAVNRFGILRNDHDIFQTFEGDNTVLLQQVAGDLLKQYKGKFKGGTFAVTWNYLRESMNTYLSQPNPVTARWEGEDHLRDPKFQLDAFRYRTSRLLQSVAVRLRKHSKSLGDFGAWNRCLNHLLTLAESHIESVILAKFIEAVQSCPDPSSQAALKLVCDLYALDRIWNDIGTYRNVDYVAPNKAKAIHKLAEYLSFQVRNIARELVDAFDLPDHVTRAPIAKRSGAYSQYTQYVGF

SEQ ID NO: 195550 - protein, 365 aa, Glycine max
  Coding DNA Sequence Number=SeqID_78772
  Gene Ontology: Mol. function=intramolecular transferase activity, phosphotransferases; Cellular component=cytosol; Biological process =metabolic process
  Homolog annotation: Hit_ID=Q6Z8J0; Match level="QueryCoverage=65%, HitCoverage=72%, E-value=1e-110, Identity=79%"; Hit description =Putative phosphoglycerate mutase
  Pfam annotation: Domain name=PGAM; Domain location=66-252; Score =146.9; E_value=5.3e-41; Accession=PF00300.12; Description =Phosphoglycerate mutase family
  Subcellular localization annotation: CTP_CleavageSite=46; ConfidenceScore=5.58e-01
MSATFKYQPTGLHGWGAPRSSSRNLARFFSMRFACNSRHHKILHASVSHPSSLSISHDSSTETESTLILIRHGESLWNEKNLFTGCCDVPLTKRGVEEAIEAGKRISYIPVDMIFTSALIRAQMTAMLAMTQHHQEKVPIIIHNESERATAWTQVYSEKTTKQSIPVITAWQLNERMYGELQGLNKQETAERYGKEKVHEWRRSFDIPPPKGESLEMCSQRAVAYFKDFIEPQLKSGKHVMVAAHGNSLRSIIMYLDRLTSQEVTSLELSTGIPLLYIYKDEKFNSRGSPVGPTEAGVYAYTQRFNPPPGLISLHYLCACSECYTHMEILPRLPLCICKGKAAYNIPPPYLRIAKSLWAMGYEVK

SEQ ID NO: 195551 - protein, 133 aa, Glycine max
  Coding DNA Sequence Number=SeqID_78773
MDRYANSVAPQDDHLYCSSSWPYDIVTPKSHEGGGGSGRGVHEVTGIALHSNLATERLHLTLLAYFAVAISILDAFKAGLDPVALSVLMSFMAIALPLVPLDDIIAMESHKAAKILVTVLARDGKGLGVVWCA

SEQ ID NO: 195552 - protein, 449 aa, Glycine max
  Coding DNA Sequence Number=SeqID_78774
  Gene Ontology: Mol. function=inositol or phosphatidylinositol phosphatase activity; Biological process=abscisic acid mediated signaling
  Homolog annotation: Hit_ID=Q9FJQ6; Match level="QueryCoverage=81%, HitCoverage=62%, E-value=1e-107, Identity=53%"; Hit description =Inositol-1, 4, 5-trisphosphate 5-phosphatase-like protein
  Subcellular localization annotation: CTP_CleavageSite=74; ConfidenceScore=5.26e-01
MSSFTGARSKANANSEMTKANDTNLCPINTSTITSTSPDTSAKNDKKKKSILPKIFGSKRNGRGSDEETLKSSSAEEGDGVTLDLENKIETRRKAFLEAAPIMRKSFSERETSPGIEGLNLSNFERPMMTPETELQSFRIFVATWNVGGKSPNYDLNLQDFLLVEGSADIYVLGTLGKSMTTTKHRNKSLLIWLVISRLKEIVPLSAGNVLVIEDNEPAAKWLALISQALNGPRNEYSDSSDSGTGSKTHSSSRELKSPASLNFFQKPSLKVISKSFRAEGSSLLKACNCPVESPSRERRRMRKFSDPMSKLDSELRGDDTVEELLSIAEIPSSPSQSRYSLISTKQMVGIFLTIWTKKELVPHIGHLRADSVGRGIMGCLGNKGCISMSMSLHQTSFCFVCSHLASGEKEGDELKRNSDVAEILKSTQFPRICKNPCRRAPEKIVDHE

SEQ ID NO: 195553 - protein, 462 aa, Glycine max
  Coding DNA Sequence Number=SeqID_78775
  Gene Ontology: Mol. function=transcription regulator activity; Cellular component=nucleus; Biological process=regulation of transcription, DNA-dependent
  Homolog annotation: Hit_ID=Q1T1X6; Match level="QueryCoverage=94%, HitCoverage=91%, E-value=1e-101, Identity=47%"; Hit description =Ethylene insensitive 3
  Pfam annotation: Domain name=EIN3; Domain location=6-347; Score =567.6; E_value=1.2e-167; Accession=PF04873.4; Description=Ethylene insensitive 3
MVEIHEEIDPFDQEEHEEEETDYDQLKKRMQKDRILLQQMKEKRPKEEAGQQEKQEASRRKKMSRAQDSILKYMVKIMEVCNAQGFVYGIVPEKGKPVTGSSDSLREWWKEKVKFDQNAPGAIAKYMPLLETDELDPSSYIHLLNDLQDTTLSSLLSALMQHCIPPQRRFPLERGLAPPWWPRGAENWWGEQGFLAHEHGPPPYKKPHDLKKAWKVSLLAAIIKHMSPNLDKLRRLVTQSKTLQDKMTARDTATWSKVMNQEETLLQLANKCLRISPSSEEDENECESSTASTIIHEGGNIIEKRKSDLFDLDAVVDKLYACQYYQCPQSLTGMGFLNKNSRMNHESLCAYRTNESQSVLLQDSQSNDTQIASVDDWMMNLEAARANQNENNHPVGHPINDQFRDIAGKTSEEDYGCLWPKSLEDLDLQAALNQMDMDLNPNPEQDTPQGQEVTSIWDLPYK

SEQ ID NO: 195554 - protein, 54 aa, Glycine max
  Coding DNA Sequence Number=SeqID_78776
MEVPWVPMKLLLSFEENWGRWGEIWLHPSPLFYFLSDLARPGSLDDKMQMHACL

SEQ ID NO: 195555 - protein, 37 aa, Glycine max
  Coding DNA Sequence Number=SeqID_78777
MAMAPKKLLTKRARKTTAGEGSSAAPQAEIEFDRHCF

SEQ ID NO: 195556 - protein, 71 aa, Glycine max
  Coding DNA Sequence Number=SeqID_78778
MEKKSVYAWQENGVAKYALLLSPRVCGPNRERKSLEVHAPVELACGHARKLLVGHGLTRVLGTRGSKLIWA

SEQ ID NO: 195557 - protein, 141 aa, Glycine max
  Coding DNA Sequence Number=SeqID_78779
  Gene Ontology: Mol. function=DNA binding; Biological process=DNA integration
  Homolog annotation: Hit_ID=Q0ZCD0; Match level="QueryCoverage=70%, HitCoverage=8%, E-value=1e-28, Identity=56%"; Hit description =Integrase
MSPYRVFFGEACHLPVEIEHKTYWAVKTYNFSIDQAGEERKLQLSKLDEIRLEDYENSKFYKEKTKKFHDNLIAKKDFVVGQKVLLYNSRLGLMSVEIKSESTDKSFKVNGHQLKPFLTNPSLVDVVVEETSLLHPTSLPS

SEQ ID NO: 195558 - protein, 57 aa, Glycine max
  Coding DNA Sequence Number=SeqID_78780
  Gene Ontology: Mol. function=catalytic activity; Biological process =cellular metabolic process
  Homolog annotation: Hit_ID=Q1RUS0; Match level="QueryCoverage=98%, HitCoverage=8%, E-value=2e-10, Identity=66%"; Hit description=NAD -binding site; Nucleotide sugar epimerase
MQALRKEPLTVYGDGKQTRSFQYVSDLGRRLHRVLRPRSVPVRLLVEGLMRLMEGEH

SEQ ID NO: 195559 - protein, 460 aa, Glycine max
  Coding DNA Sequence Number=SeqID_78781
  Gene Ontology: Mol. function=protein binding; Cellular component =integral to membrane; Biological process=protein amino acid phosphorylation
  Homolog annotation: Hit_ID=Q93V91; Match level="QueryCoverage=99%, HitCoverage=80%, E-value=2e-99, Identity=33%"; Hit description =Verticillium wilt disease resistance protein Ve2
  Pfam annotation: Domain name=LRRNT_2; Domain location=1-33; Score =8.7; E_value=0.1; Accession=PF08263.3; Description=Leucine rich repeat N-terminal domain
  Pfam annotation: Domain name=LRR_1; Domain location=154-176; Score =1.5; E_value=1.5e+02; Accession=PF00560.23; Description=Leucine Rich Repeat
  Pfam annotation: Domain name=LRR_1; Domain location=220-242; Score =14.0; E_value=0.53; Accession=PF00560.23; Description=Leucine Rich Repeat
  Pfam annotation: Domain name=LRR_1; Domain location=244-266; Score =11.0; E_value=2.5; Accession=PF00560.23; Description=Leucine Rich Repeat
  Pfam annotation: Domain name=LRR_1; Domain location=268-289; Score =8.4; E_value=7.5; Accession=PF00560.23; Description=Leucine Rich Repeat
  Pfam annotation: Domain name=LRR_1; Domain location=291-314; Score =10.2; E_value=3.5; Accession=PF00560.23; Description=Leucine Rich Repeat
  Pfam annotation: Domain name=LRR_1; Domain location=316-338; Score =9.9; E_value=4; Accession=PF00560.23; Description=Leucine Rich Repeat
  Pfam annotation: Domain name=LRR_1; Domain location=340-361; Score =9.1; E_value=5.7; Accession=PF00560.23; Description=Leucine Rich Repeat
  Pfam annotation: Domain name=LRR_1; Domain location=365-387; Score =14.2; E_value=0.47; Accession=PF00560.23; Description=Leucine Rich Repeat
  Pfam annotation: Domain name=LRR_1; Domain location=389-412; Score =5.3; E_value=29; Accession=PF00560.23; Description=Leucine Rich Repeat
  Pfam annotation: Domain name=LRR_1; Domain location=414-437; Score =8.1; E_value=8.6; Accession=PF00560.23; Description=Leucine Rich Repeat
  Pfam annotation: Domain name=LRR_1; Domain location=442-460; Score =4.7; E_value=38; Accession=PF00560.23; Description=Leucine Rich Repeat
  Pfam annotation: Domain name=LRR_1; Domain location=71-93; Score =13.7; E_value=0.66; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1; Domain location=1-33::154-176::220-242::244-266::268-289::291 -314::316-338::340-361:...
  Pfam module annotation: Domain location=:365-387::389-412::414 -437::442-460::71-93
MKHNLVFNPVKSEKLVHWNQSGDCCQWNGVTCNELGRVIGLDLSEEFITEGLDNSSLTFLPSAISFGLLKNLRYLNLSNAGFEGQIPIEIALLTKQATLDLSTSFNLLHSLKLEKPNIGMLMQNLTEITELYLDGVMASATGKEWSHALSSMQKLQILSESSCNLSGTIDSSLSKLVSHNCALTDVFPKGIFQMQKLKILDVSYNQDPHGSLPNFPQEGYLQTLSLSNTNISGQLPSTISDLKHLAIVDLYGCQFNGTLPVSLSKLSQLFHMDLSFNNFSGPLPSLNMSNNLKYLSLFQNALTGPITSTQWEKLLNLISINFGDNSFSGKFPSTLFTLPSLQELILSHNGFDGVLDEFPKVSFSNLQSVDLSNDKLQGPIPKSFLHLKNLGYLLLSSNQFNGTIWLDMFHRMQYLQTLGLSHNNLTVDITSSGDHGLSAFPNMTNLLLADCNLRKFPSFL

SEQ ID NO: 195560 - protein, 419 aa, Glycine max
  Coding DNA Sequence Number=SeqID_78782
  Gene Ontology: Mol. function=RNA-directed DNA polymerase activity; Cellular component=chromatin; Biological process=chromatin assembly or disassembly
  Pfam annotation: Domain name=zf-H2C2; Domain location=227-268; Score =15.7; E_value=0.003; Accession=PF09337.1; Description=His(2)-Cys(2) zinc finger
MAAPFTHLLTKEHLEWSKEAQFAFQQLKVAVNTLPVLLLSDFSSPFMVETGALGTGMGAILSQDDHPIAFFNKPLCIKLLHASTYVQELYAIIIAIKKWRQYLLGHSFVILMDHGSLKELMAQLMPTPEQQKYLLHLMGYDFTIQYRSSRTIVVADVLLRIPEFSSGIDIKREISKHLEFISLQKELRDITVAYLDHTLSEDLILQKGRIWLPSDLKFIPLLLQEFHSSPTGGHMGITKTLARLQENFTWQTIRKGVHQFVTHCCDCQHTKNEPAKLLEPFLISARSWEDLSLDFIVRLPSYKGNTAILVMVDKFPKLLNRIIEQYLWSFVHSKPSTWGKLLSWIEWSYNTSKNASMGVSPFEVTFGRKPPVVPHYIVKTLNLDVTKTLLTNRDKEFERLRRKLLKSQERMKYFTDLTR

SEQ ID NO: 195561 - protein, 89 aa, Glycine max
  Coding DNA Sequence Number=SeqID_78783
MESTTTLTPNSMILSETTELAILKIEIAASIDREEKEAERGKRKRQSEGKRRQGRGRGRGKRKRQREGKRKCALSEERERESHNRMKGI

SEQ ID NO: 195562 - protein, 554 aa, Glycine max
  Coding DNA Sequence Number=SeqID_78784
  Homolog annotation: Hit_ID=Q6EP64; Match level="QueryCoverage=52%, HitCoverage=35%, E-value=3e-29, Identity=33%"; Hit description =Hydroxyproline-rich glycoprotein family protein-like
NLNNRESVEPRWRPGTLGRGARGGRGNFSPHNASHDAAGSKNSGTGKDNGTPQATEKVVPPLSASQEKISKEKSSGTSSVPINANGPTSVTSGTTSGTSPSPSSAGTGDRLGPSSCDINNLNSALPSDSSNKVATVASGSGSMLSSSNHPASGPASSSAAHFSSSDPVLVPSDDLWFPGAVGAVGAIRCEVGNLHPPGELRAVSSAENKLTAASETGSSSVQGKIQGKSQGAAKNHVTEMSSTSTVTHSSPSTSRPSSNYSSRSQQLVGPQKAGSNKEWKPKPTNTINQGSGPASASEVLVSVDSTGQLQSASSALNSEEATSKLQRKLEDFHLPQRQHVILPNHIIVPDSEKNKFSFGSLGVALGVNTSYVSGPESEKSSTPVSETSQTVEETVEEQDSSQNAAVISEVGDYPDHPQSPTNGAENLSSSEVDGSSSAIQEHNESKQDTALPSGGHQYSGVLTSPNYSFGFVPPVLGTQLTQFDNSESQTRDASRLPSFIVHQQLDPASYYAQFYRTGADSDGRLSPFSSAGANTKYNGNVTVLPAPTSQSPQE

SEQ ID NO: 195563 - protein, 37 aa, Glycine max
  Coding DNA Sequence Number=SeqID_78785
MNNLSQYKLLRDAAGNGSANDAAPIDSGKNRGCKRGI

SEQ ID NO: 195564 - protein, 463 aa, Glycine max
  Coding DNA Sequence Number=SeqID_78786
  Gene Ontology: Mol. function=RNA-directed DNA polymerase activity; Cellular component=chromatin; Biological process=chromatin assembly or disassembly
  Pfam annotation: Domain name=RVP_2; Domain location=284-408; Score= -54.7; E_value=0.018; Accession=PF08284.2; Description=Retroviral aspartyl protease
  Subcellular localization annotation: CTP_CleavageSite=70; ConfidenceScore=5.15e-01
MADSTRFKSTLDRLEDAIAKLTSSQLNLTVNQTTMSTKLNDLTQKMSFLETNQPSPSSSSANPTFSPPSSAPYRMKLKVPQFDGSDPLGWIFMITQFFNYHVTTDSERLTILSFYMDGPALAWPLFTHKGTVIDYLTEFEALANRIIGLPPPFLLSYFISGLSPDIRREIQALQPLKLLHATALARLQEEKLLDLCRFFRGHTSSQGLFAPRLPRQALSSSLLPPPPLLPTPPKSTIPYKRFLLEELAMQREKGFFLLIADEDEPPPGDYAPSEDHNLEPELDDPSRAQISFHVILGHVAPDTLWLVGRITNQKVLILIDGGSTHNFTQERLFEALGLRTQPTYSLRFTVGNGNELDCLHFCGNVSIHVHGHVFTIDFHILPLRGEDLILGIQWLKSLGPILMNYSDLTMRFFTKAGLFNYRAPMTGTSTLSTLICFNEWSRQIAQALSSIFESQSSLQTKLH

SEQ ID NO: 195565 - protein, 69 aa, Glycine max
  Coding DNA Sequence Number=SeqID_78787
MILEPGCVEIVEILIPGGRIRFVCMFVLSIVNMVGVLGILCAVLLASGLEGLGWLVGKDFLVPPVLPVK

SEQ ID NO: 195566 - protein, 152 aa, Glycine max
  Coding DNA Sequence Number=SeqID_78788
  Homolog annotation: Hit_ID=Q1SLU2; Match level="QueryCoverage=66%, HitCoverage=9%, E-value=8e-10, Identity=30%"; Hit description =Leucine-rich repeat, plant specific
MIGREAENHEKYGTLLFDMFDNLENMRYNNLLSVINKFLVTKLYKLLATEPYSVADHMFAYYITNNEFGGRYLDSVTVVNKALQMNFIKIPTIFTSMDLSSYHFEGPKSQEVRWGLFYWQHVDDLLYMLVPQFGFVYEQHRGQRYRALRWIV

SEQ ID NO: 195567 - protein, 71 aa, Glycine max
  Coding DNA Sequence Number=SeqID_78789
  Subcellular localization annotation: CTP_CleavageSite=64; ConfidenceScore=5.12e-01
MPLMEKIQGLQAPHGATSHGTPKIILLKMSQRMKNSASRAYLSSSNPKTPVEEYESDTPSPIVRPMGVKRE

SEQ ID NO: 195568 - protein, 192 aa, Glycine max
  Coding DNA Sequence Number=SeqID_78790
  Gene Ontology: Mol. function=ribonuclease activity; Cellular component=cytoplasm; Biological process=carbohydrate metabolic process
  Homolog annotation: Hit_ID=Q8GZQ4; Match level="QueryCoverage=98%, HitCoverage=19%, E-value=2e-70, Identity=69%"; Hit description =Endoribonuclease
MAQSNKRFVYEEVKKAIERDRSMVKVSELSRHGLMEITRKRVRPSVTFMVSEPCACCHATGRVEALETSFSKIEQQICRLLATMDQKADPEKPKSWPKFILRVDHRMCEYLTSGKKTRLATLSSSLKVWILLKVARGFIRGSLEVKLFTDDKVEKNQHKVAISMLRSSETRTKKPGQNVTLVQVKKSKARGK

SEQ ID NO: 195569 - protein, 94 aa, Glycine max
  Coding DNA Sequence Number=SeqID_78791
MKGLLHNCWGGVTRMKHHFAGTKENDWVTASRKTRPGFGAQPACARITQFMNSKQFIWDSCDSSPNSSTKTIQDSQHDLYRQLLELNQIKCIVL

SEQ ID NO: 195570 - protein, 211 aa, Glycine max
  Coding DNA Sequence Number=SeqID_78792
  Gene Ontology: Mol. function=protein binding
  Homolog annotation: Hit_ID=Q1SLU2; Match level="QueryCoverage=80%, HitCoverage=17%, E-value=1e-38, Identity=48%"; Hit description =Leucine-rich repeat, plant specific
  Pfam annotation: Domain name=LRRNT_2; Domain location=31-73; Score =26.0; E_value=0.00013; Accession=PF08263.3; Description=Leucine rich repeat N-terminal domain
MRIHQIFFNIFILLCLINLNINIDVATCHCLDHPQFMLLHLKDNLVFNPATSKKLVHWNHSGNCCQWNGVTCSMGHVIGLDLSEEFISGGLNNSSLFKLKYLQNLNPAYNDFNSSIPLEFDKLKSLRFLLRKNLTTLDLSTSASQHFLRLQNPNIGMFLQNLTKLTKLYLNGVRVSAEGKKWCHALSSLQKLKVLNMSLKEKGCSKTYFVK

SEQ ID NO: 195571 - protein, 134 aa, Glycine max
  Coding DNA Sequence Number=SeqID_78793
MKKKKKKKTQLLVLGESVMLWWVSDSVKVERVHNSKQSERENEFKLDKARHGNETRTRRYPLKFVPILTENTRVDRDLSRGREYPIPNGYGDKVQVYVESRGLRRQYLSPPPAPLSLGVKMSKSSQALLGLSSA

SEQ ID NO: 195572 - protein, 40 aa, Glycine max
  Coding DNA Sequence Number=SeqID_78794
MAMLEPPAPTDVDMPQHAVETLPCNSKKVGTLDQHEGSYY

SEQ ID NO: 195573 - protein, 424 aa, Glycine max
  Coding DNA Sequence Number=SeqID_78795
  Gene Ontology: Mol. function=metal ion binding; Cellular component =intracellular
  Homolog annotation: Hit_ID=Q9LUA9; Match level="QueryCoverage=98%, HitCoverage=100%, E-value=3e-92, Identity=46%"; Hit description=Zinc finger protein CONSTANS-LIKE 10
  Pfam annotation: Domain name=CCT; Domain location=373-411; Score =73.1; E_value=9e-19; Accession=PF06203.4; Description=CCT motif
  Pfam annotation: Domain name=zf-B_box; Domain location=3-50; Score =45.3; E_value=2e-10; Accession=PF00643.14; Description=B-box zinc finger
  Pfam module annotation: Pfam domain module=CCT::zf-B_box; Domain location=373-411::3-50
SLKMGYLCDFCGDQRSLVYCRSDSACLCLSCDRNVHSANALSRRHSRTLVCERCNSQPAFVRSVEEKISLCQNCDWLGHGTSPSSSMHKRQSINCYSGCPSAAEFSSIWSFFLDIPSLGEACEQELGLMSINENIPPEGQNVSGSTEVTDLPSKGKSWAGTPSIPESSSEPRILDQPPGPANECVPKLYCPGKKASGICEDDDLYDDFIMDEVDLELENYEELFGMALSHSEELFENGGINSLFEAKDMSASAGDSHCQGAVAAEEDGEVGFMDHMMSFDPGSSAGLVNPIQPACSNAASADSVMSTKTEPIVCFTARQSQSNISFSGVTKDSAGDYQDCGASSMLLMGEPPWCPPCPESSLHSANRSNAVMRYKEKKKTRKFEKKVRYASRKARADVRKRVKGRFVKAGDVYDYDPLNQTRSY

SEQ ID NO: 195574 - protein, 180 aa, Glycine max
  Coding DNA Sequence Number=SeqID_78796
  Gene Ontology: Mol. function=DNA binding; Cellular component =nucleosome; Biological process=chromosome organization and biogenesis (sensu Eukaryota)
  Homolog annotation: Hit_ID=P84040; Match level="QueryCoverage=47%, HitCoverage=84%, E-value=3e-41, Identity=97%"; Hit description =Histone H4
  Pfam annotation: Domain name=CBFD_NFYB_HMF; Domain location=105-168; Score=5.0; E_value=0.053; Accession=PF00808.13; Description=Histone -like transcription factor (CBFNF-Y) and archaeal histone
  Pfam annotation: Domain name=Histone; Domain location=102-171; Score =67.1; E_value=5.7e-17; Accession=PF00125.14; Description=Core histone H2AH2BH3H4
  Pfam annotation: Domain name=TAF; Domain location=105-169; Score= -6.7; E_value=0.023; Accession=PF02969.8; Description=TATA box binding protein associated factor (TAF)
  Pfam module annotation: Pfam domain module=CBFD_NFYB_HMF::Histone::TAF ; Domain location=105-168::102-171::105-169
MFHNAPDTSPRIAHTSRRLTTPPPPPPPPNGHDESNKPTLDSYPAVFPARNKYPIPIIKLKITIPNSPKFSLKKKQQCLVAEKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 195575 - protein, 307 aa, Glycine max
  Coding DNA Sequence Number=SeqID_78797
  Homolog annotation: Hit_ID=Q9LUA7; Match level="QueryCoverage=95%, HitCoverage=92%, E-value=4e-91, Identity=57%"; Hit description =Arabidopsis thaliana genomic DNA, chromosome 5, P1 clone:MIF21
  Pfam annotation: Domain name=DUF868; Domain location=29-306; Score =535.8; E_value=4.6e-158; Accession=PF05910.3; Description=Plant protein of unknown function (DUF868)
MMQFHRSLRAQPVPTPIIPEKTTEEPLPSKVAQSTVTCFYQANVVGFWRNVSILWCKHLMNHSLHVTVDSVGGEVQYSCKIDVKPWHFWSKKGYKTFEVDGNQVELYWDLRSAKFAGSPEPSSDYYVALVSDEEVVLLLGDYKKKAYKRTKSRPALVDAMLLVKKENVFAKKSFSTKARFDEKRKDNEIVVDSLTGGPSDPEMWISIDGIVLIHVKNLQWKFRGNQTVMVNKQPVQVFWDVHDWLFSGSGSGPGLFIFKPGPPEAESEKEGSAVEGCESDDGSVGYFSTMNIATFEFCLVLYAYKIE

SEQ ID NO: 195576 - protein, 458 aa, Glycine max
  Coding DNA Sequence Number=SeqID_78798
  Gene Ontology: Mol. function=protein serine/threonine kinase activity; Cellular component=membrane; Biological process=protein amino acid phosphorylation
  Homolog annotation: Hit_ID=Q5YD56; Match level="QueryCoverage=99%, HitCoverage=99%, E-value=1e-166, Identity=67%"; Hit description =Calcium/calmodulin-regulated receptor-like kinase
  Pfam annotation: Domain name=Pkinase; Domain location=133-408; Score =140.2; E_value=5.7e-39; Accession=PF00069.15; Description=Protein kinase domain
  Pfam annotation: Domain name=Pkinase_Tyr; Domain location=133-405; Score=146.8; E_value=5.7e-41; Accession=PF07714.7; Description =Protein tyrosine kinase
  Pfam annotation: Domain name=RIO1; Domain location=146-307; Score= -91.1; E_value=0.029; Accession=PF01163.12; Description=RIO1 family
  Pfam module annotation: Pfam domain module=Pkinase::Pkinase _Tyr::RIO1; Domain location=133-408::133-405::146-307
MKKTPPPNLHQSSKSRQNANLQLVETNNDAKRHNSKTLRSLKYAAKKCVAVFSLIIYGKRKSASYVVGNDDRKNTSKIRGVVSSSTDLSSESTTKNSSKWKFSYSYASSSTASGQLGIGNFSFEEIYKSTAKFSPVNEIGQGGFGTVYKGKLNDGSIVAVKRAKKAVIQNHLHEFKNEIYTLSQIEHRNLVRLYGYLEHGDEKIIVVEYVGNGNLREHLDGIRGEGLEIGERLDIAIDVAHAITYLHMYTDNPIIHRDIKASNILITENLKAKVADFGFARLSDDPNATHISTQVKGTAGYMDPEYLRTYQLTEKSDVYSFGVLLVEMMTGRHPIEPKRPVDERVTIRWAMKMLKQGDAVFAMDPRLRRNSASIKAVKQVLKLALQCIAPSKQSRPPMKNCAEVLWDIRKSFRDEANSDHAPLPSHHSANFPQREKNTFGMEEDDSYKFVSVPNHIRS

SEQ ID NO: 195577 - protein, 143 aa, Glycine max
  Coding DNA Sequence Number=SeqID_78799
  Gene Ontology: Mol. function=oxidoreductase activity; Biological process=metabolic process
  Homolog annotation: Hit_ID=Q6ZHJ6; Match level="QueryCoverage=49%, HitCoverage=27%, E-value=8e-11, Identity=50%"; Hit description =Putative short-chain dehydrogenase/reductase
MDDPLEKQWHISLRIQRYISNQTLKKEEKVGAMTDDVNELQRHETRRGSGAAHRWARIVHRALHRLEVPHVRRHLDPRGEADRVARLLQLLRRPRKNGDVRARDEHVAVLDRDLHGRRRKRTKKAKFASAIGDDAPLKLYQVN

SEQ ID NO: 195578 - protein, 506 aa, Glycine max
  Coding DNA Sequence Number=SeqID_78800
  Gene Ontology: Mol. function=binding; Cellular component =intracellular; Biological process=protein amino acid phosphorylation
  Homolog annotation: Hit_ID=Q6K2P5; Match level="QueryCoverage=99%, HitCoverage=80%, E-value=7e-88, Identity=31%"; Hit description =Putative pentatricopeptide (PPR) repeat-containing protein
  Pfam annotation: Domain name=PPR; Domain location=125-159; Score =10.5; E_value=0.42; Accession=PF01535.11; Description=PPR repeat
  Pfam annotation: Domain name=PPR; Domain location=160-194; Score=6.8; E_value=1.2; Accession=PF01535.11; Description=PPR repeat
  Pfam annotation: Domain name=PPR; Domain location=223-257; Score =36.3; E_value=1.1e-07; Accession=PF01535.11; Description=PPR repeat
  Pfam annotation: Domain name=PPR; Domain location=259-293; Score=0.8; E_value=5.9; Accession=PF01535.11; Description=PPR repeat
  Pfam annotation: Domain name=PPR; Domain location=26-60; Score=15.9; E_value=0.099; Accession=PF01535.11; Description=PPR repeat
  Pfam annotation: Domain name=PPR; Domain location=325-359; Score =43.4; E_value=7.9e-10; Accession=PF01535.11; Description=PPR repeat
  Pfam annotation: Domain name=PPR; Domain location=391-424; Score =12.6; E_value=0.24; Accession=PF01535.11; Description=PPR repeat
  Pfam annotation: Domain name=PPR; Domain location=90-124; Score=40.0; E_value=8.4e-09; Accession=PF01535.11; Description=PPR repeat
  Pfam module annotation: Pfam domain module=PPR::PPR::PPR::PPR::PPR::PP R::PPR::PPR; Domain location=125-159::160-194::223-257::259-293::26 -60::325-359::391-424::90-124
MGIYAKYGCIELARKLFDEMPDRTAADWNVIISGYWKCGNEKEATRLFCMMGESEKNVITWTTMVTGHAKMRNLETARMYFDEMPERRVASWNAMLSGYAQSGAAQETVRLFDDMLSSGNEPDETTWVTVLSSCSSLGDPCLAESIVRKLDRMNFRSNYFVKTALLDMHAKCGNLEVAQKIFEQLGVYKNSVTWNAMISAYARVGDLSLARDLFNKMPERNTVSWNSMIAGYAQNGESLKAIQLFKEMISSKDSKPDEVTMVSVFSACGHLGRLGLGNWAVSILHENHIKLSISGYNSLIFMYLRCGSMEDARITFQEMATKDLVSYNTLISGLAAHGHGTESIKLMSKMKEDGIGPDRITYIGVLTACSHAGLLEEGWKVFESIKVPDVDHYACMIDMLGRVGKLEEAVKLIQSMPMEPHAGIYGSLLNATSIHKQVELGELAAAKLFKVEPHNSGNYVLLSNIYALAGRWKDVDKTKDLSASDGDSQCQGAVAAEELKSHHPFL

SEQ ID NO: 195579 - protein, 169 aa, Glycine max
  Coding DNA Sequence Number=SeqID_78801
MSSPSASRTPLPISPKTEFVSMIVEGGVILVLVKQLQVPPLTLSKTRECFRTWASHCLGRWGCFDNLMLMVGRHGRFGVGKVAPVRGPESPGSVTHATEREEVGGEVQHKCCLMLAKERIQDHNDTRRTIDTNHHRFHMAEVEKKKSHQKLLPLWWKTHMVRSDHKTQI

SEQ ID NO: 195580 - protein, 196 aa, Glycine max
  Coding DNA Sequence Number=SeqID_78802
  Gene Ontology: Mol. function=catalytic activity; Cellular component =mitochondrion
  Homolog annotation: Hit_ID=Q9ZW37; Match level="QueryCoverage=80%, HitCoverage=99%, E-value=1e-48, Identity=62%"; Hit description =Expressed protein
  Pfam annotation: Domain name=4HBT; Domain location=105-179; Score =29.8; E_value=9.8e-06; Accession=PF03061.12; Description =Thioesterase superfamily
MAAPSNTQEVKQYSNQQQATPIDRLRLGGLEKGKTKRMEKVREMLRLTQQESVAMSRLNSVPSLRAGDNSSFYEHFILSGIRVDRVQPGLVSCTFKVPSRLADRSGKLASGAIANLVDEVGGAVIHEEGLPMNVSVDMSISFLSSVRVGDELEITSRLLGRKGGYSGTIVLLKNKATGELIAEGRHSLFGRHNSKM

SEQ ID NO: 195581 - protein, 435 aa, Glycine max
  Coding DNA Sequence Number=SeqID_78803
  Gene Ontology: Mol. function=transporter activity; Cellular component= integral to membrane; Biological process=transport
  Homolog annotation: Hit_ID=Q8W0H5; Match level="QueryCoverage=80%, HitCoverage=67%, E-value=1e-131, Identity=64%"; Hit description =Putative glutamate transporter
  Pfam annotation: Domain name=MFS_1; Domain location=1-317; Score =61.5; E_value=2.8e-15; Accession=PF07690.6; Description=Major Facilitator Superfamily
  Subcellular localization annotation: CTP_CleavageSite=30; ConfidenceScore=5.23e-01
MAWGVALWSLATFLTPWASQTSLLALLAVRALLGIAEGVALPSMNNMVARWFPQTERSRAVGISMAGFQLGCAIGLTLSPILMSQGGIFGPFVIFGLSGFLWVLVWLSATSSTPDRSPQISKYELEYISNRRHKSFSVETAKPKKVKVIPPFRRLLSKRPTWSLIIANSMHSWGFFTVLSWMPIYFSSVYRVDLRHAAWFSAVPWAVMAVTGYFAGLWSDMMIQSGTSVTLTRKIMQSIGFIGPGLCLIGLATAKNPSIGSAWLTLAFGLKSFSHSGFLVNLQEIAPQYSGVLHGISNTAGTLAAIFGTVGAGLFVELVGSFPGFLLLTSLLYFLAAIFYCLFATGERVNFDDPVNVGLLLICKLLMRCVSNSLNSCLRVLETTYCTVQFNFLYMKGVKEIAEECQRWLCVLTVMLVKCKTETNHLPSVKSFIDV

SEQ ID NO: 195582 - protein, 112 aa, Glycine max
  Coding DNA Sequence Number=SeqID_78804
  Subcellular localization annotation: CTP_CleavageSite=25; ConfidenceScore=5.04e-01
GLAYPNDLLRTHGVIIPRFSGKYCSSGSRGSTTECLADCFAQPKTKLAAPSRTARLTPRDTDDPLLQETRSELAERRSGAVVGGHVELYPSVKGGVVATYHAVEVLASAEDL

SEQ ID NO: 195583 - protein, 510 aa, Glycine max
  Coding DNA Sequence Number=SeqID_78805
  Pfam annotation: Domain name=HPC2; Domain location=56-505; Score= -191.0; E_value=0.087; Accession=PF08729.1; Description=Histone promoter control 2 (HPC2)
  Pfam annotation: Domain name=SPT2; Domain location=389-501; Score =66.0; E_value=1.2e-16; Accession=PF08243.2; Description=SPT2 chromatin protein
  Pfam module annotation: Pfam domain module=HPC2::SPT2; Domain location=56-505::389-501
MRGYGDEGDGYDDYYEDEDEYEEEAEEEYEEEEEAPRKPSKEEMEYLELRQKLKESIRKQMKKESSGSGTSRRDSTDRSKNKLPYDNYGSFFGPSQPVIAQRVIQESKSLLENQHLASRFSDPHRIKKNQNKVPSGGSKSSSHNLAPKVSEMKVKAQKIKNTRDYSFLLSDDAELPAPSKAPPSQNMPIRNSGNLYRIFADVEEGRPAQVPARNKLPLSNGGKHVRASHEERNVGSAAGHLPPKSGSSYRTSSTSKPSMASADSRKQPGNNSGNGPGRPVGPKGLPSKISVGTTGNKSSTPAIKNPVNGMQKSLPSKNHPSIPKQIVEQRISKHSVEQRIPKQSVEQRFPKQSVEQRIQKQSVEQRIQKQSVEQRKDIRELYRPKMAPKQPVASSKPQINRPLKQNSVHTASQDRRPKPKAAKRPFDDEEDEVDVRNMIRNMFNYNPNKFVDDDDVDDMEAGFDEILREEKRSEMIAKKEDEEQLRLIEEEEERERRRKMAKLKKRKLGY

SEQ ID NO: 195584 - protein, 173 aa, Glycine max
  Coding DNA Sequence Number=SeqID_78806
  Gene Ontology: Mol. function=nucleic acid binding; Biological process= DNA integration
  Homolog annotation: Hit_ID=Q1SS72; Match level="QueryCoverage=55%, HitCoverage=6%, E-value=2e-20, Identity=47%"; Hit description =Integrase, catalytic region
MGPSYGHTFFDNFNSIVELLILIIYHFHCSFISSHGRAYLQHGIRALPVKISVVHSLSFSFFLQLHSFVISETTLSNTESFLYLHPSENLAIALVSPILDSTNYHSWSRSMITALSAKNKVEFEDGSTSKPLKTDRTYGAWRRCNNMVISWIFHSVAISIRQSILWMDKAEEI

SEQ ID NO: 195585 - protein, 120 aa, Glycine max
  Coding DNA Sequence Number=SeqID_78807
  Homolog annotation: Hit_ID=O22613; Match level="QueryCoverage=24%, HitCoverage=3%, E-value=7e-07, Identity=83%"; Hit description=Plasma membrane proton ATPase
MAFLNTVGNGLSKDYKAQKGFKFEPMSFLRDQGFEVFRIYVESSFMGHGSCNNHGHCFGGNPKINYADIGDKSVLQPWYDFLIESDFDHGDEVSFYYQRHKKIWEIVIRRQKDWGDSDTD

SEQ ID NO: 195586 - protein, 91 aa, Glycine max
  Coding DNA Sequence Number=SeqID_78808
MKVILWMNALLEPKLLNPKKTLNCWQPNPITNLSLYTSPIYGEKRLSFELQNVAVGLSSAFGLSAYPPLSAASARLAQRRIWQSINIKATR

SEQ ID NO: 195587 - protein, 91 aa, Glycine max
  Coding DNA Sequence Number=SeqID_78809
MTKKHETTLVSQYVNLSQLVSFLVHFEELESPWMTTIETKWGGVVAVPMNKLLSACELQRVLSFAISAHESNPRYEALKHLLTVINTVLLG

SEQ ID NO: 195588 - protein, 385 aa, Glycine max
  Coding DNA Sequence Number=SeqID_78810
  Gene Ontology: Mol. function=transcription factor activity; Cellular component=nucleus; Biological process=regulation of transcription, DNA-dependent
  Homolog annotation: Hit_ID=Q1SDP0; Match level="QueryCoverage=98%, HitCoverage=79%, E-value=1e-113, Identity=60%"; Hit description =Pathogenesis-related transcriptional factor and ERF
  Pfam annotation: Domain name=AP2; Domain location=135-198; Score =100.8; E_value=4.1e-27; Accession=PF00847.10; Description=AP2 domain
  Pfam annotation: Domain name=AP2; Domain location=227-291; Score =70.8; E_value=4.4e-18; Accession=PF00847.10; Description=AP2 domain
  Pfam module annotation: Pfam domain module=AP2::AP2; Domain location =135-198::227-291
MLDLNLNAESTQNNESLVLLDKFPEASLGTSNSSVVNAEGSSNEDSCSTRAGDVFAFSFGILKVEGANEVVATATKELFPVSSENWQGQSSTSSSQARKNLMDLPLDHQNGEVKVVQVQPQPQVKKSRRGPRSRSSQYRGVTFYRRTGRWESHIWDCGKQVYLGGFDTAHIAARAYDRAAIKFRGLDADINFDLVDYEEDLKQMKNLSKQEFVHILRRHSTGFSRGSSKYRGVTLHKCGRWEARMGQFLGKKYIYLGLFDSEVEAARAYDKAAIKCNRREAVTNFEPSIYESEMKPEAINEGGSHDLDLNLGIATPGHGPKENRGHLQFQSIPYNMHPGRSSRMETNVNSVIGDPSLKRLVVTEERPSVYSTFFPNLVSSNACYN

SEQ ID NO: 195589 - protein, 110 aa, Glycine max
  Coding DNA Sequence Number=SeqID_78811
MVMPDKFPATGKREGGGRREGNSQKEVCEGSFARFGSCICYFLGDDFRTRENINIGHYRIPWHQRERERESSCGLIDGNSRPPLTAEFLVIGSNKGVFGSNDHIQIFCTE

SEQ ID NO: 195590 - protein, 36 aa, Glycine max
  Coding DNA Sequence Number=SeqID_78812
MTCTERPFRNVVLHSGYSGSLKGMYKATLKVWKATS

SEQ ID NO: 195591 - protein, 1045 aa, Glycine max
  Coding DNA Sequence Number=SeqID_78813
  Gene Ontology: Mol. function=nucleic acid binding
  Homolog annotation: Hit_ID=Q1SDP2; Match level="QueryCoverage=95%, HitCoverage=85%, E-value=0.0, Identity=54%"; Hit description=RNA -binding region RNP-1 (RNA recognition motif); Aldehyde dehydrogenase
MAEKDDTEGRCPACRSPYDKEKIVGMAANCERLVAEVHMEKKMKNQKAKSKSSEARKQLSSVRVIQRNLVYIVGLPLNLADEDLLQQREYFGQYGKVLKVSMSRTTAGVVQQFPNNTSRLYVISEFSCDFFALSECCPLSVCVVLGVYGTLSKSLQTFNLSLGVGIGQLDWGIDLDDQPCSNPDCLYLHGIGSHEDSFTKDEIVSAYTSRVQQITGAAYNMQRQSGNVLPPPLDDCTDNSSGKSIVKNSSSTSVSIVRGSPPNGTSGRPIALSAAAAWGIRATNCQPAACGLLCPNGLSKLKPDTISSTLPFSSAVACTIQASLNSDVTKRPLSSDGSHSMTPQVKNELLKPVKQNRSMDILDSAEERTLASEVSLSPMKLNNQVSSLPLAGYSDRGSFTATNTTNSIDITRQPSSIGPEEAVISTSEEIENFSQELSSVHIDRNSQNKQHYSLSKTSRSPDNVLVKSMQSQESQYNTDKFKDVLIKNADSKAAALENEVCNLKQQCDLSLDSQSQSQVVSANIEVEDDVTTFDNQILKDPEVVGSYLPESASFLNVSNHSSPHLLHCGEPCNVVNAGSLDANDKIKDNSLLHAHNFCNEYSDKLISTSSYWFLHDARNEQRIGRLVSDAVNIGSDAAMDKGESSIISNILSMESDAWDDSLTSHESLAKLLGDNTDNQNGPLKKSSSWKVQSNNQSRFSFARQEESKFQANVHPSSGANQQFPKNGSLIQDFVERDFSLDKLGFANGIPSNNLEESGNLGSGHFIASNNKLSAVSRAQISAPPGFSVPNRAPPPGFSSLERMGQAFDSLSGNSLLDPSFLLRNSYQTPSNGNIGDPGDIEFMDPAILAVVKGRIQGAQNSPVLDMRSNYPEQLNYFENEARVQLLMQRSLSPHQNLRFSEIGNSFSQFGDSYGISSRLNQSQVSNLASFPQLSLQQSRNAILSNGQLDGWNEVPSGNGLGHLGFEIVGYIGHGKAKSEIYKQNFSALSKVMGLAHDITCLLGYEMMKLSRRAIAAAVLDLRKQTALRFKKSIMDLKVVYLAGRC

SEQ ID NO: 195592 - protein, 853 aa, Glycine max
  Coding DNA Sequence Number=SeqID_78814
  Gene Ontology: Mol. function=nucleic acid binding; Cellular component= chromatin; Biological process=DNA integration
  Homolog annotation: Hit_ID=Q1RWN2; Match level="QueryCoverage=99%, HitCoverage=99%, E-value=1e-119, Identity=45%"; Hit description =Peptidase S8 and S53, subtilisin, kexin, sedolisin; Integrase, catalytic region; Zinc finger, CCHC-type
  Pfam annotation: Domain name=zf-CCHC; Domain location=250-267; Score =22.3; E_value=0.0002; Accession=PF00098.13; Description=Zinc knuckle
  Pfam module annotation: Pfam domain module=RVT_2::zf-CCHC; Domain location=564-717::250-267
MATEGAFVQPAMPRFDGHYSHWKMIMENFPRSKEYWVVVENGVSATAKGVIMFEAQKKTYEEQKLKDLKAKNYLFQALDRSILETIIKKDTSKSIWYSMKQKYEGTNRVKHAHLQALRKEFETAHMKEGESVNEYLARVLVISNKMKANGEDVKDIVVVEKVLRSMTPKFNYVVCSIEESKETSMLSIDELQRSLLVHEQRMSNTIHEEHALKVAHGSQYASPTRRGRGCWNFGGRGCGQSRQNVDKATVECYNCHKLGHFQWECKKWVSNFTESQAESEEHMLLMAYIEEKKQQKTYVWFLDSGCSNHMCGKKEYFSELDENFSNSMKLGNNSNMVVNGKGNIRLDVNGVISIISGVFYVPELKNNLLSLGQLQEKGLSILFQQGQCKIYHPNKGLIMKSNMSSNRMFILHAISFPVAPTCFNTVMEDVAQLWHCSMLSEKKVPKTLWLKAVNWVVHVLNRSPMLAVKDTTLEEVWSGIKPSVQHFNVFGCVSYAHVLDNLRSKLDKKSLSRKQPAWLRDYVFGEGLSEEEAAFYLAFFALYTVGVDPLNFEEVVQIENWRNAMDAEISFYSAFFTLYTAGADPLNFEEVVYKTKLNEKGEVDKVKARLVVKGYAQQYGVDYTEVFAPVARMEIVWLVIAFTVERGWAIHQLDVKSTFLHGELAEDVFVEQPCGYVQKGNEEKNSMMFEFDMTDLGKMKYFLGLENNSVQTPIVPGFKICKDEGRKHVDKMCFMQMVSGASHSAPSTPSKEGTGGGSDKLIAYSDSDYARDVDDKKSTTGNVFLFGSAAISWCSKKQPIQEFITIQCDSSSAIKLSRNPIMHGRSKHIDPLKKDVFLKLRTMLGVCAKNDVN

SEQ ID NO: 195593 - protein, 400 aa, Glycine max
  Coding DNA Sequence Number=SeqID_78815
  Gene Ontology: Mol. function=RNA-directed DNA polymerase activity; Biological process=RNA-dependent DNA replication
  Homolog annotation: Hit_ID=Q1S7B8; Match level="QueryCoverage=84%, HitCoverage=64%, E-value=7e-28, Identity=23%"; Hit description=RNA -directed DNA polymerase
HWDRPNLDGVAFEKISSDDNDMLLGSFGKEEIVEAIWDCRSSKSLNPDGINVSFIALIPKVGDPQGVIDERQSAFLGGRNLLHSALIANEVVEDARKNRKKYFYSLGPPREFKPQKGLRKGDPLAHFLFNIVAEDLSVLIREASLKSLSKGYLVGKLGVETTCAPKNHGGLGVKDIAMFNEALLTKWKWNLFHDRGSLWLVCGGRSDGWFDNILEWRIESGELVRDMGSWSLEGWRLEFKWRKEWFDWELSVVEEFLNVLTNVNIANQGEDHWLEDSSSMYSIKSVYMALYDLRVGSNEIDIFKSLWQIKIPHKVAFLLWRVFYDGIPTKSRRVSTQLYLSRLASISDNVLMVYRVIGGKRVGVQLCGPFGRKEMQCFLNEETLRLNNFGRELCLRCGLG

SEQ ID NO: 195594 - protein, 228 aa, Glycine max
  Coding DNA Sequence Number=SeqID_78816
  Gene Ontology: Mol. function=hydrolase activity, acting on glycosyl bonds; Cellular component=cellular_component; Biological process =carbohydrate metabolic process
  Homolog annotation: Hit_ID=O82019; Match level="QueryCoverage=97%, HitCoverage=71%, E-value=5e-57, Identity=42%"; Hit description =Polygalacturonase precursor
  Pfam annotation: Domain name=Glyco_hydro_28; Domain location=52-228; Score=11.0; E_value=1e-09; Accession=PF00295.8; Description=Glycosyl hydrolases family 28
MSFSWSMTTLALLLLLASYVKVQANLFDIRKYGVVPNLDITMALQKAWTHACASMTTSKIVIPNGKYKLRQIDFMGPCKAPIEVQNFGFGFVNNLIIMDITLKDSKYFHVNIFGCKNITFTNFRVSSTTYNPNTDRIHIGKLTQVKITNSQIGTGDDCISLGDGSKEVTILNVTCGPEHGISVGSLEKYSNEDSVEDLIVKNCTLKNTNNGLRIKTWPSTLITSLASD

SEQ ID NO: 195595 - protein, 573 aa, Glycine max
  Coding DNA Sequence Number=SeqID_78817
  Gene Ontology: Mol. function=transporter activity; Cellular component= integral to membrane; Biological process=oligopeptide transport
  Homolog annotation: Hit_ID=Q9M390; Match level="QueryCoverage=99%, HitCoverage=100%, E-value=0.0, Identity=63%"; Hit description =Peptide transport-like protein
  Pfam annotation: Domain name=MFS_1; Domain location=34-518; Score =23.6; E_value=2.6e-05; Accession=PF07690.6; Description=Major Facilitator Superfamily
  Pfam annotation: Domain name=PTR2; Domain location=96-502; Score =454.1; E_value=1.8e-133; Accession=PF00854.12; Description=POT family
  Pfam module annotation: Pfam domain module=MFS_1::PTR2; Domain location=34-518::96-502
MTEEDVYTKDGTVDYRGNRANKNETGTWRACPFILGNECSERLAYYGMSTNLVTYFNTKLNQSGPTASKNNANWGGTCYITPLIGAFVADAYLGRYRTILYFSIVYVIGMTLLTLSASVPGIKPSCDDQGNCHATEAQSAMCFVALYLIALGTGGIKPCVSSFGADQFDDADEAEKEHKSSFFNWFYLSINIGGLVAASLLVWVQTTVSWGWGFGIPAVAMAIAVVSFLSGTRLYRIQKPGGSPLTRMCQVIVASIRKSKVQVTNDDRSAFYEIEQDSESAIQGSRKLEHTNGLSFFDKAAVIRDSDNVKDPINPWRLCTVTQVEELKAIIRLLPIWATGIIFSTVYSQMGSYFILQGDTMDNRLGSNKKLHISPATLSVFDTISVIFWVLVYDRIIVPVARKFTGRENGLTQLQRMGTGLFISIFAMVYSVILENIRLKMVRRHNYYDLNQVPMSLFLQIPPYFIIGCAEVFTFIGQLEFFYEQAPDAMRSTCSALQLLTVAFGSYLSSLLITIVTKITARNGSPGWLPDKLNYGHLDYFFLLLTVLSVLNFVVFLLVSKLYTYKKPVGNLH

SEQ ID NO: 195596 - protein, 327 aa, Glycine max
  Coding DNA Sequence Number=SeqID_78818
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q9SD73; Match level="QueryCoverage=96%, HitCoverage=52%, E-value=1e-125, Identity=68%"; Hit description=Beta- D-glucan exohydrolase-like protein
  Pfam annotation: Domain name=Glyco_hydro_3_C; Domain location=110 -322; Score=172.6; E_value=9.6e-49; Accession=PF01915.12; Description= Glycosyl hydrolase family 3 C terminal domain
GFVISDWEGIDELCQPYGSDYRHCISTAINAGIDMVMVPFRYEIFVEELMSLVQSGEIPIARIDDAVERILRVKFAAELFEFPLTDRSLLDVVGGKLHRDLAHEAVRKSLVLLKNGKDPSKPFLPLNRNAKRILVAGTHADDIGYQCGGWTGTKYGSSGRITIGTTILDAVKEAVGNETEVIYEQCPSTDIIECSEVSFAVVVVGEGPYAECGGDNSELVIPFNGAGIIDLVADKIPTLVILISGRPLLLEQCLLEKIDALVAAWLPGTEAQGITDVIFGDHDFKGQLPMTWFRRVEQLDQPVGVSSCEPLFPLGYGLTYDKENLHD

SEQ ID NO: 195597 - protein, 530 aa, Glycine max
  Coding DNA Sequence Number=SeqID_78819
  Gene Ontology: Mol. function=oxidoreductase activity; Cellular component=intracellular; Biological process=lignin catabolic process
  Homolog annotation: Hit_ID=P93366; Match level="QueryCoverage=99%, HitCoverage=94%, E-value=0.0, Identity=79%"; Hit description =Diphenol oxidase
  Pfam annotation: Domain name=Copper-bind; Domain location=180-268; Score=-13.4; E_value=0.02; Accession=PF00127.11; Description=Copper binding proteins, plastocyanina
  Pfam annotation: Domain name=Cu-oxidase; Domain location=130-281; Score=229.8; E_value=5.9e-66; Accession=PF00394.12; Description =Multicopper oxidase
  Pfam annotation: Domain name=Cu-oxidase_2; Domain location=379-514; Score=199.8; E_value=6.5e-57; Accession=PF07731.4; Description =Multicopper oxidase
  Pfam annotation: Domain name=Cu-oxidase_3; Domain location=4-120; Score=235.8; E_value=9.3e-68; Accession=PF07732.5; Description =Multicopper oxidase
  Pfam module annotation: Pfam domain module=Copper-bind::Cu -oxidase::Cu-oxidase_2::Cu-oxidase_3; Domain location=180-268::130 -281::379-514::4-120
MYESVVVKNVTRLCSTKPIVTVNGKFPGPTIYAREDDTVLVKVVNHVKYNVSIHWHGVRQLRTGWADGPAYITQCPIQPGQAFVYNFTLTGQRGTLWWHAHILWLRSTVHGALVILPKLGVPYPFPKPHTEKVIILSEWWKSDTEAVINEALKSGLAPNVSDAHTINGHPGSVQNCASQGGYELQVQPGNTYLLRIINAALNEELFFKIAGHQLTVVEVDAVYTKPFKTDTIVIAPGQTTSVLLKANRAAGKYLVAATPFMDSPIAVDNVTATATLHYTGSLGSTITTLTSLPPKNATPVATNFTDSLRSLNSKKYPARVPQKVDHSLFFTISLGVNPCPTCVNGSKVVAAINNVTFVMPKVSLLQAHFFNISGVFIDDFPGKPPVVYDFTGTQQPTNLRTNRGTRVYRLAYNSTVQLVLQDTGMITPENHPLHLHGFNFFVVGRGQGNFNPKKDTKKFNLVDPVERNTVGVPSGGWTAIRFRADNPGVWFMHCHLEIHTTWGLKMAFVVDNGKGPNESLLPPPSDLPKC

SEQ ID NO: 195598 - protein, 1034 aa, Glycine max
  Coding DNA Sequence Number=SeqID_78820
  Homolog annotation: Hit_ID=Q1SD81; Match level="QueryCoverage=13%, HitCoverage=10%, E-value=2e-25, Identity=51%"; Hit description=H+ -transporting two-sector ATPase, alpha/beta subunit, central region; TonB box, N-terminal
MEPTLMETKKGLKARDILLRLLRVLHVSFEISYTSMQRHPFVSGALLVFFILYIFLSFIYNLLVFLSPFFVCTAIFVRIFWSSEQNLIKSVNNEEKSNEPKFLPELLRNERRGLLYKCPSHNATSRRRNFTGKKLDVYGGLEIKAKDLSSVFCNEFTKNNKENGRTKFYKEEIGSLEAPIKKVLFAEPSMLDLEAHGASFDGLKKNTEIKEDEKKAQEGGNKGELTEDEQKNKMVLGTCELERHKRLESLIARRRAMKQLKLQIEKGLIDMKSVTPSQIAPLFVSRLNPFDSPREFDGIKMPGSAPTALRSPFDIPYDPFEEKPVLTGDNFDQELKGLLIEPRQEDLEARGHRLAHPRVRRLQGRGNHDKLEQLLLSKEASERELQTSIPSSEVEEKTHEENGKCKNDKMAGNTGKEVDNAQATKSMSYHARVPKPQEEDLNLPISRNSATKINDSLYESLSPNKETMSFTGCRISHTPSRSLASDIHVEVSEVGSPTLTVDENHENTTDGESMIYDGDIDKDVTSGSEDMWGASLHLREVRRVSEQDISELNSWRDISSPLSMQNIDEENAADVSSMSSRSDMPDDTPTYAMNSEHNNNNIFGNMKDFGAPQNSHSSVVSARWKRLMRLMDTRDSHLPHDRHSKKPGEWFDLTENSSKEQVINDWKNSAASEQDNTHNPRGNEEPGASDSVMQPEVTDEVSINSSSSSSPRPVLSITQKTIADQVPSSAFNQETHQDVLQSNMQDVSQETLNGEGPPDSIPQNIPPSMDDPNVESHYSDLSHPQEQTCPLENSIQESNMSSKMNDAEIFNKEDENKFKNDEYIGYKLAPLIIPDASKEPRRQAEMMASVDISEESRERFDGNVPLISLILESSLESPGEEEDEENSQASVRQEATTDTSSDEDFERNRSDLNENEAIVSSCLSIEDSDKLRETDKPKHSSEEVNYLHSESKQVVEDHMEKENLDKGGASEDSPLPITTQATNSEDKEGECDKINKNEATDQELNENETMAMSEPAGETDQIAHMKYPEERTPT

SEQ ID NO: 195599 - protein, 371 aa, Glycine max
  Coding DNA Sequence Number=SeqID_78821
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q9SD73; Match level="QueryCoverage=53%, HitCoverage=45%, E-value=2e-37, Identity=68%"; Hit description=Beta -D-glucan exohydrolase-like protein
  Pfam annotation: Domain name=Glyco_hydro_3; Domain location=251-371; Score=-9.1; E_value=1.8e-08; Accession=PF00933.12; Description =Glycosyl hydrolase family 3 N terminal domain
MRKKCKGSFGILKKCWVHLAILRVKLRHPVFAVGRCSEEESQDPGIGEVEVVSAACGGVHGELVLEDEATVVDGNQALQDHGGVVGLLKAVHQDLHSDQGGREPSPEERSVAECFSVGGVEESWPVTPAGPRRRTWRPAGSKVSLYRVPFGRQICMTEERSSLRGTLHLQYMDCLYMNPQESIEARVKHLLSLMTLNEKIGQMTQIERSVATPSAIKHFSIGSVFSAPHNGRFEKVLSSDSADMVDGFQKLALESRLAIPIIYGVDAIHGNNSVYGATIFPHNVGLGATRNNVVACAKHFVGDGGTEKGVNEGNTILSYEDLERIHMAPYVDCIAKGVSTIMVSYSSWNGNKLHGHHFLLNEILKEKLGFK

SEQ ID NO: 195600 - protein, 142 aa, Glycine max
  Coding DNA Sequence Number=SeqID_78822
MIANISTQGACIESWRGAAVEEFDLEKEEWMNSMQSSTAAVLWESTEDPADFDLVKEDEPRCKNLFGEIKRRAFVTLSARSFTSSMGEVSDCQGILNMQLFTCPFLVDFLLEFCLKDKPGETWEVGSRVVREVGTVRRFSCE

SEQ ID NO: 195601 - protein, 421 aa, Glycine max
  Coding DNA Sequence Number=SeqID_78823
  Gene Ontology: Mol. function=nucleic acid binding; Cellular component= integral to membrane; Biological process=protein amino acid autophosphorylation
  Homolog annotation: Hit_ID=Q9FNZ2; Match level="QueryCoverage=96%, HitCoverage=93%, E-value=1e-121, Identity=52%"; Hit description =Zfwd1 protein
  Pfam annotation: Domain name=WD40; Domain location=124-162; Score =31.8; E_value=2.4e-06; Accession=PF00400.22; Description=WD domain, G-beta repeat
  Pfam annotation: Domain name=WD40; Domain location=203-239; Score =8.9; E_value=3.3; Accession=PF00400.22; Description=WD domain, G -beta repeat
  Pfam annotation: Domain name=WD40; Domain location=248-284; Score =36.7; E_value=8.1e-08; Accession=PF00400.22; Description=WD domain, G-beta repeat
  Pfam annotation: Domain name=WD40; Domain location=288-324; Score =31.9; E_value=2.3e-06; Accession=PF00400.22; Description=WD domain, G-beta repeat
  Pfam annotation: Domain name=WD40; Domain location=331-371; Score =9.6; E_value=2.8; Accession=PF00400.22; Description=WD domain, G -beta repeat
  Pfam annotation: Domain name=zf-CCCH; Domain location=12-36; Score =12.8; E_value=0.027; Accession=PF00642.15; Description=Zinc finger C- x8-C-x5-C-x3-H type (and similar)
  Pfam annotation: Domain name=zf-CCCH; Domain location=93-118; Score =12.9; E_value=0.026; Accession=PF00642.15; Description=Zinc finger C- x8-C-x5-C-x3-H type (and similar)
  Pfam module annotation: Pfam domain module=WD40::WD40::WD40::WD40::WD4 0::zf-CCCH::zf-CCCH; Domain location=124-162::203-239::248-284::288 -324::331-371::12-36::93-118
MDTKFARRTERIGRTTCSYWRAGRCNRNPCRFLHIETPSPPAACGYGNTAYSYGKKPHSSSENTPKYGSKKALLRDNGDRGDATRVAKAFKKSSPRICKYWINNNCVHGEQCLYLHSWFCGDGFSTVTKLQEHKKVITGIALPVGSDKLYSGSTDGTVRIWDCHTGQCAKVINLGAEVTSLISEGSWIFVGLQNAVKAWNIQTMSEFTLDGPKGRVRAMTVGNNTLFAGAEDGVIFAWRGSSKADSPFELVASLTGHTKAVVCLAVGCKMLYSGSMDQSIKVWDMDTLQCTMTLNDHTDVVTSLICWDQYLLSSSSDRTIKVWACIEAGSLEVIYTHTEENGVVSLFGMPDAEGKPILFSSCRDNSVHMYELPSFSERGRLFAKKDVALIELGPGGLFFTGDESGLLMVWKWLEVPKVASS

SEQ ID NO: 195602 - protein, 88 aa, Glycine max
  Coding DNA Sequence Number=SeqID_78824
MPILNLKTLKYAELTKKDRPNPVTVVMPELNRLSELELTLNNDHAFLSCDNTITRPPTRPPTPTRSQYSDSDALWDLAILVRVRTYSS

SEQ ID NO: 195603 - protein, 183 aa, Glycine max
  Coding DNA Sequence Number=SeqID_78825
  Gene Ontology: Mol. function=nucleotide binding; Cellular component =cellular_component; Biological process=biological_process
  Homolog annotation: Hit_ID=O82391; Match level="QueryCoverage=91%, HitCoverage=46%, E-value=5e-63, Identity=65%"; Hit description =Josephin-like protein
  Pfam annotation: Domain name=Josephin; Domain location=5-182; Score =189.5; E_value=8.3e-54; Accession=PF02099.8; Description=Josephin
MATENSQVYHERQRLQFCLVHALNSLFQQKDAFTRAKLNAISERLTLEDSNSETWTPLSVLFKPHHNVLTGNYDINVLIAALEEKGKTVVWHDRRKGASSIDVDAPEDVLMGFVINVAVTRFAGIWRSRHWIALRKIDGVWYNLDSDLTAPQPFFDTDKVREFLDSTLAHGGEVLIVMNEKQS

SEQ ID NO: 195604 - protein, 466 aa, Glycine max
  Coding DNA Sequence Number=SeqID_78826
  Gene Ontology: Mol. function=transferase activity, transferring glycosyl groups; Cellular component=integral to membrane; Biological process=metabolic process
  Homolog annotation: Hit_ID=Q5IFH7; Match level="QueryCoverage=99%, HitCoverage=99%, E-value=1e-171, Identity=63%"; Hit description =Triterpene UDP-glucosyl transferase UGT71G1
  Pfam annotation: Domain name=UDPGT; Domain location=8-466; Score= -82.0; E_value=1.7e-06; Accession=PF00201.9; Description=UDP -glucoronosyl and UDP-glucosyl transferase
MAEMNKKEELIFFSIPGSGHLPSSLELAQLLIKHHNHLSITILCMKLPYAPYSDAYIRSVTASQPQIQAIDLPQVEPPPQELLRSPPHYILTFLQTLKPHVKAIVKNISSSHSNTVVGLVIDVFCAPLIDVANDLGIPSYLYMPSNVGFLNLMFSLQKREVGDAFNDSDPQWLVPGLPDPVPSSVLPDAFFNKQGGYATYYKLAQRFKDSKGIIVNSFSELEQYAIDALCDGQIQTPPIYAVGPLINLKGQPNQNLDQAQHDRILKWLDEQPDSSVVFLCFGSRGSFEPSQTREIALALQHSGVRFLWSMLSPPTKDNEERILPEGFLEWTEGRGMLCEWAPQVEILAHKALVGFVSHCGWNSILESMWFGVPILTWPIYAEQQLNAYRMVREFGLAVELKVDYRRGSDLVMEEEIEKGLKQLMDRDNAVHKKVKQMKEMARKAILNGGSSFISVGELIDVMTGSI

SEQ ID NO: 195605 - protein, 440 aa, Glycine max
  Coding DNA Sequence Number=SeqID_78827
  Gene Ontology: Mol. function=transposase activity; Biological process= transposition, DNA-mediated
  Homolog annotation: Hit_ID=UPI00005459F6; Match level="QueryCoverage =82%, HitCoverage=46%, E-value=1e-46, Identity=31%"; Hit description =PREDICTED: similar to Kruppel-like factor 7 (ubiquitous)
MNVPTRKRRKKNEEGSRSIQKNNTQKKELNSILTSLLFVDAKEKKKEDMLDGYYSEVEESNNPKKRKKLAGAGGNSVSHRRVWVKERSGAWWEECNKPEFPEQEFKKAFRMGRLTFEAICQELNSVIAKEDTTLRTAIPVKQRVAVCLWRLATGDPLSVVSRRFGLGISTCHKLVLEVCTAIKTVLMPKYLQWPNVVTLRDIKGEFENISGIPNVVGSMFTSHVPIIAPKMSVSAYFNKKHTERNHKTSYSVTVQGVVDHRGVFTDVCIGWPGSMGDDQVLEKSSLFHRANNGGINLSGVWVVGGCGYPLLDWVLVPYTQQNLTWTQHSFNEKIGEVRRVAKGAFGRLKGRWGCLQKRTEVKLQDLPLVLGACCVLHNICELKNEEMDHELLKNIDDGDDDYVGEVMEPEVAMRSVSSLKARDAIAHNLLHHGLAGTSFV

SEQ ID NO: 195606 - protein, 312 aa, Glycine max
  Coding DNA Sequence Number=SeqID_78828
  Gene Ontology: Mol. function=transferase activity; Cellular component= endoplasmic reticulum; Biological process=metabolic process
  Homolog annotation: Hit_ID=Q56Y11; Match level="QueryCoverage=80%, HitCoverage=81%, E-value=1e-94, Identity=65%"; Hit description =Dehydrodolichyl diphosphate synthase 2
  Pfam annotation: Domain name=Prenyltransf; Domain location=86-309; Score=346.0; E_value=6.4e-101; Accession=PF01255.10; Description =Putative undecaprenyl diphosphate syntha
MFSLRLPIPLVKTPPSSSSYSPYYLCPFHDPCQTRGLIVSKRGSATAKCHADVTLRHDRVSFAGESPDPFPAELAAEMMPKHVAVIMDGNGRWAKVKGLPPSAGHQAGVQSLRRMVRLCSSWGIKVLTVFAFSTDNWVRPKLEFDFLMRLFETTINSEVQAFKREGIQISVIGDSSKLPESLKRMIVSVEEDTKHNSRLQLIVALSYSGKYDVVQACKSVAKKVKDDHLHLDDINENIIEQELETNCTEFPYPDLLIRTSGELRVSNFLLWQLAYTELYFNQKLWPDFGKDEFVDALSSFQQRKRRYGGRHA

SEQ ID NO: 195607 - protein, 78 aa, Glycine max
  Coding DNA Sequence Number=SeqID_78829
MSNLNAELVVIWKGLTVARERGLLYCCYLGNSNSKLALKLVNDGDPFHTHPLAPNLVNNIQSLVSLYWWHLAYFDVLK

SEQ ID NO: 195608 - protein, 457 aa, Glycine max
  Coding DNA Sequence Number=SeqID_78830
  Gene Ontology: Mol. function=nucleic acid binding; Cellular component= spliceosome; Biological process=mRNA processing
  Homolog annotation: Hit_ID=Q9SD61; Match level="QueryCoverage=76%, HitCoverage=99%, E-value=8e-77, Identity=46%"; Hit description =Putative RNA binding protein
  Pfam annotation: Domain name=RRM_1; Domain location=38-109; Score =103.7; E_value=5.6e-28; Accession=PF00076.12; Description=RNA recognition motif. (a.k.a. RRM, R
  Pfam annotation: Domain name=zf-CCCH; Domain location=131-156; Score =32.3; E_value=1.7e-06; Accession=PF00642.15; Description=Zinc finger C-x8-C-x5-C-x3-H type (and similar)
  Pfam module annotation: Pfam domain module=RRM_1::zf-CCCH; Domain location=38-109::131-156
MNPLTLVKRTQNINAREAALGIGEQASWHTKYKDSAYVFVGGIPFDLTEGDLLAVFAQYGEVVDVNLVRDKGTGKSKGFAFLAYEDQRSTNLAVDNLNGAQVLGRIIRVDHVDKYKKKEEEDEETERQKREARGVCRAFQRGECTRGASCKFSHDEQRAANTGWGREEDKPKWGHDKFEGPKKERRSGNNQSNHIPETRDRDSRTRARNFDAELDNQPKKSDRRETAKRWHDNNDDKFEGRENNSRREENRSRRHEDDDKFEGRENNSRREDKRSRRHEDDDKFEGRENNSKREEKRSRRHGDDEFEHKSREDGYRREEKGSRMDDYDGMELEPKDQRRREDKRSIKPDDVEFEPKSRDSDIREDKKSRRRDDDDFLSKSREPHSNREDMRSRKHGEDESAPKSRENYARKQDDRSYRNDSSRTESKERYDFDRREEKRPRSDAIFSKGSKKRNALA

SEQ ID NO: 195609 - protein, 83 aa, Glycine max
  Coding DNA Sequence Number=SeqID_78831
MSTRPYLGEGLCGDSGKFGHVSGNFLTKVVGWSAEKKEREGNLKVIEREGTPTGKRAVKCPTACTYLSCLSDKRTNTLLMGQF

SEQ ID NO: 195610 - protein, 189 aa, Glycine max
  Coding DNA Sequence Number=SeqID_78832
MARRDKNWSFCTLLSSRGGGPDDMRRQNLVIPHPFAIQTQPCPMARRDKNWSFCTLCHPEAAGPMTCGDKIGHSAPLCHSDTAVSDGAQRQKLVILHPLSSRGGGPDDMRRQNLVIPHPYAIQTQPCPMARRDKNWSFCTLCHPEAAGPMTCRDKIWSVHTPLPFRHSRVRWHAETKFGHSAPFVNRGR

SEQ ID NO: 195611 - protein, 247 aa, Glycine max
  Coding DNA Sequence Number=SeqID_78833
  Gene Ontology: Mol. function=sequence-specific DNA binding; Cellular component=intracellular; Biological process=regulation of transcription, DNA-dependent
  Homolog annotation: Hit_ID=Q8PKE0; Match level="QueryCoverage=92%, HitCoverage=87%, E-value=3e-72, Identity=57%"; Hit description =Transcriptional regulator araC family
  Pfam annotation: Domain name=AraC_binding; Domain location=27-152; Score=11.5; E_value=0.0042; Accession=PF02311.9; Description=AraC -like ligand binding domain
  Pfam annotation: Domain name=Cupin_2; Domain location=25-96; Score =12.8; E_value=0.015; Accession=PF07883.2; Description=Cupin domain
  Pfam annotation: Domain name=HTH_AraC; Domain location=165-212; Score= 14.2; E_value=0.063; Accession=PF00165.13; Description=Bacterial regulatory helix-turn-helix proteins, araC family
  Pfam module annotation: Pfam domain module=AraC_binding::Cupin_2::HTH_ AraC; Domain location=27-152::25-96::165-212
MPVNKRTVTTPDEFDADAFSQAAIALHVSSSGEYAGQSPHAHRKGQLILSLRGAVSCEVEDALWLVPPGHAVWVPGEIPHSCRVTKNAETCFLFIEPGAAAMPETCCALAISPLVRELVLFLAEQEHVYSPDSKTARLAAVLLEHIPDVPVRALHLPVSDHPKIRAMAETLFKYPDDRRTLKEWAVHLATSERSLARLIKNATGLSFGRWRQQLHLMIALSHLAEGQPVQRVAGTLGYDSVSESPRL

SEQ ID NO: 195612 - protein, 109 aa, Glycine max
  Coding DNA Sequence Number=SeqID_78834
  Gene Ontology: Mol. function=transporter activity; Cellular component= integral to membrane; Biological process=transport
  Homolog annotation: Hit_ID=Q5P375; Match level="QueryCoverage=89%, HitCoverage=21%, E-value=8e-18, Identity=45%"; Hit description =Conserved hypothetical transport protein,predicted major facilitator superfamily
MSYTTNKWSSVILVTGILFIAINLRVPFTAVAPVLELIRHDFGLSITAVGLLNSLPLLAFAAFSPLSASVSRMYGLERTLFGALSVISAGILLRSTGSVWALYGGTILI

SEQ ID NO: 195613 - protein, 465 aa, Glycine max
  Coding DNA Sequence Number=SeqID_78835
  Gene Ontology: Mol. function=DNA binding; Cellular component=nucleus
  Homolog annotation: Hit_ID=Q0KIN6; Match level="QueryCoverage=99%, HitCoverage=100%, E-value=1e-150, Identity=56%"; Hit description=WD domain containing protein, putative
  Pfam annotation: Domain name=WD40; Domain location=132-171; Score =13.3; E_value=0.87; Accession=PF00400.22; Description=WD domain, G -beta repeat
  Pfam annotation: Domain name=WD40; Domain location=188-225; Score =7.5; E_value=4.9; Accession=PF00400.22; Description=WD domain, G -beta repeat
  Pfam annotation: Domain name=WD40; Domain location=303-342; Score =11.4; E_value=1.7; Accession=PF00400.22; Description=WD domain, G -beta repeat
  Pfam annotation: Domain name=WD40; Domain location=346-384; Score =19.3; E_value=0.014; Accession=PF00400.22; Description=WD domain, G -beta repeat
  Pfam annotation: Domain name=WD40; Domain location=48-89; Score=8.8; E_value=3.4; Accession=PF00400.22; Description=WD domain, G-beta repeat
  Pfam annotation: Domain name=WD40; Domain location=6-44; Score=36.5; E_value=9.3e-08; Accession=PF00400.22; Description=WD domain, G-beta repeat
  Pfam module annotation: Pfam domain module=WD40::WD40::WD40::WD40::WD4 0::WD40; Domain location=132-171::188-225::303-342::346-384::48-89::6- 44
VLVKSLDLYGKLDGHEGCVNAVEFNSTGDLLVSGSDDRQVMFWNWASKTRLFAYPSGHTDNIFQTKIIPFTDDCRIVTSAGDGQLNIFIMLKEHQMEGLTLAEWTSLIEHGESRFESLPGQVRLGLLWEDGRVDTTMLGKHHGCVYKLAVEPGSAHIFYSSGEDGFIQHFDLRSNSATKLFCCSSSIGNNKQTLSKVGLNSIVIDPRNPYYFAIGGSDEYARVYDIRKCQWGSARNSDRPVNTFCPCHLIGSNNVHITGLAYSSFSELLVSYNDELIYLFEKNVHSDSSPSSATSEDPKNIHEAQVYSGHRNAQTIKGVNFFGPNDEYIMSGSDCGHIFIWKKKEAKLVRLMVGDQHVVNQLEAHPHIPILATCGIEKNVKIWAPLGNDIPPLPANVKEIMETNRQGREDRSRRRQTLAYIERRHNRADIVSDEEDAEGYLLGFSDGDASSEEDSPGNSRDCNIS

SEQ ID NO: 195614 - protein, 496 aa, Glycine max
  Coding DNA Sequence Number=SeqID_78836
  Gene Ontology: Mol. function=hydrolase activity; Cellular component =trans-Golgi network transport vesicle membrane; Biological process =secretory pathway
  Homolog annotation: Hit_ID=Q8RWZ7; Match level="QueryCoverage=99%, HitCoverage=49%, E-value=1e-141, Identity=72%"; Hit description =Putative vacuolar proton-ATPase subunit
  Pfam annotation: Domain name=V_ATPase_I; Domain location=138-496; Score=-215.8; E_value=1e-06; Accession=PF01496.9; Description=V-type ATPase 116kDa subunit family
MEQFIDNLPPMDLMRSEKMTFVQLIIPVESAHRAISYLGELGLLQFRDVSFLPDPTSLPLDSDFPSLLFFFDFVSEVFFELSVEFSRLCMPALLRSLYDDCSSGSNLHPPSRSLLSFEICLIGFPVKLDLVNFLWTPFSCLQLNADKSPFQRTFVNQVKRCAEMSRKLRFFKDQISKAGLMSSSRTVLQPDIDLEDLEIQLAEHEHELIEMNSNSDKLQQSYNELQEFKIVLQKACGFLVSKHSLAVSDERELQENVYSNDAYVETGSLLEQEMRPQSSNSSGLRFISGIICKSKVLRFERMLFRATRGNMLFNQAPADELIMDPVSAEMARTKILKICEAFGANCYPVPEDISKQREITREGLFSSNTFQDYQVSSRLTDLEATLEAGIRHRNKALASVADHLAKWINMVRREKAVYDTLNMLNFDVTKKCLVGEGWCPLFAKTQRQEVLQRATFDSNSQVGIIFHPMDAVESPPTYFRTNTFTNPYQEIVDAYG

SEQ ID NO: 195615 - protein, 82 aa, Glycine max
  Coding DNA Sequence Number=SeqID_78837
MAMESLPWRGGLAWPSKGGEISLGELVVEGFEEGVRYTLAIQTRGYLLLSTLTEVRWLKIPPKVVFLMGAGHGGEIIRKLLE

SEQ ID NO: 195616 - protein, 79 aa, Glycine max
  Coding DNA Sequence Number=SeqID_78838
MESLSWRRGFYGVMCSARNMKVHSSNADLWVWVDSTSGWVIFVVLNSRGGVGLKIPPKVVFLMWRMLFFINLSILSLEM

SEQ ID NO: 195617 - protein, 258 aa, Glycine max
  Coding DNA Sequence Number=SeqID_78839
  Gene Ontology: Mol. function=amino acid transporter activity; Cellular component=membrane; Biological process=amino acid transport
  Homolog annotation: Hit_ID=Q9LHN7; Match level="QueryCoverage=80%, HitCoverage=43%, E-value=3e-81, Identity=69%"; Hit description =Similarity to amino acid transporter
MAGKGVPLVIVAGQAGERRVVPPLLVTGLDEVSYLIPLFAVTGAVLVYQTQWENGFHAQAAEIIAGKWLKIWIDFGAVLSAIGLFEAQLSSSAYQILGMAEIGILSKLFGVRSKWFHTPWLGILVSTIITIGVSYMDFTNIISSANFLYSLGMLLEFASFLWLRWKSPSIKRPYRVPLKLPLLVVMCLVPSGFLVLIMVIATKTVYLVSGVMSVAGIGFFLFIKLCKRKKWVGFEQEKDDGFERDNVSSLCISVVVLD

SEQ ID NO: 195618 - protein, 67 aa, Glycine max
  Coding DNA Sequence Number=SeqID_78840
MECHRGGGRLDVPVMSPTPNLSYLEGKKHMHIQGTYDGLEGHAPRHCFSGVILAKFPATKVQFCVVV

SEQ ID NO: 195619 - protein, 275 aa, Glycine max
  Coding DNA Sequence Number=SeqID_78841
  Gene Ontology: Mol. function=zinc ion binding; Cellular component =nucleus; Biological process=regulation of transcription
  Homolog annotation: Hit_ID=Q0GLE1; Match level="QueryCoverage=99%, HitCoverage=96%, E-value=1e-140, Identity=87%"; Hit description=Dof11
  Pfam annotation: Domain name=zf-Dof; Domain location=13-75; Score =138.7; E_value=1.6e-38; Accession=PF02701.6; Description=Dof domain, zinc finger
MSSQSVEKKPKPHPEQALKCPRCDSTSTKFCYYNNYSLSQPRYFCKSCKRYWTKGGTLRNVPVGGGCRKKRSSSKRAQDQTFTPNLNPLTALPHLSYDSNDLTLALARFQKQSSGQLGYNDHDLSIMGNPTTGSFCDILGNSGMNPSSENPSFLDEFQTGFLQTQNHLQNLYCVYGNGDLGEVDNGNSGGVGVSGEMMLPYDQVVMSNATAQSVSVMKQEMCSGREQSERRVLGGFPWQINADTNIIGELDSGKAIASWNSFTNSWHGLLQSPLM

SEQ ID NO: 195620 - protein, 57 aa, Glycine max
  Coding DNA Sequence Number=SeqID_78842
MITNLVRGSRMTVAGCSDDEAGRYRGGAYRGSRRCREGRIDEEMTDLLGFLGGSGAT

SEQ ID NO: 195621 - protein, 46 aa, Glycine max
  Coding DNA Sequence Number=SeqID_78843
MCHPTAYVCVYYNGQIYNTNEGTTFVSNNTKTFMVNKVLGKNHNPN

SEQ ID NO: 195622 - protein, 32 aa, Glycine max
  Coding DNA Sequence Number=SeqID_78844
MGRFQFHHANFVAQQLLTGGCPWCTIYFLGIL

SEQ ID NO: 195623 - protein, 188 aa, Glycine max
  Coding DNA Sequence Number=SeqID_78845
MASRNENVSALVYYDAYVADCDEGVEFKGGNDVLVSMRRGITLNALKTKNPTSYTQLLGGSSNYCETTPQLNEVSQINVDPTTDIHVAQCHVTTRLKMGCRMKLLMTSVTMKMKFWRTTTTTTTKAIMAYNSFSNKHHLKMSIVHIQIILMLVKSKCLTTLTIGIFWTNNNNLTRTMTSCMLVSNFVN

SEQ ID NO: 195624 - protein, 85 aa, Glycine max
  Coding DNA Sequence Number=SeqID_78846
MDKLHKIDMRGRTDTNWAEKVAKWIRETYYRACKAFSGIHGLIVFPGASNMDYTSPIVQQDDFLSNVFGIDCGTLASAREYMHSL

SEQ ID NO: 195625 - protein, 154 aa, Glycine max
  Coding DNA Sequence Number=SeqID_78847
  Homolog annotation: Hit_ID=Q9LUY5; Match level="QueryCoverage=96%, HitCoverage=24%, E-value=3e-56, Identity=77%"; Hit description =Similarity to damage-specific DNA binding protein 2
  Pfam annotation: Domain name=WD40; Domain location=49-88; Score=20.9; E_value=0.0046; Accession=PF00400.22; Description=WD domain, G-beta repeat
  Pfam annotation: Domain name=WD40; Domain location=93-132; Score =17.9; E_value=0.035; Accession=PF00400.22; Description=WD domain, G -beta repeat
  Pfam module annotation: Pfam domain module=WD40::WD40; Domain location=49-88::93-132
MELFQHLAGKRVNLWNMCLNASYDHPYLHLLSVKNRVCCIKPKYVIPDQVNCAVIRYHSRRITCLEFHPTKNNILLSGDKKGQLGVWDFGKVYEKVVYGNIHSCLVNNMRFNPTNDCMVYSASSDGTISCTDLETGISSSPLNLNPDGWQGDSG

SEQ ID NO: 195626 - protein, 56 aa, Glycine max
  Coding DNA Sequence Number=SeqID_78848
  Subcellular localization annotation: CTP_CleavageSite=20; ConfidenceScore=5.11e-01
MNGRNQSRYLRTDASRDGVTAQDKQRMSLRGSPVSFVFCSFLLLFVRISNQRLILT

SEQ ID NO: 195627 - protein, 215 aa, Glycine max
  Coding DNA Sequence Number=SeqID_78849
  Subcellular localization annotation: CTP_CleavageSite=35; ConfidenceScore=5.15e-01
MLSSSHRQPPTQGTGTGTGTSTENLMYVRKLSRSCCEQVVKKALATNDQENYRLLSTIKEGLIGLSYCVCLIHPCDDNDDSNNVIHQGGHRDTNGDHDCDDNDSSGIGGDGGGGDNDSDDDGSGNNIGGNGDNDGHTVAFTMIYPPQFCFPFLLSKIFSFSRRPSNLSQKNNDLGLIHRWIVVKFKHQVRNPIPRILTIGNFCIMSRLGEIPFAS

SEQ ID NO: 195628 - protein, 141 aa, Glycine max
  Coding DNA Sequence Number=SeqID_78850
  Gene Ontology: Mol. function=nucleoside-triphosphatase activity; Cellular component=membrane
  Homolog annotation: Hit_ID=Q7PC88; Match level="QueryCoverage=76%, HitCoverage=7%, E-value=1e-42, Identity=76%"; Hit description =Probable pleiotropic drug resistance protein 3
  Pfam annotation: Domain name=ABC2_membrane; Domain location=1-140; Score=-32.9; E_value=0.056; Accession=PF01061.14; Description=ABC-2 type transporter
MRLYFTAISALIFGTLFWDIGSKRESTQELFVVMGALYSACMFLGVNNSSSVQPIVSIERTVFYREKAAGMYSPITYAAAQGLIEIPYIAVQTVVFGVITYFMINFERAPTHDSFGVHVDIHRLIIDKSQNFIGTSSIQKL

SEQ ID NO: 195629 - protein, 398 aa, Glycine max
  Coding DNA Sequence Number=SeqID_78851
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q8L837; Match level="QueryCoverage=86%, HitCoverage=87%, E-value=1e-126, Identity=62%"; Hit description=Beta- 1,3-glucanase-like protein
  Pfam annotation: Domain name=Glyco_hydro_17; Domain location=32-349; Score=344.8; E_value=1.5e-100; Accession=PF00332.9; Description =Glycosyl hydrolases family 17
MATFIRKLVFSYAFLALFLSAGIGVFLGVESFGINYGQVANNLPQPDKVVELLSTLNLTKTRIYDTNPQILTSFANSNIEIIVTVENEILSQLDDPQQALQWVNSRIIPYLPETKITGVQVGNEVFTDDDITLIEHLVPAVVNIHNALAQLGYSNIKVSTPSSLAVLDQSYPPSAGSFKSEISGIMYQFLNFLSSSKSPFWINAYPYFAFKDDPNGISLNYVMFNPNAGMVDPYTNLHYDNMLYAMVDAVSFAIAKMGFKGIEVRVSETGWPSKGDADEVGATPMNAATYNRNLLRRQMAGEGTPLNPRMRLEVYLFALFNEDLKPGPTSERNYGLFRPDESMTYNVGLSALATSSASTSSSSISLASSGTKIKVAPWEYQSLMNWMFVFVLISTLCG

SEQ ID NO: 195630 - protein, 481 aa, Glycine max
  Coding DNA Sequence Number=SeqID_78852
  Gene Ontology: Mol. function=catalytic activity; Cellular component =nucleus; Biological process=metabolic process
  Homolog annotation: Hit_ID=Q9LTV8; Match level="QueryCoverage=91%, HitCoverage=73%, E-value=2e-70, Identity=28%"; Hit description =Selenium-binding protein-like
  Pfam annotation: Domain name=PPR; Domain location=142-176; Score =23.1; E_value=0.00099; Accession=PF01535.11; Description=PPR repeat
  Pfam annotation: Domain name=PPR; Domain location=218-252; Score =11.6; E_value=0.32; Accession=PF01535.11; Description=PPR repeat
  Pfam annotation: Domain name=PPR; Domain location=319-353; Score =46.6; E_value=8.3e-11; Accession=PF01535.11; Description=PPR repeat
  Pfam annotation: Domain name=PPR; Domain location=354-388; Score =12.3; E_value=0.26; Accession=PF01535.11; Description=PPR repeat
  Pfam annotation: Domain name=PPR; Domain location=390-423; Score =11.5; E_value=0.32; Accession=PF01535.11; Description=PPR repeat
  Pfam annotation: Domain name=PPR; Domain location=40-74; Score=16.9; E_value=0.074; Accession=PF01535.11; Description=PPR repeat
  Pfam module annotation: Pfam domain module=PPR::PPR::PPR::PPR::PPR::PP R; Domain location=142-176::218-252::319-353::354-388::390-423::40-74
MVKTGLDNVPFTLSKLLAASIIDMDYAASIFSYIQTPNLFMFNAMLRGYSLSNFPNKALPFFNELRNRAIWLDQFSFITVLKACGRVSEVGVGQGIHGVAVKSGNRVFVDVKNALLHFYCVCKRIEDARKLFDEFPEGNDLVSWNTLMGGCVSVSQPCLVFGLFRKMCWVGLEASVATVLSLLSAAGYIGNFGVGKSLHGYCIKIGFSSNLNDITALIDLYAKVGNYARNGMVGEALASFEQMSVRGMKPNSSTLSGLLSACPASGSVQVVRHVASFVEEQKVKLDAVLGTALVDVYAKCGFLDEAMDIFERMEDKDVKSWTAMISGLGVHGQPKNAIRLFNRMEKEGFKPNEVTFLAILTACSHGGLVVEGMEVFKLMVQEYGFSPQVEHYGCLIDLLGRAGMLHEAHKLIDSLPIKGDATAWRTLLSACRIYGDVKLGNTYAVAGRITDFTRMQEMKQRNVKVANYGVHETEGESMVKE

SEQ ID NO: 195631 - protein, 61 aa, Glycine max
  Coding DNA Sequence Number=SeqID_78853
MRDIWNSPLTPIYRKKGKEVAAQLAQGYENFTEALQKSRKPRKPFSNKMGEVVAAQLAQAS

SEQ ID NO: 195632 - protein, 93 aa, Glycine max
  Coding DNA Sequence Number=SeqID_78854
  Gene Ontology: Mol. function=cation transporter activity; Cellular component=integral to membrane; Biological process=cation transport
  Homolog annotation: Hit_ID=Q6R2R4; Match level="QueryCoverage=79%, HitCoverage=16%, E-value=5e-31, Identity=89%"; Hit description=CAX
RFTRDTGYMLGYEVIQVDDDEEKAVIGFWSAFTWLVGMTLVISLLSEYVVGTIEAASDSWGISVSFISIILLPIVGNAAEHAGSIIFAYKNKL

SEQ ID NO: 195633 - protein, 76 aa, Glycine max
  Coding DNA Sequence Number=SeqID_78855
MTSKRITSKRARKSTVRERSSTAPPVEFEFDAHRFRSEEHQRHFEVIKDWSFLKERRIQLAESEYIEFQAEITRRH

SEQ ID NO: 195634 - protein, 98 aa, Glycine max
  Coding DNA Sequence Number=SeqID_78856
  Subcellular localization annotation: CTP_CleavageSite=13; ConfidenceScore=5.27e-01
MKWINKPRRRKVPKSRESSFAMLASLMTSQLPTTLLNPSIGTTTTMVPTIVAKRPLNVIGQIGLPPMIPFVPPLEGTNQVMNEDATMENSLMSTMMVA

SEQ ID NO: 195635 - protein, 127 aa, Glycine max
  Coding DNA Sequence Number=SeqID_78857
MFPSKNCSFPQAPYLVPPIPGYIKCFENSYNLREFTEESLKISLARTVFILRPKKVYVGELNACPFHADTRLYLSSLSHTLGASFRGQIDFNIEQGIFEEKGKEELQNSTRHDKQSHHHNEKRIEIK

SEQ ID NO: 195636 - protein, 76 aa, Glycine max
  Coding DNA Sequence Number=SeqID_78858
MQRSFGISRRYSKAAILMTIGIMRHDSKMVFLMAFGISRPHIQTKAMCKTTSHPKYHYMQPHSEQLHTTNKPYVID

SEQ ID NO: 195637 - protein, 194 aa, Glycine max
  Coding DNA Sequence Number=SeqID_78859
MTRAYLYYAWQMTQTARTSGEFGVLEKIASINGDTCVQRPNRQSKWRHAQMLGNRQPNWRVPWSEGAGYVLGVRGCFSVLEGQLFQRSGVATVIGELPASCNSHWRFRAEKIAIRTGDFVLINTKASFNCVLTITTNIFSCVLEITSSFETKNSFLFQLCVLTISGFEFFECTRSFEFSECLGIYLHKVLNLFA

SEQ ID NO: 195638 - protein, 246 aa, Glycine max
  Coding DNA Sequence Number=SeqID_78860
MWMDRFALTLNGSQELPRLLAKAKAMADAKDAITKRAPRHPYCTRSKSRMMGDLEEVQEQMKADMSALKEQMSSMMDDMLGMKQLIESNTATVAAVSSAAEADPTLPTVVHHPIPNMEPLQHPDGVHENPREHAQGDVDSYSPFPAEGLAPNTLPQPNITGEPRRHPTQPMFLSMGGPPPIVEGKGKLDLIEERLRADEGFGDYPFADMTDLCLVPDVVIPLKFKVPDFDRYKGTTCPKNHLKMYC

SEQ ID NO: 195639 - protein, 191 aa, Glycine max
  Coding DNA Sequence Number=SeqID_78861
  Gene Ontology: Mol. function=RNA-directed DNA polymerase activity; Cellular component=chromatin; Biological process=chromatin assembly or disassembly
MADTTFCKSFERLFGLVEVLSTVYKGYAYISAPLTTLLTKEQFQWTPEAQQAFTNLKNTMCRAPVLGLLDFSLPFIVETDASEGFILQRGRIWLQTRLRFIQTILAEFHSTPIGGHMEVTKTLARVGENFIWPGMKEGIHRGSFGNATSILYSFQCCSLIHGDFRQDTRHALQSSLGLQPSICQSLLARVV

SEQ ID NO: 195640 - protein, 46 aa, Glycine max
  Coding DNA Sequence Number=SeqID_78862
MPGTCIHSGPSCPSTMWCRHSPQRSMAKIAWTSPNGLQLLNHEVYS

SEQ ID NO: 195641 - protein, 54 aa, Glycine max
  Coding DNA Sequence Number=SeqID_78863
MAMMCSKGCFAHVGLLHQYLVGGRNKEENWEVKAVISGWVGWGVEVLVEGSSQG

SEQ ID NO: 195642 - protein, 216 aa, Glycine max
  Coding DNA Sequence Number=SeqID_78864
MVERGKFDHIEERLKAIEGGRDYVFADMAGLCLVPDIVIPLKFKVSDFDKYKGTTCPKNHLKIYYRKMGAYLKDEKLRMHFFQESLTGAVSPVEGSGSSSRAPNDGEGDDNNDIRHVTYEKMVGYMPSSFADLVFVDERIEVGLRRSKFDYPALMNGKPGANGENEKEGGTHATMPFLHGPIPYQLNNINTRPILVLLITYHLTSQEHPIIHKCHP

SEQ ID NO: 195643 - protein, 69 aa, Glycine max
  Coding DNA Sequence Number=SeqID_78865
MKNEERPKNDVEINCSRDSTQNKAFGVMTARLGELSLPRQVGYFTMKLFGGPGEPEASLGKPGFKKALK

SEQ ID NO: 195644 - protein, 298 aa, Glycine max
  Coding DNA Sequence Number=SeqID_78866
  Gene Ontology: Mol. function=hydrolase activity, hydrolyzing O -glycosyl compounds; Cellular component=vacuole; Biological process =carbohydrate metabolic process
  Homolog annotation: Hit_ID=Q1RYK4; Match level="QueryCoverage=91%, HitCoverage=92%, E-value=1e-127, Identity=79%"; Hit description =Glycoside hydrolase, family 18
  Pfam annotation: Domain name=Glyco_hydro_18; Domain location=28-285; Score=216.1; E_value=7.8e-62; Accession=PF00704.18; Description =Glycosyl hydrolases family 18
MASLKQVSPLLLLFPLLLISLFKSSHAAGIAIYWGQNGNEGSLADACNTGNYQFVNIAFLSTFGNGQTPQLNLAGHCEPSTNGCTKFSDEIKACQGKGIKVLLSLGGASGSYSLGSAEEATQLATFLWNNFLGGQSSSRPLGDAVLDGIDFDIEAGGGNHWDELARALNGFSSQKKVYLAAAPQCPIPDAHLDSAIKTGLFDYVWVQFYNNPPCQYSSGSTNNLINSWNQWTSSQAKQVFLGLPASTAAAGSGFVPADVLTSQVLPAIKGSAKYGGVMLWDRFNDGQNKYSDAIKGSV

SEQ ID NO: 195645 - protein, 97 aa, Glycine max
  Coding DNA Sequence Number=SeqID_78867
  Gene Ontology: Mol. function=nucleic acid binding; Biological process= DNA integration
  Homolog annotation: Hit_ID=Q1S9K1; Match level="QueryCoverage=92%, HitCoverage=10%, E-value=2e-10, Identity=42%"; Hit description =Integrase, catalytic region; Zinc finger, CCHC-type; Peptidase aspartic, catalytic
MVESKGKSTVTVEKKKGTRFTKMSYQFPILKKFSSIGQMMEKSYSLHFEGDTCTIYDKSNKRQEIAKVKMEKGNRSFPISFKYTTNTSIAMRAIIDA

SEQ ID NO: 195646 - protein, 170 aa, Glycine max
  Coding DNA Sequence Number=SeqID_78868
  Gene Ontology: Mol. function=chromatin binding; Cellular component =chromatin; Biological process=chromatin assembly or disassembly
  Homolog annotation: Hit_ID=Q1SAV4; Match level="QueryCoverage=91%, HitCoverage=39%, E-value=3e-40, Identity=50%"; Hit description =Integrase, catalytic region
  Pfam annotation: Domain name=Chromo; Domain location=105-153; Score =15.1; E_value=0.016; Accession=PF00385.14; Description='chromo' (CHRromatin Organisation MOdifier
MKHFVDHHRREVSFQEGDWVLVKLRPRRQTSVAGNSYSKLAKRFYGPFQIIKKIGPIAYQLQLSANSRIHPVFHCSLLKPYLQPVTPVDAPIDLPTTVVENQPIISPVIILNTKWETTNIGPQFLVLVQWKGLSPDDTLWEKWEDLKVEYHLKDKVILEGHGNVMTRGNR

SEQ ID NO: 195647 - protein, 79 aa, Glycine max
  Coding DNA Sequence Number=SeqID_78869
  Gene Ontology: Mol. function=transcription factor activity; Cellular component=transcription factor complex; Biological process =regulation of progression through cell cycle
  Homolog annotation: Hit_ID=Q9M454; Match level="QueryCoverage=86%, HitCoverage=15%, E-value=5e-17, Identity=58%"; Hit description=E2F -like protein
MLLAFVLQAEVEKLSSEEQGLDDQIRPVHFCKLNETLIAIKALHGTTLEVPNPEEAVDHRERRYKIILRSTMGPLMSTL

SEQ ID NO: 195648 - protein, 75 aa, Glycine max
  Coding DNA Sequence Number=SeqID_78870
MTCSTYTILVLLEPKADPLALWNQFLFHCMWISTLCHLDFSKFYIPPIGSIGDVFLLKEYSSPSDKHLSSEVLYK

SEQ ID NO: 195649 - protein, 135 aa, Glycine max
  Coding DNA Sequence Number=SeqID_78871
MPGTATQTMSLEFTNFSGGSIDMTLVKEFYVNLYDLEDKSPKQGRACPLTPSSADGLPLKILRKNLTTLAQTWSVLPFSNLAPTSHTSDITLDRAKLIYGLVMQMNMNLGSLISSQISLFTQHDSSRLGFPALIT

SEQ ID NO: 195650 - protein, 97 aa, Glycine max
  Coding DNA Sequence Number=SeqID_78872
MERYLQHFVRQKAANHSGQVQIHECLYRFSLSQQGQGSALFACPTLEQFGVEVAWPGDWLEVQAGEEPAGSPGEADESHMDEEMTDLLGFYRGSGAV

SEQ ID NO: 195651 - protein, 484 aa, Glycine max
  Coding DNA Sequence Number=SeqID_78873
  Gene Ontology: Mol. function=protein binding; Cellular component =integral to membrane; Biological process=protein amino acid phosphorylation
  Homolog annotation: Hit_ID=Q949G9; Match level="QueryCoverage=98%, HitCoverage=86%, E-value=2e-69, Identity=32%"; Hit description =HcrVf1 protein
  Pfam annotation: Domain name=LRRNT_2; Domain location=1-33; Score =17.6; E_value=0.013; Accession=PF08263.3; Description=Leucine rich repeat N-terminal domain
  Pfam annotation: Domain name=LRR_1; Domain location=113-135; Score =15.0; E_value=0.27; Accession=PF00560.23; Description=Leucine Rich Repeat
  Pfam annotation: Domain name=LRR_1; Domain location=137-160; Score =13.2; E_value=0.92; Accession=PF00560.23; Description=Leucine Rich Repeat
  Pfam annotation: Domain name=LRR_1; Domain location=162-184; Score =14.3; E_value=0.46; Accession=PF00560.23; Description=Leucine Rich Repeat
  Pfam annotation: Domain name=LRR_1; Domain location=211-232; Score =11.7; E_value=1.8; Accession=PF00560.23; Description=Leucine Rich Repeat
  Pfam annotation: Domain name=LRR_1; Domain location=237-259; Score =8.3; E_value=7.8; Accession=PF00560.23; Description=Leucine Rich Repeat
  Pfam annotation: Domain name=LRR_1; Domain location=261-283; Score =13.9; E_value=0.61; Accession=PF00560.23; Description=Leucine Rich Repeat
  Pfam annotation: Domain name=LRR_1; Domain location=285-307; Score =12.8; E_value=1.1; Accession=PF00560.23; Description=Leucine Rich Repeat
  Pfam annotation: Domain name=LRR_1; Domain location=309-331; Score =20.8; E_value=0.005; Accession=PF00560.23; Description=Leucine Rich Repeat
  Pfam annotation: Domain name=LRR_1; Domain location=333-355; Score =18.5; E_value=0.024; Accession=PF00560.23; Description=Leucine Rich Repeat
  Pfam annotation: Domain name=LRR_1; Domain location=362-384; Score =9.5; E_value=4.7; Accession=PF00560.23; Description=Leucine Rich Repeat
  Pfam annotation: Domain name=LRR_1; Domain location=386-409; Score =10.5; E_value=3; Accession=PF00560.23; Description=Leucine Rich Repeat
  Pfam annotation: Domain name=LRR_1; Domain location=411-434; Score =9.9; E_value=3.9; Accession=PF00560.23; Description=Leucine Rich Repeat
  Pfam annotation: Domain name=LRR_1; Domain location=459-481; Score =5.4; E_value=28; Accession=PF00560.23; Description=Leucine Rich Repeat
  Pfam annotation: Domain name=LRR_1; Domain location=86-111; Score =9.8; E_value=4.2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1; Domain location=1-33::113-135::137-160::162-184::211 -232::237-259::...
  Pfam module annotation: Domain location=261-283::285-307::309 -331::333-355::362-384::386-409::411-434::459-481::86-111
MKIKNNLIDPSNRLWSWNHNHTNCCHWYGVLCHNLTSHVLQLHLNTSYYAFKYDYYNGFYHRFDEEAYRRWSFGGEISPCLADLKHLNYLDLSGNYFLGEGMSIPSFLGTMTSLTHLNLSQTAFSGKIPPQIGNLSKLRYLDLSYNDFEGMAIPSFLCAMTSLTHLDLSYTPFMGKIPSQIGNLSNLVYLGLGGSYDLLAENVGWVSSMWKLEYLYLSNANLSKAFHWLHTLQSLPSLTHLSLSHCKLPHYNEPSLLNFSSLQNLDLSFNSFSSSIPDCLYGLHRLKSLDLSSSNLHGTISDALGNLTSLVELDLSYNQLEGTIPTSLGNLTSLVELDLSRNQLEGTIPTFLGNLRNLWETDLTYLYLSINKFSGNPFESLGSLSKLSTLLIDGNNFQGVVNEDDLANLTSLKEFDASGNNLTLKVGPHWIPNFQLTYLDVTSWHIGPNFPSWIQSQNKLQYVGLSNTGILDSIPTWFWEPHSQ

SEQ ID NO: 195652 - protein, 135 aa, Glycine max
  Coding DNA Sequence Number=SeqID_78874
MVGYTPSSFTDLVFASERINVGPKRGKFDHPTRTTEKTGANKEGEDEGETHAVTAIPVRPSFPPTQQYLYSANNKLSPYPPPSYPQRPSLNLPQSLSTALPMTNTTFSTNQKHQPRSEFCSEKACRIHPNSSVLC

SEQ ID NO: 195653 - protein, 94 aa, Glycine max
  Coding DNA Sequence Number=SeqID_78875
WASSGILPDEPLLPESSRKTFSGSLPEEVFFRKTFGYFRKNTSSGNFPENVLPELPEEPLTGLPEDSVVSHFPIFSGVSCSRLLPYGSANLRFF

SEQ ID NO: 195654 - protein, 65 aa, Glycine max
  Coding DNA Sequence Number=SeqID_78876
MMEDDDAAIEVRNHVSPEPEVEDAGVASLSNPKACDKFGMQNDFKGSKVASKSANVSKCERFYGK

SEQ ID NO: 195655 - protein, 74 aa, Glycine max
  Coding DNA Sequence Number=SeqID_78877
MSEIRRFGGLGMEERRERKGAAHGFLENVIFIEQDAWRRQPTGNRLHEYCNRLQAICSSVIDYSIHVIDYQNKE

SEQ ID NO: 195656 - protein, 167 aa, Glycine max
  Coding DNA Sequence Number=SeqID_78878
MSNRKYESGYEKLKKKRKVEKLIESQHGALDKFAIIHKNDAEASSIGENVIEQPLIDHTDNEENVIEQPPIDNTDNGVEQPPRDDTDNGENVIEQPPINNTDNTNSHNFNQELEDNILEIGVEGNVEHNNTSSEVPTNIYDPELWKNIDGKFRNLMIEKGPIRHDNF

SEQ ID NO: 195657 - protein, 92 aa, Glycine max
  Coding DNA Sequence Number=SeqID_78879
MWQEYEGDQWGPDPRRKRTAKGHLVSTRIPIKMDKDENERESSIQNFIWYTEKKMSQFHGHSLRKSLTKGGHRKRTQNAAEYQEVNGSTNYL

SEQ ID NO: 195658 - protein, 539 aa, Glycine max
  Coding DNA Sequence Number=SeqID_78880
  Homolog annotation: Hit_ID=Q5XM22; Match level="QueryCoverage=18%, HitCoverage=72%, E-value=2e-28, Identity=52%"; Hit description =Resistance-like protein HAAS-2
  Pfam annotation: Domain name=DUF1723; Domain location=187-236; Score =52.6; E_value=1.3e-12; Accession=PF08330.1; Description=Protein of unknown function (DUF1723)
  Subcellular localization annotation: CTP_CleavageSite=56; ConfidenceScore=5.73e-01
CPTSSAASSSSPLTSPSVPPFPSSRKLLPAFWSCIYVVGLAQTSSVEIMVRTRGLRRSLGRGIGKGRGGQDEHHPDDVPWQSRPIASVRRQRMTEDVPAAGVEGLVADDVAAGSVAEGFLGEPRDLSVLTSYADHVAHNIWTGEERPDLKLASHGRKVEKIGRPAPEIERLVTATGLSPLIGCSVVTGDPRLISVLVERWHGEINSFHLPVGELMITLDDVSSLLHLPITGALHSFEPFLLEEAVVLLMELLEVSARAYLLHLVGCTLFAKKSATHVHVVHLEAFRDLGESGRYAWGAAVLVHMYDQLNEASQSSRQQLAGYITLLQCWIYDHFPSFHDCIIDDVYDETSPCVCRWLTTKGYIKGLRALAYRTRLDALTITDAIPPPPISASLSYEDIDDRRMHYEDHIAVAGEIFVVLGQAGDEPRHPPAPQHEEYVEPGIPEVLVGADVGPSQAPAVDGCEAITERLERVLNLRMVTEDTKLHEIVKDCLRIARGVTTQMEMLGHDEDDAQIIDRSCYVLYLTTFLYLLHYFGYNFY

SEQ ID NO: 195659 - protein, 137 aa, Glycine max
  Coding DNA Sequence Number=SeqID_78881
MVKECIFLGHMLSHVSTKVDLAKVEVIANLPLPNCVRVVRSLFGHARFSMRHLGMCRNLPFGGKARRKAKGASSKKKTHGSRHQRLFEENVRKTKKRSMNFENKGSGVIYARGRRAGYFNPKPFRGPGELEASLGEP

SEQ ID NO: 195660 - protein, 122 aa, Glycine max
  Coding DNA Sequence Number=SeqID_78882
MAADPTKTLMNYLTPTLGMLENNPFSGATHEDPKQHLGRFIKLIKMNGITTWNQCTSASLRRYFSLMKIDHYTRNTETLCKGSKKVYLKLKFPTDAIKIIEDICSNSYNNLKDKRIIKGGVD

SEQ ID NO: 195661 - protein, 53 aa, Glycine max
  Coding DNA Sequence Number=SeqID_78883
MADEDDVPLSDFTVAGPDQSSRLFRPSCFRNLMLKGTYHLEDKVLPNGPRNDR

SEQ ID NO: 195662 - protein, 363 aa, Glycine max
  Coding DNA Sequence Number=SeqID_78884
  Gene Ontology: Biological process=regulation of GTPase activity
  Homolog annotation: Hit_ID=Q9FIQ0; Match level="QueryCoverage=93%, HitCoverage=84%, E-value=8e-98, Identity=58%"; Hit description=Zinc finger protein Glo3-like
  Pfam annotation: Domain name=ArfGap; Domain location=8-88; Score= -22.7; E_value=0.0022; Accession=PF01412.9; Description=Putative GTPase activating protein for Arf
MKQYWNYQRLVGFSQTCVWKNFDWRSTNLDSWSPEQLKTMSFGGNNRAQVFFKQHGWNDGGKIEAKYTSRAADLYRQILSKEVAKSMAEDGGLPSSPVASQSSQGVNGLPEVKTNEVPKENILEKPEKPESTSSPRASHTVISSTVKKPIGAKKAVKSGGLGARKLTKKPSESLYEQKPEEPPAPVSSSTNNMPAGPSPTSRFEYVENVQSSELNTGGSHLLSHVSPPKSSSFFADFGMDSGFPKKSGPSSSKVQETDEARRKFSNAKSISSSQYFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 195663 - protein, 245 aa, Glycine max
  Coding DNA Sequence Number=SeqID_78885
  Pfam annotation: Domain name=GRP; Domain location=1-133; Score=-19.0; E_value=0.0064; Accession=PF07172.2; Description=Glycine rich protein family
MGTSKVLSIVFFVLLGVGICSAARTLLTIGGGVHGEIGVGVGVGGYGGGGGSGGGGGYGGAGGHGVGSDGGAAVGGYGGGGGGGSGGGGGAGGVDGGGYGGGAGKGGGEGYGGGGAHGGGYAGGGGGGSGGGGGGGAGAGGAGGGYGGGEGGGAGGGYGGDHGGGYGGGGGSGGGGGAGAGGAHGGGYGSGGGSGGGYGGGAAGGGGGGSGGGGGAGSGGGGAHGGGYGGGAGGGEGGGHGGYYP

SEQ ID NO: 195664 - protein, 84 aa, Glycine max
  Coding DNA Sequence Number=SeqID_78886
  Subcellular localization annotation: CTP_CleavageSite=18; ConfidenceScore=5.09e-01
MGSTVTLSLASSCIIHTSSSTSSASTCSTIELVCNVLTLLWLKLDLMVLGWPQQCYYDLMVVTGNDIVVVHAAVDEDGTMVKAV

SEQ ID NO: 195665 - protein, 113 aa, Glycine max
  Coding DNA Sequence Number=SeqID_78887
MLYYAEFDEFTEELERRNWHKEMMNFMDGSIDVAIVKEFYANLYGPEDKSPKCFEYLLEDPSDHRERGRATFLLHVCSIETDNEASFEVLIFTLSLSQSAGLASHPLSASFLG

SEQ ID NO: 195666 - protein, 78 aa, Glycine max
  Coding DNA Sequence Number=SeqID_78888
  Subcellular localization annotation: CTP_CleavageSite=31; ConfidenceScore=5.31e-01
MCLAKGSSASLSHRHLSKRMSVHPQKMNSLSAGKLPRNHITNETSKRVGLHPQKETTPENLAFHGFKQNTQMKHEAET

SEQ ID NO: 195667 - protein, 149 aa, Glycine max
  Coding DNA Sequence Number=SeqID_78889
  Gene Ontology: Mol. function=DNA binding; Cellular component=oxygen evolving complex; Biological process=DNA integration
  Homolog annotation: Hit_ID=Q0PEL6; Match level="QueryCoverage=77%, HitCoverage=9%, E-value=7e-29, Identity=61%"; Hit description =Putative integrase
MNVKRAFLNGLMKEEAYVEQPLRFERSIYPPYVFNLNKALYGLKQAPRAWYENLSSSLTENGFIKGKVDTTLFCKDYGFFPTCASRVLDEYDERIEVISWTSDQEKRQRHIHTSKREMEYILLGYWDADFIGDKVETKSTSGGCDFIGG

SEQ ID NO: 195668 - protein, 139 aa, Glycine max
  Coding DNA Sequence Number=SeqID_78890
  Gene Ontology: Mol. function=DNA binding; Biological process=DNA integration
  Subcellular localization annotation: CTP_CleavageSite=49; ConfidenceScore=5.30e-01
MRWTSPPQQQQPIPPFQNIVGPSKPYNPKNVSAITLRSGKQIEVPPPVAASALEPVKLHATPENEDEIVAQKRKFTHQGANKNFHAGGPSSSYSFGKGDLGDLQESRGEHTSAGCHQADSKICQVSKGSMHPQKEAQRQ

SEQ ID NO: 195669 - protein, 224 aa, Glycine max
  Coding DNA Sequence Number=SeqID_78891
  Gene Ontology: Mol. function=glycerol dehydrogenase activity; Cellular component=cytoplasm; Biological process=metabolic process
  Homolog annotation: Hit_ID=UPI00005F702C; Match level="QueryCoverage =88%, HitCoverage=54%, E-value=2e-74, Identity=69%"; Hit description =COG0371: Glycerol dehydrogenase and related enzymes
  Pfam annotation: Domain name=DHQ_synthase; Domain location=34-224; Score=-110.5; E_value=0.0011; Accession=PF01761.10; Description=3 -dehydroquinate synthase
  Pfam annotation: Domain name=Fe-ADH; Domain location=28-223; Score= -9.0; E_value=6.5e-13; Accession=PF00465.9; Description=Iron -containing alcohol dehydrogenase
  Pfam module annotation: Pfam domain module=DHQ_synthase::Fe-ADH; Domain location=34-224::28-223
MEQKSRGSPGGRKAIIVEAQQQAGGESPGKYIQGANALAAVGEYAKSLADHYLMIADDFVMQLAGDTLMGSLQQHGVKHHAARFNGECCRKEIDRLGHELQAHGCRGVIGVGGGKTLDTAKAVAHYQQLPVVLIPTIASTDAPTSALSVLYTEQGEFAEYLIYPRNPDMVVMDSAIIAKAPVRLLVAGMGDALSTYFEAQACFDAQATSMAGGKSTLAALSLAR

SEQ ID NO: 195670 - protein, 69 aa, Glycine max
  Coding DNA Sequence Number=SeqID_78892
  Subcellular localization annotation: CTP_CleavageSite=46; ConfidenceScore=5.01e-01
VLVLVQGVKREAVPKGQGPCRNTALKLSTHRRLASSSLSSWNRTLPCTVDKGMHVHPGIESQGPMPYLP

SEQ ID NO: 195671 - protein, 191 aa, Glycine max
  Coding DNA Sequence Number=SeqID_78893
RATRPRLYRATCPRLRRATHSLAFRGLRVLAFRGLHICTLREFKGSCPQDTQWTRRSPIGPWGFQLWLRASISPTGCPYPPARSCHRDIGIVPARHPEDPKKSNRVLGFPALITGLCQFYGVPVTPSKVIRPPTNRAFIKKYCAPRQAEGETPQQPGDGQQQATNAPPPPPKPLSSSTKRLEYCLRHMADQ

SEQ ID NO: 195672 - protein, 169 aa, Glycine max
  Coding DNA Sequence Number=SeqID_78894
MSSTVCKDHARKTPSGPEEFQQGPGVLALITGLYRFYGVSFTPNKVIRPPINRAFITKYCAPRQAQGEAPRQPGDSQQLAADSSPPPLESTSTHLQGLEHCLRYMVDQQAPNHRDRYEQRFEAIKGWSFLRQRQTQLRDDEFPHFLGGGGAIQKDVISGISCAQVTSCF

SEQ ID NO: 195673 - protein, 434 aa, Glycine max
  Coding DNA Sequence Number=SeqID_78895
  Gene Ontology: Mol. function=cysteine-type peptidase activity; Biological process=proteolysis
  Homolog annotation: Hit_ID=Q4WEJ2; Match level="QueryCoverage=69%, HitCoverage=48%, E-value=3e-78, Identity=53%"; Hit description=Ulp1 protease family protein
  Pfam annotation: Domain name=Peptidase_C48; Domain location=149-434; Score=31.3; E_value=2.7e-06; Accession=PF02902.9; Description=Ulp1 protease family, C-terminal catalytic domain
MKRAEDLAEQKANGAKRLGEDKQKPILYRAPEVAKRVKLSDSLQDNIENTAGQIQPSDTALVECSKSSATKTSGTLNAESTRELPSNEQEADKAPVKKLSPRSSFSNRATRSMSRRAPATTVVCQRLKRQIRYGAIRPLVYPRFGKKKAEVDAQDRERLRDNEFLNDNLIGFYMRFLEDHLERTNKDVAKRVYFFNSYFFATLTNVKGRRNINYEGVQKWTRAVDIFGFDYIVVPINENAHWYVAIICNLPNLPGIADKSTEDRPSENDKDNSAAPESEGREIPETPEPIEELPAVKETKVNNSRNLEPAKDEATRRSLESMSLLDKEESKDGAPELPPTEWPEQEENLAFSPAKFSSPAAIAEPTQKASLRGAPRLAASPRKGSKKAKPSGKPGGAKFDIRQATIITFDSLDLSRSPTISNLRDYLYEEAKSK

SEQ ID NO: 195674 - protein, 161 aa, Glycine max
  Coding DNA Sequence Number=SeqID_78896
MTVSSPPTLTYCQTTSVLLTLYSCITKTGPRMTDVVVVDIQRHLEQRRCGARRRYRFSTDVEASFCSCEPENSLPQNRENQPFPEQKDSMDLTVTVHLEMKGDGEHVLKIKGFSPSSTEEDNVEREKQMAQKAAVLLLYGEMLQEMGKKWRAQFQASDSSE

SEQ ID NO: 195675 - protein, 175 aa, Glycine max
  Coding DNA Sequence Number=SeqID_78897
  Gene Ontology: Mol. function=DNA binding; Cellular component=oxygen evolving complex; Biological process=DNA integration
DVAFVFQVQPKSIEECLLDVHWLLAMQEELNQLKRNEIWDLVLGMNDPQGSQEECIDYDETYAHVARLEAIRLLLAFASLMDFMLFQMDVKSSCLNGYIKDKVYVSQPLEFIDYDFSNLVYKLKKALYGLKQAPRSWYERLSNFLLNKSLQELLANDGLCKKFAKTMQGESSKCS

SEQ ID NO: 195676 - protein, 130 aa, Glycine max
  Coding DNA Sequence Number=SeqID_78898
  Homolog annotation: Hit_ID=Q2HTU4; Match level="QueryCoverage=36%, HitCoverage=5%, E-value=9e-07, Identity=58%"; Hit description =Protein kinase; S-locus glycoprotein; Curculin-like (Mannose -binding) lectin; Apple-like
MAEEFVNGFVHQNGIAVITHNPPKGDGEKKTKIWIILAVVVGLICLGIHIFLVWRFKRKPKAISSAFGYNNNIETCFSSWHETFFSSNSRKGKETRDMNDEPHTHRVLLLPLGRWSTFHSYSKEYCIFLL

SEQ ID NO: 195677 - protein, 137 aa, Glycine max
  Coding DNA Sequence Number=SeqID_78899
NIPKGSGVWTPFLSIKADSSSPALTACFRRSGLEEGVDSLKTARGREKALPEVKILNKSRMLQGLHGIRRHTGSKRNAGTEAGTGPSVASDLNAERKRNPLTEIHSWFQLAESRNQFRGRQQANWLGALWFPWIIYK

SEQ ID NO: 195678 - protein, 50 aa, Glycine max
  Coding DNA Sequence Number=SeqID_78900
MTTVVAQRNGTWAARLRRDSEVFQGSKASELSGQNNNISNLKSRLIHNPN

SEQ ID NO: 195679 - protein, 63 aa, Glycine max
  Coding DNA Sequence Number=SeqID_78901
MCMMIDTHERLNGVTSRICMSSFAQGHVPKVGQVVVNCDGSIKDNDSYSSCGGLVTDHFGSLW

SEQ ID NO: 195680 - protein, 204 aa, Glycine max
  Coding DNA Sequence Number=SeqID_78902
  Gene Ontology: Mol. function=nucleic acid binding; Cellular component= nucleus; Biological process=mRNA processing
  Homolog annotation: Hit_ID=Q1RYN5; Match level="QueryCoverage=49%, HitCoverage=24%, E-value=9e-33, Identity=66%"; Hit description=RNA -binding region RNP-1
  Subcellular localization annotation: CTP_CleavageSite=22; ConfidenceScore=5.16e-01
MDWASVFFLKTSHISTNKVFFRRAKFKEVASNSSLKYAKRHHPFRSLAVEDDLKCPLLCLMVYRPLQASAQFDLSVLPFCTSSPMIVFLCPWVKIFWFGGLGQPGYSDVGKMYAAQDSGAKMTNVVAIATAFGGGLPPGISGTNDRCIVDVSNLNLDKIDEDKLFNLFSIYRNIMSIKLLQDKPNHALIQMRDDFQEELVVHFL

SEQ ID NO: 195681 - protein, 101 aa, Glycine max
  Coding DNA Sequence Number=SeqID_78903
MIYLIWLLVSMFGVNYSGLPASGPGQARVTVAEGHATVRAPQNMKGKCILWADRKVVEEEDAKLVNLSRKSDGEEGIRPMYLHKRNPNPLLALPPNISSAT

SEQ ID NO: 195682 - protein, 137 aa, Glycine max
  Coding DNA Sequence Number=SeqID_78904
  Gene Ontology: Mol. function=DNA binding; Cellular component=nucleus; Biological process=DNA integration
  Homolog annotation: Hit_ID=Q8RUQ2; Match level="QueryCoverage=98%, HitCoverage=11%, E-value=6e-42, Identity=64%"; Hit description =Putative retroelement
MELKQLDVKTFFLHGKLEEDILMQQLEGFKVEGNEILVCRLKRSLSGRKQTPRQWYKRFNEFIVSHGYIKSPYDSCVYHSKVEDGSRIYLLLYMDNMLIASQNLLAIQKLKSLLSSEFKMKDMRVVEKILGMEIKRD

SEQ ID NO: 195683 - protein, 131 aa, Glycine max
  Coding DNA Sequence Number=SeqID_78905
  Gene Ontology: Mol. function=DNA binding; Biological process=DNA integration
  Subcellular localization annotation: CTP_CleavageSite=45; ConfidenceScore=5.21e-01
MSCALSSYSNSNLAANLDARRSVTGYTFTIGNSLANWKATLQSIMALSTTEVEYATLLEATKEGIWLKGLDQVHHERTKHIDIVYHFIRIEKRVHVQKVDTRENPADMFMKLVPRRKFMYCLDLLDIDCWK

SEQ ID NO: 195684 - protein, 84 aa, Glycine max
  Coding DNA Sequence Number=SeqID_78906
MARAAEVMQFDQLIVYCALKCSTRVSKLSMDLDGSPPYWVNGVPLRDVEKTQHMITSTLVYRLTWVRKASKCSFGSVVHHTALG

SEQ ID NO: 195685 - protein, 127 aa, Glycine max
  Coding DNA Sequence Number=SeqID_78907
MVKHCFKIKTRLLQQTSIALRFIQDQLLPQNTLFPTYQGSGNRLPGSVIDYQKTSLQISFLKGTRERYSKRTSLPNALSSTLGKNTCKSTESHPGTSNYIIHSKGEKSFCLFQKNIIELIAASSSTF

SEQ ID NO: 195686 - protein, 152 aa, Glycine max
  Coding DNA Sequence Number=SeqID_78908
MQFWSCWRVYVFKKTGAIERGLRSEARLSTNPGCEKRDNERSWGMFYRSPTVGAKCTYQNLEQVHVRMEVDEVGSKTSYVGQREAFVIRARWGTCKTKNSNAQGSREPGIYRVEWSYESLFVGVVIALAGLTWKADMCLKVSRKMPRVFCGP

SEQ ID NO: 195687 - protein, 80 aa, Glycine max
  Coding DNA Sequence Number=SeqID_78909
MSDLTCKTKSMSTSDNLTEVARTTLVQAQGLYKLDRSIILTSIEVTILNTGQHMSMLKGLMNSSPSYSSRLLPSTSDNLL

SEQ ID NO: 195688 - protein, 41 aa, Glycine max
  Coding DNA Sequence Number=SeqID_78910
MEKAEGLRVLKMRIRKLFTQEEGCFPRSYVFLNCDEEIRPT

SEQ ID NO: 195689 - protein, 91 aa, Glycine max
  Coding DNA Sequence Number=SeqID_78911
  Subcellular localization annotation: CTP_CleavageSite=59; ConfidenceScore=5.42e-01
MRISLQLKCSSLCGGPVASKSDSWWPPVAVGGGRGGISLSELVSLSRNPLLALSTASPRLSREASFPLGLGVALSALVSLSEFPSRVGSCA

SEQ ID NO: 195690 - protein, 100 aa, Glycine max
  Coding DNA Sequence Number=SeqID_78912
  Gene Ontology: Mol. function=transition metal ion binding; Cellular component=chloroplast; Biological process=iron ion homeostasis
  Homolog annotation: Hit_ID=Q94IC4; Match level="QueryCoverage=77%, HitCoverage=29%, E-value=2e-36, Identity=97%"; Hit description =Ferritin-2, chloroplast precursor
  Pfam annotation: Domain name=Ferritin; Domain location=2-100; Score =49.5; E_value=1.1e-11; Accession=PF00210.14; Description=Ferritin -like domain
MWCLVENRFFKESSEEEREHAEKLIKYQNIRGGRVVLHPITSPPSEFEHSEKGDALYAMELALSLEKLTNEKLLHVHSVADRNNDPQLADFIESEFLYEQ

SEQ ID NO: 195691 - protein, 143 aa, Glycine max
  Coding DNA Sequence Number=SeqID_78913
  Gene Ontology: Cellular component=membrane
MASRRGGVSLPDKPSNNSSSILVKISRSSIITHDKEAAGDAAFVAKKLLRSTGKAACIPFASFFVVRIPEAEIPNLIKTLRGFNDTKIEFKLANVQKIWQRFLYRDSVLLEAERQKTIIGHVDDWAVEFLKLTEDDAFATLIQ

SEQ ID NO: 195692 - protein, 119 aa, Glycine max
  Coding DNA Sequence Number=SeqID_78914
MGKVGVRGMWEKRDRKMGRVGDAIRRWRCFGLIENLFVEIGIEGFGFLGFLYGAKREEHGVIWIQVPPGAVEPLFFPIIRGKLQSHASLNTNGPFVFNVNSFGVVGDGVSDDTKAFNLA

SEQ ID NO: 195693 - protein, 89 aa, Glycine max
  Coding DNA Sequence Number=SeqID_78915
MHAALKQREQQFRGLRASMMKEKEEEFTLFLEMKKCENQRNDLLLNSFEEFDAPLNLRAINTKRDYEMCLCDVCGRKTKRERERERKRG

SEQ ID NO: 195694 - protein, 49 aa, Glycine max
  Coding DNA Sequence Number=SeqID_78916
MTSGLQGIQGPFTLAFPHLFIAKQGIWDEGSSPGRAGYFIMKLSRWFRG

SEQ ID NO: 195695 - protein, 63 aa, Glycine max
  Coding DNA Sequence Number=SeqID_78917
  Subcellular localization annotation: CTP_CleavageSite=26; ConfidenceScore=5.28e-01
MSLQKRYSSIRSYQLPKYTQTPSMPRCSFKKGTRAFGQAEYLSPQFSCIFGCSLNKYSVNPNK

SEQ ID NO: 195696 - protein, 51 aa, Glycine max
  Coding DNA Sequence Number=SeqID_78918
MKITKEDEERKEITFIVAGTLLATVNVHLSQGTLHLNLYASNPLSLWGVLA

SEQ ID NO: 195697 - protein, 98 aa, Glycine max
  Coding DNA Sequence Number=SeqID_78919
MKFEHKLLLCVDTRYGTIGICNVTKRHTHPRSGADPVFIHQGSLTPLLQPPLSAVSSSNSILTFLPFNKSRARVKKMLGTLKSNMMVKFHDYISMYGI

SEQ ID NO: 195698 - protein, 165 aa, Glycine max
  Coding DNA Sequence Number=SeqID_78920
  Gene Ontology: Mol. function=NADH dehydrogenase (ubiquinone) activity; Cellular component=mitochondrial membrane; Biological process=photorespiration
  Homolog annotation: Hit_ID=Q9M9B4; Match level="QueryCoverage=58%, HitCoverage=90%, E-value=6e-43, Identity=80%"; Hit description=NADH dehydrogenase [ubiquinone] iron-sulfur protein 6
MGRKKGYVEFEESPPDDFDPANPYKDPVAMLEMREHIVREKWIQIEKAKIIREKLRWCYRIEGVNHLQKCRHLVNQYLESTRGIGWGKDGRHPSLHGHPSLFQFQSTRVLGILNLENYETFDDFLNAVWNLYSSLSVDGLSLDCYHLKLLGADPLISGYDTSADD

SEQ ID NO: 195699 - protein, 259 aa, Glycine max
  Coding DNA Sequence Number=SeqID_78921
  Homolog annotation: Hit_ID=Q5Z6P3; Match level="QueryCoverage=28%, HitCoverage=25%, E-value=2e-14, Identity=42%"; Hit description =Putative angel protein
MTILSFRVNLQTTGREKGDTDRHRGNKLWCYYAVTRDRSDMFCRFITGSQDIHDKFVAHNHGEYMCLEPEQLWCGASVGGLHRKILRPNGEEDVLRWNVVRDRFSLPKTLPIARKVNTVCCGYFPAKEKRLSPNVKSGEFNRQMPFYIFKYILVSAFSQIAVALGGGMIILCLPHIYYFEQFHPDLYSNIPHSFLEWERWKRLILEEINNYNASILCFQEVVHFNDLDDLFQNSGFKGVYKARTGEALDGCAVFWKDNL

SEQ ID NO: 195700 - protein, 113 aa, Glycine max
  Coding DNA Sequence Number=SeqID_78922
MCHIYTFVPLCTTFSHQPRVAMWNDREDSSIADKDEEGGVHVGEEVVGGVPAVGRGEFEPIAGDKGGGTGEKVLTFFSSSRRQQGWGMGGTTFIFQKRGCLRGVGKRERRCYG

SEQ ID NO: 195701 - protein, 96 aa, Glycine max
  Coding DNA Sequence Number=SeqID_78923
  Gene Ontology: Cellular component=integral to membrane; Biological process=protein transport
  Homolog annotation: Hit_ID=P59277; Match level="QueryCoverage=93%, HitCoverage=29%, E-value=4e-31, Identity=70%"; Hit description =Syntaxin-81
MGKARDRTEDFKDAVRHTARSLGYDEAKLASVMASFIIHKPPQKSPFSKAALKTLESIGELDQFLLKHRKDYTDLHRTTEKERDSIEHEVSRGHLF

SEQ ID NO: 195702 - protein, 313 aa, Glycine max
  Coding DNA Sequence Number=SeqID_78924
  Gene Ontology: Mol. function=transcription factor activity; Cellular component=nucleus; Biological process=regulation of transcription, DNA-dependent
  Homolog annotation: Hit_ID=Q9CA27; Match level="QueryCoverage=45%, HitCoverage=45%, E-value=5e-22, Identity=42%"; Hit description =Putative AP2 domain transcription factor; 68130-67156
  Pfam annotation: Domain name=AP2; Domain location=106-168; Score =55.7; E_value=1.6e-13; Accession=PF00847.10; Description=AP2 domain
MSFPRQTQKQGMECKRGKEKAPAKEENINTLRKIKIVYTDPDATDSSSEEDDKFLSNGYRLNGCSKRVVKEISLPCMPSKLHEENSSQEDVNSEKIKASRRNRKPSSMYKGVQRRKWGKYVAEIKDPIRGVRMWLGTFDTEEEAVVAYERKRNEFDSSLLALSKRDALACESSKEKEVLFHPSPSSVLDVSTTKAPLDVNDLNGSVKEKENVDTNGEGGGIDVEPVYSEDNSILHLLEEPVVASLAGRDDFYLDEIEKEIMLFGNDFYNFLDNDMKGGSVWNVEHGEGTTLPPVDSAFEELAWIDETLNWECS

SEQ ID NO: 195703 - protein, 95 aa, Glycine max
  Coding DNA Sequence Number=SeqID_78925
MTDFQMYMARKKRSKPSSMKTELDHFLEDNLSITLDFEILAWWKQNEGKVSNSTSNYKRCLGSKEIQEIATLVIEIESDDEGELLVNDITQQLDN

SEQ ID NO: 195704 - protein, 456 aa, Glycine max
  Coding DNA Sequence Number=SeqID_78926
  Gene Ontology: Mol. function=DNA binding
  Homolog annotation: Hit_ID=Q1S0F5; Match level="QueryCoverage=98%, HitCoverage=100%, E-value=1e-127, Identity=50%"; Hit description=IMP dehydrogenase/GMP reductase
  Pfam annotation: Domain name=DUF1723; Domain location=48-97; Score =13.6; E_value=0.013; Accession=PF08330.1; Description=Protein of unknown function (DUF1723)
MNFTKRNTQKYNFKDPDLTNLRKLGSLVVSPDDFRKRYGNLLSILKTNVEEGILNTLVQFYDPLYHCFTFPDYQLVPTLEEYSYLVDLPVSDKLPFSGLEPTPKPLTIAAALHLKTSDITSNLTTKGGFQGLTPSFLYQKAYTFAEAASTGAFEAILALLIYGLILFPNIDDFIDINRIQIFISGNPVPTLLANTYHSIHHRTQKKCGIITCCAPLLYKIMSLTPTDILWYQPASDIGVIIDSCGEFPNVPLISTRGGITYNPTLARRQFGYPMKEKPNNFSLTGEFYLNHEDHAGMRLRFVRAWHTVRRLDRNQLGRRTGFVHGSYTQWVVDRASILGLPYPLPRHVSSTVPSPSLPVPFDNKEECNEQLIQMRLERDTWKRKYQELERENETLKGKLAQKDHELFVQNQRIIEKDDLLRRKDALLRQDSKRRRRFMDSLSSAHPDFEDPSTPGV

SEQ ID NO: 195705 - protein, 337 aa, Glycine max
  Coding DNA Sequence Number=SeqID_78927
  Gene Ontology: Mol. function=RNA-directed DNA polymerase activity; Biological process=RNA-dependent DNA replication
MDLIEQENQSLKEEVATLREGMDRLTTMMNALLSAQNSQAAAAVVDQPFMPPGCTWGMPPPACGNIQPAVSEVPLSFAQQLAPVPQPGTSFPQAAMTYSAPLIHTIQQEVEPIYHAESIGALDKVDELQERFDGMQKEVEALRGRDLFGKDARELCLVPNVTIPHKFKVLDFEKYKGNTCPRSHLVMYARKMSMYTDNHKLLIHFFQDSLTGAALKWYMNLDSANIRTFNDLGEAFIRQYKYNLDMAPDRDQLRAMTQKDKETFKEYAQRWREVAAQIVPPLEEKEMTKIFLKTLSQFYYEKMVASAPTDFTEMVNMGVRLEEGVREGRLTVESTPA

SEQ ID NO: 195706 - protein, 136 aa, Glycine max
  Coding DNA Sequence Number=SeqID_78928
  Gene Ontology: Mol. function=carboxypeptidase activity
  Homolog annotation: Hit_ID=Q10BH4; Match level="QueryCoverage=48%, HitCoverage=16%, E-value=2e-23, Identity=71%"; Hit description =Expressed protein
MKPPFSPSSSLLRGKARLSPYLFTLIVFILFVAILYGEDFMCIFGQQFQNYSNYPHKLSSTTERVKRQKLPFAVGKAEEGCDVFSGSWVRDELTRPLYEESECPYIQPQLTCQEHGRPDKDYQHWRWQPHGCDLPK

SEQ ID NO: 195707 - protein, 69 aa, Glycine max
  Coding DNA Sequence Number=SeqID_78929
MTTLVSVCQWTCLPLADKRYLRMSSDLPSLDDKGVDNRKVSSHAAGLTGHNSKKCARITIRCLRVPPDS

SEQ ID NO: 195708 - protein, 75 aa, Glycine max
  Coding DNA Sequence Number=SeqID_78930
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=72%, HitCoverage=28%, E-value=4e-20, Identity=85%"; Hit description =Anaphase-promoting complex subunit 10
  Pfam annotation: Domain name=APC10; Domain location=1-75; Score= -81.9; E_value=0.025; Accession=PF03256.7; Description=Anaphase -promoting complex, subunit 10 (APC10)
TALGTVVGAQSSKLSTLPANKLIVLYVVFKLDESYTPSKVSILAGDGFHNLKEIKTVELVKPTGWVYLSLSGADP

SEQ ID NO: 195709 - protein, 134 aa, Glycine max
  Coding DNA Sequence Number=SeqID_78931
  Subcellular localization annotation: CTP_CleavageSite=60; ConfidenceScore=5.26e-01
MAAYRPPLFVAPMASKKSHDGPSRPQEGSPHWTPPGLSLRLPGSNTRTTCLTRLLEKQIGVALVKEFYSNIYDLEDSSPKQFRVRGKVVKFNAQTYPDHQTITAKLCMSGGQFTMNIEGAPWKILQKDLTILAQ

SEQ ID NO: 195710 - protein, 418 aa, Glycine max
  Coding DNA Sequence Number=SeqID_78932
  Gene Ontology: Mol. function=isomerase activity; Cellular component =membrane; Biological process=carbohydrate metabolic process
  Homolog annotation: Hit_ID=UPI00005F730C; Match level="QueryCoverage =60%, HitCoverage=78%, E-value=1e-116, Identity=83%"; Hit description= COG0794: Predicted sugar phosphate isomerase involved in capsule formation
RHAVVLCAPGGGAARRSRHDRRRRRGGVHLLLRPRQRAGSDPAAAGGERHSGNRRHRRQRVAAGAGRRLRAGYRRRARSLPDGAGTDLQRGQHADDGRCLGDGADAPARFQRGRFRPLAPGRQPGGAPAEPRASPDAHRRSPAARERKRQRDGSDAGAEPHRARVSGGLRRAAAGGGRVYRRRPAPLAGEGQQPAGSAQPGNHPPGLSAAGAVARRRGAGSAARTAHQRGPGGRYGRRAGGGAQPARSASGRHRLINAGGAPSPAPPVRSFPVGIVLELLLQQRLHVVIRFAEPLILGVFLRMVDGFRPVFHRHSHAPGLGFVRAERHDQKVVAAVVRLAQVADQILFALPAQVLRRRRGADALARPARHPRLAFHHVLPAGLIPRLLNQIRRGDDLLSKAARAEAEQCAEEGATQRL

SEQ ID NO: 195711 - protein, 131 aa, Glycine max
  Coding DNA Sequence Number=SeqID_78933
MVAWPGTQPSLHREDAGTQPSLHREDEGPTAQVPQHVEDESSEATIPEPFVVGEEAGETQVRQVAAATPERSLEATLNPPAPVEDLPSPQHAADPSTPTLEIPEDLTTPVLTLDTSPPATPVLHLTDEEDV

SEQ ID NO: 195712 - protein, 59 aa, Glycine max
  Coding DNA Sequence Number=SeqID_78934
MEKVGPVSQVFTKIAEGIWNEEEKKLVGNIGAAVLVCLLRENLKQVIFNASFLTHVHES

SEQ ID NO: 195713 - protein, 150 aa, Glycine max
  Coding DNA Sequence Number=SeqID_78935
MEEEGPQSGKPIEIEGSHLETLAIGSAMVVKELGNFEYPGHGIGTIETWNLNIHAGWSLPQRMVGGTSLEGVKESMEALVDRSRGLETFLNLRPGRYLRIKRGDRFLYGDQDRLFIEEIHIDLKHSKTETVVMFCITLCDDLDYLDRKHT

SEQ ID NO: 195714 - protein, 229 aa, Glycine max
  Coding DNA Sequence Number=SeqID_78936
  Gene Ontology: Mol. function=RNA-directed DNA polymerase activity; Cellular component=chromatin; Biological process=chromatin assembly or disassembly
  Pfam annotation: Domain name=RVP_2; Domain location=75-202; Score= -53.5; E_value=0.015; Accession=PF08284.2; Description=Retroviral aspartyl protease
MALCRKKCLCYNYNERYDPNHKCQAKFFLHIASDDDDLIIRPPPNPGPEDPPSDSQIDAPFLAQLSLYALSSHTASVTLRVTSSVNGHDMVVLIDGGNIHSFIQDRMVHFLNIAAQPTQRLSVMIGNGSEIGCNQVCKNVPILVQGHQFYVDLYVMALGGADMVFGVAWLKLLVPITTDYSHVTMSFTRNNKSIMLQGCIGPGPTEATRGQVKHVLHMDRVAALFHLQL

SEQ ID NO: 195715 - protein, 95 aa, Glycine max
  Coding DNA Sequence Number=SeqID_78937
MVREVWEKTCMDKYSDQLCKYRNKVKKTANSTEYEDLRSHEPRGMKDEIWNELIDIWKTLEWKKSDAGRKNRVAHHNAMVHTGGSRSFGQHKRIM

SEQ ID NO: 195716 - protein, 170 aa, Glycine max
  Coding DNA Sequence Number=SeqID_78938
MEEAQIWDKKVELPAFMGTDPIGWIAGAEKLFELQYAFMSMKGVATHWFYIWSQNNPDSHWESFSTALIKRFEDHHGNHIFERLSILKQENSTKTKTHIKKWETSTKFLKGRTDISEWKHMLCKILNEEVDSHASQQDKNSMEGNGTKFSEAKASSWARKVELPNFDRSI

SEQ ID NO: 195717 - protein, 59 aa, Glycine max
  Coding DNA Sequence Number=SeqID_78939
MNLKDMEHCLEMKLKLKVENLNLVMVDETLQAWVENGKILIKITLQEIDMARFCRLNTT

SEQ ID NO: 195718 - protein, 146 aa, Glycine max
  Coding DNA Sequence Number=SeqID_78940
MAVHCDCGLCYNCDERYDPHHKCKAKFFLLITNNDDDLVDPTLSDLTSMVVDDPSSDIGHSDSSSPARISFHDLSGHLTSATLRVDGFVNGHDVVVLIDGGSSHNFVKDGVSRLMTPHCSYFLCIYLSRKFQWGVFTGKCTESSCI

SEQ ID NO: 195719 - protein, 84 aa, Glycine max
  Coding DNA Sequence Number=SeqID_78941
LIFSLKWRLLSLSSFSIPLPFIFQEVKESIDEEDPRPTSSNEAYISNTFNSQQAVSHSLVEHKLNYFAVVELGLALSSSNAITH

SEQ ID NO: 195720 - protein, 311 aa, Glycine max
  Coding DNA Sequence Number=SeqID_78942
  Gene Ontology: Mol. function=nucleic acid binding; Cellular component= intracellular; Biological process=DNA integration
MDVKTAFLNGDIEEEIYMAQPEGFISSGDEQKVCKLQRSIYGLKQASRSWNKRFDTTIKEFEFVKNPEEPCVYKKVSGSAVTFLVLYVDDILLIGNDVGMLQSTKVWLSTRFSMKDLGEASYVLGIRIYRDRSRRLLGLSQSMYIDTVLKRFSMEESKKGFLPMSHGVRLSKSMRPQTQMEIEEMKRTPYASAIGSIMYGMLCTRPDIVYVVSVTSRYQSDPGPAHWKAVKDILKYLRRTRDLFLVYGDTELKLEGFTDSSFQSDVDDSKSNSGYLFKVNGGVVCWKSSKQGTMADSTTEAEIYCSIRCFK

SEQ ID NO: 195721 - protein, 111 aa, Glycine max
  Coding DNA Sequence Number=SeqID_78943
  Gene Ontology: Mol. function=protein serine/threonine kinase activity; Cellular component=membrane; Biological process=protein amino acid phosphorylation
  Homolog annotation: Hit_ID=Q9FLW0; Match level="QueryCoverage=99%, HitCoverage=14%, E-value=2e-16, Identity=42%"; Hit description =Receptor-protein kinase-like protein
MEWQKKGLIEKIVDPFIVDEIKPSSLKKFGETAEKCLAEYGVDRPTMGDLQTNERKREHGIDADDGSEAAVTPPPMGVPARRGGVDADSDDGTSDISSSRVFSQLITNEGR

SEQ ID NO: 195722 - protein, 158 aa, Glycine max
  Coding DNA Sequence Number=SeqID_78944
  Gene Ontology: Mol. function=transferase activity; Cellular component= cytoplasm; Biological process=DNA integration
  Homolog annotation: Hit_ID=Q1S0G2; Match level="QueryCoverage=99%, HitCoverage=18%, E-value=5e-56, Identity=69%"; Hit description =Peptidase S8 and S53, subtilisin, kexin, sedolisin; Polynucleotidyl transferase, Ribonuclease H fold
  Pfam annotation: Domain name=rve; Domain location=12-156; Score =122.5; E_value=1.2e-33; Accession=PF00665.16; Description=Integrase core domain
MTKSPYKGIMERAEGLLDLIHTDVCGPLSVSAKGGYNYFATFTDDYSRYGYVYLMKYKSETFERFKDFRHEVEKQLGRSIKKLRSDRGGEYLSIEFIDYLKENGIQSQWTPPGTPQLNGVSERRNRTLLDMVRSMMGVHKLTGILVGSCTPYCRVFAE

SEQ ID NO: 195723 - protein, 86 aa, Glycine max
  Coding DNA Sequence Number=SeqID_78945
  Homolog annotation: Hit_ID=Q1S0G2; Match level="QueryCoverage=67%, HitCoverage=6%, E-value=8e-13, Identity=61%"; Hit description =Peptidase S8 and S53, subtilisin, kexin, sedolisin; Polynucleotidyl transferase, Ribonuclease H fold
MPDRLFLLENDEDHVDLGRDPGTYNEAGMDLGDPPKGIVPIGCKWIYKKKIGVDEKVSTYKARLVAKGIHSKARCDYEETFSQSRC

SEQ ID NO: 195724 - protein, 270 aa, Glycine max
  Coding DNA Sequence Number=SeqID_78946
MARIAKVVEISEQELDRVKQNRNGAAGVPRKHLEEKAEALTSQGEWATFIDVLALIVFGTVLFPNVDDLFVPYKVIACFSEKGKANWEKLLASMMGASISWFPQWKEGGAGVLCSCYPLRGVPSEEIITTFIARGRQDKEIKGSSNGVIGGYHKWLKSRPQGMTWLPKLKSLSGKKAEILEESEEVQALKAELEKTRVAKEKLKTTVTRVTKDNELKLKRAEKEESRMENMVLEDKSKACQRSKRSLTKQCSHSGILLVCVDAKSTGKCT

SEQ ID NO: 195725 - protein, 116 aa, Glycine max
  Coding DNA Sequence Number=SeqID_78947
MDARWMQFDDYIALVGEICVVFGQCLSDYIEWFYMISHSFMTSAQPGDPPRVLLVQQYDTFVEPDVPQQPVAAAAPDETDVDVRRPRHAVDGYVAIADKLERLLNLRILTEGIKSL

SEQ ID NO: 195726 - protein, 72 aa, Glycine max
  Coding DNA Sequence Number=SeqID_78948
MCVVKKVIWTFRLPVTKDETNIQWGLPATICYQREKLYMRVHCYQASRRPSMTTDLPPLLMFPWTRVYMCIK

SEQ ID NO: 195727 - protein, 81 aa, Glycine max
  Coding DNA Sequence Number=SeqID_78949
MPSTQEEQISLKLLVYKKTNKVILAEAGKDFVDVLFCFLTMPLGTIARLVQTSDLGPGGVGCLSSLYGSVTNLQEYLFTVT

SEQ ID NO: 195728 - protein, 238 aa, Glycine max
  Coding DNA Sequence Number=SeqID_78950
MNFPCSYDLLSAFKNESFNCGDLLARSVSVKSDKVYNGFVKDVATFIVTDDLVVIPNAMDSSFGVLQKFGVKSWSSIQEMTVNVTKKKDYDYYPNQSASNYEKIRWEGYSSIGSIDGLYNSIVGLNENKYLIAKEVKNRLVDPGLAPQFKLSMKVFPIIEQTSQYHCYYQRRGYTDSNYFYLTNGCRSYGKNIETCKVLKSCSGSLKGYAKGQRCSWLPMTWLWNECHPLQVYLYSTV

SEQ ID NO: 195729 - protein, 85 aa, Glycine max
  Coding DNA Sequence Number=SeqID_78951
MAKSLVGDPYVGRLTKDEKTIIGDMKKSMVKPKNILLTLKEHNATSCTTMKQYIHWHRLKDEDVVRDIFWSHPDAMKLTNACNLG

SEQ ID NO: 195730 - protein, 70 aa, Glycine max
  Coding DNA Sequence Number=SeqID_78952
  Subcellular localization annotation: CTP_CleavageSite=40; ConfidenceScore=5.18e-01
MGLADLAMTALRFVPPSSMPGGIKAHATLRRGASVLFHCQGAAVAPRVFQPFPYLRVGPDHSNPALTLAH

SEQ ID NO: 195731 - protein, 131 aa, Glycine max
  Coding DNA Sequence Number=SeqID_78953
  Gene Ontology: Mol. function=transferase activity; Cellular component= cytoplasm; Biological process=DNA integration
  Homolog annotation: Hit_ID=Q1S0G2; Match level="QueryCoverage=100%, HitCoverage=15%, E-value=2e-48, Identity=70%"; Hit description =Peptidase S8 and S53, subtilisin, kexin, sedolisin; Polynucleotidyl transferase, Ribonuclease H fold
  Pfam annotation: Domain name=rve; Domain location=12-131; Score=64.2; E_value=4.2e-16; Accession=PF00665.16; Description=Integrase core domain
MTKSPYKGKMERAEGLLDLIHTDVCGPLTVSAKGGYNYFATFTDDYSRYGYVYLMKYKFETFERFKDFRHEVEKQLRRSIKKLRSDRGGEYLSIEFIHYLKENGIQSQWTPPGTPQLNGVSERRNRTLLDM

SEQ ID NO: 195732 - protein, 162 aa, Glycine max
  Coding DNA Sequence Number=SeqID_78954
  Gene Ontology: Mol. function=nucleic acid binding; Biological process= DNA integration
MEPALARKYESHLHAFDIKAHLDSMYSENIRASRYAATKELITARLREGTSVHEHCLKMITLLEKLVNLDVTLPAELSLDLILLSLPSSYESFIVNFNMNKLDPPLDELMNMLVSFESTIKKEKFVLIAATFGKKSSSQKKIKERVPFPNSKFEVGEGSGGP

SEQ ID NO: 195733 - protein, 157 aa, Glycine max
  Coding DNA Sequence Number=SeqID_78955
  Gene Ontology: Mol. function=nucleic acid binding; Biological process= DNA integration
  Homolog annotation: Hit_ID=Q1SDY9; Match level="QueryCoverage=94%, HitCoverage=28%, E-value=7e-28, Identity=43%"; Hit description =Peptidase S8 and S53, subtilisin, kexin, sedolisin; Zinc finger, CCHC- type
MQVNNWYQSLFDLEGLMENVEPPALEENPTVAQIRSHSEQVATRAKDLTILHLVVDGDIFIRILNLDTTGNLGEDSRRFFLRNERTKQMQVLNLNEAESINDFMNKMMKVVNQIRLLGEKFPDSKIVDKLLVVLLERFESKISSLEKSKDLSKISLT

SEQ ID NO: 195734 - protein, 36 aa, Glycine max
  Coding DNA Sequence Number=SeqID_78956
  Subcellular localization annotation: CTP_CleavageSite=30; ConfidenceScore=5.06e-01
SFAFLLIAYSPHSLSPKISFPRSSFYSFPRSVSVLQ

SEQ ID NO: 195735 - protein, 172 aa, Glycine max
  Coding DNA Sequence Number=SeqID_78957
MKISVVEVEAFCGVDSSIKEEGVVEFLVVVGVLLADLENGDPTVVRGRVGVAVSKEGNDHNENAESGGGVGMGSGVNMGDGVDMDSGVGKGVGRDCMSARSGGGVSMGGRGGMGDGGDCTEEEGHPVWIRGGVELQQVWPWRSRGDPRELQKVRHPPFEVCAEMEGKVVADE

SEQ ID NO: 195736 - protein, 582 aa, Glycine max
  Coding DNA Sequence Number=SeqID_78958
  Gene Ontology: Mol. function=RNA-directed DNA polymerase activity; Cellular component=chromatin; Biological process=RNA-dependent DNA replication
  Homolog annotation: Hit_ID=Q1SRI1; Match level="QueryCoverage=59%, HitCoverage=65%, E-value=2e-53, Identity=31%"; Hit description=RNA -directed DNA polymerase
MNDTRGLKEVSTTRSKRKDAPPACLRKIFHDCAYLFVIAVGILFPSRIQKEVVKELNDLDYKDECRPFSTQVKARRIDLHDMFWQLGKNLGPSGCWKEKNVLKGLYVNNCSVEDPKQVKDEARSFLPSRFIEFGGLRPTLDGVHFPSISQEEYASLISHFLEEEIKEAVWDCGGSKSPSLVLRVPLRPHPIDAPQAQTVFLEDDHRREGRVASSRMRFRELSGERNDEVFWIKECLQSTTISALVNGSPSKEFSPQRGIRQEGPLALLLFIVVVEGLSGLMREVVAKNMFKGFSVGKERSPVELFQYDDYTIFFGEPTIRNIMVLKMKRNTLEFFVNILNCMLMSFPFVYLGLSMGANPRLVETWKSLLKKVDRRLAKWKHRVLSMAGRMGRKRISWVKWSKVCSPKINGDLGVKDVGIFNETLLTKWKWSCFHQRNDMWVKIINSKYGGWDALGGVGSLQNQSIWWRDIKMVRDGDDGDRWFDVQVTWSLGDGMRTNFWHDNWMGEEPHFVRFPRIYVNSLSVEAKVGNLGYWEGGGWVWNFTRRHRWFEWEIQSFNQSEPKINLSRLNQQRCDAWWWNAE

SEQ ID NO: 195737 - protein, 689 aa, Glycine max
  Coding DNA Sequence Number=SeqID_78959
  Gene Ontology: Mol. function=nucleic acid binding; Biological process= DNA integration
  Homolog annotation: Hit_ID=Q1T010; Match level="QueryCoverage=96%, HitCoverage=97%, E-value=1e-45, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MRLSHCMGLGSACFGLLDEVVAQRFIDTIKLGVQELGATPTEVQKATYQENNKKDGKALFIIHQSVDVDISEKTIGVNTTKEMSDQESVAEYFTRMLTLTNQMKNYGDKIKYTIIVDKILRTSTPRFDHIVVAIEQGRDLEGMKVEELQGILEAQDMRLNERNSLRSSNQALQAQTYKGNSSDKECKSKKVPRNFDETQLAQDEDFDFDKDDQQTLISDILYVPNTRNNLLSLGQLLVKGFSIQMEDNHMKLFDQSVITSMYILNRSPTKKLQGCTPEKARSGHKPSVSHFKIFGSLCFKHVLEQLRRKLDDMAKSMVLIGYHPTGAYKLYNPKMKKVLVNRDVLIDESKSWDWTTTTTDNTKRNVIMHFDNADIEVKIVESTNIQLRRSHRERQAPQALRDYEVYFDTTINAEGELVHFSLLAESKLVSQEEFSRSTCWRYAMEEELKSIEKNDTWELVDLPKRKRPIDVKWVYKTKMKPNGVMSRYKEFEMTDLGELSYFLDIEVKTSEWIFMHQKKYAKDILKRFNMSECNPIITLVETGISVQLEGDEEEVDPTLYKQIEKSMAIMTQIGVEIKEIRKVLLVMFSNLSQHQFLGVQGSKEVMKELNLKMVNPMRLLIDNRSIIDLAKHPVVHGRSKHINTKFHFFRDQVSKEKFELEFCKYEDQLVDMLPKPLKCIKFKKMRDRI

SEQ ID NO: 195738 - protein, 162 aa, Glycine max
  Coding DNA Sequence Number=SeqID_78960
  Gene Ontology: Mol. function=protein kinase activity; Biological process=protein amino acid phosphorylation
  Homolog annotation: Hit_ID=Q8LD58; Match level="QueryCoverage=49%, HitCoverage=12%, E-value=7e-13, Identity=50%"; Hit description =Receptor kinase, putative
MKAKKRGSIVRGGVGGVDRATQRQKLFCRRLATAIPCYHSNDRRVAIGMTSIVLDIGDPFVGKNLGLRLRMFDSSNVEVASILVEGEFVQVVDWARELVVFEKQSFQAGEAVEGGGKGLGEVVEAHVQANQVHQIKQKGWDLVAEQVALNVEVVEVDAGGQI

SEQ ID NO: 195739 - protein, 678 aa, Glycine max
  Coding DNA Sequence Number=SeqID_78961
  Gene Ontology: Mol. function=DNA binding; Cellular component=nuclear pore; Biological process=DNA integration
  Homolog annotation: Hit_ID=Q1SLU3; Match level="QueryCoverage=75%, HitCoverage=55%, E-value=5e-76, Identity=45%"; Hit description =Integrase, catalytic region
  Pfam annotation: Domain name=rve; Domain location=177-321; Score =11.7; E_value=0.00062; Accession=PF00665.16; Description=Integrase core domain
  Pfam annotation: Domain name=zf-CCHC; Domain location=45-62; Score =7.3; E_value=0.063; Accession=PF00098.13; Description=Zinc knuckle
  Pfam annotation: Domain name=zf-CCHC; Domain location=93-110; Score =8.9; E_value=0.033; Accession=PF00098.13; Description=Zinc knuckle
  Pfam module annotation: Pfam domain module=RVT_2::rve::zf-CCHC::zf -CCHC; Domain location=343-492::177-321::45-62::93-110
MDNARDIWKDLKSRYSQGDLLRISELQQEMASIKQAGNNSSNSGPSCTYCGKDNHIIDRCYRKNGFPQNYDSIGGKGTQSNPSKGNSRVKGNKICTYCGFSNHTADDCYKKHGYPPGHKLYKDMNQQKISTVEMMEGLCRLKMIPFKSRHKSGFISSSISNFLPFHKRLSFPNSESHSSCAFPLIHVDIWGPCNVTSLNGYKYFLTIIDDYSRFVWVFLMHSKAETQSHLKNFVANVERQFETKVKVISTLAANKKKLDPRAATSTFLGFKQNTKGFIIFDLKAKSISISRNVIFYEDCFPFIGRSLRQTHRPSKYKDFHVSYPSSTIASYSTAFKDPVWIEAMNAEIKALELNDTWVLTDMPQHKNVICCKWVYKIKHRSNGSVERHKARLVANDYTQVEWQDYLDTFSPVAKLTTVRLLLALAAINKWFTQLLDNAFKIKDLDDLRYLLGFEVARKPTGINLCQRKYALDILSDVGKLGSKPVSTPSDYATKLHQQSGTPLSMEDASSFRRLIGKLIYLTNTRPNITYVVQHLSQFVVAPTSAHQHVVVRVLRYIKGSLGAGIFLSAASKVHLKGFSDSDWGGCIDTRRPITSYGMYIGNSLISWKSKKQVTIARSSSEVEYKALASFICELQWLIYLLEEFKVDFQKPVTLYRDNSFESSVHERTKHVEIDCHIV

SEQ ID NO: 195740 - protein, 79 aa, Glycine max
  Coding DNA Sequence Number=SeqID_78962
MKVAWDFVICVRDEGSLIMKLGWGIIHQPDAFWIVDAGGGWCKGLFESYIPFWLLGEILGTLPPQDLLGEDRVFLEWFF

SEQ ID NO: 195741 - protein, 99 aa, Glycine max
  Coding DNA Sequence Number=SeqID_78963
  Subcellular localization annotation: CTP_CleavageSite=35; ConfidenceScore=5.49e-01
MANIKRQIMGLGQQGHVSSMLNPFFFSFSSHLTFNSAAKFSFHSLEGLGNDNDNNNNGNESPISVFVILIIFLSTVRNKKHNPFWDVSHKVPFIAGYQV

SEQ ID NO: 195742 - protein, 76 aa, Glycine max
  Coding DNA Sequence Number=SeqID_78964
  Gene Ontology: Mol. function=nucleic acid binding
  Homolog annotation: Hit_ID=Q0WQM7; Match level="QueryCoverage=64%, HitCoverage=16%, E-value=4e-12, Identity=66%"; Hit description =Putative RNA-binding protein
  Subcellular localization annotation: CTP_CleavageSite=67; ConfidenceScore=5.01e-01
YPGFLKLKMQSTYGAPVAFVDFQDVGSSTDALNSLQGTILHSSQSGEGMRVECLVLFNTNLRYAKSRMGMRKKPNR

SEQ ID NO: 195743 - protein, 66 aa, Glycine max
  Coding DNA Sequence Number=SeqID_78965
MGNPAFNTNMFGYPSAQSLGNADGSTMSGGLFANLGGYKLVGKEDGKLARVSILGFNSSQRDLVPT

SEQ ID NO: 195744 - protein, 124 aa, Glycine max
  Coding DNA Sequence Number=SeqID_78966
  Gene Ontology: Mol. function=small conjugating protein ligase activity; Cellular component=heterochromatin; Biological process =protein modification process
  Homolog annotation: Hit_ID=Q70I24; Match level="QueryCoverage=66%, HitCoverage=51%, E-value=2e-44, Identity=95%"; Hit description=SUMO E2 conjugating enzyme SCE1
  Pfam annotation: Domain name=UQ_con; Domain location=1-92; Score =93.4; E_value=7e-25; Accession=PF00179.16; Description=Ubiquitin -conjugating enzyme
MTDWEGGYFPLTMHFSEDYPSKPPKCKFPQGFFHPNVYPSGTVCLSILNEDSGWRPAITVKQILVGIQDLLDQPNPADPAQTEGTETWWSLLPNWVDDNFSLPLGIPTGLPHLWIGNWGPCSLP

SEQ ID NO: 195745 - protein, 261 aa, Glycine max
  Coding DNA Sequence Number=SeqID_78967
  Gene Ontology: Mol. function=transferase activity, transferring hexosyl groups; Cellular component=integral to membrane; Biological process=metabolic process
  Homolog annotation: Hit_ID=Q1S2F8; Match level="QueryCoverage=93%, HitCoverage=50%, E-value=8e-76, Identity=56%"; Hit description=UDP -glucuronosyl/UDP-glucosyltransferase
MTRLQEHYKTVTGTKTWSLGPVSLWVNQDASDKAGRGYAKEEGWLKWLKSKPEKSVLYVSFGSMSKFPSSQLVEIAQALEESGHSFMWVVKNRDEGDDRFLEEFEKRVKASNKGYLIWGWAPQLLILENSAIGGLVTHCGWNTIMEGVTAGLPMATWPLFAEQFFNEKPVVDVLKIGVAVGAKEWRPWNDFGKEVVKKEDIGKAIALLMGSGEESAEMRRKAVVLATAAKTAIQVGGSSHTNMLGLIQELKSLRFEGNCLP

SEQ ID NO: 195746 - protein, 85 aa, Glycine max
  Coding DNA Sequence Number=SeqID_78968
  Gene Ontology: Mol. function=small conjugating protein ligase activity; Cellular component=synaptonemal complex; Biological process=protein modification process
  Homolog annotation: Hit_ID=Q42551; Match level="QueryCoverage=56%, HitCoverage=30%, E-value=6e-21, Identity=93%"; Hit description =Ubiquitin-conjugating enzyme
MSGIARGRLAEERKSWRKNHPHGFVAKPETLPDATVNLMVWHCTIPGKAGVHDKNLERTTLQNLAIVDGVPDASSIPHLNPLLPI

SEQ ID NO: 195747 - protein, 158 aa, Glycine max
  Coding DNA Sequence Number=SeqID_78969
  Gene Ontology: Mol. function=nucleic acid binding; Biological process= DNA integration
  Homolog annotation: Hit_ID=Q1T010; Match level="QueryCoverage=98%, HitCoverage=15%, E-value=2e-35, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAEGMGKFVIRRKNSKASMIEEVLFVLGMKCNLMGIGQLIEKGFLVVMKESDLQLFDSRQRLILKSPLSRNRTFQTSIKPAQVEYLAARTNEGLPRITTPDKSCESCILGKQARSSFNSYLPMRATRRNLYFVTFVDEYNRMMWLYMIKCKSDVFEIL

SEQ ID NO: 195748 - protein, 117 aa, Glycine max
  Coding DNA Sequence Number=SeqID_78970
MHQIAFPFVPIKGKHARLLQGFKDKPPRGPHTAQLNAPEYPRDTDRSRWGCITLGRGTGQGCVKAECRNLPFGGRATRDSRDACSTKGIRVESPPTFIRGKRRKNRKRRDLRTFKLK

SEQ ID NO: 195749 - protein, 390 aa, Glycine max
  Coding DNA Sequence Number=SeqID_78971
  Homolog annotation: Hit_ID=Q1ZY19; Match level="QueryCoverage=85%, HitCoverage=63%, E-value=4e-35, Identity=30%"; Hit description =Fgenesh protein 60
  Pfam annotation: Domain name=DUF247; Domain location=1-351; Score =532.7; E_value=4e-157; Accession=PF03140.6; Description=Plant protein of unknown function
MKEIEERARSCYEGPISISSNEFAEMLVLDGCFVLELFRGATEGFKQLGYSRNDPVFAMRGSMHSIQRDMIMLENQLPLFVLDRLLGTQLGKPDLKGLVASLSLRFFDPLMPTDEPLTKSDRNKLESSLGGTNTFDPLSDQEGLHCLDVFRRSLLRSGPQPVPRIWIKRRSNAQRVADKRRQQLIHCVTELKEAGIKFKKRKTDRFWDIKFKDGKLRIPRLLIHDGTKSLFLNLIAFEQCHLDCSNDITSYVIFMDNLINSPEDVGYLHYRGIIEHWLGSDAEVADLFNRLCQEVVFDINNSYLSPLSEDVNRYYNHRWNTWCASLRHNYFSNPWAIISLVAAVVLLLLTLAQTYYGIYGYYRPARHRRYWYWLDAIAVVQLPFVMQMIA

SEQ ID NO: 195750 - protein, 57 aa, Glycine max
  Coding DNA Sequence Number=SeqID_78972
RAFAKRDTQWLSARKNPEEDELSGLFSAPLQVIKHTASAHPLSERSTLSHNPLMRTK

SEQ ID NO: 195751 - protein, 240 aa, Glycine max
  Coding DNA Sequence Number=SeqID_78973
  Gene Ontology: Mol. function=phosphoric monoester hydrolase activity; Biological process=dephosphorylation
  Homolog annotation: Hit_ID=Q2QT46; Match level="QueryCoverage=68%, HitCoverage=23%, E-value=8e-46, Identity=58%"; Hit description=PTEN, putative, expressed
  Subcellular localization annotation: CTP_CleavageSite=5; ConfidenceScore=5.29e-01
MEPASADSSSQPTPPASNTEEQHSTKVSGQPGNAHDSQLSSPTSGISSWARNLKFPQALGLGAQQNSQTENAGMSAFARLTGGLGLRTPSNETAPVKSGAEQSNLIESVTKGLVDSSKSAVKAVQVKARHIVSQNKRRYQVHDLNDTTNAAANHEGGFDLDMTYITENIIAMGFPGGDFSSGIFGYIEGFYRNHMDEVIKFFETHHKWLTCCVDLPRFLSKGWSKKSRTETKSTYLLVNS

SEQ ID NO: 195752 - protein, 395 aa, Glycine max
  Coding DNA Sequence Number=SeqID_78974
  Gene Ontology: Mol. function=phosphoric monoester hydrolase activity; Biological process=dephosphorylation
  Homolog annotation: Hit_ID=Q2QT46; Match level="QueryCoverage=60%, HitCoverage=39%, E-value=2e-91, Identity=64%"; Hit description=PTEN, putative, expressed
MGPWKNRQNHDGMLVVPLVGPPQPLLCSNNTRLHSNENSFYWEKLGDMTRRIFKMSWLFIVKLFFPTAEEAIDYFNHKRCVDGKALVLPSQIRYVKYFERTLTHFNGEVQPGRRCMLRGFRLHKCPYWVRPSITISDHTGILFTTRKHPKTKDLMPEDFWISVPKKGIVVFALPGEPGLAELVGDFKIQFQDRQGDFYCWMNTTMTENRKFLDGSDFDGFDKRKIPAPGFKVEVVMIDYNGTLPANTKSNPASKGSDGNTSNALPGPKSTTSNSSESKVPRNGDDDVFSDSDEEETRDTQSNKAAAEYKFMAPHQVSEATNDHVGMLTQKSDQLSLQHEECKQNDASEESPTDKLHKNHTGNKSTNMGSVGASDIKAIAADASVFSFGDEDFDSD

SEQ ID NO: 195753 - protein, 91 aa, Glycine max
  Coding DNA Sequence Number=SeqID_78975
MEQFLDKVAWPEAQLLLGRAPEVVLPSPIPTRTEPAPTESQPPVVDPPASLEVEILSPPLAPPAPPLILILDDSDAEAVAPSNSPAYYLED

SEQ ID NO: 195754 - protein, 264 aa, Glycine max
  Coding DNA Sequence Number=SeqID_78976
  Gene Ontology: Mol. function=nucleic acid binding; Biological process= DNA integration
  Homolog annotation: Hit_ID=Q1T010; Match level="QueryCoverage=59%, HitCoverage=11%, E-value=9e-27, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKALFEFQDVMEVVKNGVAAEPAEPATEAVRNAYKDSKKKDAKAIFFLHQSVDDANFNLILKATSAKQAWDKLEKCYAGGDRIKKVKLQVLQRQFDSMTMEENEKIADFFARVKVVTNQMATQGETLTDGKICEKITRSLLEKYDYIVCAIEESKEVSEMSLEELQSSLEARELRLLERNKKKIAEQALLAQSSNKNSGDSNKGRSGFRGRGRGRNNKGRNDYVSSSGRGHNNVENKPDQSQRGMGKGYYRGGSNGRGRGGRKR

SEQ ID NO: 195755 - protein, 165 aa, Glycine max
  Coding DNA Sequence Number=SeqID_78977
MTKGEKDDVSLYASTGSLPSWLMKGAEDDITIRYLRTSLDSQVTIAKGGVINKSGAFAPMYPQSRWGIQTNGPGVSSFDYEPLSVLRSTVAPSKVIGPPTNRAFIKKYCAPWQAQGETPQQPGDGWQGATDAPSPPPRPLCSSTKAGALPTTSDRLAGDQVQSQR

SEQ ID NO: 195756 - protein, 119 aa, Glycine max
  Coding DNA Sequence Number=SeqID_78978
  Homolog annotation: Hit_ID=Q00M75; Match level="QueryCoverage=30%, HitCoverage=6%, E-value=1e-10, Identity=86%"; Hit description=PPR -repeat containing protein
MAKLRYIVFVSTSSAIDMLCYERRDSMFTYEHAKYTYPYPCICKEAVSGFEPMTNKSPRHNFTAAPGLALPKDNSYHKGIINNFKEICCTRIPPSKINFRARPLMERTPENMELGLSSL

SEQ ID NO: 195757 - protein, 63 aa, Glycine max
  Coding DNA Sequence Number=SeqID_78979
  Subcellular localization annotation: CTP_CleavageSite=27; ConfidenceScore=5.03e-01
MTQGSLKLSLLSNGGAIFFDESTCLILASMRQQGMTLLQTKNNSSNTINFPDSVGTSANFGFS

SEQ ID NO: 195758 - protein, 65 aa, Glycine max
  Coding DNA Sequence Number=SeqID_78980
MTKGAEDEVSLCASIGSLFPWLTEDAEDDITIRYLHTSSDSQVTIAKSGAVGKSGAFAPTYPQSR

SEQ ID NO: 195759 - protein, 344 aa, Glycine max
  Coding DNA Sequence Number=SeqID_78981
  Gene Ontology: Mol. function=zinc ion binding; Cellular component =integral to endoplasmic reticulum membrane; Biological process =protein amino acid palmitoylation
  Homolog annotation: Hit_ID=Q9FF67; Match level="QueryCoverage=78%, HitCoverage=86%, E-value=2e-53, Identity=40%"; Hit description =Arabidopsis thaliana genomic DNA, chromosome 5, P1 clone:MUG13
  Pfam annotation: Domain name=zf-DHHC; Domain location=134-185; Score =65.3; E_value=2e-16; Accession=PF01529.11; Description=DHHC zinc finger domain
  Subcellular localization annotation: CTP_CleavageSite=13; ConfidenceScore=5.18e-01
MPPLPPPPQANPDSGATSAPSQVFLCGGRLIFGPDVKSIFISIFLIVLPVAVFCGMVARKLLDDFPHHTGWSIMAVLIALTLFVLITLVVTSARDPGIVPRNAQPPETDDYHWTDNSNNGQISLSRFPRTKDVIVNGITLKVKYCDTCMLYRPLRASHCSVCDNCVERFDHHCPWVGQCIGLSTYENFKYRYDPQTNPYNRGMVNNFKEVFCTRIPPSKNNFRSKVLREPLDSHQRTGIRPISPMMKRRPRSMELVGNSVYNEQDEEESNYRDEIDNEARSKDSGLTDKSLDLSRILHTEGVEGQESSLRHHLWEATPEVQDSITEFGESNWATAPSCSTREVV

SEQ ID NO: 195760 - protein, 58 aa, Glycine max
  Coding DNA Sequence Number=SeqID_78982
MANEMVAKLTSTSWDKCLTGTPGDERPCHEKVSEYAMKIKGHLCASSVDGSSFNFYFG

SEQ ID NO: 195761 - protein, 184 aa, Glycine max
  Coding DNA Sequence Number=SeqID_78983
  Gene Ontology: Mol. function=DNA binding; Cellular component=nucleus; Biological process=regulation of transcription
  Homolog annotation: Hit_ID=Q1S9D9; Match level="QueryCoverage=77%, HitCoverage=59%, E-value=5e-44, Identity=58%"; Hit description=No apical meristem (NAM) protein
  Pfam annotation: Domain name=NAM; Domain location=1-85; Score=82.1; E_ value=1.7e-21; Accession=PF02365.6; Description=No apical meristem (NAM) protein
MSARNCDPQERHFFSPKEAKYRNGNRMNRTTKCGYWKATGSDKRISSSTSTCNGIVGVRKTLIFYEGKSPKGSRTHWVLHEYRLVSVETGAANSSHNYVNEIGDWVLCRLSMTTTTKESDGSGTHHKHRQNTAVQTTRPRLMFDFMMVGKTNSSTSSSCSSSSNIMEVSSNASDHEETSGYAHF

SEQ ID NO: 195762 - protein, 258 aa, Glycine max
  Coding DNA Sequence Number=SeqID_78984
MGIGNSKSNAAEGERLPPKIRPMLVSRFEEFRKRRNGETTLSKKNLLNEEDDNSQSSHRTEEENKVSSSKEIEPPKEETVERVITAEKLSRVVPVPNSECENVEETHPNKDNIEQVIKYMDPSQDVFNRAVEMAEAEVKTEEEKTAELVEETKEEKKQKVDAKGDDHHEDSGDEDESEKVGRFLCPGSPSFRIYCIEAEKRNEEECNGPTIVLQKSRSVDSVETAESTNSNEVLQELESTSKRKGHKKKFGAMKTLLK

SEQ ID NO: 195763 - protein, 182 aa, Glycine max
  Coding DNA Sequence Number=SeqID_78985
  Gene Ontology: Mol. function=nucleotide binding; Cellular component =intracellular; Biological process=small GTPase mediated signal transduction
  Homolog annotation: Hit_ID=Q9LYJ3; Match level="QueryCoverage=98%, HitCoverage=95%, E-value=9e-86, Identity=84%"; Hit description=ADP -ribosylation factor-like protein
  Pfam annotation: Domain name=Arf; Domain location=4-177; Score=416.0; E_value=5.4e-122; Accession=PF00025.11; Description=ADP-ribosylation factor family
  Pfam annotation: Domain name=MMR_HSR1; Domain location=18-129; Score =8.7; E_value=0.00016; Accession=PF01926.13; Description=GTPase of unknown function
  Pfam annotation: Domain name=Miro; Domain location=19-129; Score =15.7; E_value=0.00016; Accession=PF08477.3; Description=Miro-like protein
  Pfam annotation: Domain name=Ras; Domain location=19-149; Score= -57.7; E_value=6e-05; Accession=PF00071.12; Description=Ras family
  Pfam module annotation: Pfam domain module=Arf::MMR_HSR1::Miro::Ras; Domain location=4-177::18-129::19-129::19-149
MGLTVSRLLRLFYARKEMRILMVGLDAAGKTTILYKLKLGEIVTTIPTIGFNVETVEYKNVSFTVWDVGGQDKIRPLWRHYFQNTQGLIFVVDSNDRERILEARDELHRMLSEDELRDATVLVFANKQDLPNALSVAEITDKLGLHSLRLRRWYIQPTCATSGQGLYEGLDWLSSHITNKTR

SEQ ID NO: 195764 - protein, 76 aa, Glycine max
  Coding DNA Sequence Number=SeqID_78986
MNEQAKKNEIVNAQNGMEKKVETVDYRSSAGQRQEERNVQVIHQPHSTNTSGGVLAGAAAAVASTLQSAKDAISKK

SEQ ID NO: 195765 - protein, 94 aa, Glycine max; identical to SEQ ID NO: 193507
  Coding DNA Sequence Number=SeqID_78987

SEQ ID NO: 195766 - protein, 64 aa, Glycine max
  Coding DNA Sequence Number=SeqID_78988
MKNWMQNSKWDVYLGAYLNGALKGLDDTPQPKSKAGARWIIVKTIGSREIEGASHPMDKVLSQS

SEQ ID NO: 195767 - protein, 87 aa, Glycine max
  Coding DNA Sequence Number=SeqID_78989
MSFCLKCELHERVKIWNCQSKYQLFKKFHQKPETVSKKLKEVIFEQIRGKSKAAKDIEKCKKFCAHRGDGVLRALKCNCNSIAKSTE

SEQ ID NO: 195768 - protein, 284 aa, Glycine max
  Coding DNA Sequence Number=SeqID_78990
  Homolog annotation: Hit_ID=P09444; Match level="QueryCoverage=96%, HitCoverage=95%, E-value=6e-51, Identity=43%"; Hit description=Late embryogenesis abundant protein D-34
  Pfam annotation: Domain name=SMP; Domain location=15-71; Score=54.3; E_value=4e-13; Accession=PF04927.3; Description=Seed maturation protein
  Pfam annotation: Domain name=SMP; Domain location=156-217; Score =105.6; E_value=1.4e-28; Accession=PF04927.3; Description=Seed maturation protein
  Pfam annotation: Domain name=SMP; Domain location=221-283; Score =63.6; E_value=6.6e-16; Accession=PF04927.3; Description=Seed maturation protein
  Pfam module annotation: Pfam domain module=SMP::SMP::SMP; Domain location=15-71::156-217::221-283
MSQEQPQKENHEEEGIKYGDVFNVKGEMKSKPEAPVDAGMMQKAETETTGKTQKAGAAMQSAAAKNERGGMAGHKDKNNVAADGGVSVTETEAHLSGSQVISESVAGQVVNRLEEKKRKVNKLVEVVKQFNQKAPLNTMTPPSIVQEMGAGGAGSGITIGEALEATVLTAGKKPVEWSDAAAIQAAEVRATGRTNIVPGGVAAAAQSAATLNARVTKDEEKIKLADILADATSKLPSDRAATRRDAEGVTGAEMRNDPNLTTHPGGVSASVAAAARLNKTNTNT

SEQ ID NO: 195769 - protein, 174 aa, Glycine max
  Coding DNA Sequence Number=SeqID_78991
MAPKRRPKKGESRMEAALDAMKPYGFPNRLVRTAVNSLLKVYGGNNGWVFIEESAYSLLIETLLEEQASSSPQPEPSNLGLSRDTGVGPFKIPNRETPNQRENFLALSGTSMYKGTLGMNIDLNPFKIKGTGKAPVHYKTVENKPPELKSTQNNTVPGQSPVPSIDAEESSCLH

SEQ ID NO: 195770 - protein, 116 aa, Glycine max
  Coding DNA Sequence Number=SeqID_78992
MDRELRIRELVQTRLEPPVGGFPSLFSVACHKLWSSILSQLHQLHAHDWPTSSYDRSKFSSSPLLNRLRFSNPIQFIWGKTWRAINLGKTMEHLTELCGLPDILKTGTAKEEEEIC

SEQ ID NO: 195771 - protein, 396 aa, Glycine max
  Coding DNA Sequence Number=SeqID_78993
  Gene Ontology: Mol. function=protein binding
  Homolog annotation: Hit_ID=Q5N8Y4; Match level="QueryCoverage=71%, HitCoverage=25%, E-value=2e-72, Identity=52%"; Hit description=SF21 -like protein
MLSRNTAQKQWDETLVLVLGGIARILRLFFPFFTSLSNFWSGWESLLQFVENSILNGSKEVALAAINCLQTTVNSHSSKGNMPMPYLISVIDVYELVLRKPSSYRGNAADKVTQEILHGLGELYVQAQGLFNDVIYTQLIAIIDLAVKQAMLTNDNFEMEFGNVPPVLRTILEILPLLRPTEHISSTWPVLLREFLKYLPRQDSHLQNEDGKIDQARDSQVNYDAPNGATPISPNKIAVSPGSGSTAAIPSYIFAEKLVPVLVDLFLQAPAVEKYIIYPEIIQSLGRCMTTRRDNPDNALWRLAVEAFNRVLVHYVTKLTNGGPDSTISKPVRTRIWKEIADVYEIFLIGYCGRALPSNSISAVVLEADESLEMSILNILGDTILKLPVDTPSDVS

SEQ ID NO: 195772 - protein, 384 aa, Glycine max
  Coding DNA Sequence Number=SeqID_78994
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=36%, HitCoverage=36%, E-value=5e-33, Identity=52%"; Hit description =Integrase, catalytic region
MMYHRRILLHGRSDIKLVPVDIPQRVHHVLAYTVTRPCSHISYELLHFRLHFQDLTRGSGTATESLPQAIALAKLQEDKLNDHQHPVRNMSLFSSPTPTTVSPHSPSPSTTKCPDSATIETTPNEEALPTPQISMNAMFGMPTLEMFRLYGQIDGHRITILVDGGSTHNFIQTQVTKFLNLPLLSTFALPVKSPLLQSQSFSIDLPMRPSTTLLSTREAICDRLKRKLSKAQTTMKHFADSKRRDVQHNDGDWVYVKLKPYRQLSVVGAYHKLSKRFYGPFPIMESVDVVPYHLQLPASSEIHPVFHCSLLKPHHRDIPTKIATLPSKARDHHPIIEPLTLLDWKLDHSTSPLDQTEVGIDSNMAQSSQPKRNTRRPLHLQDFV

SEQ ID NO: 195773 - protein, 152 aa, Glycine max
  Coding DNA Sequence Number=SeqID_78995
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q5N8Y4; Match level="QueryCoverage=83%, HitCoverage=13%, E-value=4e-46, Identity=69%"; Hit description=SF21 -like protein
MAFMAVLESDLRALSAEARRRYPAVKDGAEHAILKLRTLSSPSEIAHNDDILRIFLMACEVRTVKLSIIGLSCLQKLISHDAVSPSALTEILSTLKDHAEMVDEGVQLKTLQTISIIFQSRLHPENEYINCILAGPGSCLCDMDLLALICKV

SEQ ID NO: 195774 - protein, 223 aa, Glycine max
  Coding DNA Sequence Number=SeqID_78996
  Homolog annotation: Hit_ID=Q5N8Y4; Match level="QueryCoverage=77%, HitCoverage=14%, E-value=1e-49, Identity=57%"; Hit description=SF21 -like protein
MAFLVQTSTLQMLNPGCVDVTGAYSAQKTELNISLTAVGLLWTMTDFIAKGLLNGPFEEKEAGVGSTVKQIDRKKMEDQTRISYNVRDQASVDGVDFEKLLFSVFSLLQNLGADERPEVRNSAVRTLFQTLGTHGQKLSKSMWEDCLWNYVFPTLDRASHMVATSSKDEWQGKELGTRGGKAVHMLIHHSLSDVIYLFEKMGRLEGGEKISFTNYMKFLIWKK

SEQ ID NO: 195775 - protein, 99 aa, Glycine max
  Coding DNA Sequence Number=SeqID_78997
  Subcellular localization annotation: CTP_CleavageSite=91; ConfidenceScore=5.31e-01
MAKGSLSLSVGLMQEAPPFHDGAIVSTSPSLYSRAPPSLPCCVGSDRVAPSSGPLMLGRVSLDPVPACRNLPFGGRATRDSRDACSTKGIRAESPPTFI

SEQ ID NO: 195776 - protein, 303 aa, Glycine max
  Coding DNA Sequence Number=SeqID_78998
  Gene Ontology: Mol. function=beta-pyrazolylalanine synthase activity; Cellular component=chloroplast; Biological process=cysteine biosynthetic process from serine
  Homolog annotation: Hit_ID=Q43317; Match level="QueryCoverage=98%, HitCoverage=78%, E-value=2e-86, Identity=56%"; Hit description =Cysteine synthase (EC 2.5.1.47) (Beta-pyrazolylalanine synthase) (Beta-PA/CSase) (EC ...
  Homolog annotation: Hit description=2.5.1.51) (L-mimosine synthase) (EC 2.5.1.52) (O- acetylserine sulfhydrylase) (O-acetylserine (Thiol)-lyase)
  Pfam annotation: Domain name=PALP; Domain location=1-280; Score =193.2; E_value=6.2e-55; Accession=PF00291.15; Description=Pyridoxal -phosphate dependent enzyme
MVFKSVLVEATSGNTGIGMAFVATLKGYKVIVAMPASVSLERKIVLRAFGAEVYLTDPAKGTDAVLRKAEEIVNNTPGSYMLRQIDNPANPKIHYETTGPEIWRDSGGKVDALVAGVGTGGTITGAGRFLKERNPNVKLYGIEPVESAVLSGGPPGDHLIQGIGNGLIPSVLDFNLLDEVIQKIYSNNLNIFRFYADISQTQLPINGSTLATVTRHFVKANKVCKLQISSEEAIETAKLLALKEGLLMGISSGAAAAAAIKLGKRPENAGKLIVVVFPSYGERYLSSPLFESIRHEAEQMTFD

SEQ ID NO: 195777 - protein, 399 aa, Glycine max
  Coding DNA Sequence Number=SeqID_78999
  Gene Ontology: Mol. function=exonuclease activity; Cellular component= intracellular; Biological process=regulation of transcription, DNA -dependent
  Homolog annotation: Hit_ID=Q9FQ04; Match level="QueryCoverage=86%, HitCoverage=37%, E-value=1e-150, Identity=72%"; Hit description=XRN4
  Pfam annotation: Domain name=XRN_N; Domain location=1-256; Score =548.4; E_value=7.4e-162; Accession=PF03159.8; Description=XRN 5'-3' exonuclease N-terminus
  Pfam annotation: Domain name=zf-CCHC; Domain location=255-272; Score =30.6; E_value=5.5e-06; Accession=PF00098.13; Description=Zinc knuckle
  Pfam module annotation: Pfam domain module=XRN_N::zf-CCHC; Domain location=1-256::255-272
MGVPAFYRWLADRYPLSIADAVEVDPSVAEDGVPLPIDASKPNPNGMEFDNLYLDMNGIIHHCFHPDGKPAPATYDDVFKSIFDYIDHLYSLVRPRKLLYLAIDGVAPRAKMNQQRSRRFRTAKDVAEAEAEEERLRKKFMSEGKVLSSKDKPETSDSNVITPGTQFMVVLSVALQYYIHTRLNHNSSWRNTKVILSDSNAPGEGGNKIMEYIWLQRNLPGFNRNTRHCLYRMDADLIMLSLATHEVHFSVLREDKCFLCGQVGHFAADCQAEDFDTPDDSSIHKKKYEFLNIWVLREYLQFELEIPNPPFEIDIERIVDDFVFLCFFVGNDFLPHMPTLEIRETTEIALHSNLKSSTFSTSIQQNPQMITLMRYQERYENDHPKEVSGSGICHCIPLS

SEQ ID NO: 195778 - protein, 62 aa, Glycine max
  Coding DNA Sequence Number=SeqID_79000
MGKNGTPTHGTWDTLIVKELGYFKYPAQRVLTIEVRHFELQVVITNFYRQSSGGPTALRMLT

SEQ ID NO: 195779 - protein, 523 aa, Glycine max
  Coding DNA Sequence Number=SeqID_79001
  Gene Ontology: Mol. function=RNA-directed DNA polymerase activity; Cellular component=chromatin; Biological process=chromatin assembly or disassembly
  Pfam annotation: Domain name=RVP_2; Domain location=155-273; Score= -60.2; E_value=0.049; Accession=PF08284.2; Description=Retroviral aspartyl protease
MTTPTTSFSNSNSDYLTDFEWLVNRIIGLALPFLLSCFISGLNPELHRVSSPAVDEDKLSNRHKGPRHSYSNVLLFASAIIAPSSPRIPFKQLSSKELVLHRDHGLYYHCEEKWVQGHHCKPHLQLFIADEDNDVLDKNPTLVLNHTSLSSPDLPTPQLSLNAMAGMPAPKTIHVYGTINHHCVLILVDGGSTHNFIRSHVAKFLGLPTTSTPLLHVMVGNGTMMDCTSSCPQVSVEIHDHRFVVDLYALPLSGTNLVLGAKQPTPPTSDNPSPSPKLTQLLHLFVKIFQEPNTLPPQRSITYLIQLLPNFVLVNGFHQIRVSDEDILKTVFHAHQGHYEFRVMPFGLCNASSTFQGEFYLRRSKCLFARNHLQNLGHIVFEKEVASNPEKIQAMVAWPRPSTTTELRGFLRLTGFYCRFIKGYTSIAGDNDPGSHTGLVEFHNSFHIGNRRFWASIYVRDLHVITSTIRIWRHYLLGNSFIILTDHKSLKDLMAQVIQAPEQQVYLFKLLGYNYTIEYKSDA

SEQ ID NO: 195780 - protein, 43 aa, Glycine max
  Coding DNA Sequence Number=SeqID_79002
MWVTGRLDGNERAMAASVIDCVTAESLPDTNKNSSEISPDKNL

SEQ ID NO: 195781 - protein, 60 aa, Glycine max
  Coding DNA Sequence Number=SeqID_79003
FGKSTLPRVVYENHKPRYQPEARRVERWDRVVGDCVVEIRGTEGGEAVYKGVVEGSENHV

SEQ ID NO: 195782 - protein, 145 aa, Glycine max
  Coding DNA Sequence Number=SeqID_79004
MLSRLVSWILSPSSSEEEEEILDIIKDNDINHENDQKFNVEDDKNDHFLNSCDVDDTIPIALAVPNASPAVTVAFPANDERNTVPTTATVATIVTRSKGQRNAKYSGMVRQYQRLWTKEDEMELLKGYLDYVKQHRKETNTLQNV

SEQ ID NO: 195783 - protein, 187 aa, Glycine max
  Coding DNA Sequence Number=SeqID_79005
LKRKHKLALEKGKDKEVPFRNPQEQAIFEISHKIWANDTDNIIVQDALDGDESGHTPESHDHVGNVKVKIEQVDNSDEIGNRVPKRLRLDDADDMNRTNDQNNGDSIQGFIEDTMRSCFSPLLKEVLDEAQEESLPELEAIPMPLCSGEVDHEQWRKRRILELEVYVKRLELLQNQIKSRLEELRSS

SEQ ID NO: 195784 - protein, 67 aa, Glycine max
  Coding DNA Sequence Number=SeqID_79006
  Subcellular localization annotation: CTP_CleavageSite=24; ConfidenceScore=5.27e-01
MVGAFSQNSMTLTGLPMILPSLGSSSSVESFASLRLMATEWRRTKDDWRCHFKEKMSQEQAHHHRKP

SEQ ID NO: 195785 - protein, 90 aa, Glycine max
  Coding DNA Sequence Number=SeqID_79007
DADEAPLDVSICLHAFGIVGCGSFSGVKSCEREDPFHPGLFVGDAGGFQSPTREPLNVGGLVPPHCSLKSVVSDDACPGACFVQRDATTL

SEQ ID NO: 195786 - protein, 74 aa, Glycine max
  Coding DNA Sequence Number=SeqID_79008
  Subcellular localization annotation: CTP_CleavageSite=25; ConfidenceScore=5.04e-01
IIGPNLGPWAQKSTLRFMRTLGPCSAALAQSSWSLLLMALVTGPFLWRIASGTPGDEDGAQEGEDMADVMAFFL

SEQ ID NO: 195787 - protein, 81 aa, Glycine max
  Coding DNA Sequence Number=SeqID_79009
  Homolog annotation: Hit_ID=Q1XVZ0; Match level="QueryCoverage=85%, HitCoverage=25%, E-value=1e-07, Identity=35%"; Hit description =Hypothetical protein precursor
MYAVPNVGPMPGIGKSFKNKNSIMYSGALEYSYDNAFAVRTGYFRESPEQGAREFATAALDNTLRFGLTWNIGDETSNVDN

SEQ ID NO: 195788 - protein, 145 aa, Glycine max
  Coding DNA Sequence Number=SeqID_79010
  Gene Ontology: Mol. function=argininosuccinate synthase activity; Biological process=amino acid biosynthetic process
  Homolog annotation: Hit_ID=Q7WKW7; Match level="QueryCoverage=86%, HitCoverage=28%, E-value=8e-61, Identity=92%"; Hit description =Argininosuccinate synthase
MSASWRTLGRAVCLTFLPMLRQRGAGGGEQAGLRVGEQLGAGVDDVEVAHGQLADAVGGGEGGVLDLFHRQALGGVGQVGRFGVQQRVVVAAAQFDGDFAGDGAGDPALGGFAQHDGLRVEPAALVQQATQLAAAFAVLLDGVFV

SEQ ID NO: 195789 - protein, 68 aa, Glycine max
  Coding DNA Sequence Number=SeqID_79011
MAATMKRERKKRLNGGGGEQREQSDEEDSKVFSRPISTIDLISYSVCQASLRNGGGTCKKDFNAQVSK

SEQ ID NO: 195790 - protein, 65 aa, Glycine max
  Coding DNA Sequence Number=SeqID_79012
MVSLKKEIEAKGPAQGQAGPMTRARARKAEETLQQVGQSITLVASSFGLSCIAGSGAFHLPSSDQ

SEQ ID NO: 195791 - protein, 160 aa, Glycine max
  Coding DNA Sequence Number=SeqID_79013
MAKKIKDGLLIKGKEGENHKELNWSMLKIDEQHAWAYSWKVNNVILEFASRTIRTKCPWLGLHHMVLMMSKRICLIMSVIIKKRENVNHGENVNVCIHDFDDAKEESNKVASKDKQCFKINTRLLQQTKPCFKISSRSSLASNQRVSKSSKALVIDYQTV

SEQ ID NO: 195792 - protein, 141 aa, Glycine max
  Coding DNA Sequence Number=SeqID_79014
  Subcellular localization annotation: CTP_CleavageSite=32; ConfidenceScore=5.23e-01
MEIGSIVYSTPLDGTFMKSATNASTFVILGIVVSTKSSLRETEWVGSKVRGFGEEVLAVSSNTSALVMVSDQGLSSDMDNGSSYFSTFLNQLPERMFDNIEVVPNVETIVFREISNPVARRSMYHGAKEDDMPNSPNPSIE

SEQ ID NO: 195793 - protein, 168 aa, Glycine max
  Coding DNA Sequence Number=SeqID_79015
MADLGGGFAKKRHRIAVAWRVWDGGAMAAAIAMAVVAVIAGWRKMAGFAWVLSAVGVGPTRSNPTRLCIQLNVVRRRTSPHLCVLPSPLRPSLTSASFPHPAAPSRRRDRRHPHSPRTQPPPPATPLHEDEGQLRASPGNAASRDRDRNTFLSREEDEEDEDADAVPF

SEQ ID NO: 195794 - protein, 365 aa, Glycine max
  Coding DNA Sequence Number=SeqID_79016
  Gene Ontology: Mol. function=zinc ion binding; Cellular component =integral to membrane; Biological process=ubiquitin cycle
  Homolog annotation: Hit_ID=Q1S3P0; Match level="QueryCoverage=92%, HitCoverage=90%, E-value=2e-92, Identity=54%"; Hit description=Zinc finger, RING-type; RINGv
  Pfam annotation: Domain name=PHD; Domain location=141-186; Score= -0.9; E_value=0.071; Accession=PF00628.19; Description=PHD-finger
  Pfam annotation: Domain name=zf-C3HC4; Domain location=142-183; Score= 35.9; E_value=1.4e-07; Accession=PF00097.15; Description=Zinc finger, C3HC4 type (RING finger)
  Pfam module annotation: Pfam domain module=PHD::zf-C3HC4; Domain location=141-186::142-183
MAAVVNPRTWIPYMNSKDCSQGFCSLYCPQWCYIVYPPPPPFEYPDDDSSPNFSPLVIAIIGILATAFLLASYYTLISKYCGPRESARRDPNDENLQDDLNHNSYLREHASIAGLDEAMIKSIAVFKYKKGSIGGSAGVTDCSVCLSEFEDDESVRLLPKCSHVFHAPCIDTWLKSHSSCPLCRAGIFTFTSSAAPPPQDEAEAPSRNQTTHHNESGGNEFGVVALQEEEEESMHHARAYPNPALRAFSDLSCFQLCKYLNHDHQYFQGRHRVIDIRDEVCESVGRSVSMDHSSFQSALSVADVLQMSEEEDATEAGPSKRSRGESSKCRYKTRVLHCVLSPISMKRSSFSSGRRFSVSKSGRGN

SEQ ID NO: 195795 - protein, 215 aa, Glycine max
  Coding DNA Sequence Number=SeqID_79017
MAIYREKTTLGAVEARPGDLNLNPEVMSLPRRAGCLAMKPFDGPGEPDASLGELGGKRAMKESVEAMPSMIILMMPKNQELSKFQRIRLQESSLKESRVKQALKNQESKSFKNQVSRIKNNQDQDSRLKIQESRENSIKIRYFLCGTSRGYIYLGCYTENKRGYISCGSVQVEGTSTWLFKENKGGYIPCGSLACKGFYKVERNLKYRWLPGDWM

SEQ ID NO: 195796 - protein, 87 aa, Glycine max
  Coding DNA Sequence Number=SeqID_79018
MGVPYGYPYLLLILTREVRWHAGVPYGYPRLHLILTREVRFYFRHPKTLKPDDAQDSSLLGRDNRVQYHVETSWLSRFITFKALKFC

SEQ ID NO: 195797 - protein, 123 aa, Glycine max
  Coding DNA Sequence Number=SeqID_79019
MEAMIEQMTTMMEVMMSMRKMMEVNTTTVIVISTTTEVDLTHPFGLNHVNHPVLGMAGQGGEALGSTSGPYFVQVPQPMGETHEVPQDNTLADFKPHLEYATEGQAFGGVPPPNTSGGPQYHP

SEQ ID NO: 195798 - protein, 81 aa, Glycine max
  Coding DNA Sequence Number=SeqID_79020
MSDMPFRGLKSARNQLHFLENAMNSLSEHAALSEFINTHWSFNSGNWSDSKVLNSAGLSCRAFTRNRGAISQLSMCVLMRS

SEQ ID NO: 195799 - protein, 155 aa, Glycine max
  Coding DNA Sequence Number=SeqID_79021
MRSFNGDFPPWRCSGRKRRRGERRRHPLGNKPWKKELHHQDEPWIRSLERMLQWRKRKRTSLNEKCMLLTSGRMTTNSQRNRSNNNNNNNNNNNVANTSTNNIGSNEQNQTNPPFGVSNEMTIGVNHANNDPKNISGKDAMRTQFQIVAIETSLP

SEQ ID NO: 195800 - protein, 114 aa, Glycine max
  Coding DNA Sequence Number=SeqID_79022
MYNAIITYIGLHCSEHWPGNYLKGIINSALKGLDDTSQSKSKAAARWIVLKCNRQKGSTECGYYVIHWMSTIILGTFKNNWEMYFNDARPWEPERLKALCIQWTKFYLKVKNET

SEQ ID NO: 195801 - protein, 115 aa, Glycine max
  Coding DNA Sequence Number=SeqID_79023
MGTTDIGLVYHGDTSCALAGYLDFDYAVDLDARRTMTRIRGEMRRHLLEDKPWKEKLHHQKSALDKKLTEEASMKEENERDRVMQSYPLRALDRRLQEDWARDAREGPTVLMSLK

SEQ ID NO: 195802 - protein, 75 aa, Glycine max
  Coding DNA Sequence Number=SeqID_79024
MASRKYLALVKEFYVNLHSFDGPSPKQARVRGHLVKIGADSLNTFLETPVVLAEGCPQITERLRLPYAYQVEGSF

SEQ ID NO: 195803 - protein, 69 aa, Glycine max
  Coding DNA Sequence Number=SeqID_79025
MESVSAFVHYDVDIIPSDKGIVFESPSDPKVITISEDILFAALRKIIFDTMKVMVVLHMTVWSSNTTMM

SEQ ID NO: 195804 - protein, 50 aa, Glycine max
  Coding DNA Sequence Number=SeqID_79026
MAATSALLGEGEVDLVKVEKEGLRKVKVDLPWLVPPTSVEKILQTQDPKD

SEQ ID NO: 195805 - protein, 61 aa, Glycine max
  Coding DNA Sequence Number=SeqID_79027
MEAFKDRFNPKMKKNHISNGMFFIEILRLARVEDVQKHIKKKVKKEVIETPLSDAHHIVGT

SEQ ID NO: 195806 - protein, 114 aa, Glycine max
  Coding DNA Sequence Number=SeqID_79028
MAPPRKNESSGIPTIDNVEDSLQAFPEGWFIPGKWINFQNLKKEGFDMKGLFHRELLGKLYGPYALQPPLLLHLDMLWMEVFDKLFYGKPYPNGGDKKALNTFLRTINLTYLCR

SEQ ID NO: 195807 - protein, 103 aa, Glycine max
  Coding DNA Sequence Number=SeqID_79029
METEQHLPQQSPPIVASMHDEGLQPHAQSYEFMPQPHHHQEDYGYNPQFFSASEEDFMSNLMGTNLQTLDSTYAYMQSMLIPSFASFHQSIVGNSSTNDLIQE

SEQ ID NO: 195808 - protein, 357 aa, Glycine max
  Coding DNA Sequence Number=SeqID_79030
MSEKELQKTYFDARVQSAMETSVYILPVVSAERDVELQLALVQDTIAKEEREALDDPTLHFVIEVSLQGFDVVVGSDTIETNPGVAPLHPYPVTTKDEVVVDAMLAQPISEANISRLESIYGAIELVPFHAKKFRLEIKKRVEIVVPQLLTNIFNKLHQRLSRLDGDLIEWLLPLRSQPQTELELVSTLDKNVSLYHGFKGYRLSEGQTRNQAWRENMDIGTQHLDPEIKSHKGISFKVSLSSNLNNIIFEHIPSDRKVCPPRITVWRSREVASDEMPFSTHLDLQQLLGLMATFNVVLPWNHAQSGESLYIEDIYLEDLEMSPTFSNWDFFYYSPQLRLCLNQYKEEIKARRASFR

SEQ ID NO: 195809 - protein, 118 aa, Glycine max
  Coding DNA Sequence Number=SeqID_79031
  Gene Ontology: Mol. function=DNA binding; Biological process=DNA integration
  Homolog annotation: Hit_ID=Q1SUE2; Match level="QueryCoverage=51%, HitCoverage=8%, E-value=4e-14, Identity=77%"; Hit description =Integrase, catalytic region
MAFVSLLLEVTMELSLKIELRSFCEKNDIFHNFSSLRTPLQNGVVERKNRTLQEMARTMLYEKNLVLEESIHVKFNDGLTSNKKLSDLEEDFADMQIGSFVTPKEREIKKSDEILPHT

SEQ ID NO: 195810 - protein, 237 aa, Glycine max
  Coding DNA Sequence Number=SeqID_79032
  Gene Ontology: Cellular component=integral to membrane; Biological process=response to antibiotic
  Homolog annotation: Hit_ID=Q39PL0; Match level="QueryCoverage=94%, HitCoverage=32%, E-value=1e-47, Identity=46%"; Hit description =Fusaric acid resistance protein
MSRGWLSRLIDELRPSDSRINLVIRALLSSAIAIVISQTLQVPWLALSLIAVFFITQSNIVITRAIGILFFVSSTLAIGAAILVLKFTYDYPMLRILLSSALFFLSVFLMRVTKVGVLFFLMALVVIYTQSFVDLTPQAEVVIRLVLWVWVAIKYAILLTLIVNTLLLPAEPLKQLKGRMIAVLDETRAMLAHGGETRDLSAISQHATELHKLLRFSVMRSDRCRANEPGYLALITL

SEQ ID NO: 195811 - protein, 208 aa, Glycine max
  Coding DNA Sequence Number=SeqID_79033
  Gene Ontology: Mol. function=RNA-directed DNA polymerase activity; Cellular component=beta-galactosidase complex; Biological process =DNA integration
MDVKNAFLQGELEEEVYMKPPPGLEDHNAPGKVFKLKKAIYGLKQSPRAWYHKLSTTLLERGFKKSEADNTLFTLPSKEGIVVILVYVDDIIISGNDKVGIQETKTFLKSVFDIKDLGELKYFLGIEVCRSKEGLFLSQRKYTLDLLSQVGKLGAKPAKTPLEDEYKANRKGELDNKPFEDVTQYRRLVGKLIYLTITRPDICFAVNV

SEQ ID NO: 195812 - protein, 143 aa, Glycine max
  Coding DNA Sequence Number=SeqID_79034
  Homolog annotation: Hit_ID=Q9AVH2; Match level="QueryCoverage=32%, HitCoverage=16%, E-value=3e-20, Identity=97%"; Hit description =Putative senescence-associated protein
  Subcellular localization annotation: CTP_CleavageSite=32; ConfidenceScore=5.15e-01
MARHKAQGGGGAWSSVRPGTHLVSTRQAKRERADERKATLPLTIPRRVFKSSARILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 195813 - protein, 170 aa, Glycine max
  Coding DNA Sequence Number=SeqID_79035
MTIGKFDFSAHDARQLVCTNNADMTGRLLSILLPRSSNLAQVSEEDLIIMWAFHTGRQLDWAHLRSFLIGVVVIASFGYRKDHDGSWVKKGAQPADEEGNLPVEDNSTLLRRLMDKFDGLQTFVGDKFDAMELQVDMRFDAMESRITKVEEDVSFIRTCFDPPPPPPSSS

SEQ ID NO: 195814 - protein, 101 aa, Glycine max
  Coding DNA Sequence Number=SeqID_79036
  Subcellular localization annotation: CTP_CleavageSite=79; ConfidenceScore=5.42e-01
MPKWLSAQTITINPDPGSQVASGGTVWLSAPFVNQGKTSLLTRKDLRRLLHLLSSRDSELGGRQRYLMKVRTFPQPRRTSSMVFTLVVRRHSSPTTHEILL

SEQ ID NO: 195815 - protein, 477 aa, Glycine max
  Coding DNA Sequence Number=SeqID_79037
  Subcellular localization annotation: CTP_CleavageSite=8; ConfidenceScore=5.00e-01
GVTFYGCQGASPSHYDPPTSLFGSVRRVGGDGDERLSPRVCPSMNVGSVLCAPVIVGYEWVRDSVEVQVHLDIEGGPGVGCHSTLDYFSVCSAGALECGPFLASPKQLGDGALAIDVVDDGMPLMFNRDMEPRFPFYWQSDPTRFKLYDEDLLTLVERVGKAILEYYGGGQPVGKVGPIAIAAEIIPNAPSSVLVKRKRDDAIRSSGRKNPPAPPVVDSPIEAASLAILAPSPSSIVDVVQGAAAATAMVPPSTVVAPLLSVSVATTSASTMPPLSSTLAALPDVVFAAMAGAEDPDWLCVSLQHKPYKEFGHSGREWTVTLGGSVEDCILRGKGEPSTAFQGWRCFGQTVAHPAEKLDLGGKVKSMTTENEGLAKRIAELEAQLRESESKLEDFELQVAKERKVNKELEVELLLYKKEVGYFVKDLDLGLFDPFKDVKEDVLLDEEEIGVKEEKAAHERKQDLVGVEVGSWWSCKE

SEQ ID NO: 195816 - protein, 140 aa, Glycine max
  Coding DNA Sequence Number=SeqID_79038
  Subcellular localization annotation: CTP_CleavageSite=67; ConfidenceScore=5.37e-01
MSWVQGSTNQRSTLGEAFSITNFHPHENSRNTGLLKTQATTTTTIKGPSSTKRTTTPLFDKPFNQVEAHTHSSPPDCMTRPSIRCSSHSLPMTIRGGTKQIKQPIPTLVRQDLQPGGQVKHNSLQPPGEKLYTTEGSTTR

SEQ ID NO: 195817 - protein, 45 aa, Glycine max
  Coding DNA Sequence Number=SeqID_79039
MASRASGASVKFLKTLGINEALSLIRILVVDFERANKATFTLVNF

SEQ ID NO: 195818 - protein, 271 aa, Glycine max
  Coding DNA Sequence Number=SeqID_79040
  Gene Ontology: Mol. function=2,5-didehydrogluconate reductase activity; Cellular component=cytoplasm; Biological process=L -ascorbic acid biosynthetic process
  Homolog annotation: Hit_ID=Q8ZI40; Match level="QueryCoverage=89%, HitCoverage=97%, E-value=1e-101, Identity=68%"; Hit description=2,5 -diketo-D-gluconic acid reductase A
  Pfam annotation: Domain name=Aldo_ket_red; Domain location=32-259; Score=321.5; E_value=1.5e-93; Accession=PF00248.11; Description =Aldoketo reductase family
MAGESGKIFAGLHRAKVPFGCHNDPQQPRIKLHDGNMMPQLGLGVWQASIDEARNAVLEALKVGYRSIDTAAAYKNEEAIGQALQETDVARDEIFITTKLWNDDQQNVEQAMETSLKKLQLEQVDLVLAKSIGVCNFHEAHLKRLIDETGVSPVVNQIELHPMLQQRTLHAWNALHQIQTESWSPLAQGGEGVFDQEIIRELAKKYSKTPAQIVIRWHLDSGLVVIPKSVTPARIQENFQVFDFRLDKSEVSEIAKLDKGKRLGPDPEEFN

SEQ ID NO: 195819 - protein, 152 aa, Glycine max
  Coding DNA Sequence Number=SeqID_79041
  Gene Ontology: Mol. function=sequence-specific DNA binding; Cellular component=intracellular; Biological process=regulation of transcription, DNA-dependent
  Homolog annotation: Hit_ID=Q83Q58; Match level="QueryCoverage=91%, HitCoverage=37%, E-value=3e-34, Identity=52%"; Hit description =Putative ARAC-type regulatory protein
  Pfam annotation: Domain name=AraC_N; Domain location=39-152; Score =78.2; E_value=2.7e-20; Accession=PF06719.3; Description=AraC-type transcriptional regulator N
MRHTAFFAARESAMPNDALCRQLAQRVITLMREPQKPLCAVENVRLIYAEEPLPRTPMLYPAGIVILFQGHKTGYLGSTVFRYDATKYLMLTVTLPVECETDATPQQPLAGMSLTVDPASLQDLLLSIGDDEQFQPQPQTSGIHSAFLSEEM

SEQ ID NO: 195820 - protein, 580 aa, Glycine max
  Coding DNA Sequence Number=SeqID_79042
  Gene Ontology: Mol. function=tetracycline:hydrogen antiporter activity; Cellular component=integral to membrane; Biological process=tetracycline transport
  Homolog annotation: Hit_ID=Q6D171; Match level="QueryCoverage=76%, HitCoverage=99%, E-value=0.0, Identity=81%"; Hit description =Probable glucarate transporter
  Pfam annotation: Domain name=MFS_1; Domain location=154-538; Score =235.3; E_value=1.3e-67; Accession=PF07690.6; Description=Major Facilitator Superfamily
  Pfam annotation: Domain name=Sugar_tr; Domain location=151-572; Score= -74.5; E_value=0.00015; Accession=PF00083.14; Description=Sugar (and other) transporter
  Pfam module annotation: Pfam domain module=MFS_1::Sugar_tr; Domain location=154-538::151-572
MLSQLQTVIKAAACGQSLIVDHYRHVGSLLTFRFVAPVIAPQYKQGYWPTHCATDWLCAAIGAQFAIWRLDGGFREPRRSVMGKCHKIVPDWGLSSGVPPVFRGDAVPILIAVLQLRVNVAFAIFQECIMNSYSQTAAAVQKRTNARYWIVVMLFIVTSFNYGDRATISIAGSAMSKEIGLDSVGLGYIFSAFSWAYVIGQIPGGWLLDRFGSKRVYFWSIFLWSLFTLLQGFVDIFSGFGIVVSLFLLRFMVGLAEAPSFPGNSRIVAAWFPAQERGTAVAIFNSAQYFATVIFAPIMGWLVAEVGWAHVFWFMGGLGIILSFIWLKVIHDPNDHPGVNKAELEYMEQGGALINMDAKKAERKVSWDEKWFQIKQLLSTRMMWGIYLGQYCVNALTYFFITWFPVYLVQARGMSILKAGMIASIPAICGFLGGVLGGVISDYLMRKTGSLNIARKTPIVIGMLLSISMVMCNYTETEWVVVLFMALAFFGKGIGALGWAVMADTAPKEISGLSGGLFNMFGNISGIVTPIAIGYIVGTTGSFNGALIYVGVHALVAVLSYLVLVGDIKRVELKPVEERG

SEQ ID NO: 195821 - protein, 94 aa, Glycine max
  Coding DNA Sequence Number=SeqID_79043
MFSTNKHWWRLRAFSSFGRHTREPRFARPQKAPTGLSKKGALYPGPWESKEWRWIYGHARSSTCLIVVKPRLELSLFIMCCRWYSIPPQYYYLE

SEQ ID NO: 195822 - protein, 296 aa, Glycine max
  Coding DNA Sequence Number=SeqID_79044
  Gene Ontology: Mol. function=protein binding; Cellular component =membrane; Biological process=defense response
  Homolog annotation: Hit_ID=Q1SW22; Match level="QueryCoverage=95%, HitCoverage=34%, E-value=5e-43, Identity=39%"; Hit description =Disease resistance protein; AAA ATPase
  Pfam annotation: Domain name=NACHT; Domain location=117-241; Score= -30.3; E_value=0.013; Accession=PF05729.3; Description=NACHT domain
  Pfam annotation: Domain name=NB-ARC; Domain location=80-296; Score =19.7; E_value=1.5e-11; Accession=PF00931.13; Description=NB-ARC domain
  Pfam module annotation: Pfam domain module=NACHT::NB-ARC; Domain location=117-241::80-296
MEDVIDEYNISGEDEQPDDPRCAAVLCEAVAFIKTQILRLQSAYKIQDVKSLVRAERDGFQRHFPLEQRPTSSRGNQDVTWKNLRRVPLFIEEDEVVGLDNDRATLKNWLTKGREKRTVISVVGIAGVGKTTLAKQVYDQVRNNFECHALITVSQSYSAEGLLRRLLDELCKLKKEDPPKDVSNMESLIEEVRNRLRNKRILITTRDEKVAGYCRKSSFVEVHKLEKPLTEEESLKLFCKKAFQNSSNGDCPEELKDISLQIVRKCKGLPLAIVVIGGLCLKKMKMHLNGDSLVEI

SEQ ID NO: 195823 - protein, 70 aa, Glycine max
  Coding DNA Sequence Number=SeqID_79045
MTSYGGELLLDYLLLEVASPIILLLLHSAAIKIYEAKDSIDEEDQGLQAPVELHHVVLSFFSHNIFVLNL

SEQ ID NO: 195824 - protein, 93 aa, Glycine max
  Coding DNA Sequence Number=SeqID_79046
MRCLPWSLPEWRTLADGGHPAQGTPSCLCNRQNGSTEYGYYVMHWMSTIILGSFRNNWEVYFNDPRPLEPERLKALRIQWTQYSLELELRARI

SEQ ID NO: 195825 - protein, 127 aa, Glycine max
  Coding DNA Sequence Number=SeqID_79047
MSEIEEVQEQMKADLEAMKEQMTAMMEAMMSMRRMMEVNMAIVVAASTATKVDLTHPFGLNQVNRPVSDMVGQGGEALGSMGGLHFVQVQSKHSFPPYGLPPNYTPPNVTHALNENVDNSVPIPIES

SEQ ID NO: 195826 - protein, 120 aa, Glycine max
  Coding DNA Sequence Number=SeqID_79048
MVFQNLMQRKDRSYKKYDMLRQLLTYHLYSKNRVSYAQSKEQHLPMNSFFSKQHINVFLRRHHNKCNRYSSISNKHIYTGDAILSRKGPVTRTMSKRLQEDWARATEEGPRVLMNLRVDF

SEQ ID NO: 195827 - protein, 49 aa, Glycine max
  Coding DNA Sequence Number=SeqID_79049
MAGGNLPTTKCKGYRGMPPNACPSVAYPRGGSNAAKVWSRGTLCVSPMG

SEQ ID NO: 195828 - protein, 76 aa, Glycine max
  Coding DNA Sequence Number=SeqID_79050
  Subcellular localization annotation: CTP_CleavageSite=52; ConfidenceScore=5.13e-01
MPNTGQHLSILGGLTNSSPSACQDYYPRHQTDSLNMGQAPSTSPLLSKALLQANVEVRTPLSHVHLDVPRFRILSN

SEQ ID NO: 195829 - protein, 54 aa, Glycine max
  Coding DNA Sequence Number=SeqID_79051
MRQATTTCGGHWWSWVVKEEGVSVSLSSFPFELGIMLSMPILLSEFPSQVGNCA

SEQ ID NO: 195830 - protein, 97 aa, Glycine max
  Coding DNA Sequence Number=SeqID_79052
MTQPLQISLVSNKQQGGDKKAGSQGKKKKACITWEENAFNTSSESSNEEEANLCLMVDGEADSAALEESSCNNKTISTSPPSQCEMCKALRSKMSTY

SEQ ID NO: 195831 - protein, 613 aa, Glycine max
  Coding DNA Sequence Number=SeqID_79053
  Gene Ontology: Mol. function=transporter activity; Cellular component= integral to membrane; Biological process=auxin mediated signaling pathway
  Homolog annotation: Hit_ID=Q8GV76; Match level="QueryCoverage=99%, HitCoverage=96%, E-value=0.0, Identity=75%"; Hit description=Auxin efflux carrier protein
  Pfam annotation: Domain name=Mem_trans; Domain location=9-613; Score =729.3; E_value=2.5e-216; Accession=PF03547.8; Description=Membrane transport protein
MITWKDLYMVLTAVVPLYVAMILAYGSVRWWKIFSPDQCSGINRFVAIFAVPLLSFHFISTNNPYAMNFRFIAADTLQKIIMLFALAIWTNLTKTGSLEWMITIFSLSTLPNTLVMGIPLLIAMYGEYSGSLMVQVVVLQCIIWYTLLLFLFEYRAAKILIMEQFPETAASIVSFKVDSDVVSLDGRDFLETDAEVGDDGKLHVTVRKSNASRRSFMMTPRPSNLTGAEIYSLSSSRNPTPRGSNFNHADFFSMMGYQPRHSNFTANDLFSSRGPTPRPSNFEESSMPQAATVASPRFGFYPSQTVPASYPPPNPEFSSSTKHLKSQSQNSLTPANGAHDAKELHMFVWSSSASPVSENAGLNVFGNTELGTSQQPDQGGAKEIRMLVADNHAHLQNGEANNKGGLEAGLDVEEFKFPVNGGEQVEEEKEKEKEGLNNGLNKLGSSSTAELHPKAAGAAEAPASKHMPPASVMTRLILIMVWRKLIRNPNTYSSLIGVVWSLIAFRWHVHMPKIIEKSISILSDAGLGMAMFSLGLFMALQPKIIACGNSVATFAMAIRFLTGPAVMAAASIAVGLRGTLLHVAIVQAALPQGIVPFVFAKEYNAHPAILSTA

SEQ ID NO: 195832 - protein, 95 aa, Glycine max
  Coding DNA Sequence Number=SeqID_79054
MEKSDKRNFKEKKAYITWEDNDMDSSSDSENEIINLGLMAKDYESEEEGFDEAKVESNNKVVPTNIQRLSITSRIIQGQSKQDQEKDKASNNLIG

SEQ ID NO: 195833 - protein, 74 aa, Glycine max
  Coding DNA Sequence Number=SeqID_79055
  Gene Ontology: Mol. function=boron transporter activity; Cellular component=integral to membrane; Biological process=response to boron
  Homolog annotation: Hit_ID=Q9SV84; Match level="QueryCoverage=97%, HitCoverage=25%, E-value=6e-10, Identity=48%"; Hit description =Probable aquaporin NIP5.1
MPESETGTPTAASVPATPDTPGGPLFTSLRVDSLSHERDSFAMARCKCLPTKGHICFTDFSVGVPLPNVSLTQK

SEQ ID NO: 195834 - protein, 41 aa, Glycine max
  Coding DNA Sequence Number=SeqID_79056
MVLINKSELYSYMKKISHKSQALKLLSQDKVCLHLVGAGCC

SEQ ID NO: 195835 - protein, 241 aa, Glycine max
  Coding DNA Sequence Number=SeqID_79057
  Gene Ontology: Mol. function=inositol or phosphatidylinositol phosphatase activity; Biological process=abscisic acid mediated signaling
  Homolog annotation: Hit_ID=Q5VRY7; Match level="QueryCoverage=86%, HitCoverage=51%, E-value=5e-30, Identity=46%"; Hit description =Putative inositol polyphosphate 5-phosphatase
ADKPITDEEALNTNLQASVAADIANTGEPVGNDLQRQFSDGKRLNRLNCFRDENSTEKTDTSSSQQASKLSRMISSSDRIGLSWPEPPLHLLSQRPLDRPTSFKSVRSFSASKSFRTCQTFKQTIDDIGLLAEIDLEALMKRKRRSSYVRIVSKQMVGIFITIWVRRCLRKHIQNLKVSTVGVGVMGYIGNKLTKELEKGVFDGWSEGKLNFPPTYKYEINSEKYYGEDPKVGRRTPSWYA

SEQ ID NO: 195836 - protein, 74 aa, Glycine max
  Coding DNA Sequence Number=SeqID_79058
MNIIYSLLNCGEIFRVSTCTTTEEMWDLIQVIDEESKDLTSITHAMLFGKLREYEMDMTRMDEKEAKERKSKGL

SEQ ID NO: 195837 - protein, 83 aa, Glycine max
  Coding DNA Sequence Number=SeqID_79059
MKMKANKIRNELKVSDLNTCWWKTEERTKNGQRTVKNDGKSSRICSRKRLESVTEAPRLGFSSRNTFFSPKTTEMDSIGVRDP

SEQ ID NO: 195838 - protein, 244 aa, Glycine max
  Coding DNA Sequence Number=SeqID_79060
  Gene Ontology: Mol. function=phosphatidylglycerophosphatase activity; Cellular component=integral to membrane; Biological process=lipid metabolic process
  Homolog annotation: Hit_ID=UPI00005F7AE5; Match level="QueryCoverage =64%, HitCoverage=95%, E-value=3e-81, Identity=86%"; Hit description =COG1267: Phosphatidylglycerophosphatase A and related proteins
FGKSLYEETEGIDAIIAERVASLADERGVSRAQIALAWLLNKPAVSAPIVGASRSEQLDDAIAAVDLSLSPQEVAELETAYVPHRVDDAGRQHAGDDIVDHDAHAAMHVAVEPADRPRLPHVENAEDNETGGDPAPVVDRQRHQRDPHADELVPDDAAVIVHLHVFCRAVANIDADADAEHHRQRVELPRQLDQQQPKRDRRQRSHGARHHRRQTAAKPGGQQVPRIAHPQPALGFIHGCPAPR

SEQ ID NO: 195839 - protein, 129 aa, Glycine max
  Coding DNA Sequence Number=SeqID_79061
MGLPPPFLLSCFIFELSLDILCEVQALPPLSLVQAAALAKLQEDKLFYARHGLRFWLPVSPITKTTFKKLTPAEMASHREKGLCYNCDECYGPNHHCHAKFFLLIASKEDYPIDPTPTTDPEPSSPIAL

SEQ ID NO: 195840 - protein, 129 aa, Glycine max
  Coding DNA Sequence Number=SeqID_79062
  Gene Ontology: Mol. function=RNA-directed DNA polymerase activity; Biological process=RNA-dependent DNA replication
MVLGVTWLKLLGPITIDYSHLTMSFVWNSNVVSLQGCLGPGPTEATHGQVKRLLDTDHVTSFSHIHLRDMTTSSGTSTMPTLPKLRSLLSRYSPIFQQHSSLPLPRPTDHTIHLVLNSQPMNVRPYRYP

SEQ ID NO: 195841 - protein, 87 aa, Glycine max
  Coding DNA Sequence Number=SeqID_79063
CITVLVPDRVAQVLNLNLDGVVGGGHKQQHKPRFIGENGSAVSRVRSNNYNNNNHYGYSHHQKRNNMKLQQPQVVNHEIQLPQEWTY

SEQ ID NO: 195842 - protein, 115 aa, Glycine max
  Coding DNA Sequence Number=SeqID_79064
  Gene Ontology: Mol. function=inositol or phosphatidylinositol phosphatase activity; Biological process=abscisic acid mediated signaling
  Homolog annotation: Hit_ID=Q84MA2; Match level="QueryCoverage=50%, HitCoverage=10%, E-value=7e-11, Identity=52%"; Hit description=Type I inositol-1,4,5-trisphosphate 5-phosphatase 1
MKIGKVGTGMNFIRIWKLSIMFRYFCDLPQFEYAEWGKRTRFGDSREELAPIESNEFLPRLRRQKSLTSRSQYINKKELRVCVGTWNVGGKLPPDDLDIDDWLGINEPADIYVLG

SEQ ID NO: 195843 - protein, 112 aa, Glycine max
  Coding DNA Sequence Number=SeqID_79065
  Gene Ontology: Mol. function=RNA-directed DNA polymerase activity; Biological process=RNA-dependent DNA replication
MCKKEHKSFKEYAQRWRDLAAQVAPSMIEKEMITMIVDMLSVFYYEKMVGYMPSSFVDLVFAGERIEVGLRRGKFDYSALMNRKPGANGENKKEGETHVVVAIPTWSNFPLA

SEQ ID NO: 195844 - protein, 70 aa, Glycine max
  Coding DNA Sequence Number=SeqID_79066
  Homolog annotation: Hit_ID=Q2UY13; Match level="QueryCoverage=71%, HitCoverage=3%, E-value=5e-20, Identity=88%"; Hit description =Nucleoporin
DSIEGAGEQNEEAIMKVTSHLLSIAKRHGCYKVMWTICCDVNDSELLRNIMAFANCNDDFLSISTQIFCY

SEQ ID NO: 195845 - protein, 91 aa, Glycine max; identical to SEQ ID NO: 158188
  Coding DNA Sequence Number=SeqID_79067

SEQ ID NO: 195846 - protein, 221 aa, Glycine max
  Coding DNA Sequence Number=SeqID_79068
  Gene Ontology: Mol. function=oxidoreductase activity; Cellular component=mitochondrion; Biological process=fatty acid biosynthetic process
  Homolog annotation: Hit_ID=Q1LFB7; Match level="QueryCoverage=99%, HitCoverage=71%, E-value=2e-46, Identity=48%"; Hit description =Alcohol dehydrogenase, zinc-binding
  Pfam annotation: Domain name=ADH_N; Domain location=27-113; Score =55.7; E_value=1.6e-13; Accession=PF08240.2; Description=Alcohol dehydrogenase GroES-like domain
  Pfam annotation: Domain name=ADH_zinc_N; Domain location=144-221; Score=13.3; E_value=0.00087; Accession=PF00107.16; Description=Zinc -binding dehydrogenase
  Pfam module annotation: Pfam domain module=ADH_N::ADH_zinc_N; Domain location=27-113::144-221
MKAALIDTFGTADVLTIGERQLRAASPDEVTVQVEAASVNPLDVKIISGHMQQVFPVDLPYVPGMDFCGVITAAGERVSHLKPGDRVFGRTPPGAGGAFAQSLVIAADDVCLVPAAMSAEQAAALPTAFGSAQQALFDVGQLQRGERVLIHAAAGGVGSMAVQLAHQAGAYVIATASAKNHALVTSLGADEVIDYRTQDFAATRDIDLVIDSVGGETLSRS

SEQ ID NO: 195847 - protein, 88 aa, Glycine max
  Coding DNA Sequence Number=SeqID_79069
SGSADVVFIRITTWGISACHLTHGSGLTDVVFVQITIWGISACHLMHGSGSTDVVFVRTLRSLDSKSVWADNHRVSLHATGLTGHDSK

SEQ ID NO: 195848 - protein, 164 aa, Glycine max
  Coding DNA Sequence Number=SeqID_79070
  Gene Ontology: Mol. function=zinc ion binding; Cellular component =endoplasmic reticulum; Biological process=protein palmitoylation
  Homolog annotation: Hit_ID=Q5N9N4; Match level="QueryCoverage=95%, HitCoverage=54%, E-value=4e-58, Identity=63%"; Hit description=Zinc finger DHHC domain containing protein 2-like
  Pfam annotation: Domain name=zf-DHHC; Domain location=1-30; Score =7.4; E_value=5.3e-05; Accession=PF01529.11; Description=DHHC zinc finger domain
MDHHCIWINNCVGHANYKVFFIFVLYAVIACIYSLVLLVGSLASDSIQDEEKNGRSSFRTVYVVSGLLLVPLSIALCVLLGWHIYLILHNKTTIEYHEGVRALWLAEKGGSIYKHPYDLGPYENLTFVLGPNILSWLWPTANHIGSGLRYRTIYDLPKGASTSK

SEQ ID NO: 195849 - protein, 60 aa, Glycine max
  Coding DNA Sequence Number=SeqID_79071
MSWDFTSSASEDVRREEIDICKNGALEIKIYKTERMGECGMHSKRQGDKGGTRHHTTREK

SEQ ID NO: 195850 - protein, 190 aa, Glycine max
  Coding DNA Sequence Number=SeqID_79072
MAEDPFSFHPFFNSLNPKVKVRVPEQEEELVHPENNSGTWMFSKLIELLYFKEEKNQNQNECPPSISESTKACTQHVETGVDFDDVSTSTGLFKSINRVGESPKVNARACSVIRPRAVLSSPENDGLIGSINDLNHSVSSAHRKNNAKVKIEGQAKVLSIQVKEGKYSDKEECEAFNKGRTPSKVHVRNF

SEQ ID NO: 195851 - protein, 105 aa, Glycine max
  Coding DNA Sequence Number=SeqID_79073
  Gene Ontology: Mol. function=RNA-directed DNA polymerase activity; Cellular component=chromatin; Biological process=RNA-dependent DNA replication
MEDSKPIAYFSEKRSGATLNYPTHDNELYAMARTSQNQHYLWPREFIIHYDHQSLKFSKTQGNLQKIHAKWFNFIEMFQYMIKYKNGKKNVVANALSRRYDGVLE

SEQ ID NO: 195852 - protein, 503 aa, Glycine max
  Coding DNA Sequence Number=SeqID_79074
  Gene Ontology: Mol. function=sugar porter activity; Cellular component=integral to membrane; Biological process=carbohydrate transport
  Homolog annotation: Hit_ID=Q10710; Match level="QueryCoverage=79%, HitCoverage=76%, E-value=1e-164, Identity=73%"; Hit description =Sugar carrier protein A
  Pfam annotation: Domain name=DUF81; Domain location=79-345; Score= -73.6; E_value=0.086; Accession=PF01925.9; Description=Domain of unknown function DUF81
  Pfam annotation: Domain name=MFS_1; Domain location=1-396; Score =72.8; E_value=1.1e-18; Accession=PF07690.6; Description=Major Facilitator Superfamily
  Pfam annotation: Domain name=Sugar_tr; Domain location=1-436; Score =372.7; E_value=5.7e-109; Accession=PF00083.14; Description=Sugar (and other) transporter
  Pfam module annotation: Pfam domain module=DUF81::MFS_1::Sugar_tr; Domain location=79-345::1-396::1-436
MDDFLIEFFPSVYRQKKHAHENNYCKYDNQGLAAFTSSLYIAGLVASLMASPVTRKYGRRVSIIGGGISFLIGSALNASAVNLIMLILGRVMLGVGIGFGNQAIPLYLSEMAPTHLRGGLNMMFQVATTFGIFTANMINFGTQKIKPWGWRLSLGLAAVPALLMTVGGIFLPDTPNSLIERGLAEKGRKLLEKIRGTKEVDAEFQDMVDASELAKSIKHPFRNILERRYRPELVMAIFMPTFQILTGINSILFYAPVLFQSMGFGGDASLISSALTGGVLASSTFISIATVDRLGRRVLLVSGGLQMITCQIIVAIILGVKFGADQELSKGFSILVVVVICLFVVAFGWSWGPLGWTVPSEIFPLEIRSAGQGITVAVNLLFTFIIAQAFLALLCSFKDRNGTRIGTQPVRGSQNQIETFVVAAAGLGAERLASLEDLDMAHDEVRAGAFHHHAGAVAVVEPPPASLMELGTRHRGGLEDNRGSGEERFPLEGNQGVMHYGGN

SEQ ID NO: 195853 - protein, 102 aa, Glycine max
  Coding DNA Sequence Number=SeqID_79075
MVGGEKEWSRNQRLSEENVRKTKKRFANFENKGSGVVYAWGSASASLFFFFLPVPSFFFPSKLSEPPKPFPYMAIYRKNHLGQGQLAQASWLLHPEGISSPR

SEQ ID NO: 195854 - protein, 81 aa, Glycine max
  Coding DNA Sequence Number=SeqID_79076
MVRELTCLTLLLLTGSETIIFGVESLGINIRCTWHRECCFPGKIIFPGYERRTQPYNQHLSGTDVRGDHDGLILAKIKEYK

SEQ ID NO: 195855 - protein, 143 aa, Glycine max
  Coding DNA Sequence Number=SeqID_79077
MGDETGYRWGGRSIVHMEGRHIRVGRMFHGGGIPWSERNVERDAFCERKKKLTMWEDLKRRMMARNTTHCCLIGDFNCLRSQHETQGKGESSYKVGEAVEFNEFIDDIELIDIPLSYPNFVRGPLLDDMRPFFGPCEVLGTHH

SEQ ID NO: 195856 - protein, 370 aa, Glycine max
  Coding DNA Sequence Number=SeqID_79078
  Gene Ontology: Mol. function=transferase activity; Cellular component= cytoplasm; Biological process=protein modification process
  Homolog annotation: Hit_ID=Q6K8N9; Match level="QueryCoverage=92%, HitCoverage=88%, E-value=1e-94, Identity=53%"; Hit description =Glutathione S-transferase C-terminal domain-containing protein-like
  Pfam annotation: Domain name=GST_C; Domain location=248-343; Score =31.2; E_value=3.6e-06; Accession=PF00043.15; Description=Glutathione S-transferase, C-terminal domain
  Subcellular localization annotation: CTP_CleavageSite=26; ConfidenceScore=5.56e-01
MASCTCSSSLLLVNPPPSTSRHHAIRRNLRMSLNNNDSKLNPSSLLNSVTKLLWGQSLPPGLLVATVRTAWNSTWHLMMSQLAPSDSSGGYSRPASKFRFSSTTPSQGSSLHLYVGLACPWAHRTLIVRALKGLEDAVPVSVASPGLDGSWEFKRAGGPDTNTIAPSLDRANGCNTLKEVYRLRRGGYDGRSTVPMLWDKGSKDVVCNESYDIIHLFNSELNSVAQNPGLDLSPPQLKKQTEEWYQIIYPNVNNGVYRCGFAQSQEAYDRAVNDLFSTLDKLEDHLANSRYLCGDTLTLVDICLFTTLIRFDLAYNVLFKCTKKKLCEYTNLHAYMRDIYQGALDPLCLLLLSMKAFAGLMEGNHCHQLH

SEQ ID NO: 195857 - protein, 599 aa, Glycine max
  Coding DNA Sequence Number=SeqID_79079
  Gene Ontology: Mol. function=histone-lysine N-methyltransferase activity; Cellular component=nucleus; Biological process=chromatin modification
  Homolog annotation: Hit_ID=Q1S200; Match level="QueryCoverage=70%, HitCoverage=58%, E-value=1e-169, Identity=68%"; Hit description=SET -related region; Pre-SET; Histone H3-K9 methyltransferase
  Pfam annotation: Domain name=Pre-SET; Domain location=239-385; Score =6.8; E_value=0.00012; Accession=PF05033.6; Description=Pre-SET motif
  Pfam annotation: Domain name=SET; Domain location=387-532; Score =128.5; E_value=1.9e-35; Accession=PF00856.18; Description=SET domain
  Pfam module annotation: Pfam domain module=Pre-SET::SET; Domain location=239-385::387-532
MRNWSIKNGVAGKHSGRATVASSQSRDGVVDEDVIRTSNGERTCDVEIASSTLGEVKLSLSCSPALWGSDFHMPSQDQLIEMMEDKCLQSYKITDPNFSVKNLLRDICDCMLEFRNDKSQEGSTIRSSVDVLKEPHAPDTLSVVGNKDLDRSSHFSNGSINVKSSDALVSPRSILPLAHPNGLSDAVLVSKMDGTNDFLQSNVRKDLEDPMSPNSQSLVFVPQHQLTVGDIRSFHDANDLTKGEENVEIPWVNETTSDFAPSFNYIPQNLVFQDAYVNISLSRIGGEDCCSTCMGNCVLSTTCACANKTGGKFAYNTEGLLKEEFLEECIAISRNPQQHFYYCKNCPLERSKNDGCLEPCKGHLKRKFIKECWSKCGCGKQCGNRVIQRGITYNLQAFFTSEGKGWGLRTLEDLPKGAFVCEFVGEILSIKELHERSMKCTENGKYTYPVLLDANWDSGYVKDEEALCLDAASFGNTARFINHRCSDANLIEIPVEVEDPGHYYYHFAFFTSRKIAAQEELTWDYGIDFDDHDHPVKLFQCRCGSKFCRNMKRSSSRLAYESKELAFIVGFILVFLLLEVLTQTRSKWMFAKKKKTDRG

SEQ ID NO: 195858 - protein, 47 aa, Glycine max
  Coding DNA Sequence Number=SeqID_79080
MNGTDSGDRQREKEKEAGVFEFRHRQAHPRATHSRAQQSLDSVSWTL

SEQ ID NO: 195859 - protein, 487 aa, Glycine max
  Coding DNA Sequence Number=SeqID_79081
  Gene Ontology: Mol. function=DNA binding; Biological process =regulation of transcription
  Homolog annotation: Hit_ID=Q94CL7; Match level="QueryCoverage=85%, HitCoverage=88%, E-value=3e-76, Identity=46%"; Hit description =Phosphate starvation response regulator 1
  Pfam annotation: Domain name=Myb_DNA-binding; Domain location=261 -312; Score=43.1; E_value=9.2e-10; Accession=PF00249.21; Description =Myb-like DNA-binding domain
MEAHPTFSIESSKQLNNMGMSGALSSSLSILPIPPEELFPKLPESQLDFVEQELMIRPFTHSSYLNSGGVIGHIFSSSPGYSTDLHHSTLSSAEKHSTNAHLISQSSTNITQFPLSYSSNIGPPASATPSHYSKENSVSWHTDSLPGFLDFPENGSIDNNPVESSACPIMASEEYSKQNDWQEWAERLISDDGTLTSNWNDLLADNIQDLEPKGPFQVSKPLSQIPGHQSQGHQQLPASYGENCAGAALSSSANSAPAKSRMRWTPELHEAFVEAVNQLGGSEKATPKGVLKLMKVEGLTIYHVKSHLQIWLEMKKYRTARYRPESSEGVMDKKTSSVEEMSSLDLRTGIEITEALRLQMEVQKRLHEQLEIQRNLQLRIEEQGRCLQMMFEKQCKPGTETFKAPSFTTIETPFGMSSNATKDSLSKNEMEASLVLDHCRSGPDQVNGSTRVEEGSLEKCGKPDSPKTQHAIASEDSAQAPKRQRTE

SEQ ID NO: 195860 - protein, 209 aa, Glycine max
  Coding DNA Sequence Number=SeqID_79082
  Gene Ontology: Mol. function=cellulose synthase (UDP-forming) activity; Cellular component=membrane; Biological process=cellulose biosynthetic process
  Homolog annotation: Hit_ID=O81649; Match level="QueryCoverage=55%, HitCoverage=12%, E-value=4e-46, Identity=71%"; Hit description =Cellulose synthase
MAMSAVLNTGSHSRNGFRFSEEENGDFNQQQWQHNDDQAFSAAGSVANEDFEGQKAFYSNAEKRKEKRSLKSNDQAEDDYLFEREGGEPNLLAPVDIFVTTADPLKEPPILTANTVSCYVSDDSASMLFFDTLSETAEFARIWVPFCNKYNIEPRAPEFYLSWKLDYLKDKMHPTFVKDRRAMKREHEEFKVKINELAAKAKKNKKRSG

SEQ ID NO: 195861 - protein, 272 aa, Glycine max
  Coding DNA Sequence Number=SeqID_79083
  Gene Ontology: Mol. function=transferase activity, transferring glycosyl groups; Cellular component=membrane; Biological process =cellulose biosynthetic process
  Homolog annotation: Hit_ID=Q6UDF1; Match level="QueryCoverage=99%, HitCoverage=27%, E-value=1e-106, Identity=68%"; Hit description =Cellulose synthase catalytic subunit 10
  Pfam annotation: Domain name=Cellulose_synt; Domain location=1-268; Score=-257.2; E_value=0.0034; Accession=PF03552.5; Description =Cellulose synthase
MGGKEIGWLYGSVTEDLLTGFNMHCRGWKSVYCMQKKAAFKGSAPINLRPITPSSEMGFSRKLKWLQRLAYTNSVVYPFTSIPLYLLYNSSCLSSDWKLSNLASIWLMALFISIVLTCVLELRWSGVSIQDWWRNEQFWVTGGVSAHLFAVFQGLLKVGGVHTNFTVRAKSANDTAAFGQLYLFKWTTLLIPPTSLVILNMVGIVAGISDAINNGYDSWGPFFGKLFFSLWVILHLYPFLKGLMGRQNRTPYHCSPLVNSSSHNFLNDLGAN

SEQ ID NO: 195862 - protein, 904 aa, Glycine max
  Coding DNA Sequence Number=SeqID_79084
  Homolog annotation: Hit_ID=Q75HJ9; Match level="QueryCoverage=72%, HitCoverage=86%, E-value=9e-57, Identity=25%"; Hit description =Expressed protein
MESSLTPPPPPPKFRFRDNSEPESQNSSELGSDVVSAMSPSIRHPDADLEIESMTGRGIMHLCDELRELKEAANEDLQKNIFSKYSTFLRILEEVIGVENELVQLENHFLSHKRQVKDLIDRIYPKILSIDITFEDHINFVPSPPTELEAHMNECFENLDILISENKIDEALNLLESADEHCQSLQLQHCSHSEIILYESAISEKKSMLVQQLTQIVENKRTPGPDLQRALARLCRLGDIQLAVNLLLKHYRLRVANGTDNLRWAKSSSIEIYMRELARFVFSVISQAARSFVMLCGETSPYASELMLFAYEETKSFIICFDKYVKGTSAISGGLSSAIKAVNFSVMYCSLLENQKLVLRPYLVKNLFPCMEEVLNTHINHFKKVISIFSASDAWILEKYLVSGVFVGAGSSSLAVGEQHDYCLLTTSGRKVLTLLQVIVEDISPLVSLQMGSLVISGITNLLAEYIVILERALTYETSSTEQGSPRIKLAESLPQQVSILANLSTLVQFLTIMVKNIFSSSDHIELQVLENHSIVHQQQGLDDFLLFIEEGSNKLRNMFCQQLILRELSTYHRHEMFSASHCNDQFDANTVPHPMPSGIFQVLFLELRKIEQLEEENVFEVNWLMGLLRELMESMFIWVSNNKEILATTEENVSSKTDEAKQFILDVQFLVEIGMYGGYFSSDPLLLLTLMKSTFNSAGLDPFNHQEVVMVLKATNVSNIDWCFLYRDVDDDDWAIDAATKTIQKLLEFEKTSLHPKEPAVTIKEESHEHESQINQLAYESNFSEEDDISSSENNVVDTSLDAEKDEVAKHELEVAIDAKMASLDTVFSPGEGSLVERDYYVDSNTSNLIPTSIITFQLEDADFEEAADTKNDELTPTSSVGEVGLNSEEETKSKSDEWPTLI

SEQ ID NO: 195863 - protein, 308 aa, Glycine max
  Coding DNA Sequence Number=SeqID_79085
  Gene Ontology: Mol. function=protein-tyrosine kinase activity; Cellular component=membrane; Biological process=protein amino acid phosphorylation
  Homolog annotation: Hit_ID=Q1SXD2; Match level="QueryCoverage=93%, HitCoverage=76%, E-value=4e-93, Identity=56%"; Hit description =Protein kinase-like
  Subcellular localization annotation: CTP_CleavageSite=24; ConfidenceScore=5.55e-01
MPLCMSMTGGSFPAVNSVSTNVPFASAERAKMWLVKPSSGPSFAPVQSPSYQVPIATPRPQLPHYHHRHNCGKPYAAAPSLSKDQACSQICTDPLTATPFGSPCGCVFPMKVRLVLDAAPLAVFPVIDELEIELSSGTYLKQSQVRIMGVTADSQNQGKTTIDIYLVPLGEKFDNTTAVLLSKRFWHNEVPLNRSLFGDYAILCITYPGIPSPRPPETLTGRGHMPRESINVLPITADMNSENEKMNLRTIIVIALSSVVLLLVLVGAFYIILKWRKIRRPSSAVGPAFTSCLNKRSDAYIELVEFVI

SEQ ID NO: 195864 - protein, 106 aa, Glycine max
  Coding DNA Sequence Number=SeqID_79086
MNSAKTKEEIKRSEYMMMIPEKEKRRARRKIREVDIDIASVRKGKKSIRHCREHGDDAEASRSQKCGEEKTCERKNTHRYVYICRRRRTGSITKREKEREREENGG

SEQ ID NO: 195865 - protein, 73 aa, Glycine max
  Coding DNA Sequence Number=SeqID_79087
MSKNSLKASRVKAEVEFMMEPEMLWSKLSKHTLTELNIQGQIEEALDKVESNMPFGEAKLKMLWTQSRQKYHG

SEQ ID NO: 195866 - protein, 417 aa, Glycine max
  Coding DNA Sequence Number=SeqID_79088
  Gene Ontology: Mol. function=binding; Cellular component=membrane; Biological process=photosynthesis
  Homolog annotation: Hit_ID=Q337L2; Match level="QueryCoverage=97%, HitCoverage=55%, E-value=1e-104, Identity=51%"; Hit description=TPR Domain containing protein, expressed
  Pfam annotation: Domain name=TPR_2; Domain location=137-170; Score =6.4; E_value=6; Accession=PF07719.7; Description=Tetratricopeptide repeat
  Pfam annotation: Domain name=TPR_2; Domain location=322-355; Score =14.3; E_value=0.44; Accession=PF07719.7; Description=Tetratricopeptid e repeat
  Pfam module annotation: Pfam domain module=TPR_2::TPR_2; Domain location=137-170::322-355
MKCLRSGESLGGADDEVLFPSSSGSLASAIKDFSASENSCLAEQFDKKPDTGNIEEAESSLRESGILNYEEARALLGRYEYQKGNIVAALHVFEGIDIGVVTPKIKIALSRSRERRKRHSQNHAEPQMSIHSVGLLLEAVFLKAKSLQVLERFKEAAQSCKVILDIVESSLPEGMPDNFGAECKLQETLNKAVELLPELWKLADCPREAILSYRRALLHHWNLDAETIAKIQKEFVVFLLYSGGEATPPNLRSQMDGSFVPRNNIEEAILLLMILLRKVSLNRIEWDPSILDHLSFALSVSGDLTALANQLEELLPATIHRSERYYALALCYYGAGKDLVALDLLRKLLRSREDQHHVPGLLMASKICCENSTLAEEGVSFAKRVLQNLDGRCNQLENHANFFLGVTLSGTFEIGCF

SEQ ID NO: 195867 - protein, 128 aa, Glycine max
  Coding DNA Sequence Number=SeqID_79089
MLLLSNILPNDHNVDLPLRKYQLGSHPQDTQWTRWSPTGPWGFQLWLRASINPTGCPSPLARSCHRDIGKDHARKTPNGPGEVQQGLGVSNSNYGPLSVLRSACRPQQGHQALTNRAFIKKYCAPCQV

SEQ ID NO: 195868 - protein, 137 aa, Glycine max
  Coding DNA Sequence Number=SeqID_79090
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=10%, E-value=3e-24, Identity=35%"; Hit description=Chromo
MTSAEMQLRRERGLCFTCDDKFSPSHRCPNKQYFVLQWEEEDEPALQPDPPDEVETAGDPSLQDHHLSYNALKGSSGLGTMKFQGSINGLGVLVGNGNALTAEGLILDLEVKIQGHTLKLPVYLLPISGADLVLGAA

SEQ ID NO: 195869 - protein, 509 aa, Glycine max
  Coding DNA Sequence Number=SeqID_79091
  Gene Ontology: Mol. function=ATP binding
  Homolog annotation: Hit_ID=Q2QQZ4; Match level="QueryCoverage=98%, HitCoverage=38%, E-value=8e-57, Identity=30%"; Hit description =Expressed protein
EAVVLMLECIHFADVSHKLVNALKRTNCLKTYIGFEIPSECFLLDPVWGCILNVFNDFPVIDHKFYGDKILTYKIELRKTGVVIDFEEAIKAFGHTRVGDYRSSKKCILFGPDWESFSAITRLPFIGDSDNCYGKFVHEYKEELKSTGVITEIKHGLNFVTTFLRFPSDPSSITRESVFSLLECIRCLNKNDWKPENKATKRIWIPKAVDNGEWVSPEQRVNHDMGDLFGSRSMPSLDDYIEIWKEWESSGEQLSHDKCCNFWAYVLQHESKRTVKNIAESLTKLPITSGSDLILLLDKRDVFVADNLHLQNLFEQERVFVWYPESSLASLPRSELLDLYKKIGVSIISESVLKEESSLLDGVEVRQVDPSNIFIGKGLVKLVLSFLACSSIKIEAEKRHEAVQGLIELTVHETIEPVTVCYSLSLSSGKTITKKWRYKHAKNMPHISQAISAGVLRENVDNVLALSELIKLGFLVKFNEEAVDFLMESKDLQIFLEDEEFLRSAFPFV

SEQ ID NO: 195870 - protein, 297 aa, Glycine max
  Coding DNA Sequence Number=SeqID_79092
  Gene Ontology: Mol. function=ATP binding
  Homolog annotation: Hit_ID=Q2QQZ4; Match level="QueryCoverage=88%, HitCoverage=34%, E-value=2e-16, Identity=32%"; Hit description =Expressed protein
MTDDGSHDSDYDVIGGGDSDNNNDNNHVSDDDQRISDKVAPHCGLGYIVPEWVEQNPALEDIKQIYRAGDDTLPTTTIILPLKSDKRLSIREDNEDPKLSTLGSVAISSEINFMTRKNINAESYTLCLSEEENRNSEKECDYYLSGFKGGKPYLGETIMLDDKWNQGILDCVPSAFMEAFKSLVKGIDKAPLSSLARMFLGYLTPREVGSLCSSIPLVDNYGHVVERRTGVLVPASVSKWADLTVSNPWRDQTSDLPCICALDAGISGVDTPLTKEKAFLLLDWIRDWKYMGMSLPE

SEQ ID NO: 195871 - protein, 164 aa, Glycine max
  Coding DNA Sequence Number=SeqID_79093
MDVCVKEEVLETPIVTERRPRTGVVSAPPPGSVIELSDSDTDEDEGHDLDSAVANAVNGASSSVESPSKKRRTSEAGGVVLPVGFLTPLPPAPAPTPPPTAVLSLPAPEWASNSTASRANASKSLSLNSSKQFWKAGDYDGAPLGGSGSSTGEVEIIFGEGKPA

SEQ ID NO: 195872 - protein, 410 aa, Glycine max
  Coding DNA Sequence Number=SeqID_79094
  Gene Ontology: Mol. function=protein serine/threonine kinase activity; Cellular component=nucleus; Biological process=protein amino acid phosphorylation
  Homolog annotation: Hit_ID=Q1S9D3; Match level="QueryCoverage=99%, HitCoverage=73%, E-value=0.0, Identity=84%"; Hit description=Protein kinase
  Pfam annotation: Domain name=Pkinase; Domain location=1-279; Score =277.4; E_value=2.7e-80; Accession=PF00069.15; Description=Protein kinase domain
  Pfam annotation: Domain name=Pkinase_Tyr; Domain location=1-278; Score=17.2; E_value=1.6e-13; Accession=PF07714.7; Description =Protein tyrosine kinase
  Pfam module annotation: Pfam domain module=Pkinase::Pkinase_Tyr; Domain location=1-279::1-278
IGQGTYSNVYKAKDLVSGKIVALKKVRFDNVEAESVKFMAREILVLRRLDHPNVVKLEGLVTSRISSSLYLVFEYMEHDLAGLSAAVGVKFSEPQVKCYMKQLLSGLEHCHSRGVLHRDIKGSNLLIDNEGILKIADFGLATFFDPKKKHPMTSRVVTLWYRPPELLLGSTSYGVGVDLWSAGCILAELLAGKPTMPGRTEVEQLHKIFKLCGSPSDEYWKKYRLPNATLYKPQQPYKRNILETFKDFPSSSLPLIETLLAIDPDDRGTTSAALNSEFFTTEPYACEPSNLPKYPPTKELDIKLRDEEARRQKALSGKTNAVDGARRVRVRERGLAIPGPEANVEIQNNVDRWRVVTHANAKSKSEKFPPPHQDGAVGYPLDDSNKRAVSFGATETSSASTIFDSKSWGS

SEQ ID NO: 195873 - protein, 52 aa, Glycine max
  Coding DNA Sequence Number=SeqID_79095
MRFVEVIIGDCGGLSDGGKLPVKASWEVVKGWVAGGEGLVKAIIGCGNWEAK

SEQ ID NO: 195874 - protein, 57 aa, Glycine max
  Coding DNA Sequence Number=SeqID_79096
MRKERLITTKQYNQEQRQLISCTWERKAKANKQRPNCFTSNGKMAIFSLQMPETNRL

SEQ ID NO: 195875 - protein, 85 aa, Glycine max
  Coding DNA Sequence Number=SeqID_79097
MTSTLLSSSALPCFTTIVGEGEDDRGGEEALDNEANFGVVVEGEVAKMCLRQVMRAGELKRQRRKRKLEWERCVEFGGKRKRREL

SEQ ID NO: 195876 - protein, 178 aa, Glycine max
  Coding DNA Sequence Number=SeqID_79098
  Subcellular localization annotation: CTP_CleavageSite=49; ConfidenceScore=5.06e-01
MVKKFGKFLKRFKDRKFSKPSKKIESNNNNFTCFKCGKQDSMNDFSTIEETEVNSQFEEFLEAFNEMCDEAQRLAVSNNKLRSEQNFISLNWLQHKWLCLCASTSLNMDDYKSLQIEFEKFQKDHSEECMKFQTELSYLKDLLRKLNKGKSNLSHFLSVQKHTTDKTGLGIQQANYLF

SEQ ID NO: 195877 - protein, 73 aa, Glycine max
  Coding DNA Sequence Number=SeqID_79099
MESKRLIKRWKLYDSDYYNYCNQLGDKDQKYSPSGGVQFNSLDHSIPNSKQDSNRFVIRSSILCEILLDYNKG

SEQ ID NO: 195878 - protein, 55 aa, Glycine max
  Coding DNA Sequence Number=SeqID_79100
MKVKLVKLIDITNEGKDSPNRKLGSDKNTKKNEQDVALIAANSICPRIRKNPVSG

SEQ ID NO: 195879 - protein, 70 aa, Glycine max
  Coding DNA Sequence Number=SeqID_79101
MVAITPARFPQPPFFRGYDSNTMCAYHGGAPGHSIEHCMTLKRKRPALLSVNFQDRSIRDCSSCTLVGVP

SEQ ID NO: 195880 - protein, 213 aa, Glycine max
  Coding DNA Sequence Number=SeqID_79102
MGTSMTTLTQMWMTLLLSNVLPSDHNSDLHLPKCMPTTRHPLDPDKSNRALGFLALITGLCQSFGVLVTTSKVIRTPIAQAFIEKYCTPRQAQGDAPQAADAPLPPHQADPAGSLGMERYLQHLVRQQAANHRGQLQIHECLYQLSLSQQGQGFAPFACPTPENFRAEVAWPRDWPKAQAGEAPAGSPDDAEETHMDEEMMDLIGFLGGSGAT

SEQ ID NO: 195881 - protein, 91 aa, Glycine max
  Coding DNA Sequence Number=SeqID_79103
  Homolog annotation: Hit_ID=Q1PF35; Match level="QueryCoverage=73%, HitCoverage=32%, E-value=3e-16, Identity=57%"; Hit description=P21 -rho-binding domain-containing protein
  Pfam annotation: Domain name=PBD; Domain location=29-78; Score=25.3; E_value=0.00014; Accession=PF00786.18; Description=P21-Rho-binding domain
MSGNKVKGILKGFRYLTQIFENEKEQEIQIGFPTDVEHVAHIGSMRDESSVNLPSWMKEFKTAPGFSSVPLDVQNKGQHSAKWVSEVVLDW

SEQ ID NO: 195882 - protein, 168 aa, Glycine max
  Coding DNA Sequence Number=SeqID_79104
  Gene Ontology: Mol. function=protein serine/threonine kinase activity; Cellular component=nucleus; Biological process=protein amino acid phosphorylation
  Homolog annotation: Hit_ID=Q6K988; Match level="QueryCoverage=92%, HitCoverage=31%, E-value=3e-70, Identity=82%"; Hit description =Putative casein kinase I
  Pfam annotation: Domain name=Pkinase; Domain location=9-168; Score= -85.2; E_value=0.0017; Accession=PF00069.15; Description=Protein kinase domain
MEHVIGGKFKLGRKIGSGSFGELYLAVNVQTGEEVAVKLFLTIPSCSAKQFQEPVKTRHPQLHYESKLYMLLQGGTGIPHLKWFGVEGDYNVMVIDLLGPSLEDLFNYCNRKFTLKTVLMLADQLINRVEYRHSRGFLHRDIKPDNFLRGLGRKANQSETERKGAPKM

SEQ ID NO: 195883 - protein, 56 aa, Glycine max
  Coding DNA Sequence Number=SeqID_79105
MGILLERVMGRTSSTLSPRHRHFTAQTLSCKGQIACARDKTFHGQLLGNHVMQLRK

SEQ ID NO: 195884 - protein, 241 aa, Glycine max
  Coding DNA Sequence Number=SeqID_79106
  Gene Ontology: Mol. function=protein serine/threonine kinase activity; Cellular component=membrane; Biological process=protein amino acid phosphorylation
  Homolog annotation: Hit_ID=Q49N12; Match level="QueryCoverage=67%, HitCoverage=16%, E-value=1e-44, Identity=59%"; Hit description =Putative receptor-like protein kinase 2
  Pfam annotation: Domain name=Pkinase_Tyr; Domain location=137-237; Score=-121.9; E_value=5.4e-05; Accession=PF07714.7; Description =Protein tyrosine kinase
MMSLERDVQESRFSSIDFSKKLQDAVFDVQNEIAQHLQNLKVSNFRMIPVKREFAFERSEIPADSKPCSDQKNARHKIIVGVGFGVTALCLVFIIVGIFWWKGYFKRIIRTIKGTERQDSQKGIFTLKQIRDATYDFTPDNMIGEGGFGHVYKGQLSDGTLIAVKQLSSKSRQGNREFLNEIGMISCLHHLNLVKLHGCCMERDQLILVYEYMESNSLARALFSEFLPKVQTIVFVFYLVI

SEQ ID NO: 195885 - protein, 148 aa, Glycine max
  Coding DNA Sequence Number=SeqID_79107
MTNGKNRCSREHGDSVVIKFIDNKDDFQIIVFELASACARHARTPCRVRSHARGMAKCEATPLLERVLCSLHVVRPCDAVATEGVLFDATMKEMRFDYDKRERVNQWHAVGGVVRGIEVKVCVVVKVVEVDTSVAAELRNLKIRIRRK

SEQ ID NO: 195886 - protein, 151 aa, Glycine max
  Coding DNA Sequence Number=SeqID_79108
MVERKDKELRGSSNGVISGYHKWLKARTQGITWLPKLKSPSGGEAEVLEESEEVQALKVELERMRVVKEKLKMTVTRVRKECDELRDINMTTTKGLYGATTTSLSFEGPKGTSQGTEENMLTIIDQYKEKLNLAVSHGQRLENEHEKVSAQ

SEQ ID NO: 195887 - protein, 296 aa, Glycine max
  Coding DNA Sequence Number=SeqID_79109
  Subcellular localization annotation: CTP_CleavageSite=29; ConfidenceScore=5.26e-01
MALKKLPTKRSRKDAVGGGSSAAPQDFARSITGRQVRIMDTSMTTLKQIWMTLLLSNVLPSDNTSELPLPKCQLVYAILTQVSVHVAQLISDAMYHFVEVAPPRHPVDLEKSNKALGFLALITGLCQFYGVSVNPTKLIRPPISRAFIEKYCMPRIKLQMHTYMQHVTSQQVVNHRGQDPNPFPWPTPEQFGATVAWLRDEANFETRAGSTGALGRTEELRRMKIWMTCWISSLKEAELHGPLGWAKGVSSVEGKRMESPPTFIRGKHQKNQNGRGRKFAYFENEGSRVVYTRGRY

SEQ ID NO: 195888 - protein, 172 aa, Glycine max
  Coding DNA Sequence Number=SeqID_79110
  Homolog annotation: Hit_ID=Q9SP39; Match level="QueryCoverage=100%, HitCoverage=47%, E-value=5e-07, Identity=30%"; Hit description=BHLH transcription factor GBOF-1
MAAFSSQYYHSFVVDSACFSITPPIINTSSNFLPSPHYLHNNNIQETSYSVTDNKETSCFEQSSKVTISDIELSVVKNHSPETSMVVDKLEKGEQVTQKVVTRMEKKRRARNGSSSSDPLSKESTEGGKKKQKKPKEVTKDKKIGAEDPPTGYIHVRARRGQATDSHSLAER

SEQ ID NO: 195889 - protein, 54 aa, Glycine max
  Coding DNA Sequence Number=SeqID_79111
MGDDEAITSRLVFLEAVKKRRYVAMMGWDGWRLGREKRDGDKVSDPIWRALSLD

SEQ ID NO: 195890 - protein, 104 aa, Glycine max
  Coding DNA Sequence Number=SeqID_79112
MKLKKVKLQMFTVYLKCSNSLARYHVLQKREKILHFLNYKISNDGNGFGGGENSCSDGSGSDSDSGSGDCHNSGNDNNRSGGGGSSGRGGDDNDKSGGGNGERE

SEQ ID NO: 195891 - protein, 976 aa, Glycine max
  Coding DNA Sequence Number=SeqID_79113
  Gene Ontology: Mol. function=protein tyrosine/serine/threonine phosphatase activity; Cellular component=intracellular; Biological process=protein amino acid dephosphorylation
  Homolog annotation: Hit_ID=Q9FFA8; Match level="QueryCoverage=95%, HitCoverage=98%, E-value=0.0, Identity=55%"; Hit description =Similarity to DsPTP1 protein
  Pfam annotation: Domain name=Act-Frag_cataly; Domain location=131 -456; Score=232.6; E_value=8.7e-67; Accession=PF09192.1; Description =Actin-fragmin kinase, catalytic
  Pfam annotation: Domain name=DSPc; Domain location=749-891; Score =81.5; E_value=2.7e-21; Accession=PF00782.11; Description=Dual specificity phosphatase, catalytic domain
  Pfam module annotation: Pfam domain module=Act-Frag_cataly::DSPc; Domain location=131-456::749-891
MITGEEGMNESGEIPLAFSVESITVTNNKVPQLSWHGKGQERELELESDESQAEIEAPLPLTVTSRVLYMLGDITAGPAFRFTQWLQLVRKRTAKYRSSGFPHRTSTTMPSSSCIRESLENSKLDLHPDQTEISLWERLGKAAMLDIESGSFSWDMLSSLHHTEHSSSNEHSEDEMNKALEVHRILQLFCTSTSITSIAIRVDVLVQLVTVNSGGVVFFAFFNISGNADACPKEAAAVIKIASSRMATQSERLGYEFAKWMGVQTPQGRVIHNTCLEWQQIKEAAEKAREAANSEGDEIGEVTCFELLEALELSRCLFFMSYVHGSPLLENSSAFESRESAERTSEALGRVLMLDLVIRNEDRLPCHELKWRGNPANLLLAGKNICANTDALESAFDSAVNRYRPKVIRAFQKERRSTSVDCRLNSHNPGLISQSYDLSDITESPRSADMSFQTSGESLSPDFNIVAIDSGVPWRPPAGKRANDQVNYPKLVELLVNSSEFASNLLYDITGGKLGCPPPEDMEKTYVHTSDTMFVVHAFRNGFRAALRDLQGFHIFLLTLHQRLDTLLRSFMNIISKISLGEFDKEDSVVPDSLSLTAGGSCSSPTCKERLANDNHQDFIDSESQRTASRASSSGNRDCSDSTPMSRETWHGKFYKGNGEPLRSLRLTAKLRDFHKFAKVDAESSKELEQWNEMLKSDAIKLCQENNFNPGFFEGSDNNCVVDAYELKVRLEHILERIALISDAASTEKPSAVTSSLFIGGALAARSVYTLQYLGITNILCLCTNEIGQSETQYPDLFEYKNFSVCDSDDYNISSIFEEACDLIDFVEQTGQKVLVHCFEGRSRSVTLVLAYLMLRKKYTLSQAWQALKRVHRRAQPNDGFAKILLELDQKLHGKVSMEWHQRKPVMKVCPICGNNAGLSSSSLKLHLQKSHRKLSSGSVDSAMTMEIQKALTALKISRGGSVSPTQRSSHPLIDQ

SEQ ID NO: 195892 - protein, 359 aa, Glycine max
  Coding DNA Sequence Number=SeqID_79114
  Gene Ontology: Mol. function=binding; Cellular component=integral to membrane; Biological process=transport
  Homolog annotation: Hit_ID=O80413; Match level="QueryCoverage=99%, HitCoverage=97%, E-value=1e-149, Identity=74%"; Hit description =Mitochondrial phosphate transporter
  Pfam annotation: Domain name=Mito_carr; Domain location=165-253; Score=82.2; E_value=1.7e-21; Accession=PF00153.17; Description =Mitochondrial carrier protein
  Pfam annotation: Domain name=Mito_carr; Domain location=266-349; Score=4.2; E_value=0.0014; Accession=PF00153.17; Description =Mitochondrial carrier protein
  Pfam annotation: Domain name=Mito_carr; Domain location=68-156; Score= 101.4; E_value=2.6e-27; Accession=PF00153.17; Description =Mitochondrial carrier protein
  Pfam module annotation: Pfam domain module=Mito_carr::Mito_carr::Mito_ carr; Domain location=165-253::266-349::68-156
  Subcellular localization annotation: CTP_CleavageSite=73; ConfidenceScore=5.67e-01
MAPSDQSHHSLVPGFLYSSKTLSHLNNNTNHGLPPSSSIASSSLPQGRTKSPMILSPKEGIRMFSPAYYAACSAGGIFSCGLTHMAVTPLDLVKCNMQIDPVKYKNITSGFGVLLKEQGAKGFFKGWVPTLLGYSAQGACKFGFYEFFKKYYSDLAGPENAIKYKTIIYLAGSASAEVIADVALCPMEAVKVRVQTQPGFARGLSDGLPKFIKADGVSGLYKGLVPLWGRQIPYTMMKFASFETIVEKIYKYAIPTPKEQCSKTKQLGVSFAAGYIAGVLCAIVSHPADNLVSFLNNAKGATVGDAVKKIGVVGLFTRGLPLRIVMIGTLTGAQWGLYDSFKVFVGLPTTGGSAPAPVR

SEQ ID NO: 195893 - protein, 75 aa, Glycine max
  Coding DNA Sequence Number=SeqID_79115
MSSGGRAVKPKEEEQDGMSVHSPCKPPPSSASSLPKEQSQVELELRLLEALEIYPPMKLQGILIDTCLHTYTHNS

SEQ ID NO: 195894 - protein, 939 aa, Glycine max
  Coding DNA Sequence Number=SeqID_79116
  Gene Ontology: Mol. function=nucleoside-triphosphatase activity; Cellular component=chloroplast; Biological process=nucleotide -excision repair
  Homolog annotation: Hit_ID=P35100; Match level="QueryCoverage=99%, HitCoverage=100%, E-value=0.0, Identity=80%"; Hit description=ATP -dependent Clp protease ATP-binding subunit clpC homolog, chloroplast precursor
  Pfam annotation: Domain name=AAA; Domain location=277-505; Score =35.7; E_value=1.6e-07; Accession=PF00004.19; Description=ATPase family associated with various cellular activities (AAA)
  Pfam annotation: Domain name=AAA_2; Domain location=651-826; Score =368.5; E_value=1e-107; Accession=PF07724.4; Description=ATPase family associated with various
  Pfam annotation: Domain name=AAA_5; Domain location=277-451; Score =3.0; E_value=0.001; Accession=PF07728.4; Description=ATPase family associated with various
  Pfam annotation: Domain name=AAA_5; Domain location=655-814; Score =22.8; E_value=3.2e-05; Accession=PF07728.4; Description=ATPase family associated with various
  Pfam annotation: Domain name=Clp_N; Domain location=102-154; Score =79.8; E_value=8.2e-21; Accession=PF02861.11; Description=Clp amino terminal domain
  Pfam annotation: Domain name=Clp_N; Domain location=177-229; Score =47.7; E_value=4e-11; Accession=PF02861.11; Description=Clp amino terminal domain
  Pfam annotation: Domain name=NACHT; Domain location=654-822; Score= -34.9; E_value=0.03; Accession=PF05729.3; Description=NACHT domain
  Pfam annotation: Domain name=ResIII; Domain location=255-378; Score= -34.0; E_value=0.033; Accession=PF04851.6; Description=Type III restriction enzyme, res subunit
  Pfam annotation: Domain name=Sigma54_activat; Domain location=625 -818; Score=-181.6; E_value=0.021; Accession=PF00158.16; Description =Sigma-54 interaction domain
  Pfam annotation: Domain name=Torsin; Domain location=607-857; Score= -165.6; E_value=0.0047; Accession=PF06309.2; Description=Torsin
  Pfam annotation: Domain name=UVR; Domain location=526-561; Score =52.9; E_value=1e-12; Accession=PF02151.9; Description=UvrBuvrC motif
  Pfam module annotation: Pfam domain module=AAA::AAA_2::AAA_5::AAA _5::Clp_N::Clp_N::NACHT::ResIII::Sigma54_activat::Torsin::UVR; Domain location=277-505::651-826::277-451::655-814::102-154::177-229::654 -822::255-378::...
  Pfam module annotation: Domain location=625-818::607-857::526-561
  Subcellular localization annotation: CTP_CleavageSite=100; ConfidenceScore=5.71e-01
MARVLVQSTGMPGLLSGQRHGKHKGSGKSKRSVKMMSTLRMPALRMSSFSGLRTLNPMDSLSRPRHTFPLNTTSRRERAKRCVPKAMFERFTEKAIKVIMLAQEEARRLGHNFVGTEQILLGLIGEGTGIAAKVLKSMGINLKDARVEVEKIIGRGSGFVAVEIPFTPRAKRVLEFSLEEARQLGHNYIGSEHLLLGLLREGEGVAARVIRMVGEGADSVGATVGPGSSNNNKMPTLEEYGTNLTKLAEEGKLDPVVGRQQQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQGVGERIEFVLLLNFVIETKKQKDKKLVLFCVVALVCIGATTLDEYRKHIEKDPALERRFQPVKVPEPTVDETIQILKGLRERYEIHHKLRYTDDALVAAAQLSHQYISDRFLPDKAIDLIDEAGSRVRLQHAQLPEEARELDKEVRQIVKEKEEFVRNQDFEKAGELRDREMDLKAQISALIEKGKEMSKAESEAGDEGPMVTEVDIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFDRLKAKEIDLSVTERFRERVVDEGYNPSYGARPLRRAIMRLLEDSMAEKMLAREIKEGDSVIVDADSDGNVIVLNGSSGAPDSLEEALPV

SEQ ID NO: 195895 - protein, 186 aa, Glycine max
  Coding DNA Sequence Number=SeqID_79117
  Gene Ontology: Mol. function=phosphopantetheine binding; Cellular component=chloroplast; Biological process=fatty acid biosynthetic process
  Homolog annotation: Hit_ID=P52411; Match level="QueryCoverage=59%, HitCoverage=82%, E-value=1e-30, Identity=63%"; Hit description=Acyl carrier protein 1, chloroplast precursor
  Pfam annotation: Domain name=PP-binding; Domain location=108-175; Score=63.6; E_value=6.6e-16; Accession=PF00550.15; Description =Phosphopantetheine attachment site
  Subcellular localization annotation: CTP_CleavageSite=16; ConfidenceScore=5.29e-01
MASVSATSLRFQPFLKLSTRTTTQRNQFKFPNINTSEKKFRRCSEMYHDLEGRSNGWKRVTKEGRDQGCYKTSSLGAVSVGWNRRTFPSLRSSRLRICAVKAQPETVQKVCDIVRKQLALPAESELTPDTKFSALGADSLDTVEIVMGLEEEFGITVEEDGSQNISTVQEAADLIEKLIQDKSGAS

SEQ ID NO: 195896 - protein, 530 aa, Glycine max
  Coding DNA Sequence Number=SeqID_79118
  Gene Ontology: Mol. function=nucleotide binding
  Homolog annotation: Hit_ID=UPI000034F110; Match level="QueryCoverage =75%, HitCoverage=54%, E-value=1e-170, Identity=73%"; Hit description= ATP binding
MKGTRKRIHEDSGLNMLHSFKKKDLTDNGGGMDPEKMRQCMSLGYSVKSKMANTIGQYGNGFKTSTMRLGADVIVFSRYPGKDMKSSSQSIGLLSYTFLRSTGKEDIVVPMLDYERRGQEWNKIIRTSLDDWDKNVETIVQWSPFSNEADLLRQFNLVKDHGTRVIIYNLWEDDQGQLELDFDEDPHDIQIRGVNRDEKNIQMAKEFPNSRHFLTYRHSLRSYASILYLRLPPGFRIILRGKDILHHNIVNDMMMSQEVTYRPQAGVDGLLPKDSNMVAVVTIGFVKDAVHHIDVSGFNVYHKNRLIKPFWRIWNPAGSGGRGVIGVLEANFVEPAHDKQGFERTLVLSRLESKLIQMQKKYWSTNCYKIGYASNRSKIQIRDSADKEASADYFPESSQSKRKYSTTDGKAPPLTSDKLHSYSNQKRIQKQTEKYRVYINGQSSVSPKRKVQSSSEQSSSDDEVSEVLPKKKTQKLSTAEKSFENENGCFQHTTSRGKTSQYTRGSKLESIADSRKKQPPLENAIAGLLT

SEQ ID NO: 195897 - protein, 98 aa, Glycine max
  Coding DNA Sequence Number=SeqID_79119
  Gene Ontology: Mol. function=nucleotide binding
  Homolog annotation: Hit_ID=Q6K8H1; Match level="QueryCoverage=66%, HitCoverage=8%, E-value=5e-26, Identity=80%"; Hit description=ATP -binding region, ATPase-like domain-containing protein-like
MDHVRVHPKFLHSNATSHKWALGALAELLDNSLDEVCSGATYVNVDMLTNKKDGTRMLLIEEGSGGSTLSAVILSFIPLFVEAIPPHNSFSIKMQSKP

SEQ ID NO: 195898 - protein, 273 aa, Glycine max
  Coding DNA Sequence Number=SeqID_79120
  Gene Ontology: Cellular component=membrane; Biological process =hypersensitive response
  Homolog annotation: Hit_ID=Q8GYN5; Match level="QueryCoverage=88%, HitCoverage=99%, E-value=5e-39, Identity=41%"; Hit description=RPM1 -interacting protein 4
  Pfam annotation: Domain name=NOI; Domain location=198-267; Score =58.1; E_value=2.8e-14; Accession=PF05627.2; Description=Nitrate -induced NOI protein
MRKASRKCNSYLVGLKSLVINFLGPDLKVQRSHVPKFGNWDSGENVPYTAYFDKARKGRTGTRIINPNDPEENADLSFDNPSSDNLPPTRPRTNSEDQSGKGSLHLEDDPKNFIESPARHDNVSSRSGSRSHGVGSADNRRRHSTQSTGSEYSIERSPLHRQARAPGRDSPQWEPKNSYDSSQGTPGRSRLRPANRGDETPDKGAAVPKFGDWDVNNPASADGFTHIFNKVREERQGGPGQVPGTPNERPQPINGLSNDDKVQCCCFAWGGKK

SEQ ID NO: 195899 - protein, 53 aa, Glycine max
  Coding DNA Sequence Number=SeqID_79121
  Subcellular localization annotation: CTP_CleavageSite=41; ConfidenceScore=5.12e-01
MAESSKKGKGTSSTTTATGHRRHGPSEAPTTPIHPSLSSPRSSTLFSLDDQRL

SEQ ID NO: 195900 - protein, 138 aa, Glycine max
  Coding DNA Sequence Number=SeqID_79122
  Gene Ontology: Mol. function=transcription regulator activity; Cellular component=nucleus; Biological process=regulation of transcription
  Homolog annotation: Hit_ID=Q1HIU3; Match level="QueryCoverage=96%, HitCoverage=25%, E-value=7e-43, Identity=69%"; Hit description =Inducer of CBF expression 1 protein
  Pfam annotation: Domain name=HLH; Domain location=36-83; Score=38.3; E_value=2.6e-08; Accession=PF00010.16; Description=Helix-loop-helix DNA-binding domain
  Subcellular localization annotation: CTP_CleavageSite=40; ConfidenceScore=5.08e-01
MEEISARNGGNSSKANSTVTGSGVDQKGKKKTGIPAKNLMAERRRRKKLNDRLYMLRSVVPNISKMDRASILGDAIEYLKELLQRISELHNELESTPAGGSSSFLHHPLTPTTLPARMQEELCLSSLPSPNGHPANAR

SEQ ID NO: 195901 - protein, 291 aa, Glycine max
  Coding DNA Sequence Number=SeqID_79123
METYSLFHCTYTGKEDPVKEIFPEVSQWVSGASDYTIGNASASDYVDLESTETWLADYFNDAVMDFSPEELNFSVADGVQIDDGTEVSAITPSHEQNVVQQTHVPRTTCNIIFKGQCGLAQVVKDPELILILSMDVHLISSNATEILLGWITIITLSTQGLADLNIANGTLPGSIGGVSPFYHIFYSKKTHVYSNAPRRCRKSFIHMPTKLASSVAYPFAFIKPSGAHGDVTLKEINQRIQTPSPSKSNQSIDDDPSAYPKSAFSGKPVVGKTKIRTEGGKGSITITRTKG

SEQ ID NO: 195902 - protein, 147 aa, Glycine max
  Coding DNA Sequence Number=SeqID_79124
  Gene Ontology: Mol. function=nucleic acid binding; Cellular component= nucleus; Biological process=DNA integration
  Homolog annotation: Hit_ID=Q1S3Z1; Match level="QueryCoverage=89%, HitCoverage=10%, E-value=5e-26, Identity=43%"; Hit description =Integrase, catalytic region; Zinc finger, CCHC-type
MLATGNRLLPSEFSDLAKGSMLLGNNKPGKIAGIGSIRFRLHDGVERLLPKVRYVLDLKRNLISLGEYYKKGYVFKGEKGMLEVAKGSMVVMRGIKKNGIYSLESDIVIGSTSVVSKKLVSKIEPWHMRLGHLSERGLIDLGKQNLL

SEQ ID NO: 195903 - protein, 64 aa, Glycine max
  Coding DNA Sequence Number=SeqID_79125
QCSTRTTVGGGDLTRVVKTACNDFNRGQFLTTLSNRLHPVGIFSQPGKRKQSDPLGGSSYTERC

SEQ ID NO: 195904 - protein, 176 aa, Glycine max
  Coding DNA Sequence Number=SeqID_79126
MEVQFHCTISMESYFRYYFNDGGVCPGCSYKGGFVAEQWWLHHGRGGCERMGKERRKRVARIGKGKGNEGRIRRERGRGKRWHARGMERGRKVKCPTQGKREKGWWHRGRGKGKKEGLHGGRPIVVLGSQRDQPSESLYNTIENMEFGPGKEMHVGLDSKAHEVNNNNKKKVVIGP

SEQ ID NO: 195905 - protein, 359 aa, Glycine max
  Coding DNA Sequence Number=SeqID_79127
  Gene Ontology: Mol. function=transcription factor activity; Cellular component=nucleus; Biological process=regulation of transcription
  Homolog annotation: Hit_ID=Q96304; Match level="QueryCoverage=98%, HitCoverage=54%, E-value=1e-96, Identity=52%"; Hit description =SCARECROW
  Pfam annotation: Domain name=GRAS; Domain location=1-263; Score =298.5; E_value=1.2e-86; Accession=PF03514.5; Description=GRAS family transcription factor
MECAVAISVDNLGEAHRMLLELTQVSSPYKASCAERVVAYFAKAMTSRVMNSWLGVCSPLVDHKSINSSFQVFNNISPFIKFAHFTSNQAILEAVSHCDSIHIIDLDIMQGLQWPAFFHILATRMEGKPQVTMTGFGASMELLVETGKQLTNFARRLGMSLKFLPIATKIGEVIDVSTLHVKPGEAVAVHWLQHSLYDATGPDWKTLRLLEELEPRIITLVEQDVNHGGGGSFLDRFVASLHYYSTLFDSLGAYLHNDDENRHRVEHGLLSREINNVLGIGGPKRSEDKFRQWRNELARHCFVKQVPMSANSMAQAQLILNMFSPAYGYSLAQVEGTLRLGWKDTSLYTASAWTCSNSS

SEQ ID NO: 195906 - protein, 441 aa, Glycine max
  Coding DNA Sequence Number=SeqID_79128
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q9ZPL9; Match level="QueryCoverage=87%, HitCoverage=100%, E-value=1e-107, Identity=57%"; Hit description =Nodule-enhanced protein phosphatase type 2C
  Pfam annotation: Domain name=PP2C; Domain location=156-427; Score =213.7; E_value=4e-61; Accession=PF00481.12; Description=Protein phosphatase 2C
  Subcellular localization annotation: CTP_CleavageSite=61; ConfidenceScore=5.68e-01
MAPTLTSSFTQPYRFSQHRRSTYLLLQSQPSTSPSLESNPLFFPSLHAKTTMKTPKRQSSPANAARPVESDSGEIVTRFKNGGRRRIKIKRMKYTCQTKIRVRNDAGAGGVSQPPAVDSEGEKREIDEHVEISLSLASSSSEEEERLSSKQSDGVLSYGSASVIGSRTEMEDAVSSEIGFAAKCDFFAVYDGHGGAHVAEACKERLHRLVAEEVVGSSESHVEWDWRGVMEGCFRKMDSEVAGNAAVRMVGSTAVVAVVAVEEVIVANCGDSRAVLGRGGEAVDLSSDHKQKLLLAVNVWTLGPHRPDELMRIEEAGGRVINWNGQRVLGVLATSRSIGDQYLRPYVISKPEVTVTQRSSKDEFLILASDGLWDVMSSEVACQVVRKCFQGQIRRVCDGVGNHQNRATEAADLLAEIALAKGSRDNTSVIVVELRGTVTTD

SEQ ID NO: 195907 - protein, 439 aa, Glycine max
  Coding DNA Sequence Number=SeqID_79129
  Gene Ontology: Mol. function=phosphoric monoester hydrolase activity; Biological process=dephosphorylation
  Homolog annotation: Hit_ID=UPI00005FA1F0; Match level="QueryCoverage =59%, HitCoverage=100%, E-value=4e-91, Identity=64%"; Hit description= COG2365: Protein tyrosine/serine phosphatase
  Pfam annotation: Domain name=SNARE_assoc; Domain location=304-429; Score=-11.2; E_value=0.0022; Accession=PF09335.1; Description=SNARE associated Golgi protein
MTAQILLHPSLAPLDGGINFRDFGGNGVADGRRIKRGLLLRSGSLERLTENDCAFLAGVPVRSVLDYRDADEVQAKPDILWSGADYHHVPANPLSSEVNANLEKLTNETLAAFDARAFMLELYRRLPFGNAAYQRLAQLLSNPGGGAIVQHCAVGKDRTGVGSALVLFALGADEATVLEDYLLTETTLATFREQMLDQLSIKLNAAALEQFAYVLSAREEFLMTALGCIRQQYGSTDRWLEAEYGLGAAQREALQAFYLESPALSLNDVINWVSDVVRQHEGWAIPIIFFLAFGESLAFLSLLLPATVILLALGALIGESGIAFWPIWAAAAVGAFFGDWLSYWIGYHYQDRVAHMWPLSRNPQLLVRGHAFFERWGVLGIFIGRFFGPLRAVVPLVGGICGMPQRYFQLANVTSAMIWAFGILAPGAFGIKWLSQWLG

SEQ ID NO: 195908 - protein, 335 aa, Glycine max
  Coding DNA Sequence Number=SeqID_79130
  Gene Ontology: Mol. function=nucleic acid binding; Cellular component= cytoplasm; Biological process=transcription-coupled nucleotide -excision repair
  Homolog annotation: Hit_ID=Q7F2E4; Match level="QueryCoverage=95%, HitCoverage=28%, E-value=1e-129, Identity=69%"; Hit description =Putative DNA repair and recombination protein
  Pfam annotation: Domain name=Helicase_C; Domain location=125-203; Score=88.9; E_value=1.6e-23; Accession=PF00271.21; Description =Helicase conserved C-terminal domain
MPYLLRRMKADVNAQLPKKTEHVLFCSLTSEQVSAYRAFLASTDVEQILDGRRNSLYGIDVMRKICNHPNLLERDHAFDDPDYGNPKRSGKMKVVAQVLKVWKEQDHHVLLFTQTQQMLDIFENFLTTSGHIYRRMDGLTPVKQRMALIDEFNDSSEIFIFILTTKVGGLGTNLTGANRVIIYDPDWNPSTDMQARERAWRIGQKRDVTVYRLITRGTIEEKVYHRQIYKHFLTNKILKNPQQKSQISEEANIIGTHKENKDKYKHSQPAELDSEDVAVGNDDKSERGSLRGKGKEKVEHNSNKVDEETNILKSLFDANGIHLTHPIFHASLLPI

SEQ ID NO: 195909 - protein, 626 aa, Glycine max
  Coding DNA Sequence Number=SeqID_79131
  Gene Ontology: Mol. function=protein serine/threonine kinase activity; Cellular component=phragmoplast; Biological process =protein amino acid phosphorylation
  Homolog annotation: Hit_ID=Q9LW99; Match level="QueryCoverage=99%, HitCoverage=98%, E-value=0.0, Identity=70%"; Hit description=Protein kinase MK6
  Pfam annotation: Domain name=Pkinase; Domain location=161-456; Score =295.8; E_value=7.9e-86; Accession=PF00069.15; Description=Protein kinase domain
  Pfam annotation: Domain name=Pkinase_C; Domain location=474-524; Score=44.5; E_value=3.6e-10; Accession=PF00433.14; Description =Protein kinase C terminal domain
  Pfam annotation: Domain name=Pkinase_Tyr; Domain location=161-434; Score=20.1; E_value=1.1e-13; Accession=PF07714.7; Description =Protein tyrosine kinase
  Pfam module annotation: Pfam domain module=Pkinase::Pkinase _C::Pkinase_Tyr; Domain location=161-456::474-524::161-434
MDSARSWLQKFQPRDKTRAAGKKKEEDGNGGNQDSNEAIDEALLSSVTKQKVAAAKQYIENHYKEQMKNLQERKERISIALFHHHVDTSHTARYVKLFALGCTDLTGISKNTVNGVRTILEKKLADADVSEEDQNNLLKFLEKKETEYMRLQRHKMGVEDFELLTMIGKGAFGEVRVCREKTSGHVYAMKKLKKSEMLRRGQVEHVKAERNLLAEVDSNCIVKLYCSFQDDEHLYLIMEYLPGGDMMTLLMRKDILTEDEARFYVGETVLAIESIHKHNYIHRDIKPDNLLLDRYGHLKLSDFGLCKPLDCSTLEENDFSVGQNVNGSTQSSTPKRSQQEQLQHWQINRRTLAYSTVGTPDYIAPEVLLKKGYGMECDWWSLGAIMYEMLVGYPPFYSDDPMLTCRKIVNWKTYLKFPEEARLSPEAKDLISKLLCNVNQRLGSKGADEIKAHPFFKGVEWNKLYQMEAAFIPEVNDELDTQNFEKFDESDSQTQSSSRSGPWRKMLSSKKDLNFVGYTYKNFEIVNDYQVPGMAELKKKQSKPKRPTIKSLFGRLSHALGPLYSFQLFSFSLCYTFVFLAYCESETPEASDTSANDQPAQGSFLKLLPPQLEVSPHRDKNLPPRS

SEQ ID NO: 195910 - protein, 163 aa, Glycine max
  Coding DNA Sequence Number=SeqID_79132
  Subcellular localization annotation: CTP_CleavageSite=70; ConfidenceScore=5.07e-01
MRLHHTIPPPTKSLQICHLSQPPSTYHNQYVSSPIPISPAIAIAAFAEPSTSHTSSIVVAPLAQSHYCNRHSSAGCSLFHFFFDSHTTIDFINFFTLPWFFPFPTTLYHEGEKEKKEKEKGLDSAVVTIDSTMGGGGKVVVVVVFIGEGEEGKEDDDVVLTRH

SEQ ID NO: 195911 - protein, 150 aa, Glycine max
  Coding DNA Sequence Number=SeqID_79133
  Gene Ontology: Mol. function=transcription factor activity; Biological process=regulation of transcription, DNA-dependent
  Homolog annotation: Hit_ID=Q6DAS3; Match level="QueryCoverage=61%, HitCoverage=29%, E-value=9e-44, Identity=93%"; Hit description =Transcriptional activator protein
MARRHVAQQQAGGQHMIVPGEIADRHKSTRPAVAVANDERAARGQPPTALPALSCRPQPCATAVRWRGRRPNFIRRSLPCRTSSAILSNVWASSCSCARASPCASPPRARSCCSWRSRCCRRSSRRCRPATSRIRPRCASPSNATAAFSG

SEQ ID NO: 195912 - protein, 678 aa, Glycine max
  Coding DNA Sequence Number=SeqID_79134
  Gene Ontology: Mol. function=dolichyl-diphosphooligosaccharide -protein glycotransferase activity; Cellular component=oligosaccharyl transferase complex; Biological process=protein amino acid N-linked glycosylation via asparagine
  Homolog annotation: Hit_ID=Q5N7W3; Match level="QueryCoverage=94%, HitCoverage=93%, E-value=1e-173, Identity=50%"; Hit description =Putative ribophorin II
  Pfam annotation: Domain name=Ribophorin_II; Domain location=2-672; Score=845.8; E_value=2.2e-251; Accession=PF05817.4; Description =Ribophorin II (RPN2)
  Subcellular localization annotation: CTP_CleavageSite=28; ConfidenceScore=5.18e-01
MATHVSHVIVAAAFLLLLLPFSFSFSISHSHRSAAINLFAATPTSLEDAYEALRVFQILGIEEKNTPVNEDTCQKVVESLASSSPLKDLFYALKVNAILKCNVNGNVFKDIASRLKATVHDASALLDIYYSIGGLVVIKDQDSNVDVLLADVDGVFQSIKVLSQSDGRWRYSSDNPESSTYAAGLALESLAGLISLASSEFDQSKVNVVKNGIVKLFDGIEKYEDGTFYFDEKYVGGHEQRGSLSTTSSVVRGVTAFAAVTSGKINLPGDKILGLAKFFLGIGIPGDAKDFFNQVEISIPLILSLPETAYSLTKKGQLKVKVNTVLGSAAPPLTVKLVRAFSTGAKDSAIIDSKELRYDQESGFHVLDALPKNVDVGTYVFVFEIVLHDFGSEKVYATGGQIHVPIYVTGIIEVGNAEITVLDSDLGSAETQKKLDLAGNDAVSLSANHLQKLRFSFQLTTPHGHVFKPHQAFFKLRHETKVEHIFVVGNTGKKFEKDFLGLVEKLFYLSGKYEIELTVGDAVMENSFLRLLGHVELDLPEAPEKAPRPPPPPVDPYSRYGPKAEITHIFRSPEKRPHQELSLAFLGLILLPFIGFLVGLLRLGVNLKNFPGSTVPATFGILFHVGIAAVLLLYVLFWLKLDLFTTLKAFGLLGAILMFVGHRILSHLAFTSAKLKSA

SEQ ID NO: 195913 - protein, 143 aa, Glycine max
  Coding DNA Sequence Number=SeqID_79135
  Gene Ontology: Mol. function=nucleic acid binding
  Homolog annotation: Hit_ID=Q7F2E4; Match level="QueryCoverage=85%, HitCoverage=10%, E-value=3e-32, Identity=59%"; Hit description =Putative DNA repair and recombination protein
KASNELPNKGTNKINGFAAGESSGKALSSAELLAQIRGNQEKAIGAGLEHQFGVLSSSTNQARSVDARSSMATENSSVQPEVLIRKICTFIQQRGGSSDSASIVQYFKDRIPSKDVVLFKNLLKEIATLHKGSNWVLKPDYQF

SEQ ID NO: 195914 - protein, 103 aa, Glycine max
  Coding DNA Sequence Number=SeqID_79136
MEELDFVPFVKGKKNPYYTPYFGVAMLWKCGNCVISGVVCKRKKASERWIYVWIGVVWSLWKARSNIILRGSNFDKQKLIQEAHAISYLDTVKKLGYRVTLFM

SEQ ID NO: 195915 - protein, 509 aa, Glycine max
  Coding DNA Sequence Number=SeqID_79137
  Gene Ontology: Mol. function=transferase activity, transferring nitrogenous groups; Cellular component=intracellular; Biological process=biosynthetic process
  Homolog annotation: Hit_ID=Q6CZ17; Match level="QueryCoverage=72%, HitCoverage=98%, E-value=1e-139, Identity=70%"; Hit description =Putative aminotransferase
  Pfam annotation: Domain name=Aminotran_1_2; Domain location=29-431; Score=4.9; E_value=1.3e-07; Accession=PF00155.11; Description =Aminotransferase class I and II
MKTEGLLAQRIVNVKSSAIRELLKHSKMEHVISLAGGIPSDALFDFEGLSIATQQAITEQPKSAFQYGLTEGSPLLRERICALCAERGVTARAEEVMVTAGSQQALDLVMRAIVNPGDVFVVERPTYLAALQTLELAEANIMSVSSDSDGMVVEELAELLKTQRIKGVYVVPNFGNPSGITLSAARRELLVKLAAEHNFLIIEDDPYGELRFTEERHPTLHQVSQRVLGNTDHIIYTSTFSKILAPGLRLGWAILPPFLLHKVAIIKQAADLHASALSQSIVECYLGLDRLPAQIDKIRTAYKQKGEILAGRHVPVGAFPPAVQRHRMAEYHAAAGRGVRAGGILLLRQPGSFDLPPVVRHRHRATNAGSGGAPAPFAVIPAAAEGMPAADIKLPSSLHSPELGMLTYAIRKTTLCVALTLAVSTQALAATEIPFWHSMEGELGKEVDSLADRFNQSHSDVKIVPVYKGNYEQSLAAGIAAYRSGKAPGDPAGLRGGHRHHDGQQGHQT

SEQ ID NO: 195916 - protein, 123 aa, Glycine max
  Coding DNA Sequence Number=SeqID_79138
MVPKTCSQPASVPDRTSSIKRTLESHQFPLLNDPNKACIYVIRDLTITHKHISSSHNGFRFELASLQIFTQQNLSELSGSWTFLSLELPKHAKASNQGQTLVHAEASSRKIPKSLCKSDFKLK

SEQ ID NO: 195917 - protein, 176 aa, Glycine max
  Coding DNA Sequence Number=SeqID_79139
  Gene Ontology: Mol. function=nucleic acid binding; Biological process= DNA integration
  Homolog annotation: Hit_ID=Q1S9I4; Match level="QueryCoverage=89%, HitCoverage=16%, E-value=2e-13, Identity=31%"; Hit description =Integrase, catalytic region; Zinc finger, CCHC-type
MADSMDDSSAIEETKVNSEFEEVLEAFNEMHEEAQRLAVLNNKLRSDLKLHNTKLASTQSELDKLRQENENLVSSYKATGCVCSSASLNMDDYKSWQIEFGKLKKDHYEEQDTYLINAMLGDLMFLEVCLKARDSPWYLDNGCSRHMMGDKSRHTDFVSKEGGYVTFGDNNKGRIV

SEQ ID NO: 195918 - protein, 294 aa, Glycine max
  Coding DNA Sequence Number=SeqID_79140
  Gene Ontology: Mol. function=GTPase activator activity; Cellular component=cytoplasm; Biological process=regulation of GTPase activity
  Homolog annotation: Hit_ID=Q9FIT8; Match level="QueryCoverage=98%, HitCoverage=35%, E-value=4e-48, Identity=38%"; Hit description=GCN4 -complementing protein homolog
  Pfam annotation: Domain name=Ank; Domain location=188-220; Score =40.7; E_value=5.1e-09; Accession=PF00023.20; Description=Ankyrin repeat
  Pfam annotation: Domain name=Ank; Domain location=221-253; Score =12.8; E_value=0.44; Accession=PF00023.20; Description=Ankyrin repeat
  Pfam module annotation: Pfam domain module=Ank::Ank; Domain location =188-220::221-253
VRSLTLDVKVWDPSVLSMLKSLGNLFANSVWEELLYPPSNLQTVDTPASSSKENGEEFFHARKPKHDDSISLKERFIHAKKDGGSLNPPTLRSKEFIAYIFQLRITYSEKIFIPRTKKYHPLFSPAQLVLESIYANDKKAVYQHIIKSDFDINAIGWQASSGMSYYSRSLNSSEVFGVGKPPIEAIQDGSSVLHLACLTSDIGMVELLLQHGANINACDSRGQTPLHYCIIKGKTAAAKVLIMSCGLLWKIDIECQHYRGANTYVADKEGKTPVKLASESGCGDDEILALLTSR

SEQ ID NO: 195919 - protein, 96 aa, Glycine max
  Coding DNA Sequence Number=SeqID_79141
MGRIEDRLLSEMQRLFGLGRDCWRKTRVAASRKEILSVMAVKKIELVSFNGEYPYGWVYHTLVQLVEINWRNTHLRQVEGVSGSVQGDTSKILIKK

SEQ ID NO: 195920 - protein, 410 aa, Glycine max
  Coding DNA Sequence Number=SeqID_79142
  Gene Ontology: Mol. function=protein binding; Cellular component =cytoplasm; Biological process=regulation of GTPase activity
  Homolog annotation: Hit_ID=Q5W7F2; Match level="QueryCoverage=93%, HitCoverage=48%, E-value=1e-122, Identity=59%"; Hit description=ARF -GAP
  Pfam annotation: Domain name=ArfGap; Domain location=335-410; Score =45.0; E_value=2.6e-10; Accession=PF01412.9; Description=Putative GTPase activating protein for Arf
  Pfam annotation: Domain name=PH; Domain location=129-264; Score=60.6; E_value=5.1e-15; Accession=PF00169.19; Description=PH domain
  Pfam module annotation: Pfam domain module=ArfGap::PH; Domain location=335-410::129-264
MVETFQELQDARASFEEARFNLVGTLNNIEFKKRFEVLKAVTGIMDAHLRYFQQIMDYVKQSKESYNQEQISLYERMQDYKKQVYEESRLSLNGPYGSPSRDSAPPFSRISNEVADVVMESAANGKVQIIRQGYLSKRSSNLRGDWKRRYFVVDSRGMLYYYRNPYGSNQPSPKRNSGTENGSGLLSRWLSSHYHGGVHDERSVARHTVSLLTSTIKVDADQSDLRFCFRIISPSKNYTLQEAMQAENAVDQMDWMEKINGVIASLLSVQTLGMPLSADSENGDSYSDDNIDKLESSPDDDHTVTVKSASKNPTPKNQFRSSRSLQLHKHSMRIEKPIDVLRRVSGNDKCADCGKPEPEWASLNLGILICIECSGVHRNLGVHISKLETGLEDLVPGTSKPSLLANNCYS

SEQ ID NO: 195921 - protein, 373 aa, Glycine max
  Coding DNA Sequence Number=SeqID_79143
  Gene Ontology: Mol. function=DNA binding; Cellular component=nucleus; Biological process=regulation of transcription
  Homolog annotation: Hit_ID=Q67UM4; Match level="QueryCoverage=89%, HitCoverage=96%, E-value=8e-39, Identity=33%"; Hit description=Gt-2 -related-like
MAQDSEKICEGASESPTTPVGTQAPAPAPAPAPPESEPKSTSTQRIKATRHPRWTRQETLVLIESKKMVENGEQVCRFRSASGCVQTDPKWDMVSSLCQQRGVKRGAVQCRKRWGNLLTDFRKIKKWESGVKEVESESFWIMRNDVRKEKKLPGFFDSVVYNVLDGGVCTTVAFPLTLVKMVPKGENGVVVEGVSHHQEQCKENEEEEEEEEEEEEEDEAIVDAEKMGWSTEEENMETNINGFLKTPTGLLIKEKGIAGRLKRTPILTLPTPEKLQQQPSYQGNYDPGFQKEPMFQEGYKRKRLPLDSSEDCTDFNSNITNLLRRNSDMLKAHLGAQNINYQLARDQQKQQTDIIVAALGKLTDALTKIADKL

SEQ ID NO: 195922 - protein, 657 aa, Glycine max
  Coding DNA Sequence Number=SeqID_79144
  Gene Ontology: Mol. function=signal recognition particle binding; Cellular component=signal recognition particle, endoplasmic reticulum targeting; Biological process=electron transport
  Homolog annotation: Hit_ID=Q9FH46; Match level="QueryCoverage=98%, HitCoverage=98%, E-value=0.0, Identity=62%"; Hit description=Signal recognition particle 68kD protein-like
MGKESQTSAMEIDAPKSMNSDLIVPKFSINGLFSPSLCIGVPFRAIPFTNEMENNTAFNVLQLLKSAQMQHGLRHGDYTRYRRYCTARLRRLYKSLKFTHGRGKYAKRALTESTVTEVRFLHVILYTAERAWSHAMEKRQLPNGPNARQRIYLIGRLRKAVKWATLFSQLCAVKADSRTSLEAEAYESYMKGSLLFEQDQNWDVALKNFKSASILASGMLLFFLFTLFEFLTMSLFNRAVYEELGKYGDLDNQVLCRERVEELEPSIRYCLHKIGQSDLQASELLQISDVEGPALDLFKAKLEAAMAEARSQQAASMTEFLWLGHRFPISNAKTRVSILKAQELEKDIHGPLADSIPADKRLVIFDKIFSAYHEARGYIRADLATTGSTESVKDDLNGLDKAVSAVLGERTIDRNLLLVKVAKSKLAKRHDDKNEKLTKPEELVRLYDLLLQNTGDLSDLVSSGRDKKPEEVIFAEVCSCKSLAFRAQRCFYVAKSYSVAGKRAEAYALYCRARNLADDALKKFQMLDGDNKTMMKELEDLCNECRSNSCIEHALGIMEEKKTQENLSERVSNISLTGTERLEKFLLEKLDVYESAVGDSNVKCTPRIAGFPPAFQAISRNPIVLDLAYNMIEFPPIENRMKKDRKAKGGFISRIFG

SEQ ID NO: 195923 - protein, 90 aa, Glycine max
  Coding DNA Sequence Number=SeqID_79145
MSPKKELIFELQGKDVNGGEQPLSDKDLLTLEQFKKENRELKERLQRKEEDILGEVLHALQHEKDRCKSLETQVWTMISTLYSLILGFIK

SEQ ID NO: 195924 - protein, 280 aa, Glycine max
  Coding DNA Sequence Number=SeqID_79146
  Gene Ontology: Mol. function=chitin binding; Cellular component =extracellular region; Biological process=chitin metabolic process
  Homolog annotation: Hit_ID=UPI000044A8F0; Match level="QueryCoverage =69%, HitCoverage=99%, E-value=5e-27, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPLEDYTSLRSKGCPPSLSEDYTSLASEGCTSSPSEGSTPSPLEDYTSLPSEGSTPSSSKDYTSSPSEGCSLSPSEDYTSLPSEGCTGLHVLSIRGIHVLTIRRLYAFTLRGLHALTFRGLQVLAIRGSHALIFRGLHILTIRGSHGLIFRGLHVLTFRELQFFTIRGLHVLPFRGLHVLTIRGLHALTCRGLHALPIRGLHALTFRGLHILTIRGLHALTCRGLHVLTIRGLHALTFRGLHVLAIKGLQALTFRGLHVLSIRGSHPFIFRGLHVLTF

SEQ ID NO: 195925 - protein, 62 aa, Glycine max
  Coding DNA Sequence Number=SeqID_79147
MSLAELGALLLLLLLPLLILIVVDIGGRDVVDEVAVAGAEVVETKTRVALTQVIGTGDILYT

SEQ ID NO: 195926 - protein, 293 aa, Glycine max
  Coding DNA Sequence Number=SeqID_79148
  Gene Ontology: Mol. function=RNA-directed DNA polymerase activity; Biological process=RNA-dependent DNA replication
MEAQLPPRRKSLNIDHYNELSDSDEHMDAFVTQMNLFTNDDAIMCRVFPIMLKVESKGYQIHLDGRENHVLRESAGIILKEVGELRTKNRPSPGADRSKYYQYHQVAGHNTEDCTSGKNPQPKTRLQGVINPIVGGFTRGGNSNSTRKGYVCNLKLVNPGINQCHYDPMVAKIEVANFLMWKVLLDNGSLADDLYWLAFKQLGIPEKHIESFSEQLIGLSLNELGAIISTPYLAMKFLSKDGKIISHTCTSLNSNLGETKLDPRKAEKKLEPTKEVKSFQLSNEPSQCTKLGC

SEQ ID NO: 195927 - protein, 200 aa, Glycine max
  Coding DNA Sequence Number=SeqID_79149
  Gene Ontology: Mol. function=protein binding; Cellular component =intracellular; Biological process=defense response
  Homolog annotation: Hit_ID=Q1S2K5; Match level="QueryCoverage=99%, HitCoverage=29%, E-value=7e-70, Identity=65%"; Hit description =Disease resistance protein; AAA ATPase
YFRDRILFLTVLQSPNVEQLRTNIWGYIIGNERLDANYVVPQWMPQFDCRSEAQTLIVLDDVWTLFVANQLVCRIPGCKFLVVSRPKFQMVLSYEVEFFIEDDAMYFFCHHAFGQKSIPLAINENLVKQVVIECGRFPLALKVIRASLRDQIEMFWLSVRNRISHGSSIGESHEINLIDKMTISINYLLEKIKECYLDLC

SEQ ID NO: 195928 - protein, 90 aa, Glycine max
  Coding DNA Sequence Number=SeqID_79150
  Gene Ontology: Cellular component=membrane; Biological process =protein modification process
  Homolog annotation: Hit_ID=Q9SW27; Match level="QueryCoverage=63%, HitCoverage=49%, E-value=3e-21, Identity=84%"; Hit description =Membrane-anchored ubiquitin-fold protein 3 precursor
MGEEDQTKGVPGKTVVPKSANEVKLISSGKILENNKTVGQCKVPFGETAGGVIIMHVVVQPSLSKTKAELMSEPTSTSLQLDLHDDILAC

SEQ ID NO: 195929 - protein, 178 aa, Glycine max
  Coding DNA Sequence Number=SeqID_79151
MAAFASSTSITDHIDAAIVKLTFDQFHFIATQNSMSTKLDKILQRLTLLEIHYQFSNVLLPSSIPSFEKPVAGVVPQSNTEDRAAKFESSFMEESLNSVSSQGRVARKSNHGSGMFRRGYGFGNHDCTVFHRHMPFKLDHSDSEDTNVVSFEVMKENPFWVYDREALRLFRKLGKGHL

SEQ ID NO: 195930 - protein, 127 aa, Glycine max
  Coding DNA Sequence Number=SeqID_79152
  Subcellular localization annotation: CTP_CleavageSite=35; ConfidenceScore=5.29e-01
MTETKATNVYFISGNHTTWKLAPRWKSYFNSSWTRGSSKCPREIGKNRRFAHSRQKGRLPQPPKPYNKTNPWKYTPPAFREGAATEVDSLSAKETNITGLSGLTRSGWVFAPPHSAEFTSKGKAPMT

SEQ ID NO: 195931 - protein, 94 aa, Glycine max
  Coding DNA Sequence Number=SeqID_79153
  Gene Ontology: Mol. function=DNA binding; Cellular component =nucleosome; Biological process=chromosome organization and biogenesis (sensu Eukaryota)
  Homolog annotation: Hit_ID=Q93YH8; Match level="QueryCoverage=58%, HitCoverage=13%, E-value=1e-18, Identity=82%"; Hit description=HMG I/Y like protein
MTGQIESDCHGSTSASTSQNAANEDLRRKLEHFQSKVKESLAVLKPHFNHESPVIAIATIQGLEVLGTMDLNAPLRDETLPQQEELPSPQPPVQ

SEQ ID NO: 195932 - protein, 278 aa, Glycine max
  Coding DNA Sequence Number=SeqID_79154
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=7e-29, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TTRPRLERTTRPHPREGYTPSPWVLVTLTVERTTRPRLERTTRPHHQRAARPHLQRTTCPRLERAKRPHRGTTRPHHQRAARPHLQRTTCPREGYTPSPWVLVTLTVERTTRPRLERTTRPHHQRAARPHLQRTTCPRLERATRPHRGTTRPHHQRAAHPHLQRTTCPRLERATRPHLGELHVLTFVGLHALTFRGLHVLANRGLHTLTLRGLHVLANRGLHALTLRGLHVLANRGLHALTLRGLHVLTNRGLHALTLRGIHVLAIRGLHALTSRGLH

SEQ ID NO: 195933 - protein, 81 aa, Glycine max
  Coding DNA Sequence Number=SeqID_79155
  Gene Ontology: Mol. function=binding; Cellular component=thylakoid; Biological process=photosynthesis
  Homolog annotation: Hit_ID=Q10CT3; Match level="QueryCoverage=59%, HitCoverage=14%, E-value=4e-11, Identity=61%"; Hit description=TPR Domain containing protein, expressed
MDGYCQLGCSYTGSAPFELAFVWRFLTSPPKWIKVNERRTLHDVLKEPNFIIPGIPVFYVVSKQSSFYGKFKAGKWAPPSI

SEQ ID NO: 195934 - protein, 66 aa, Glycine max
  Coding DNA Sequence Number=SeqID_79156
MKKPKRMKDKGLNKSRDVELALKKNEDEHMIEEECQRKNGRKEGNQAWTMVSMLLAWGSTYGGCSE

SEQ ID NO: 195935 - protein, 324 aa, Glycine max
  Coding DNA Sequence Number=SeqID_79157
  Gene Ontology: Mol. function=binding; Cellular component=thylakoid; Biological process=photosynthesis
  Homolog annotation: Hit_ID=Q75LL1; Match level="QueryCoverage=99%, HitCoverage=84%, E-value=6e-85, Identity=51%"; Hit description =Expressed protein
  Pfam annotation: Domain name=TPR_1; Domain location=105-138; Score =11.3; E_value=0.24; Accession=PF00515.18; Description=Tetratricopepti de repeat
  Pfam annotation: Domain name=TPR_1; Domain location=31-66; Score=8.9; E_value=0.46; Accession=PF00515.18; Description=Tetratricopeptide repeat
  Pfam annotation: Domain name=TPR_1; Domain location=71-104; Score =20.5; E_value=0.0059; Accession=PF00515.18; Description =Tetratricopeptide repeat
  Pfam annotation: Domain name=TPR_2; Domain location=105-138; Score =18.9; E_value=0.018; Accession=PF07719.7; Description=Tetratricopepti de repeat
  Pfam annotation: Domain name=TPR_2; Domain location=31-66; Score=2.0; E_value=19; Accession=PF07719.7; Description=Tetratricopeptide repeat
  Pfam annotation: Domain name=TPR_2; Domain location=71-104; Score =14.7; E_value=0.33; Accession=PF07719.7; Description=Tetratricopeptid e repeat
  Pfam module annotation: Pfam domain module=TPR_1::TPR_1::TPR_1::TPR _2::TPR_2::TPR_2; Domain location=105-138::31-66::71-104::105-138::31- 66::71-104
MALWMEKGSEPLTESEKADLEAIAALKESAAFEFKEKGNQYVKMGKKHYSDAIDCYTRAIDQKALSDSETSILFANRAHVNLLLGNLRRALTDSNEALKLCPSNIKAIYRASKASLSLDMLAEAREYCLKGLQFDPNNEDLKKLDRLIGLKISEKEKHEAEFSKAVAETKELASVIEHRGLKIGKAMYRELIGLRKPVLDKSNILHWPVVLLYAEVMSSDFIEDFCETDMFSVHLDMISFSVKWFMVYGLYLSNVFAEDQPLSWDVETNYKREFVELYYEAGSGVSLSKEKLIHCLLEGTAAAHREGVGDEEKDTIEDYKQHTG

SEQ ID NO: 195936 - protein, 376 aa, Glycine max
  Coding DNA Sequence Number=SeqID_79158
  Gene Ontology: Mol. function=nucleic acid binding; Biological process= DNA integration
  Homolog annotation: Hit_ID=Q1T010; Match level="QueryCoverage=93%, HitCoverage=42%, E-value=5e-31, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=229-367; Score =13.5; E_value=0.00044; Accession=PF00665.16; Description=Integrase core domain
MSQKLYKVFKNLGQISMRRKWQLIMMQNKKDESVVEYFTQILTLRNQMKNYGEKLEDVMVIGKIMRTLTPRFDYIVVAIEQGTDLEGMKVEEPTGILEAQELRLNERNSMRSSDQALQAQTYKGNSNNGGKNKKGKENGRTKGRTLVKIQAIGTRVIMKKTTRRMVEKIRVARRNSTRKGSSAIIGKKVPRKEDEAQLAYDEGSDSDDNVLLMVTTNSEDDNSNLWYLDTGCSNHMIGYREWFVNLDEKVFDNIGRLILKSPLSNNRTFKIEIQIMEHQCLATTINDGSWVSIIDGIIHEVTSPYTPQHNGVAKRRNKTILDMVISIMNGKKMSHHFWGEAVSTTTYILNRSPTKRLKGITPEEAWSGNMLDVSNF

SEQ ID NO: 195937 - protein, 1015 aa, Glycine max
  Coding DNA Sequence Number=SeqID_79159
  Gene Ontology: Mol. function=protein serine/threonine kinase activity; Cellular component=integral to membrane; Biological process=protein amino acid phosphorylation
  Homolog annotation: Hit_ID=Q1S227; Match level="QueryCoverage=99%, HitCoverage=99%, E-value=0.0, Identity=75%"; Hit description=Protein kinase; Actin-binding, actinin-type
  Pfam annotation: Domain name=LRRNT_2; Domain location=25-71; Score =43.5; E_value=7.4e-10; Accession=PF08263.3; Description=Leucine rich repeat N-terminal domain
  Pfam annotation: Domain name=LRR_1; Domain location=122-144; Score =12.1; E_value=1.5; Accession=PF00560.23; Description=Leucine Rich Repeat
  Pfam annotation: Domain name=LRR_1; Domain location=146-168; Score =11.7; E_value=1.8; Accession=PF00560.23; Description=Leucine Rich Repeat
  Pfam annotation: Domain name=LRR_1; Domain location=170-192; Score =18.6; E_value=0.022; Accession=PF00560.23; Description=Leucine Rich Repeat
  Pfam annotation: Domain name=LRR_1; Domain location=194-216; Score =17.4; E_value=0.053; Accession=PF00560.23; Description=Leucine Rich Repeat
  Pfam annotation: Domain name=LRR_1; Domain location=218-240; Score =10.1; E_value=3.7; Accession=PF00560.23; Description=Leucine Rich Repeat
  Pfam annotation: Domain name=LRR_1; Domain location=242-264; Score =8.5; E_value=7.3; Accession=PF00560.23; Description=Leucine Rich Repeat
  Pfam annotation: Domain name=LRR_1; Domain location=266-288; Score =5.0; E_value=33; Accession=PF00560.23; Description=Leucine Rich Repeat
  Pfam annotation: Domain name=LRR_1; Domain location=290-312; Score =16.3; E_value=0.11; Accession=PF00560.23; Description=Leucine Rich Repeat
  Pfam annotation: Domain name=LRR_1; Domain location=314-336; Score =9.9; E_value=4; Accession=PF00560.23; Description=Leucine Rich Repeat
  Pfam annotation: Domain name=LRR_1; Domain location=338-360; Score =14.4; E_value=0.41; Accession=PF00560.23; Description=Leucine Rich Repeat
  Pfam annotation: Domain name=LRR_1; Domain location=362-381; Score =10.9; E_value=2.6; Accession=PF00560.23; Description=Leucine Rich Repeat
  Pfam annotation: Domain name=LRR_1; Domain location=386-408; Score =8.2; E_value=8.3; Accession=PF00560.23; Description=Leucine Rich Repeat
  Pfam annotation: Domain name=LRR_1; Domain location=410-432; Score =11.1; E_value=2.3; Accession=PF00560.23; Description=Leucine Rich Repeat
  Pfam annotation: Domain name=LRR_1; Domain location=434-456; Score =4.8; E_value=36; Accession=PF00560.23; Description=Leucine Rich Repeat
  Pfam annotation: Domain name=LRR_1; Domain location=458-480; Score =3.7; E_value=58; Accession=PF00560.23; Description=Leucine Rich Repeat
  Pfam annotation: Domain name=LRR_1; Domain location=482-504; Score =15.4; E_value=0.21; Accession=PF00560.23; Description=Leucine Rich Repeat
  Pfam annotation: Domain name=LRR_1; Domain location=506-528; Score =13.1; E_value=0.99; Accession=PF00560.23; Description=Leucine Rich Repeat
  Pfam annotation: Domain name=LRR_1; Domain location=530-552; Score =16.3; E_value=0.11; Accession=PF00560.23; Description=Leucine Rich Repeat
  Pfam annotation: Domain name=LRR_1; Domain location=554-576; Score =12.9; E_value=1.1; Accession=PF00560.23; Description=Leucine Rich Repeat
  Pfam annotation: Domain name=LRR_1; Domain location=578-599; Score =7.2; E_value=13; Accession=PF00560.23; Description=Leucine Rich Repeat
  Pfam annotation: Domain name=LRR_1; Domain location=75-97; Score=7.8; E_value=10; Accession=PF00560.23; Description=Leucine Rich Repeat
  Pfam annotation: Domain name=LRR_1; Domain location=99-120; Score =8.1; E_value=8.5; Accession=PF00560.23; Description=Leucine Rich Repeat
  Pfam annotation: Domain name=Pkinase; Domain location=706-981; Score =148.1; E_value=2.4e-41; Accession=PF00069.15; Description=Protein kinase domain
  Pfam annotation: Domain name=Pkinase_Tyr; Domain location=706-981; Score=99.0; E_value=1.4e-26; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=25-71::122-144::146-168::170-192::194-216::218-240::242 -264::266-288::290-312::314-336::338-360::362-381::386-408::410 -432::434-456::458-480::...
  Pfam module annotation: Domain location=482-504::506-528::530 -552::554-576::578-599::75-97::99-120::706-981::706-981
MQMKTQFFFYFCCICCFSYGYAAAANDEVAALLSIKEGLTDPLNSLHDWKLVDKAEGKNAAHCNWTGVRCNSIGAVEKLDLSRMNLSGIVSNEIQRLKSLTSLNLCCNEFASSLSSIANLTTLKSLDVSQNFFTGDFPLGLGKASGLITLNASSNNFSGFLPEDFGNVSSLETLDLRGSFFEGSIPKSFSNLHKLKFLGLSGNNLTGEIPGGLGQLSSLECMIIGYNEFEGGIPPEFGNLTKLKYLDLAEGNLGGEIPAELGRLKLLNTVFLYKNKFEGKIPPAIGNMTSLVQLDLSDNMLSGNIPGEISKLKNLQLLNFMRNWLSGPVPSGLGDLPQLEVLELWNNSLSGTLPRNLGKNSPLQWLDVSSNSLSGEIPETLCTKGYLTKLILFNNAFLGPIPASLSTCPSLVRVRIQNNFLNGTIPVGLGKLGKLQRLEWANNSLTGGIPDDIGSSTSLSFIDFSRNNLHSSLPSTIISIPNLQTLIVSNNNLGGEIPDQFQDCPSLGVLDLSSNRFSGSIPSSIASCQKLVNLNLQNNQLTGGIPKSLASMPTLAILDLANNTLSGHIPESFGMSPALETFNVSHNKLEGPVPENGVLRTINPNDLVGNAGLCGGVLPPCGQTSAYPLSHGSSRAKHILVGWIIGVSSILAIGVATLVARSLYMKWYTDGLCFRERFYKGRKGWPWRLMAFQRLDFTSSDILSCIKDTNMIGMGATGVVYKAEIPQSSTIVAVKKLWRSGSDIEVGSSDDLVGEVNLLGRLRHRNIVRLLGFLYNDADVMIVYEFMHNGNLGEALHGKQAGRLLVDWVSRYNIALGIAQGLAYLHHDCHPPVIHRDIKSNNILLDANLEARIADFGLAKMMFQKNETVSMIAGSYGYIAPEYGYSLKVDEKIDIYSYGVVLLELLTGKRPLNSEFGESIDLVGWIRRKIDNKSPEEALDPSVGNCKHVQEEMLLVLRIALLCTAKFPKDRPSMRDVMMMLGEAKPRRKSGRSSETFSANKEMPAISSSPVNGLL

SEQ ID NO: 195938 - protein, 150 aa, Glycine max
  Coding DNA Sequence Number=SeqID_79160
  Gene Ontology: Mol. function=transferase activity, transferring glycosyl groups; Cellular component=membrane
  Homolog annotation: Hit_ID=Q1S232; Match level="QueryCoverage=58%, HitCoverage=16%, E-value=1e-43, Identity=95%"; Hit description =Exostosin-like
MREEVISLIPRLVYADPRSKLETLKDAFDVAVQAVIDKVTNLRKDIIEGRTDDNFIEENSWKYALLPEGEHEVGPHEWDPFFSKPKDGFSDFCFMYFSSLLSGSKNDLGGNINKIITVNGTRTSLTIEVMDRSVEVSFLRYISLPYTKMR

SEQ ID NO: 195939 - protein, 373 aa, Glycine max
  Coding DNA Sequence Number=SeqID_79161
  Gene Ontology: Mol. function=protein dimerization activity; Cellular component=nucleus; Biological process=regulation of transcription
  Homolog annotation: Hit_ID=Q8RW17; Match level="QueryCoverage=52%, HitCoverage=65%, E-value=2e-48, Identity=57%"; Hit description =Aux/IAA protein
  Pfam annotation: Domain name=AUX_IAA; Domain location=107-362; Score =139.5; E_value=9.4e-39; Accession=PF02309.7; Description=AUXIAA family
MKEPHEPDQTCGPTLPNALSPSLSHFHQHSHLTVPLIILFFFFCPQNYSIQFNSLLILPLPLFVILLQFSQKSYFYTLSGFSACGSMSTVSKDDNLALSSEDSSCPEESELELGLGLSLSSGSSSKSHHHHHARIYTAKDFPSSAAAAAAAASSPSSSSSSPNNITAGTKRAAADSLVANNRPSQVVGWPPLRTYRVNSFNSHAKSTEVFNSVAEKSKTDNTVARKTNDNGNDNNINAKEKRHLRSSLFVKVNMDGIPIGRKVDLSAHSSYETLAQTLEDMFNESTTVTTCKGSNGEDYGFIIGGERHSKLLDGSSKFVLTYEDKEGDWMLVGDVPWGMFFSSVRRLRIMRTSEANGLAPRLEENIKKRCKPI

SEQ ID NO: 195940 - protein, 161 aa, Glycine max
  Coding DNA Sequence Number=SeqID_79162
MTTLTQIWMTLLLSNILPSDHNSDLPLPKCQLVYAILTRISIHMAQVVADAIYWFAGMGPTRHPLDPEKSNGALGFPALITGLCQSYRVLVTPSKYCTPRQAQGDAHQNAGAPPPPQQADSARSLGVEWYLQHLVRQQAANHHGKVQIHECLYLFSLSQQG

SEQ ID NO: 195941 - protein, 66 aa, Glycine max
  Coding DNA Sequence Number=SeqID_79163
MWYMLVKNLIGCLGVHDKTDHTLVNQVTLTRLQGTFKPSVFILKVYTPKSLSGPLSPYSGPTQKIF

SEQ ID NO: 195942 - protein, 146 aa, Glycine max
  Coding DNA Sequence Number=SeqID_79164
  Gene Ontology: Cellular component=integral to membrane
  Homolog annotation: Hit_ID=Q1S9E8; Match level="QueryCoverage=59%, HitCoverage=41%, E-value=3e-26, Identity=63%"; Hit description=MtN3 and saliva related transmembrane protein
  Pfam annotation: Domain name=MtN3_slv; Domain location=1-73; Score =54.8; E_value=2.8e-13; Accession=PF03083.6; Description=MtN3saliva family
MVDLVEFQKVVIRTKSVEFMPITLSLLLTVSATMWMAYGILLRDIYVTLPNFVGITFGTIQIVLYLIYRKSKPVKDQKLPEHKNHVVNDENASTAVSGENQGPNTTGFVDIEIGEKKQVQEQAEKKQDQQFVNARDQTEHNKTRES

SEQ ID NO: 195943 - protein, 49 aa, Glycine max
  Coding DNA Sequence Number=SeqID_79165
MGAVTCITEWSRRTLHGLLSESVVWTHLGYFLGFGCCLDWIHGWMMSNC

SEQ ID NO: 195944 - protein, 85 aa, Glycine max
  Coding DNA Sequence Number=SeqID_79166
MVVILPKENLVVWFCSLHNKPDNYLTRIINSALKGLDDNPQPKSKAAARWIVVKYFNDARPLGQERLKVLRIQWAQYYLGLRDQT

SEQ ID NO: 195945 - protein, 50 aa, Glycine max
  Coding DNA Sequence Number=SeqID_79167
MQNSQRDVYLGAYINGPDNCLKGIINSALKGFNNSQGSKSKVAARWIVVK

SEQ ID NO: 195946 - protein, 94 aa, Glycine max
  Coding DNA Sequence Number=SeqID_79168
ESIIHRRWFKENFSQIWGRYYQGMEAKCLRKKGKYGEGMNEKVKVILWMNALLEPKLLNPRKTMNCWQPNPITSLESLSDSFLCVHCCMIEDEM

SEQ ID NO: 195947 - protein, 224 aa, Glycine max
  Coding DNA Sequence Number=SeqID_79169
  Gene Ontology: Mol. function=oxidoreductase activity; Cellular component=mitochondrial outer membrane translocase complex; Biological process=aromatic compound metabolic process
  Homolog annotation: Hit_ID=Q1SA66; Match level="QueryCoverage=100%, HitCoverage=51%, E-value=7e-93, Identity=72%"; Hit description =Pyridine nucleotide-disulphide oxidoreductase, class I; FAD -dependent pyridine ...
  Homolog annotation: Hit description=nucleotide-disulphide oxidoreductase
MENLFRLVDYEDMFSKRCIWVNGPVIVGAGPSGLATAACLKQQGVPFMVLERAECIASLWQKRAYDRLKLHLPKQFCQLPNLPFPKDFPEYPTKKHFIDYLESYAQKFEINPRFNECVQCARYDETSGLWRVKTVATCGAAKSEFEYICRWLVVATGENAECVIPEIEGLGEFKGDVIHACEYKSGESFKGKKVVVVGCGNSGMELSLDLCNHNASPSMVVRSS

SEQ ID NO: 195948 - protein, 100 aa, Glycine max
  Coding DNA Sequence Number=SeqID_79170
MTMIVDTLPVFYYGKWWATHLQSFEDLVFASERIDVGPKRGKVDHPTRTTEKTGANEEGEKEGETHAVTAIPIRPSFPPTQQCHDSANNKPPPYPPTSYP

SEQ ID NO: 195949 - protein, 185 aa, Glycine max
  Coding DNA Sequence Number=SeqID_79171
MGEVEEVQEQVKADTEALKEQMATMMEAMMSIKEIMEVNAVAIAATSTIAECKNKHAFPPYDLPPNYTPPNVAYTPSEDVNNSAPILFESRQPQTDHAHVSQTMGETHEIPHHNLADFEPCLGYATEGQAVGEERLKVVEESGGYAFANLEELFLVPNVVTPPKFKVSDFDKYKETTCPKNRLKD

SEQ ID NO: 195950 - protein, 152 aa, Glycine max
  Coding DNA Sequence Number=SeqID_79172
MALQRTRQPSMSALTQEHKHISLELRKLKAGHDQLEARVRCPQGDKHSAHTMHECTQEESHTQHTINTLDDPNLLHIHIHEGLATCRYPFVDRLMESNQFLGWKPLNLEHYDGTTDPDEHLDAFFTEDNLYNNSDAIMCQVFPTSPKGETLP

SEQ ID NO: 195951 - protein, 332 aa, Glycine max
  Coding DNA Sequence Number=SeqID_79173
  Gene Ontology: Mol. function=transcription factor activity; Cellular component=chloroplast; Biological process=regulation of transcription, DNA-dependent
  Homolog annotation: Hit_ID=Q710C2; Match level="QueryCoverage=95%, HitCoverage=67%, E-value=7e-76, Identity=44%"; Hit description=Sigma factor
  Pfam annotation: Domain name=Sigma70_r2; Domain location=189-259; Score=68.3; E_value=2.5e-17; Accession=PF04542.4; Description=Sigma -70 region 2
MLLSQENKGKRSLSSVNKMIDNTQMHFGEVSTVSMKFESFRAQHFCLLMDNLFVLEETFADYEALRLEKAIILQLEKLGALKLFNVCLSRSLGTSPVSDYADKEDLLGFSASVVKRVPNTKNKRIIVAKREAEISKGLKVLAELEKIRTAIEEDTKQVASLSNGAEASGVDEKVLQQLLHHGYYCRDELIQSTHSLVLYLARKYMGMGIALDDLLQAGYVGVLQGAGRFDSSRGYKFSTYVQYWIRKSILRVVARYARGIVIPPLNRAINQIQKARKAMKCMHKKCPDDYEIAKMTGLSLDKIKSASNCLRIVASLDQKVGNHLGVEYMVRL

SEQ ID NO: 195952 - protein, 199 aa, Glycine max
  Coding DNA Sequence Number=SeqID_79174
  Gene Ontology: Mol. function=oxidoreductase activity; Cellular component=mitochondrial outer membrane translocase complex; Biological process=aromatic compound metabolic process
  Homolog annotation: Hit_ID=Q1SA66; Match level="QueryCoverage=99%, HitCoverage=48%, E-value=9e-93, Identity=81%"; Hit description =Pyridine nucleotide-disulphide oxidoreductase, class I; FAD -dependent pyridine ...
  Homolog annotation: Hit description=nucleotide-disulphide oxidoreductase
VHVLPREVFGKSTFELAVLMLQWVPLWLVDKILLVLAWLVLGNMERFGLKRPSEGPLLLKNTKGKTPVLDIGTLEKIRSGDIKVVPEIKRFTNGCVEFVNGEKQHVDAVVLATGYRSNVPSWLQEGEFFSKNGFPKSPFPNGWKGNGGLYAVGFTRRGLSGASSDAMKIAQDIGQVWKQETRQKKQRTNACHRRCISQF

SEQ ID NO: 195953 - protein, 71 aa, Glycine max
  Coding DNA Sequence Number=SeqID_79175
MTIYSWKFCVGSSEGSHAIQVYDLPEESSNIPVAFGFGYYDWSDTYKVVAVFSNAESQKIEVKVHCLGDPC

SEQ ID NO: 195954 - protein, 173 aa, Glycine max
  Coding DNA Sequence Number=SeqID_79176
MKMIESLKVCYEEMKNGWIKEKGSKSVLIPENGPEEAVKKQDLGYVGDNNNCQTETKYGRESTVVHRAKAQSESSSSFKVHNKFKKSSLGRILKKGRNGQNSKPSSTNFSNSISKNGVKNCNRIFWIKNALAESNNAWDLGTSMGVTYGGDNKVIIKGEVGKRSGVGCKERFP

SEQ ID NO: 195955 - protein, 108 aa, Glycine max
  Coding DNA Sequence Number=SeqID_79177
  Homolog annotation: Hit_ID=Q41228; Match level="QueryCoverage=32%, HitCoverage=24%, E-value=9e-12, Identity=91%"; Hit description =Photosystem I reaction center subunit IV A, chloroplast precursor (PSI-E A) [Contains: ...
  Homolog annotation: Hit description=Photosystem I reaction center subunit IV A isoform 2]
MFHSKPLSACAALVLFPRLRSPKREPKTHNTDSHKELQEKSSWHQQHLDEPAAAAPATATPPAEAEAKPKPPPIGPKRGAKVKILRKESYWYKGTGSVVAVDQDPNTR

SEQ ID NO: 195956 - protein, 541 aa, Glycine max
  Coding DNA Sequence Number=SeqID_79178
  Homolog annotation: Hit_ID=UPI00005FA6A9; Match level="QueryCoverage =46%, HitCoverage=67%, E-value=1e-104, Identity=76%"; Hit description= COG0673: Predicted dehydrogenases and related proteins
  Pfam annotation: Domain name=GFO_IDH_MocA; Domain location=292-418; Score=122.3; E_value=1.4e-33; Accession=PF01408.12; Description =Oxidoreductase family, NAD-binding Rossmann fold
  Pfam annotation: Domain name=GFO_IDH_MocA_C; Domain location=430-539; Score=24.6; E_value=0.00036; Accession=PF02894.8; Description =Oxidoreductase family, C-terminal alphabeta domain
  Pfam annotation: Domain name=NAD_binding_3; Domain location=298-417; Score=-9.8; E_value=0.031; Accession=PF03447.6; Description =Homoserine dehydrogenase, NAD binding domain
  Pfam annotation: Domain name=Oxidored_molyb; Domain location=47-207; Score=219.8; E_value=6.3e-63; Accession=PF00174.9; Description =Oxidoreductase molybdopterin binding d
  Pfam module annotation: Pfam domain module=GFO_IDH_MocA::GFO_IDH_MocA_ C::NAD_binding_3::Oxidored_molyb; Domain location=292-418::430 -539::298-417::47-207
TERLTRASQRLLGGQRLAPEFSEADISPLFRANGTQMPDSDEYARLLANGFADWRLRVTGLVQQPLSLSLSDLQRFPSRTQITRHDCVEGWSAIGKWQGVPLGLLLDAARLRPGARYVVFLCADELEQTLDGSGRYYESIDLQDAWHPQTLLAYRMNDQPLPVAHGAPLRLRVERQLGYKHAKYLMEIKVVDSFAQLWGGRGGYWEDRGYEWYGGFSKSGSSDWTRTSDIRINSPPFYRLNYRGIVWNGAHIIGQAVASLRLIVRDVTNAMQNYILICRFCQIPRMCSMNKVRIGMIGSGYIGRCHAIAYAQAPTVFALKGEIVREMLAEVNPALAAQQAATFGFARSTGDWRELVRDPHIDVVDICAPNFLHKEMALEAIRHGKHVYSEKPLSLSVADAEEMVQAAEQAGVKTLVGFNYMKNPTSQLAREIIARGEIGEVVHFYGTHNEDYLARAETPLDWHCQKALAGLGALGDLAAHIVNMAHYLVGDIDEVSGDMMTVIKQRPDPKAPSRLLPVENEDQASALLRFKNGAHGVIETS

SEQ ID NO: 195957 - protein, 75 aa, Glycine max
  Coding DNA Sequence Number=SeqID_79179
  Gene Ontology: Mol. function=protein transporter activity; Cellular component=nuclear pore; Biological process=intracellular protein transport
  Homolog annotation: Hit_ID=Q9SLX0; Match level="QueryCoverage=78%, HitCoverage=11%, E-value=1e-10, Identity=54%"; Hit description =Importin alpha-1b subunit
  Pfam annotation: Domain name=Arm; Domain location=11-51; Score=17.7; E_value=0.042; Accession=PF00514.13; Description=Armadillobeta -catenin-like repeat
MRIKRSFKVVMGPRTRYLVDQRCIQALCDLLAYPNSEIVSNCLEGLENILVVGEVDKDIDRGNSFAERVDTCDGW

SEQ ID NO: 195958 - protein, 60 aa, Glycine max
  Coding DNA Sequence Number=SeqID_79180
MTCGSGGKRRRPIGLKSPVARRDQCGHLHLSWRCQRLPVETAKKSRLLSVRIKGPVACSD

SEQ ID NO: 195959 - protein, 235 aa, Glycine max
  Coding DNA Sequence Number=SeqID_79181
  Gene Ontology: Mol. function=formate dehydrogenase activity; Cellular component=membrane; Biological process=electron transport
  Homolog annotation: Hit_ID=Q48GN2; Match level="QueryCoverage=63%, HitCoverage=81%, E-value=3e-41, Identity=57%"; Hit description =HupC/HyaC/HydC family protein
MVCMFMSGWEIYNASPLFDFRFPPQMTLGGWLGGAIGWHLARPFSPRSVAASRRRAAAGYLAGADAAPAPPAWPLQRHSKADVSRRAGAGPIAGAVRPGDLEAGSAAGIGRPVWRLRFRALRAFLRHGRHWPVRGDPRLYGDRRAQNARRLMLRSGLTLGGIAMLTGCNLQDGDRVDKVLWAMSRWNDRVQAWLFSGQRLAQTYRPDQITQPFPFNAFYPEYNVPEIDLAGYRLE

SEQ ID NO: 195960 - protein, 35 aa, Glycine max
  Coding DNA Sequence Number=SeqID_79182
MPTSSHQLGGSSPESYSLDPAAVILLPRTMFVIIT

SEQ ID NO: 195961 - protein, 82 aa, Glycine max
  Coding DNA Sequence Number=SeqID_79183
MGLEIYPEVHENPRAFFRSSSAILLEYSIQYPWGVIMSLERSAYLWLRTMHVVVVGDGCRCGVGFVAVVVLGTTMVLGGGGV

SEQ ID NO: 195962 - protein, 286 aa, Glycine max
  Coding DNA Sequence Number=SeqID_79184
  Homolog annotation: Hit_ID=UPI0000D9B3B9; Match level="QueryCoverage =91%, HitCoverage=79%, E-value=3e-10, Identity=26%"; Hit description =PREDICTED: similar to splicing factor 3a, subunit 2
  Subcellular localization annotation: CTP_CleavageSite=29; ConfidenceScore=5.26e-01
MCPPPSSLEPLRIDCLALFANSPFSNFIRSPMNSLPSAIHVSSTFESGAPRIDCLALFANSPFSTFIRSPMNLLPSAVHVSSTFESGALRIDCLELFANSPFSTFIRSPMNSLPSAFHAYSTNESGAPRIDCLALFANSPFSTFIRSPMNSLPSAVHVSSTFESGALRIDCLALFANSPFSTFIRSPMNSLPSAVHASSTNESGAPRIDCLALFANSPFSTFIRSPMNSLPSAVHVSSTFESGAPRIDCLALFANSPFSTFIRSPMNSLPSAVHVSSHFESGAPQI

SEQ ID NO: 195963 - protein, 295 aa, Glycine max
  Coding DNA Sequence Number=SeqID_79185
  Homolog annotation: Hit_ID=Q47522; Match level="QueryCoverage=16%, HitCoverage=59%, E-value=2e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIVIGILVALWCHYTVFLHKSHPDATLPISISNYIKKESFKVISTSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 195964 - protein, 108 aa, Glycine max
  Coding DNA Sequence Number=SeqID_79186
MIDQGRLEVGSEEEEEQHVYMQSADEEGPKRPKPLRYAPPGGRKEEVTNISSLSAKVTNITGLSGITRSVRMFAPPSLLIQPSNTKRKAKMTEGQNGKVIPAPARMFR

SEQ ID NO: 195965 - protein, 85 aa, Glycine max
  Coding DNA Sequence Number=SeqID_79187
  Subcellular localization annotation: CTP_CleavageSite=45; ConfidenceScore=5.51e-01
MSWATGTRRPPRVIPLSCRSPLFPRQNPSSEHPRRLGGANMRTLRVMPLSPVILVTLADSELILVTSSFLPPGGAYLYGTARLSW

SEQ ID NO: 195966 - protein, 185 aa, Glycine max
  Coding DNA Sequence Number=SeqID_79188
  Pfam annotation: Domain name=Transposase_23; Domain location=88-158; Score=-1.2; E_value=0.0015; Accession=PF03017.5; Description =TNP1ENSPM transposase
MARTKKTGQIMFEAAKEIVDKIGSAGGSIIEKVTQQLMLSFNQMQSQLQSQIQSQGLALPPEPEVGPSATRVSTKGSCVDPSPTDLETGDLDKCGLYIKDNPSHLVALGRVYEGSIVVHNIPLLHGQVKVGVEQVKDAEAPVPVPTDEVNLVGQTLKTFLAWPTHLMKRVSEQVFYSYYMLLFFN

SEQ ID NO: 195967 - protein, 93 aa, Glycine max
  Coding DNA Sequence Number=SeqID_79189
  Gene Ontology: Mol. function=actin binding; Cellular component =cytoplasm; Biological process=cytoskeleton organization and biogenesis
FEEMHKCPKCRVSWYKVNDDDECSNDESIKKDPPMKVLWYLLIIPRFKHFFANEDDTKDLTWHTDGRNCDGMLCHPADSSRWKKINCLNLNFG

SEQ ID NO: 195968 - protein, 249 aa, Glycine max
  Coding DNA Sequence Number=SeqID_79190
  Gene Ontology: Mol. function=chitin binding; Cellular component =extracellular region; Biological process=chitin metabolic process
  Homolog annotation: Hit_ID=UPI000044A8F0; Match level="QueryCoverage =78%, HitCoverage=99%, E-value=1e-26, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLANRGLHALTFRGLHVLAFRGLHVLAIRGLHILANRGLRALTFRRLHALAFRGLYVLTIRGLHVLTFRGLHILAFRGLHAPAFRGLHVLTISGLHALTFRGLHVFTFRGLHVLAFRGLHALAFRGLHVLTIRGLHVLTFRGLHILTFRGLDVLAFRGLHALAIRGLYVLTFRGLHVLNFRVLHVLAFRGLCVLTFSGLHIHALRDCDHKAPSGPGGAQQGPGVSSSGYRPLSALQGARPPQKGHAIVK

SEQ ID NO: 195969 - protein, 97 aa, Glycine max
  Coding DNA Sequence Number=SeqID_79191
  Gene Ontology: Mol. function=ribonuclease H activity; Biological process=DNA integration
MMKEMCEDFKIQHQNSTPYRPKMNGAVEAANKNIKKIVQKMTMSYKDWHEMLLFAVNYEGPFVVKKALLRGALLLARMDDEELPSPVNSDIVKRYYA

SEQ ID NO: 195970 - protein, 129 aa, Glycine max
  Coding DNA Sequence Number=SeqID_79192
  Gene Ontology: Mol. function=structural constituent of ribosome; Cellular component=ribonucleoprotein complex; Biological process =translation
  Homolog annotation: Hit_ID=Q9BBQ0; Match level="QueryCoverage=85%, HitCoverage=90%, E-value=4e-52, Identity=92%"; Hit description =Chloroplast 50S ribosomal protein L14
  Pfam annotation: Domain name=Ribosomal_L14; Domain location=10-129; Score=213.3; E_value=5.4e-61; Accession=PF00238.10; Description =Ribosomal protein L14pL23e
MSPRWTIWVRIFQTTGYTDNSGARELMCIRILGASNRRYAYIGDIVVAVIKQAVPNTNLERSEVIRAVIVRTCKELKRSNGIIIQYDDNAAVVIDHEGNPKGTRIFCAIARELRQLNFTKIVSLSPEVL

SEQ ID NO: 195971 - protein, 37 aa, Glycine max
  Coding DNA Sequence Number=SeqID_79193
MVMLQKHNAEAHKIQYKNGWHCTARILKTEGVWLIDL

SEQ ID NO: 195972 - protein, 46 aa, Glycine max
  Coding DNA Sequence Number=SeqID_79194
MASKHILKELKDLQKDPPTSCRSSSRYKEYVTGLFTGVVVVATTTL

SEQ ID NO: 195973 - protein, 91 aa, Glycine max
  Coding DNA Sequence Number=SeqID_79195
  Subcellular localization annotation: CTP_CleavageSite=52; ConfidenceScore=5.05e-01
QDTQWTRRSPTGSWVSSSDYEPLSVLQSARPPSKFIRPPINRAFIKKYCAPRQAQGETPQQPRDGRQRATDAPPPPLEFTSAHPQKGRKIP

SEQ ID NO: 195974 - protein, 68 aa, Glycine max
  Coding DNA Sequence Number=SeqID_79196
MASTNSSHAFYSQCCRYMFMNAIESFHSVTLPSANDATDADPPPLTADTPSRFARLFTKTSFQATMND

SEQ ID NO: 195975 - protein, 91 aa, Glycine max
  Coding DNA Sequence Number=SeqID_79197
MHERKRNSWGSEKRGREWRIALSNHYAWLQTRGWRMHERKRNSWGSEKSGREWRIALSNHYAWLQTRGWRMHERKRNSWGSEKGLENGELH

SEQ ID NO: 195976 - protein, 98 aa, Glycine max
  Coding DNA Sequence Number=SeqID_79198
MASRKRKSTSSRPQPNYDTRKFTSEEAWNRYADNILDRNILQERNAKLYITEFEEFRRELERHNPHKCLTNLADGSIDVAVVKELYANLYNPEDNLPK

SEQ ID NO: 195977 - protein, 98 aa, Glycine max
  Coding DNA Sequence Number=SeqID_79199
  Subcellular localization annotation: CTP_CleavageSite=52; ConfidenceScore=5.56e-01
MLLRISAQPIFLLAGPFADLNFSLASLAFPSSNFRARWSRELSQRALRGRARARLTGALSKGGKVCGVATNVYLWKTSEKSKETGQNENSKFGSCIYA

SEQ ID NO: 195978 - protein, 216 aa, Glycine max
  Coding DNA Sequence Number=SeqID_79200
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=8e-19, Identity=28%"; Hit description= UPI00006A17C9 related cluster
MSSPLEGARRAHLQRTTRPYLQMVHALTLKGLQVLAFRGLHVLTFRVLHVLTFRGQHVLTLKGPHALAFRGLHTLTFRGLLVPAFKGLHVLTFRGLHVLTLRVLHTLTIRGLHVPDFRGLHVLSFRRLHVLTFKGYTVLHVLAFRGLHVLAFVGLHALPFRGQHALTFRGLHVPAFRWYTFSPSDDYMCSPLDGYTPPPSQGLMPSPSGDYMSSLS

SEQ ID NO: 195979 - protein, 160 aa, Glycine max
  Coding DNA Sequence Number=SeqID_79201
MVRTRGLGRALGAGKGRGISEDTHEADVPLCRRPTASARRQQVRLREDVTERPEDVPQLHEDVPHVSDATPEMTGAADAVQTEGVATDGSLGSPAADEGFPGGPRDPSILTDFAEHEQPDLKLVSHGRKVDKIGRPAPEIERVGCWHRIKSTDQVFCYHH

SEQ ID NO: 195980 - protein, 60 aa, Glycine max
  Coding DNA Sequence Number=SeqID_79202
MEIAGCTGKKQARKQDEREPISFLTKMWGVKMRGKREEGSEGRKIGELSQDKYFKFRFGL

SEQ ID NO: 195981 - protein, 152 aa, Glycine max
  Coding DNA Sequence Number=SeqID_79203
  Pfam annotation: Domain name=zf-CCHC; Domain location=81-98; Score =19.3; E_value=0.00065; Accession=PF00098.13; Description=Zinc knuckle
MEPMRLHQHEENDKKRKGIAFKASSSSIQEESDKEDLNEIKEDDDFRFFVKRFNKFLKNKGNQRRSNINPKKKGEDSSLAPKCYECNQPGHLRLNCHVLKRRMEKSDKKNFKEKKACIWEDNDMDSSSNSENEIINLGLMAKDYESEEELAH

SEQ ID NO: 195982 - protein, 312 aa, Glycine max
  Coding DNA Sequence Number=SeqID_79204
  Homolog annotation: Hit_ID=Q6A9Q5; Match level="QueryCoverage=17%, HitCoverage=15%, E-value=2e-19, Identity=74%"; Hit description =Phospho-N-acetylmuramoyl-pentapeptide-transferase
  Pfam annotation: Domain name=Glycos_transf_4; Domain location=11-181; Score=-60.4; E_value=0.0043; Accession=PF00953.11; Description =Glycosyl transferase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPFNQWCSRPTTAGNHCYAVRDPHDIAVVAIAIAGACFGFLWWNAKPAQIFLGDNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 195983 - protein, 127 aa, Glycine max
  Coding DNA Sequence Number=SeqID_79205
MIMRGQDIYSSQDKATTSPSSSESEEAKGEESSEEIYPQEDGQPLAIKEKCKEALASIATPLGLEFIPQVKLLDEGLVRKSLNPCALLVPKIGIIRHQVPKIGGMMNVLSGATLFCKITRTPNIFME

SEQ ID NO: 195984 - protein, 203 aa, Glycine max
  Coding DNA Sequence Number=SeqID_79206
  Homolog annotation: Hit_ID=Q0YZC5; Match level="QueryCoverage=66%, HitCoverage=61%, E-value=5e-37, Identity=60%"; Hit description =Forkhead-associated
ELRNGDTIEVGKYKIRFLQDADAQNFEKTMVFKPGMAPALNAAARPGGVAAPPAPMNAVIRVLSGAAAGREVALHKVVTTIGKPGVAVASITKRIQGFVLAHVEGPDMPLLNGLAIGSSPVPLKSGDKLELAGTEMHGRHRGGAPIRPIVSRITIHWPSFYNVVTGKTLALPNLIALQHIPLSPAGVIAKRPAPIALPNSCAA

SEQ ID NO: 195985 - protein, 148 aa, Glycine max
  Coding DNA Sequence Number=SeqID_79207
MEAIKEQMATMMKAMMSMKKIMEANAVIVAAISAVAKVNPMLPSGLKQMNHPTSNMPWLGYATEGQAVGGIPFENTLEGPQFRPQPQPLHFAVGRAPPAMAEKGKVDHLKERLRAIEGGEDYAFANLEKLFLIPKHGHSQVQGAGLWQ

SEQ ID NO: 195986 - protein, 103 aa, Glycine max
  Coding DNA Sequence Number=SeqID_79208
DNIASQQEDATVATTGVHQPNKEVQLVSKTKKRIAKFDIAEATKVKTKVMSTVATRWRQFKSTLTSKFVFAKSEGQQTQDVVTKYGLDPEAWKQFEETRLTPN

SEQ ID NO: 195987 - protein, 264 aa, Glycine max
  Coding DNA Sequence Number=SeqID_79209
  Gene Ontology: Mol. function=carboxypeptidase activity; Cellular component=membrane; Biological process=auxin mediated signaling pathway
  Homolog annotation: Hit_ID=Q5ZFS7; Match level="QueryCoverage=67%, HitCoverage=58%, E-value=8e-56, Identity=65%"; Hit description =Nodulin-like protein
MKCPQSLDGCLVELLVKIEIENIFLMSNRLLIFSFLRLVLSCAISNMLSTMTFVMAAIFRMEKLNVRKVRCQPKVIGTVVTVVGAMLMTLYKGQVISFFGSKYMHHPTNYVPENNTDSGEKDWFKGSVLLVLATLSWASSSFRQAVTLRKYTVQLSLTALVCALGNNIIRYHLLCSRDCHAEKRACFRYCFQPFDDDYRSHHGCLHPCRKNISWRVLGTPTLTYWQTTSGLSNPTLKWKHTTTCLGLPDIEMGQNNDVFWATRH

SEQ ID NO: 195988 - protein, 78 aa, Glycine max
  Coding DNA Sequence Number=SeqID_79210
MEDRVTTDRSSSLPALDEQRTSLQGTLISSGDLCLVACDFHLTILRNRGANSNQAHLGPPEDSSRRRLLLEEAPCSPG

SEQ ID NO: 195989 - protein, 62 aa, Glycine max
  Coding DNA Sequence Number=SeqID_79211
MATPLGMEWRFICGHVGSPTRLITMKAHLEFSSFGDALSLVVPNATMLLPKRMISLEADKAT

SEQ ID NO: 195990 - protein, 135 aa, Glycine max
  Coding DNA Sequence Number=SeqID_79212
MIPRRKSCSFVLRLKASVPRPRIAFGHLFYPQRAVLIHINQPRGPKLKKPCSYIVEAFHRALGGRMFRHEYQENGGNVACPITLECTLGLRPSLTTPQFNKNKRQFKDKSLTFFSKYKQLRAPKYINGKLESPRM

SEQ ID NO: 195991 - protein, 347 aa, Glycine max
  Coding DNA Sequence Number=SeqID_79213
  Gene Ontology: Mol. function=metal ion transporter activity; Cellular component=integral to membrane; Biological process=metal ion transport
  Homolog annotation: Hit_ID=Q8XS16; Match level="QueryCoverage=59%, HitCoverage=63%, E-value=3e-53, Identity=49%"; Hit description =Probable magnesium and cobalt transport transmembrane protein
  Pfam annotation: Domain name=AzlD; Domain location=31-127; Score =42.3; E_value=1.6e-09; Accession=PF05437.3; Description=Branched -chain amino acid transport protein (AzlD)
SYAYSGHPRCAAVRTGNAFCACRAKMLNSLVIAGITLLAAGTYAIRFAGYRLGSRMHMSERVRNMLSDAATVLLLDVSVTTALFEGTDFAGVARLTGVLFAVFLAWRRAPLILVIIGAAVMTALLRYFGVPDSEYNKDNAKMVINCVVYRHGKREEHVEVDQISEVLKEEKSFVWLGLYQPDPAFMQTLQEEFSLHELAIEDALVAHQRPKIEQYGESVFIVVKTAHMEDRQRISFGETHFFLGKNFLITVRHGSVEGYKAIRAKAEKNHAMLCQGPGYALYCILDFIVDNYSKITESLSERIADLEDGMFTTRFDSVTLENVYHLRRQLLSLRNAAMPVTEICPQL

SEQ ID NO: 195992 - protein, 45 aa, Glycine max
  Coding DNA Sequence Number=SeqID_79214
MCKCRTLDIWKTRAQRETSENEQYGTQNQVRPLEFCYLYTDFQEF

SEQ ID NO: 195993 - protein, 702 aa, Glycine max
  Coding DNA Sequence Number=SeqID_79215
  Gene Ontology: Mol. function=protein binding
  Homolog annotation: Hit_ID=Q8ZL36; Match level="QueryCoverage=65%, HitCoverage=80%, E-value=1e-155, Identity=55%"; Hit description =Putative inner membrane protein
  Pfam annotation: Domain name=AsmA; Domain location=190-702; Score =239.4; E_value=7.6e-69; Accession=PF05170.4; Description=AsmA family
  Pfam annotation: Domain name=Xan_ur_permease; Domain location=1-154; Score=-80.1; E_value=4e-05; Accession=PF00860.11; Description =Permease family
  Pfam module annotation: Pfam domain module=AsmA::Xan_ur_permease; Domain location=190-702::1-154
  Subcellular localization annotation: CTP_CleavageSite=72; ConfidenceScore=5.08e-01
MLVFMVTSLETIGDITATSDVSEQPVSGPLYMKRLKGGVLANGLNSFVSALFNTFPNSCFGQNNGVIQLTGVASRYVGFVVALMLIVLGLFPAVSGFVQHIPEPVLGGATIVMFGTIAASGVRIVSREPLNRRAIMIIALSLAVGLGVSQQPLILQFAPDWLKTLLSSGIAAGGITAIVLNLVFPQEKLLSCNGNSGITTTHRINIGMDGCDEIFRQVFPYLVTADSAGAGGSLCAAANPHNFSSPSHIILDDFSFGHDGQPAVLVAKRVDLGLALVQFSDPLHFDSIEVRDGDINLANQSPQTTLPIQANRLQLNNVQIESPHSALPLAAQRVNGGIVPWKPTPDDMLGSDAQFQMSAGAMTLDGVAGNNVLLQGNIAKRRLVLSNIGADLARGSMTGRAERDAQGNWQINQLRLNDIRLQTQQSLSEFLSPLRDVPSVSINRLDMTDARLQGPDWAVTDLDLTLKNITLRGDDWQSDDGSLAMNAGNFINGSFELNDPIVNAEFSPQGIQLTQFSSRWVNGVIRASGSWTRSDKRLTLDDLAIAGLEYTLPQNWRDRWQQTLPGWLDSVLVKRATANRNLVIDINPAFPFQMTALDGNAENLLLARQHQWGIWAGKASFNAAEATFNRTDLRHPSISLNASDRQIEVSEMSAFNGSGLLEGTATAGQEAQRPFTLNLKGQAVPANVLQNWGWPALPLSGS

SEQ ID NO: 195994 - protein, 70 aa, Glycine max
  Coding DNA Sequence Number=SeqID_79216
  Gene Ontology: Mol. function=unfolded protein binding; Cellular component=cytoskeleton; Biological process=tubulin folding
  Homolog annotation: Hit_ID=O04350; Match level="QueryCoverage=66%, HitCoverage=41%, E-value=3e-11, Identity=70%"; Hit description =Tubulin-specific chaperone A
MMIPDCRKRLEAALADLKGILAELEESDEKASLEIDEAKNTIVEVEKVDSNPLCQGAKKLTQHFHLWLWS

SEQ ID NO: 195995 - protein, 402 aa, Glycine max
  Coding DNA Sequence Number=SeqID_79217
  Homolog annotation: Hit_ID=Q8H348; Match level="QueryCoverage=87%, HitCoverage=99%, E-value=1e-40, Identity=38%"; Hit description =Putative fiber protein
  Pfam annotation: Domain name=DUF761; Domain location=7-379; Score= -24.7; E_value=1.7e-08; Accession=PF05553.2; Description=Cotton fibre expressed protein
MGYVSMKVVLISTGVLSMAMGLKLTLPLLSHFLLNQAPHVWTFLLTCFTPPYLYILLNFIILTIVASSKLNNHHHSPPDTTVLLPSDPVIYALPPAAVQILAPETVNISAAVQTDYNAVASEKYLYETKPTLSYDTVTEGNGSVGYVYDENTPVKATVNNDDEAVGVVSPSLQRKDSSDFAFANENLKPPVSARFSHRKSVRASPEDINREEDAIVSAVMHWILLELRKVFEMREGGGVGSGEGEEAGDVGEHVEDDNGGESDAVNAASEEGGDVGEGDAVTGLERRGQIDEEVGDVRGEGEERVDEAEEGAVAESGRVEPPSGSVHQQVQCGYEAAEAGVAEAVQGDDESRSSLTHTSHKTFAPIIKLGGKKENVIKQGFLVLHCIGFLFRQMMNETQFGI

SEQ ID NO: 195996 - protein, 76 aa, Glycine max
  Coding DNA Sequence Number=SeqID_79218
MKMKHFLGSGRPLQRLIISKQKFAELEEVPFQPIDLSIRSMPKLMALNGAKTSVSEKLLYGAAAKTMRHKAAVMKN

SEQ ID NO: 195997 - protein, 75 aa, Glycine max
  Coding DNA Sequence Number=SeqID_79219
MPMLDQFHPCIHDFIENIVDVKTDGMSEDSWSLVCNQLLKELTKWFDEYINLLGGIDRFEESKRSDYPWFPWTSG

SEQ ID NO: 195998 - protein, 242 aa, Glycine max
  Coding DNA Sequence Number=SeqID_79220
  Homolog annotation: Hit_ID=Q2HRX8; Match level="QueryCoverage=42%, HitCoverage=14%, E-value=1e-13, Identity=40%"; Hit description=IMP dehydrogenase/GMP reductase
  Pfam annotation: Domain name=DUF1723; Domain location=40-89; Score =31.5; E_value=2.9e-06; Accession=PF08330.1; Description=Protein of unknown function (DUF1723)
MVRTRGLGRALGRVIGRALGREERPKLKLSSHGRKVDKFGMPAPKIEGLVERWHKETTSFHLLVGEVIITLDDVASLLHLPITGAFHNFEALHVDKVVLLLVELLEVSLEEARAEIIQYHEAYCWIYEHFPFVAYSIAVKDYHERKPPVCRWKSGKALPVSTYHKRLDRLMSNVTCWIPYGDHRAFREFEIISLFSRHIRWGPSIIIHRPERVVRQFGYVQTIPPHPVASSLCIEDIDDRWI

SEQ ID NO: 195999 - protein, 89 aa, Glycine max
  Coding DNA Sequence Number=SeqID_79221
MSLAQPGDPPRHSPMVHNNTFVEPDVPQHPMAATIMDKALADAHVDVDQTQHAVACLSIVERLERLLNLKIVIEGTKTYTVIEDYLRIA

SEQ ID NO: 196000 - protein, 69 aa, Glycine max
  Coding DNA Sequence Number=SeqID_79222
  Homolog annotation: Hit_ID=Q70VU9; Match level="QueryCoverage=79%, HitCoverage=18%, E-value=8e-10, Identity=53%"; Hit description =Farnesylated-proteins converting enzyme-2
MEQDGVVSQPVALMACIAMALFYVAILYAPTVLIRLPPPPSFKAYMIRRFLCAVVSSILSLFISALILP

SEQ ID NO: 196001 - protein, 80 aa, Glycine max
  Coding DNA Sequence Number=SeqID_79223
MVQPRLVRKTYMLPLLSSKVSGLGLSSAIGIREREDMNVNECSDAIKSTLPQSILPFSGFVDFVAMIKRMAEERDIVPIF

SEQ ID NO: 196002 - protein, 86 aa, Glycine max
  Coding DNA Sequence Number=SeqID_79224
MSMKTCLKAFLTSDSEAPRCILKVFIGAGGGGLFSGGEQSQEIAGRKKFRETRHPVYCRVRRRDSDKWVREGFVEWKNDERVSDES

SEQ ID NO: 196003 - protein, 71 aa, Glycine max
  Coding DNA Sequence Number=SeqID_79225
MNNQHNVKNTIESNQNTVENNQNNQNHDFTVEKSFKRKTYRESKSDNDIYTVSKSEFNSDDTVSDTTVVSP

SEQ ID NO: 196004 - protein, 139 aa, Glycine max
  Coding DNA Sequence Number=SeqID_79226
MANTMMKTNKKAEEMFNTVHVIDQDAPSIMYPFIKVARFTHLNLEGTTECRIVYNHHRKTVKIGNEWRARRGSRVRFPKEERCAELPPTFNCGKRRKNRRKPVKTKILSSRVVFTFEEGRLKRGFCSYVPSIEEEIRPT

SEQ ID NO: 196005 - protein, 113 aa, Glycine max
  Coding DNA Sequence Number=SeqID_79227
VEAHKESLVEEHDSKEKDEEKSEEKTQQWEKHSQVEIQQESILQVNTPPHQLIVKEERHGKHEKALSVILSLIVTTSLAIMWKVLPEYTSFKVLPKCVLCDLHATLKTFDLSS

SEQ ID NO: 196006 - protein, 179 aa, Glycine max
  Coding DNA Sequence Number=SeqID_79228
MDDEAIKLSGSNRRPHSEITKNSKRGNAKANMETDNLDSVQEPKSETQLNTVPRKRGRNKTWEISQSRKARNCSSPYPSSEKPTSRKDKLHRMPKTVSETLVCMQKSENIAKAVQSRRTQNIGTDFLANDTSKVHEALASKPKADENTNTASVNNNYPDAGAISSAISSKTRSEKQVHK

SEQ ID NO: 196007 - protein, 111 aa, Glycine max
  Coding DNA Sequence Number=SeqID_79229
MVIDQSLFHNLTQLSSDGVPFEEHDGSWVKKGAQPADDEGNLPIEDNSSLLRRLLDKFDGLQTFVGDKFDAMELQVDMRFDAMDSRITKVEEDVSFIRTCFDPPPPPPSSS

SEQ ID NO: 196008 - protein, 54 aa, Glycine max
  Coding DNA Sequence Number=SeqID_79230
MVVEDRTACGSEGIENETEEGKIVEVENDEDYSEAEDMIVKEGFLEDNVVNLYT

SEQ ID NO: 196009 - protein, 149 aa, Glycine max
  Coding DNA Sequence Number=SeqID_79231
  Subcellular localization annotation: CTP_CleavageSite=33; ConfidenceScore=5.48e-01
MTTLVQFSIKCSNLKPNFFHHGIYKRPTRSFSRIETKFGSFNGNNLKLTAGRVSLFFLGGEVFKNGVLWEEKGCKRKKRVVLVKNNQGFGFNGGGGGGGRDDGATARILGNLALAIGLTYLSMTGQLGWILDAIVSIWVLFNIPSRGLL

SEQ ID NO: 196010 - protein, 37 aa, Glycine max
  Coding DNA Sequence Number=SeqID_79232
MEPIDAATISSAGARYALPTFRLRVILFRWHVRDWVG

SEQ ID NO: 196011 - protein, 99 aa, Glycine max
  Coding DNA Sequence Number=SeqID_79233
  Homolog annotation: Hit_ID=Q75ID5; Match level="QueryCoverage=55%, HitCoverage=61%, E-value=4e-11, Identity=51%"; Hit description =Expressed protein
MALIMKVQRSLIDHHGPPKVNFWQDPTSPSKWKEEHFVIVSLTGWGVLFYIGYKFFTRGKGKNEEGSFLHSGVWNFLMNSSLACLAADNWRIKQGLRLL

SEQ ID NO: 196012 - protein, 238 aa, Glycine max
  Coding DNA Sequence Number=SeqID_79234
  Gene Ontology: Mol. function=protein kinase activity; Cellular component=membrane; Biological process=protein amino acid phosphorylation
  Homolog annotation: Hit_ID=Q2QZ78; Match level="QueryCoverage=92%, HitCoverage=39%, E-value=2e-58, Identity=49%"; Hit description=AT hook motif-containing protein, putative
MNLVLLEVEKLLKANQSSLKDYPSMPYPENANLLTHADNDLFLSELNFNNEELRSKFLNLFSQMTDQQAKIYNQIIQAVNKNEGGMFFLYGYGGTGKTFIWKTLAASLRADNKLVIMVASSGIASLLLPGGKTTHSKLKILVPIFEDSTCNIHQGTQLAELLNEASLVIWDEAPMAHKFCFEALDRSLRDVIKAKLSSDKIFGGKVMVFGGDFRQILPVIPRGSCSDIVNSTINSSYL

SEQ ID NO: 196013 - protein, 245 aa, Glycine max
  Coding DNA Sequence Number=SeqID_79235
  Gene Ontology: Mol. function=protein serine/threonine kinase activity; Cellular component=membrane; Biological process=protein amino acid phosphorylation
  Homolog annotation: Hit_ID=Q6J6Y5; Match level="QueryCoverage=47%, HitCoverage=63%, E-value=7e-39, Identity=68%"; Hit description=Pto -like receptor kinase resistance protein
  Pfam annotation: Domain name=Pkinase; Domain location=25-222; Score= -68.2; E_value=0.00017; Accession=PF00069.15; Description=Protein kinase domain
  Pfam annotation: Domain name=Pkinase_Tyr; Domain location=10-204; Score=-58.4; E_value=6.9e-09; Accession=PF07714.7; Description =Protein tyrosine kinase
  Pfam module annotation: Pfam domain module=Pkinase::Pkinase_Tyr; Domain location=25-222::10-204
  Subcellular localization annotation: CTP_CleavageSite=58; ConfidenceScore=5.08e-01
MTILTKNFVLRINFTFVSYTNANPYVFKEHAINVNAKTLTLTFVPSKNSVAFNVHIPRNAPLSKQGLAEFQNEIHLLSKLQHLHIVPLIGYCHEGEEMILVYEYMANGSLSKWLYEHSESPLSWKQRLEICMGAARGLHYLRTNTAEGIIHRDVKTDNILLDENFVAKVARFWHLKERFAEVSKRCLAENRINRPPMGFVLCCLEDALHLELSNIADEENSFLNYEMQDNARIEGELDAVLPISL

SEQ ID NO: 196014 - protein, 83 aa, Glycine max
  Coding DNA Sequence Number=SeqID_79236
GKLVITHNHSKSISGKLISVQIYSGTEVDPDKEKTVVVDGRSRELGLVDVDRRKRWVAGGSGAKTVIEAHRRSRFQRGRQEEG

SEQ ID NO: 196015 - protein, 81 aa, Glycine max
  Coding DNA Sequence Number=SeqID_79237
  Homolog annotation: Hit_ID=Q9FG54; Match level="QueryCoverage=48%, HitCoverage=11%, E-value=4e-10, Identity=72%"; Hit description=Root cap protein 2-like protein
  Pfam annotation: Domain name=Root_cap; Domain location=43-81; Score =44.7; E_value=3.2e-10; Accession=PF06830.2; Description=Root cap
MERNLPSKKATSLHGNARKINIMVTLPEVVEIYVNVVPVTKEDRVLGRTYQPDFQNPAKSGVAMPVVGGEDKYRITSLISA

SEQ ID NO: 196016 - protein, 82 aa, Glycine max
  Coding DNA Sequence Number=SeqID_79238
MGWPQQKNCGNQRGFPTMLESKYKFLGLPANGTTIDLEILSSSEGPGPLKFGSRSVIIKYRMKTCCSYIQHGNQKNVPSQEF

SEQ ID NO: 196017 - protein, 156 aa, Glycine max
  Coding DNA Sequence Number=SeqID_79239
  Gene Ontology: Mol. function=RNA-directed DNA polymerase activity; Cellular component=chromatin; Biological process=chromatin assembly or disassembly
MALEGGTTTLLSSLSRILAFDTVGHELCDVIPKSRPVQILQEPSYHLRDPHMPSCGCCMIFNKERRNYWEGVMPEKSRCLGANCGIVGDWPIADVVHRERSSKEQRGSLREKMCVLSYSIKRARYICCSGVCMTWVNNSLRLRWSMMIVNWWPNRY

SEQ ID NO: 196018 - protein, 116 aa, Glycine max
  Coding DNA Sequence Number=SeqID_79240
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=92%, HitCoverage=8%, E-value=5e-16, Identity=47%"; Hit description=Chromo
MTSGNDITGQILVPSCISEGGQTCGFKGGRRLSIARTTVNESCEEFFGLGKLLPSAQKAFEQLKQVLSTTPVLALPDFLVSFTVETDSFGNGMGAVLSQRGHPIAYFSKPFSKKLL

SEQ ID NO: 196019 - protein, 267 aa, Glycine max
  Coding DNA Sequence Number=SeqID_79241
  Gene Ontology: Mol. function=RNA-directed DNA polymerase activity; Cellular component=chromatin; Biological process=chromatin assembly or disassembly
  Subcellular localization annotation: CTP_CleavageSite=23; ConfidenceScore=5.02e-01
MAFPGVWSRTGTLYSSVRLTILKVMVKSNTGTTPYEITFGRKPFSFPEYLSGTSNLDVVDEILTNWEEVFNSIRKKLIKAQASMKHHVDAKHREINCQTGDWVRLKLHPYRQKSAKGAQVVSDKLAKRFYSPFQIIDRIDTVAYQLQLPESSQIHPVLHCSMLKSFHGIPDRANIAQLPDHFVNDQPLITPLAISDYRHSSRIKDAPWDVLDHHLEDKVILQGPKEDNSISEAIPEMETGTTIAKAAMQMAKTKRSSTRPSYLKDYV

SEQ ID NO: 196020 - protein, 58 aa, Glycine max
  Coding DNA Sequence Number=SeqID_79242
MCFTFDVLDCCLTYRDWRPKWRSRLEGQLQVKDREILTITRTVAKNSQTLKAQNEKLQ

SEQ ID NO: 196021 - protein, 332 aa, Glycine max
  Coding DNA Sequence Number=SeqID_79243
  Gene Ontology: Mol. function=RNA binding
  Homolog annotation: Hit_ID=Q1T290; Match level="QueryCoverage=63%, HitCoverage=50%, E-value=3e-33, Identity=40%"; Hit description =Cyclin-like F-box
  Pfam annotation: Domain name=F-box; Domain location=13-60; Score =29.7; E_value=1e-05; Accession=PF00646.23; Description=F-box domain
MKEELFLPKDDRDKISELPDNILLHMMDFMDTREAVQTCVLSKRWNNLWKRLSTLLFNTSKFESVFKINKFLCRFLSDRDDSISLLNVDLDVGPPIELELYLSGVLYRPPIELELLHRIMEYAVSHNCQRFTINTGIGFKFEVVTVIFFCPSLTNLRLSCGTPLGRTCKLPKSLQLPVLETLHLHSVFFTASDNGCAEPFSKCFLLNTLVLKSHYEDSSVCPSWLQLVTNVKELILSAKTIRFILKLALKVLDSVRIQPPGFVNLESLVVKRDSLDFVSDEEVHCIVRFLLQNSILTLDVEKTEKVIYTNSLFKYLGNVFLEDDNLKTLTNL

SEQ ID NO: 196022 - protein, 163 aa, Glycine max
  Coding DNA Sequence Number=SeqID_79244
  Subcellular localization annotation: CTP_CleavageSite=49; ConfidenceScore=5.05e-01
MEIGTIIVKAGVQIAKTKRSITRPSYLKDYPALGGSCRINLVLSLSLCRISTRTRGPLIIFRMPLFASPTSNCTSTSLPPPMPQPPPVPASTHRMKLDVPRFDGTKPLGWIFKINQFFEYHGTLEQNKLTIASFYMEALHTRFAPSQYDDPTAALFKLTQKGM

SEQ ID NO: 196023 - protein, 203 aa, Glycine max
  Coding DNA Sequence Number=SeqID_79245
MHGASGDGAFDRDKPRGCVATATGDSSDVATCNGALAMQGGVAGAALLFAGAAFAENASSFGDLGMNSVITVLYFNGRVYEDNDGVIFEGSKKAIQIKRGISFNALKKKIGDKDVAGDSMFHSANSLTSCGNYLSNDETQPATNMSNLHIDEDDDDHDDDDYLMSNSYVEESVDEDDSVDGISKTDDEVTDIPQPVRIVHPAE

SEQ ID NO: 196024 - protein, 334 aa, Glycine max
  Coding DNA Sequence Number=SeqID_79246
  Gene Ontology: Mol. function=RNA-directed DNA polymerase activity; Cellular component=chromatin; Biological process=chromatin assembly or disassembly
MADHGTRKTTTDRLEDAIVRLTNSQASINERYADLSSKVDSILDHLRLHDSGQNTATTANHQNHQRNAVKLDIPRFDGRDPLRWIFKITQLFQYQNTLEEDRITVASLYLDGAALSCYQWMFSNDFITSWNGFLQALESQFAPTFYDDPKDALFKLMQRGTMNEYLTEFEQLANRVEEKLRDKRAPIPRNFVPPSPSASHITHTTSKAKPSYVQRTPEEMVFRREKGLCYNCDEKWNANHRCKRQVMLFIADEQLPLPETVELGPEGEQATHPLHVLVGNGSMLECDQVCPDIQVAIQGHSFAVTFHLLQISGADAVLGIDWLKKPGPVTTYYT

SEQ ID NO: 196025 - protein, 324 aa, Glycine max
  Coding DNA Sequence Number=SeqID_79247
  Gene Ontology: Mol. function=RNA-directed DNA polymerase activity; Cellular component=chromatin; Biological process=chromatin assembly or disassembly
  Pfam annotation: Domain name=zf-H2C2; Domain location=165-206; Score =20.2; E_value=0.00074; Accession=PF09337.1; Description=His(2) -Cys(2) zinc finger
MGTLWLTSVKALALSSSMPLPIFENYMLSLRLSFTILTDHKSLWELMMQVIQTPEQHYYLSKLLGYEYHIQYKAGVTNVVTDTLSRAPPPVGQLLILSVPRLDFMTDARHSLEASLEFQKLITSIQTEPASYPDHTFCNGLILFKGRIWLNNDNPCIPNLLTEYHASPLGGHMGVAKTTHRIESSFFWTSLKQDVKHFVKVCSTCQQTMSITRRPAGLLQPLPPPTGVWEDLSMDFITHLPPSNGFTIILVVVDRYLKGVHLGALPTSFTAFKVVTLFLDIICKLHGFPKSIVSNRDPIFLSKFLRELFWLSGTRLQLSTAYHP

SEQ ID NO: 196026 - protein, 69 aa, Glycine max
  Coding DNA Sequence Number=SeqID_79248
MPMMSSKGRFLNVVIVHQYLVEPPSERYGGTFTGAVDGFKARRYEHIIEGGLRWRRWGVGSWFARVDVR

SEQ ID NO: 196027 - protein, 218 aa, Glycine max
  Coding DNA Sequence Number=SeqID_79249
  Gene Ontology: Mol. function=chromatin binding; Cellular component =chromatin; Biological process=chromatin assembly or disassembly
  Homolog annotation: Hit_ID=Q1SAV4; Match level="QueryCoverage=70%, HitCoverage=39%, E-value=5e-32, Identity=45%"; Hit description =Integrase, catalytic region
PPPTVLDYVAGTTNNEAAQSLLESRHALHSKLQQRLKKAQETMKRYADAKRDDVSFKVGQWIYVKLRPGRQSSVTGQPLPKLSKHFFGPFQIMERVGAVAYRLQLSPESRIHPVFHCSLLQAHHGPQLAAHDVCPLQFLDQQPLRQPLCFLDPELRDTYHLEGKVDFGEGGIVSTTHQVEEEKARSTPSTLMVQPTRPARTRARPLRLQDYHVDGLPY

SEQ ID NO: 196028 - protein, 76 aa, Glycine max
  Coding DNA Sequence Number=SeqID_79250
MLEGTAHPPREKNSFQEGYWNFNQLATLISKEIKHLGNGLVLDDVLDGWVWDHSLNGTYSTKEGYKWITNLGNSTS

SEQ ID NO: 196029 - protein, 156 aa, Glycine max
  Coding DNA Sequence Number=SeqID_79251
  Gene Ontology: Mol. function=transition metal ion binding; Cellular component=chloroplast thylakoid membrane
  Homolog annotation: Hit_ID=Q9M2Z4; Match level="QueryCoverage=66%, HitCoverage=44%, E-value=6e-24, Identity=55%"; Hit description =Putative steroid-binding protein 2
  Pfam annotation: Domain name=Cyt-b5; Domain location=71-151; Score =7.8; E_value=0.057; Accession=PF00173.18; Description=Cytochrome b5 -like HemeSteroid binding doma
MALQLWETLKEAIVAYTGLSPPTFFTLLALILALYYVVSGLFPSSDHRHNTASRDLEPQMEPLRPPVQIGEVTEDDLKAYDGTDPEKPLLMAIKGQIYDVSQSRKGCNSTQVLAKCFWASIFQLLVDTSASLASGSALIRWKSGLEENELLTESDI

SEQ ID NO: 196030 - protein, 162 aa, Glycine max
  Coding DNA Sequence Number=SeqID_79252
  Gene Ontology: Biological process=metabolic process
  Homolog annotation: Hit_ID=Q7NNC1; Match level="QueryCoverage=64%, HitCoverage=17%, E-value=3e-13, Identity=44%"; Hit description =Phosphodiesterase/alkaline phosphatase D
  Subcellular localization annotation: CTP_CleavageSite=52; ConfidenceScore=5.62e-01
MPSSAASCHSTTIGRAGMPPPNTSGSVASRVHSTMPSAEGSPEATPRVKGVLAKRGEASRLRGFSAVASDCAASAHAVPIQAPAADRPAKARNRLRLIVSTALPSVVDDVEVEEAAVVVDLGSETPVRTGAVGWLGVEQVLGLVLQRHVLADLVAERHVERH

SEQ ID NO: 196031 - protein, 57 aa, Glycine max
  Coding DNA Sequence Number=SeqID_79253
MDTSESGVLNTVSGATIMKAIMDSSGMVLMPFLNNGNLVIHRLWNLEDTNIKSDRVT

SEQ ID NO: 196032 - protein, 65 aa, Glycine max
  Coding DNA Sequence Number=SeqID_79254
WKIGITNKRWLLEDLFSGDIVESEAAERDDLTEEEEEGKDPASCFPDLMGLKFEDKGVRYECLRE

SEQ ID NO: 196033 - protein, 190 aa, Glycine max
  Coding DNA Sequence Number=SeqID_79255
  Gene Ontology: Mol. function=zinc ion binding
  Homolog annotation: Hit_ID=Q1S9E2; Match level="QueryCoverage=97%, HitCoverage=68%, E-value=6e-25, Identity=49%"; Hit description=Zinc finger, DHHC-type
VLITLLLTSGRDPGIVPRNANPPILDEYEGGANVNNEQTLRPHLPRAKEVVVNERFDLHCPWVGHCIGLSTYENFRYRYDQQSNPYNKGVAANFREIFCSCIPPSKNNVRSKIPIPKEPSDSSRRRVEEEEESDYADEFTNDEEHGKGSGIGDNMSVDLSRMLHTEGGQTEVASFLRLSLWDRSSKENGT

SEQ ID NO: 196034 - protein, 105 aa, Glycine max
  Coding DNA Sequence Number=SeqID_79256
  Gene Ontology: Mol. function=zinc ion binding
  Homolog annotation: Hit_ID=Q6Z1H3; Match level="QueryCoverage=61%, HitCoverage=15%, E-value=2e-12, Identity=55%"; Hit description =Putative DHHC-type zinc finger domain-containing protein
MCSLWCRRTPTAAVAGDTPLVRTYCAWKGNNEFCLRGRLIFGPDGKSIFLTIFLIVAPVAVFSAFVARNLLDDFPHHWGYSILIVVILHSVSISNILYKRMAEEA

SEQ ID NO: 196035 - protein, 102 aa, Glycine max
  Coding DNA Sequence Number=SeqID_79257
  Homolog annotation: Hit_ID=Q1S9D9; Match level="QueryCoverage=57%, HitCoverage=23%, E-value=1e-07, Identity=53%"; Hit description=No apical meristem (NAM) protein
MLLGWQNYANEIGEWILCRIFMKKRNIESDNNTTAPRKNNNAVMNNVEVAQPRFFDFLSVHNSAPPAPIQYSSTSSSCSSSNNVVEASSPNHEETSGYADFC

SEQ ID NO: 196036 - protein, 339 aa, Glycine max
  Coding DNA Sequence Number=SeqID_79258
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=23%, E-value=6e-88, Identity=47%"; Hit description =Integrase, catalytic region
MNEEIHALEMHNSLVVQPLPPGKRTISCRWIYKVKYRANGSLDRYKAHLVAKGYTQQVGIDFLDTFSSVAKLTIVRVLLSIAAHRNWNMLQLDINNAFLNGDLIEEIYMDMPLGYPVKNNIMVSSRQWLHEFSIIILDQGFQQCPTNHFLFTRGSGATLVTLLVYIDDIIIVGPDQKLIAETQQMLAKPFKIKVIGDLKYFLGLEIAKSPREIHLCQRKYSLQLLTDTSFAASKPQSVHMDPNLQLNETDSVPLEHASQYCRLIRRLMYLTISHPDNSFIVNHLSQFMSKPRTPHLHAIYHLLQYLKSSLGQGILFPSSSSMRVSAYVDADWGSCQVTR

SEQ ID NO: 196037 - protein, 81 aa, Glycine max
  Coding DNA Sequence Number=SeqID_79259
  Gene Ontology: Mol. function=DNA binding; Biological process =regulation of transcription
  Homolog annotation: Hit_ID=Q1S9D9; Match level="QueryCoverage=98%, HitCoverage=38%, E-value=4e-20, Identity=50%"; Hit description=No apical meristem (NAM) protein
  Pfam annotation: Domain name=NAM; Domain location=2-81; Score=-24.3; E_value=3.1e-05; Accession=PF02365.6; Description=No apical meristem (NAM) protein
MERINFIENGIFSCQLPASIIPEINVSKYDPWDLPAVTSQTQEYEEDFKGNCDVQERYFFSSKEAKYRNGNRMNRTTNSGY

SEQ ID NO: 196038 - protein, 571 aa, Glycine max
  Coding DNA Sequence Number=SeqID_79260
  Gene Ontology: Mol. function=nucleic acid binding; Cellular component= beta-galactosidase complex; Biological process=DNA integration
  Pfam annotation: Domain name=rve; Domain location=308-468; Score =121.6; E_value=2.3e-33; Accession=PF00665.16; Description=Integrase core domain
  Pfam annotation: Domain name=zf-CCHC; Domain location=127-144; Score =7.4; E_value=0.058; Accession=PF00098.13; Description=Zinc knuckle
  Pfam module annotation: Pfam domain module=rve::zf-CCHC; Domain location=308-468::127-144
MICQIACKVLSVLQYYTKMKSIWEELSEYKPVHHCHCGGVQPVLDHFHFEYVQTFLLGLNESYNQIRGQILTMDPFPSIQHAFPLVIQEEKLREVGNVQTSLDSQLACVVQGSQNLKSGNKKDKGRPLCTHCGLLGHTKDTCFKIIGYSQGHKKHKSPINLVSDNQGESSNSFNIAQCQQLLNLIESQMARAMISETSQSDQSNLGMIFSTLGQSSSINSSSWIIDSGATSHICHDLKLFDQYTLFSNRIVTLPNNYKINDKKQNGVIGKGNLHQGLYHFQPHNEYACSSMHTVVLSQCLSFDSHNNFSELPFDLIHCDIRGPFPHDTHDGKKYFLTTMDDNSQYNWVHLMRNKFEAPHLLQAFFKLVQTQFSKNIKAMRSDNAKELSLTKFLQNARVVHQFSCPHRPQQNSIVERRHQNLLNVAHALMFQAQLLIYFWGECVSMKAYIINKTPSSNLQNQSPYELLYGKVPAYDLMKVFGCLCYAATVPAQRHKFTPRATKCVFLGYPFGYKGCKLYDLYNHKFLISRDVTFQENSFPFATSTYTTSDPFPNFVVPRPLPDMLPDRNPTP

SEQ ID NO: 196039 - protein, 288 aa, Glycine max
  Coding DNA Sequence Number=SeqID_79261
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-39, Identity=30%"; Hit description= UPI00006A17C9 related cluster
VLTFTGLHAHPSRGLHVLAFIGLHALAFRGLQVLTIRGLHAIAFRVLQVLAFRGLHDLAFRGLNVLAIRGLHVLAFRGLHALALKGLHVFAFKGLHILNFRGLHVLTFRGLHVLAFRELHVLVFRGQHALAFRGLHVLTLRRLHALTFKGLHVLTFRWLHARAFRGLYVLTFRGLHILAFRGLHTLALRGLHVLTFRKVHTLTGRGLRVLPFRWLHALTFRGLHVLAFRGLHVLTIRGLHALTFKRQHVLPFRRLHVVAFIGLHAFPFRGLHVLTFRRLHAHAFRGLH

SEQ ID NO: 196040 - protein, 88 aa, Glycine max
  Coding DNA Sequence Number=SeqID_79262
MTFRSFSKIGAGFGIDDDDEKDRLGDKNVGAVRAGVDKIKVVPGGGDKKVVTGGGNHHRHSDDSWMQRPMKLMIPPLINNFPNRLIAT

SEQ ID NO: 196041 - protein, 44 aa, Glycine max
  Coding DNA Sequence Number=SeqID_79263
MVILHPSLFESFDDGVCKNRLRFQRQYYQNATGSIYYDDANGPR

SEQ ID NO: 196042 - protein, 261 aa, Glycine max
  Coding DNA Sequence Number=SeqID_79264
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=56%, E-value=2e-33, Identity=38%"; Hit description =Integrase, catalytic region
  Subcellular localization annotation: CTP_CleavageSite=64; ConfidenceScore=5.27e-01
MDFLGVWSPTRMHFFSATSGKNSFGLAGKSSPTISDYVRGTSTIDAVDSLLTDRTKLHATLQCRLRKAQETMKLNANKHHRDLQLSVGDWAYVRLRPYRQTSMASNYSKLSKWYYGPYQVIERIGVVAYKLLLPPSSRIHPMFHISLLKLHQGPLPTVETTLPPEAIDHHPIVTPLSILDWKWDTSVTPAVCKEIWPALKDTYNLEDKVIFRGASVDSNMQYDTIVADSKTNQEEMEVANSSTTNRPKHITSRLIYLKEFV

SEQ ID NO: 196043 - protein, 118 aa, Glycine max
  Coding DNA Sequence Number=SeqID_79265
MTLDQVRALFLGYGSNHMIVLGGKHKNKCECRACGWWCLVWAWPIVVVGVGLADGGGSDGEGGAEWWLGRWWWFTEEKRGTEWWLVVALGCSGALAVRIPSSLPLTCTVINAAFKGHN

SEQ ID NO: 196044 - protein, 155 aa, Glycine max
  Coding DNA Sequence Number=SeqID_79266
MRMRRHSMFPFACMPLVLWGVVRLVVSSLANVRCMSGNRDVFVHGSMLAHVTCDMHPFHCHLSLRGLCADDWFCVAYLPNGIRVASQTHSISASLLVTLEDFKVPHVNHVIVLSDAVHAVNVNGLVPPHCSLKSVVSDDACPGACFVQRDATTLS

SEQ ID NO: 196045 - protein, 114 aa, Glycine max
  Coding DNA Sequence Number=SeqID_79267
  Subcellular localization annotation: CTP_CleavageSite=57; ConfidenceScore=5.64e-01
MAKPSSPANLASAIICFFASKKFPHRLKASPGRFARQNPSPHPSVMVHVHGFFKVLLADSRFTRPDMGFHPTKLNFVPSDADEAPLDVSICLHAFGIVGCGSFSGVKSCKREGA

SEQ ID NO: 196046 - protein, 146 aa, Glycine max
  Coding DNA Sequence Number=SeqID_79268
  Homolog annotation: Hit_ID=Q47522; Match level="QueryCoverage=39%, HitCoverage=77%, E-value=1e-19, Identity=74%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPEFDEEKAGATVTFQTDATKPCTMDYVPRLTVLGVNPPKDPSDYTLTLKGGNLDGEVKVLG

SEQ ID NO: 196047 - protein, 218 aa, Glycine max
  Coding DNA Sequence Number=SeqID_79269
LHALTFRGLDFLAFRGLNVLAFRGLDVLAFRGLHTLTFRGLHALTFRGLDVLTLRGLHAFAFRVLHAFAFKVLHVLAFRGLPTVRIQPEREAITQLLCIPRQDFTRATAERQVWIVRTNMTTLTQICMTFLLSNILPSDRNADLPLRKYQLGSRPQHIQWTRRSPVGIAGIAPAMPQVPVIPSKAGTGRDTTAAWGWPAIGNKCTAATSRAPQLIHKK

SEQ ID NO: 196048 - protein, 143 aa, Glycine max
  Coding DNA Sequence Number=SeqID_79270
  Homolog annotation: Hit_ID=Q26UP7; Match level="QueryCoverage=88%, HitCoverage=17%, E-value=7e-25, Identity=44%"; Hit description =Hypothetical protein precursor
  Subcellular localization annotation: CTP_CleavageSite=46; ConfidenceScore=5.15e-01
MTQTGRSPLLASAAAFVLSGVVGSAHAADSVAGQFAEWSGDSTVSRQMTLRELGFRQPLVLSGQESQREVYLPVPAGVATRDAQLQLDGRYVRGHAGRTSGLWSVDGDPIAARSITDAQGDASQLLAIDGEPRQNGFVRVGVG

SEQ ID NO: 196049 - protein, 152 aa, Glycine max
  Coding DNA Sequence Number=SeqID_79271
MQKNCQIMQKSCQIMQKIRLCSTSTSFHCRDSNGQDVGFCIRNLQLKFQGDPTVNELGMGTLLKTLLSLVDVCIELIDGEDESNPREKPEETTTIRDDALRWLTMLRLRGIDGNPVLRGTRRRTTLVEMEYLLCAIARPPPSTTYDGCPIIQ

SEQ ID NO: 196050 - protein, 52 aa, Glycine max
  Coding DNA Sequence Number=SeqID_79272
MVSKVWSFDGGFNGEEEEEKSNVRRLNQPHRVPTALSPTRSPFLSVTSFFDQ

SEQ ID NO: 196051 - protein, 100 aa, Glycine max
  Coding DNA Sequence Number=SeqID_79273
MTRYAFSPSMAAACEKVSKVEETAATRKQEETNAWRIGTHHIERGGHLGMAKCEDRKENQVMQSYPARALARRLQVDWARDPRKGPRVLMSLGVDFEPMG

SEQ ID NO: 196052 - protein, 142 aa, Glycine max
  Coding DNA Sequence Number=SeqID_79274
  Gene Ontology: Mol. function=DNA binding
  Homolog annotation: Hit_ID=Q9LTJ8; Match level="QueryCoverage=65%, HitCoverage=12%, E-value=2e-12, Identity=43%"; Hit description =Arabidopsis thaliana genomic DNA, chromosome 5, BAC clone:F17P19
  Pfam annotation: Domain name=MBD; Domain location=42-111; Score=8.6; E_value=0.0048; Accession=PF01429.10; Description=Methyl-CpG binding domain
MKLDTVEWKGKNGKYYFPPSSGLKFNSKEVFRYLDNVQNKIIVEKAIVEGLPPGWVKKTRITTNGDSVRRDTFYIDPVNGYTFCSIEDVDHYLETGKIGRNEFTSKDKDGSDMELKADKSPVWMIIIVLLVVYVYSLISLIC

SEQ ID NO: 196053 - protein, 230 aa, Glycine max
  Coding DNA Sequence Number=SeqID_79275
  Gene Ontology: Mol. function=protein serine/threonine kinase activity; Cellular component=Golgi stack; Biological process=protein amino acid phosphorylation
  Homolog annotation: Hit_ID=Q10Q32; Match level="QueryCoverage=96%, HitCoverage=67%, E-value=2e-55, Identity=35%"; Hit description =Expressed protein
  Pfam annotation: Domain name=PPR; Domain location=11-45; Score=37.7; E_value=4e-08; Accession=PF01535.11; Description=PPR repeat
  Pfam annotation: Domain name=PPR; Domain location=117-151; Score =18.6; E_value=0.022; Accession=PF01535.11; Description=PPR repeat
  Pfam annotation: Domain name=PPR; Domain location=182-216; Score =25.8; E_value=0.00015; Accession=PF01535.11; Description=PPR repeat
  Pfam annotation: Domain name=PPR; Domain location=46-80; Score=17.2; E_value=0.06; Accession=PF01535.11; Description=PPR repeat
  Pfam annotation: Domain name=PPR; Domain location=82-115; Score=16.3; E_value=0.087; Accession=PF01535.11; Description=PPR repeat
  Pfam module annotation: Pfam domain module=PPR::PPR::PPR::PPR::PPR; Domain location=11-45::117-151::182-216::46-80::82-115
MLKDELKPNLVACNALINSLGRAGELKQAFQVYNTMKSFELKPDAYTFNALLSSLNKADRHHKALELFEMIERDQTSQFNIHLYNTVLMSCSKLRLWDKAIEILWQMEAYGLSDLTMSYNLVIRTCELARKLTIALQVYKHMVHQKCSPNIFTYLSVIRCCVRGNLWEELEEILNQTMPNATLYNAAVQGLCLRKNDDLANKVYAKMLESGFQPDVKTQVLMLRMIRKRK

SEQ ID NO: 196054 - protein, 98 aa, Glycine max
  Coding DNA Sequence Number=SeqID_79276
MNEHKSRFVLNPRARNALVCALSQEEYSKVHSFRSAKQKWLFERKWRPQVIALRAIKNLDSLTLEELIAILKVHEQELALDEGTKKRKSLSLTVQRPK

SEQ ID NO: 196055 - protein, 135 aa, Glycine max
  Coding DNA Sequence Number=SeqID_79277
  Homolog annotation: Hit_ID=Q9LTJ9; Match level="QueryCoverage=83%, HitCoverage=91%, E-value=5e-26, Identity=56%"; Hit description =Arabidopsis thaliana genomic DNA, chromosome 5, BAC clone:F17P19
MQIRVRCNCGEGSCEEWGVIELQGVVEPQPGFHDSLQNLHIGTLCRPSSQEVYTFTVGYHELTGSKVPLKKPMVVLKKVKHPDGESGCKVELQVVGVIRHKILFKNRPKALISTCSIVLWMLFYIRGTSGISSFV

SEQ ID NO: 196056 - protein, 37 aa, Glycine max
  Coding DNA Sequence Number=SeqID_79278
METAAAFHPFKKEMAALPGLSMWQNEVPMYVLIQAAL

SEQ ID NO: 196057 - protein, 107 aa, Glycine max
  Coding DNA Sequence Number=SeqID_79279
  Gene Ontology: Mol. function=DNA binding; Biological process=DNA integration
  Homolog annotation: Hit_ID=Q1T035; Match level="QueryCoverage=99%, HitCoverage=12%, E-value=4e-32, Identity=60%"; Hit description =Integrase, catalytic region
MARTMLNDHLTPKHSWAEAVNIACYSQNTIYIRPFLKKAPYELWKGCKPNISYFHPLGCQCFILSTKDNLGKFDSKCDSGILPEYSESSKAYRAYNFITLTLEEAIH

SEQ ID NO: 196058 - protein, 138 aa, Glycine max
  Coding DNA Sequence Number=SeqID_79280
MDNGTNKLCARWHPWRHRSPSGGLMLAWFQDRSAPSVLAKLLRTRLDNDEMSTYCKGMQEEKNDLTSKVEGIVAERDELAKVVADLEARLKESESKLEESELRLAKEREVSKDLEDELTMYKKEAMERHEKGFNKAIR

SEQ ID NO: 196059 - protein, 77 aa, Glycine max
  Coding DNA Sequence Number=SeqID_79281
MPHEMRWPRESFPQRDPGKTPLEKATVLPNRLTQILTCTDFEASSISGASRPSRDAHSLERGGSNLGMMSSLASRRR

SEQ ID NO: 196060 - protein, 287 aa, Glycine max
  Coding DNA Sequence Number=SeqID_79282
  Gene Ontology: Mol. function=metal ion binding; Cellular component =integral to membrane; Biological process=ubiquitin cycle
  Homolog annotation: Hit_ID=Q8LGA5; Match level="QueryCoverage=64%, HitCoverage=57%, E-value=1e-30, Identity=39%"; Hit description=RING -H2 finger protein ATL5H precursor
  Pfam annotation: Domain name=PHD; Domain location=110-155; Score=0.1; E_value=0.056; Accession=PF00628.19; Description=PHD-finger
  Pfam annotation: Domain name=zf-C3HC4; Domain location=111-152; Score= 39.0; E_value=1.6e-08; Accession=PF00097.15; Description=Zinc finger, C3HC4 type (RING finger)
  Pfam module annotation: Pfam domain module=PHD::zf-C3HC4; Domain location=110-155::111-152
  Subcellular localization annotation: CTP_CleavageSite=28; ConfidenceScore=5.54e-01
MTTHPKPLLILTTSSSSYSYAQSPAAPAVAHVPSTRATLPMLLVIFLFALLFTAFCSIFIRYCSHEEQPHALPQATRATPRGVDPRVLATCPVTSYYAVKMKTPQKAAFQCAVCLAEFDDADALRLLPKCGHVFHAHCIDAWLAAHVTCPVCRGEVSVEIEGEARARHVFEESSVRGFGVLLRSHSTGHSLERFTLRMPEEVMKKILEDSERGNVTRMMKRSASYDVVLRSMEEGGEGSSNSGSNSKEKSSTNNNNRWVLSMTPPFVSRAVRGFRECQERTVFHCEV

SEQ ID NO: 196061 - protein, 69 aa, Glycine max
  Coding DNA Sequence Number=SeqID_79283
MGSYDVFNRVNVMSGEEEDGIPWFEVKVPPTKLSFSQNIFQENDRAYPAQVVAAQIRTLLYKHEGCTSF

SEQ ID NO: 196062 - protein, 45 aa, Glycine max
  Coding DNA Sequence Number=SeqID_79284
NVITHSLCVICIDLVMISNLVFMGVDDEVDDFKEPRARGRWSTML

SEQ ID NO: 196063 - protein, 162 aa, Glycine max
  Coding DNA Sequence Number=SeqID_79285
  Gene Ontology: Mol. function=hydrolase activity; Cellular component =intracellular; Biological process=sulfate transport
  Homolog annotation: Hit_ID=Q4UY92; Match level="QueryCoverage=88%, HitCoverage=53%, E-value=1e-56, Identity=75%"; Hit description=Beta -lactamase
MTGVAPGHARRAQRRGSGPALDVGLHCGLHQLRFFQRRIAGLAHADELCLGHAVVHVDVVRALFADGGFVGEPAATRAVVVADKHARRIGQGQQALDRAVQLRGIAAREIAAGSAAVGHEQRVAGEQRIVDQIGDAVAGVAGHGDHLAAQVTQSEGLAIAEQ

SEQ ID NO: 196064 - protein, 288 aa, Glycine max
  Coding DNA Sequence Number=SeqID_79286
  Gene Ontology: Mol. function=RNA-directed DNA polymerase activity; Cellular component=chromatin; Biological process=chromatin assembly or disassembly
MNDALQPFLRKCVAIFFDNILVYSSDLDTHVSHLDFVLSTLVARQFFLWEPKGIAPDPDKVQAMLDWPIPTSTTILRGFLGLTGFYHKFIQGYASATTPLTSLLRKNQFLWFPKATTAFEHLKSLMTQAPVLATPDFSLPFTLETDAFAIAIGVVLLQQDHPIACFSKVLCPRLQRALAYVKELHAITVVVCKWRHYLLGPSLTILTDHKSLKDLMTHVIQAPEQQNYLTKLLGYDYDIRYKPGSSNVVADALSRLPTGEYLSFTIPHFGFLDKLCTSLMEDNQYRDL

SEQ ID NO: 196065 - protein, 103 aa, Glycine max
  Coding DNA Sequence Number=SeqID_79287
MAGLDQAGRKHGGDLGFNLGFLEVGIMVGSDIHRSEIGKKGGWVKEDGGVTVKEGGNGCWNGLGVGGAAKGGGQISLIGLLLQTNSANGAILKQIPTWGCFTT

SEQ ID NO: 196066 - protein, 345 aa, Glycine max
  Coding DNA Sequence Number=SeqID_79288
  Gene Ontology: Mol. function=transferase activity, transferring phosphorus-containing groups; Cellular component=membrane; Biological process=two-component signal transduction system (phosphorelay)
  Homolog annotation: Hit_ID=Q1M678; Match level="QueryCoverage=98%, HitCoverage=45%, E-value=1e-121, Identity=58%"; Hit description =Putative two component sensor kinase/response regulator
HLQRLLGQFLSGGARKLHIRHEHIRRHLPQEDDRFLGAAGFDHLIAGVAQDIGGVHADQRVILDQEHLAAHLRARLRRRAGGQRRGLGRALALRAVGQHMAHLPRQRLARIGLRQQLDACVEPTAMHDRVLGVAGGEEHADLGQAHARQPRQLRALEFARHHHVGEQQVDRDAALDDMQRARRIAGLEDAVAEISEHLDHRGPDLLVVLDHEHGLGAAGNRPVIGIGLDVLLLQRSRQIELHRRAVAELGIDLHMPARLLDEAVDHREPEPRSLALGLCREERLEHLRQGFLAHAAAGVADGEHHILARRNLVMGAGIVIVEMRVGEFDGELARAVHRIARMIAR

SEQ ID NO: 196067 - protein, 34 aa, Glycine max
  Coding DNA Sequence Number=SeqID_79289
MASESSADLTSTSASSDSSTATSKGLLFQHGFGI

SEQ ID NO: 196068 - protein, 529 aa, Glycine max
  Coding DNA Sequence Number=SeqID_79290
  Gene Ontology: Mol. function=helicase activity; Biological process =viral genome replication
  Homolog annotation: Hit_ID=Q9LTU4; Match level="QueryCoverage=99%, HitCoverage=37%, E-value=1e-143, Identity=46%"; Hit description =Helicase-like protein
MWYHENISKHSNASSPRFSLCCGDGKIELPLLQNPPKFQQQLLFEQNTAYAKNYQQNIRTYNMMFAFTSAGIKFDKTIDHSRGPPTIRIKGQPCHRIGSLLPMPRKEPKFAQLYIYETENEVQNRIKIISHNNEIEAHIVSNLQKMLDENNAHAKSFRMARDRLTDTQVHNVRLKLIAGREKDGRTYNIPSVPEVAALLAGDIDANSNRDIIVETQNGQLQRIHELHCSYLALQYPLLFHYEEDGYRTDIVHRDTLSRKRRKRNRLTMREWFAYRLQCRPNEGQTLLHSRKLFQQFVTEGYTMIESERLSYVRNNQKKLRVDKLCSLQQSSEAGNKKGLGQGKRIILPSTFAGSPRYMDQLYFDGIAICSHIGFPNLIITFTCNPNWPEIHRLLTPLNLTSIDRPEIISRIFKLKYEQMLSDLTKNHLLGKVVAYMYTVKFQKRGLPHVHLLLFLHANNKYPSPNDIDNIISAEIPSQKDDPKLYKLVQNHMIHGPCGILRPASPCMKEGKCSQFYPKKFQPTTLIDGD

SEQ ID NO: 196069 - protein, 102 aa, Glycine max
  Coding DNA Sequence Number=SeqID_79291
MKSWQVEKAKVLPLMEVHPEFSSQGICNFWRKDIETFRETWLDGFFWNFTRLTPHTLKVIRLLTLSKFKTCTARLYYGHAEKMKHRIHALFKVTSMKFMDAR

SEQ ID NO: 196070 - protein, 139 aa, Glycine max
  Coding DNA Sequence Number=SeqID_79292
  Gene Ontology: Mol. function=cysteine-type endopeptidase activity; Cellular component=endoplasmic reticulum; Biological process =proteolysis
  Homolog annotation: Hit_ID=Q1SLA1; Match level="QueryCoverage=98%, HitCoverage=47%, E-value=3e-47, Identity=63%"; Hit description =Peptidase C1A, papain
  Pfam annotation: Domain name=Peptidase_C1; Domain location=10-137; Score=-50.4; E_value=4.8e-08; Accession=PF00112.13; Description =Papain family cysteine protease
MGMKVAMVVTWKHSHLSQSVEDLPQIKTILIKDQMVTNKAKVRNHAVAICGYENLPAHNENMLKAAVAHQPASVATDAGGYAFQLYSKGTFSGSCGKDLNHRMTIVGYGEENGEKMKRDPKDKDGTCGTAMEASYPDKH

SEQ ID NO: 196071 - protein, 49 aa, Glycine max
  Coding DNA Sequence Number=SeqID_79293
  Homolog annotation: Hit_ID=Q1SLA2; Match level="QueryCoverage=59%, HitCoverage=8%, E-value=3e-08, Identity=93%"; Hit description =Tetratricopeptide-like helical
MRGEHGSEELERNQNVKSVVGQLVQGGRDGSFEGCKKEDTNKLAGPSNV

SEQ ID NO: 196072 - protein, 167 aa, Glycine max
  Coding DNA Sequence Number=SeqID_79294
  Homolog annotation: Hit_ID=Q1SM20; Match level="QueryCoverage=47%, HitCoverage=19%, E-value=5e-07, Identity=37%"; Hit description =Nucleic acid-binding, OB-fold
MGDKILAHVKSQDIEKWKNQLTENQTYIVQNFEVENSTRQYRGSNHKYKLIFARGTMVKEKDLPDIPSYCFCFTEFEAFTSQNAQSDILKRYALLLYYENNNVSFFNSCAYRNNMFLFVPDLIGEFVDVVQWQLDSKRIKLKGFLDKHGDGPVTLVLEQAKIKENKA

SEQ ID NO: 196073 - protein, 130 aa, Glycine max
  Coding DNA Sequence Number=SeqID_79295
  Gene Ontology: Mol. function=nucleotide binding; Cellular component =intracellular; Biological process=small GTPase mediated signal transduction
  Homolog annotation: Hit_ID=Q40220; Match level="QueryCoverage=81%, HitCoverage=83%, E-value=1e-29, Identity=99%"; Hit description=Rac -like GTP-binding protein RAC2
  Pfam annotation: Domain name=Ras; Domain location=8-103; Score=-14.2; E_value=3.3e-08; Accession=PF00071.12; Description=Ras family
MSTARFIKCVTVGDGAVGKTCMLISYTSNTFPTDYVPTVFDNFSANVVVDGSTVNLGLWDTADLREDRQYLIDHPGATPITTAQAGRRAEEGNWCCCVHRMQLKDSAAFGIVGFKYYKGIVIAGDVPIIV

SEQ ID NO: 196074 - protein, 65 aa, Glycine max
  Coding DNA Sequence Number=SeqID_79296
MVSSCTSMPYNDTDSKYWTKWKWEDEFDTIVHGKNIDFPSHHITAQMRNQRSVLGLGGSIPIFIG

SEQ ID NO: 196075 - protein, 99 aa, Glycine max
  Coding DNA Sequence Number=SeqID_79297
MAEVHWPVMPYAFDTKQDGPGRSDDQFEGPTARLNPPQRLGQELMTWEMKRKEELVLLGHRMFHGGGGLQWWWWRRIPFVSLTILPLELVSANSDQWAL

SEQ ID NO: 196076 - protein, 97 aa, Glycine max
  Coding DNA Sequence Number=SeqID_79298
  Homolog annotation: Hit_ID=Q1SP37; Match level="QueryCoverage=93%, HitCoverage=27%, E-value=5e-10, Identity=45%"; Hit description =Bacterial adhesion
MSRSGKKGCGERTFGAFKSHFIIICGPLGNWQMGTMKNIILAYIILHNMIVEDERDTYNGNVDVDYDHIDNEISNIDLSCGAHPDFATYLQTKTLYA

SEQ ID NO: 196077 - protein, 427 aa, Glycine max
  Coding DNA Sequence Number=SeqID_79299
  Gene Ontology: Cellular component=integral to membrane; Biological process=transport
  Homolog annotation: Hit_ID=P34027; Match level="QueryCoverage=84%, HitCoverage=96%, E-value=2e-80, Identity=45%"; Hit description =General secretion pathway protein L
LRLHALFALAQGGHVGIDFAQRLGEPGVHQQQRSRRALGIGIGRLPGRGRSRQRLQFGGHGEAVTATGGAIGLQYAGQIDLAPLRRILQQLHQLRGLAAQADQLQVVVLDGQLFQVGALRQAPGQFIPDFHRSGALAALLFQECGTIDQCLQLRAFAGDTTRTARTAFNLRTQLIGGGTAVVEQLQGRQHQHHQRGHGQQHIPAPRRIHPQLALPRRQQIHLQGVTVGVDGIDTGQRIGPLAHAGAPRFKLAQWPGNQFDLQLAFGRAPEFTHVIADLAGFERRLAVDLETDHGAQAVGRSRRQAQMTTQYFAGRQQPRPRQAAQSRFQHAVQFGRRQRPRHAGHRFAALTGLSPDLQLVTLALQQQARLCPAQCPLPTRRHPGQQRLPPPAQETAGARADPALHLPHTVLPCRHLAVIPCSQRSTV

SEQ ID NO: 196078 - protein, 180 aa, Glycine max
  Coding DNA Sequence Number=SeqID_79300
  Gene Ontology: Mol. function=protein dimerization activity
  Homolog annotation: Hit_ID=Q1SR56; Match level="QueryCoverage=70%, HitCoverage=59%, E-value=1e-33, Identity=56%"; Hit description=HAT dimerisation
  Pfam annotation: Domain name=hATC; Domain location=73-158; Score =99.0; E_value=1.4e-26; Accession=PF05699.5; Description=hAT family dimerisation domain
MHVISGTEYPTSNLYLGEVWKMKQVLEESCTDEGNTSGSNTSSNFVHKSTIVTGFDEIINIVREKVVHAMKSEIDVYLEEDVCVTKSDSSYFSALEWWKNNSLKYKVLSKMSTDILAIPISTVASGTSVSARGRVIDEYQSKLNEESIEALICGEDWFRHKYNLKKKEVDEPLKVINLKI

SEQ ID NO: 196079 - protein, 69 aa, Glycine max
  Coding DNA Sequence Number=SeqID_79301
  Homolog annotation: Hit_ID=Q9M315; Match level="QueryCoverage=70%, HitCoverage=13%, E-value=3e-08, Identity=59%"; Hit description=3 -methyl-2-oxobutanoate hydroxy-methyl-transferase-like protein
MDHHRHRVADEIDVDADSVEVHRGEVVVCDDQGDGLGGAVLLPQLVQRHTLKSFITHTRWKMKVKEDKE

SEQ ID NO: 196080 - protein, 82 aa, Glycine max
  Coding DNA Sequence Number=SeqID_79302
  Gene Ontology: Cellular component=membrane
  Homolog annotation: Hit_ID=Q5VQN0; Match level="QueryCoverage=78%, HitCoverage=17%, E-value=2e-11, Identity=45%"; Hit description =Exostosin family protein-like
MQIAVFISSIDVVKPGWLLKYLKGIRPAHIKAMQQNLAKMVGKVVNIKLHTRRSQRVVEGSRSQCTCECRSGKITNTASIIS

SEQ ID NO: 196081 - protein, 336 aa, Glycine max
  Coding DNA Sequence Number=SeqID_79303
  Gene Ontology: Mol. function=RNA-directed DNA polymerase activity; Cellular component=chromatin; Biological process=RNA-dependent DNA replication
MTNSVAESERHYLIFIVAMMHSKNGFVDVCLRHENLVKPLPEIEFREPRCVTQFIQELVYGRHRKLIFDCDRVKSSVGDGYGGQWCEVEVRLWAHETRGQNDRGVWFNDVVEAGNQDRWSLAEMFWYGAQILQPLDPKHNICTIKAQDEEVDLKGGGEVQKVGDTWLYKVVCTTIIHKNCHLVDECGGLRGSSGGVSTGNKVSRPLSQHTANSSDDKRFTGTRNGEGHVGGGMENKGGVWPLRQLGATVEVARLGPLNGVQDIADQDVRKPLRDIHWFRQRAGPSMKNDAMVVVVGLVVSAVMEERISKAVDGLLKTFGGSQMGIVFGHDGYDRAG

SEQ ID NO: 196082 - protein, 137 aa, Glycine max
  Coding DNA Sequence Number=SeqID_79304
  Gene Ontology: Mol. function=3-methyl-2-oxobutanoate hydroxymethyltran sferase activity; Biological process=pantothenate biosynthetic process
  Homolog annotation: Hit_ID=Q9M315; Match level="QueryCoverage=96%, HitCoverage=41%, E-value=1e-21, Identity=62%"; Hit description=3 -methyl-2-oxobutanoate hydroxy-methyl-transferase-like protein
  Pfam annotation: Domain name=Pantoate_transf; Domain location=2-131; Score=-172.7; E_value=0.0047; Accession=PF02548.6; Description =Ketopantoate hydroxymethyltransferase
MTTCSRRCSSTVVAAPWRMEPRRCISLGTWILGPRSPAPIRSCSCAVHIAVRILKEGGMNAIKMEGGLPSRIVAAKAIVEVGIVVIGHVGLTPHAISVLGGFRPQGKNVASVVKSVCLHGCDYNHDSPSNSYNWNWG

SEQ ID NO: 196083 - protein, 157 aa, Glycine max
  Coding DNA Sequence Number=SeqID_79305
  Gene Ontology: Mol. function=RNA-directed DNA polymerase activity; Cellular component=chromatin; Biological process=chromatin assembly or disassembly
MSPLPLLMLSLVNTKVATGEVCCRLLRKGIYQWSNEQWYCTKVLFEGPVQDLCLAVGLKMSEVFPDKGWNGKRLKEASRISGFVLDLLASKVLGYEGTHILSHVWPTKIILYSSKCFRNAPMSAQKGGVEFCKKSGDEIMAEGKPQLAVVENEAPLN

SEQ ID NO: 196084 - protein, 325 aa, Glycine max
  Coding DNA Sequence Number=SeqID_79306
  Gene Ontology: Mol. function=RNA binding
  Homolog annotation: Hit_ID=Q1T290; Match level="QueryCoverage=88%, HitCoverage=72%, E-value=8e-51, Identity=43%"; Hit description =Cyclin-like F-box
  Pfam annotation: Domain name=F-box; Domain location=31-78; Score =36.9; E_value=6.8e-08; Accession=PF00646.23; Description=F-box domain
MEGKETEGMLKMTTDKRQQKRSRSDREEERDRLSELPDCVVLHIMEFMDTKYAVQTCVLSKRWKDLWKRLTYLGFNTTLFKNVVKFNKFVSRVLSGRDGSVSLLNLEFTCRGMAEPKLFNRLMKYAVLHNVQQFTVSLNLSFRQSFEFRPYIFSCESLTFLKLSFNSFDTSIVALPGSLNMPALKSLQLEAVSFTARDNDYAEPFSTCNVLNTLILDGCSLHKDAKFLSISNSSLSSLTISGSFEGGAYKIALSTPNLSSLTVTGHNNHTISSACNLSFLEEVTIDTLGYTLFPNTDLLIISWLQVLTNVKILRLYSGTLLTILR

SEQ ID NO: 196085 - protein, 74 aa, Glycine max
  Coding DNA Sequence Number=SeqID_79307
MSASQFGGECAYCNSLAVEESEYAFMDVVESDSLEIGYTNVDLDSSEMELDMGDEMTTLSSLVSIMHIFCIIII

SEQ ID NO: 196086 - protein, 61 aa, Glycine max
  Coding DNA Sequence Number=SeqID_79308
MTGGKGREGGERRFLVHTLLIQALKGSYVAQFGTLSEQSEEKFEESQETVRDVAIVVTMHT

SEQ ID NO: 196087 - protein, 1160 aa, Glycine max
  Coding DNA Sequence Number=SeqID_79309
  Gene Ontology: Mol. function=transcription factor activity; Cellular component=nucleus; Biological process=regulation of transcription, DNA-dependent
  Homolog annotation: Hit_ID=Q1SIZ0; Match level="QueryCoverage=93%, HitCoverage=87%, E-value=0.0, Identity=66%"; Hit description=Zinc finger, NF-X1-type; Single-stranded nucleic acid binding R3H; Zinc finger, RING-type; Zinc finger, PHD-type
  Pfam annotation: Domain name=C1_3; Domain location=311-341; Score =13.0; E_value=0.015; Accession=PF07649.3; Description=C1-like domain
  Pfam annotation: Domain name=zf-NF-X1; Domain location=427-445; Score= 20.0; E_value=0.0086; Accession=PF01422.8; Description=NF-X1 type zinc finger
  Pfam annotation: Domain name=zf-NF-X1; Domain location=482-501; Score= 31.4; E_value=3.2e-06; Accession=PF01422.8; Description=NF-X1 type zinc finger
  Pfam annotation: Domain name=zf-NF-X1; Domain location=546-565; Score= 27.6; E_value=4.3e-05; Accession=PF01422.8; Description=NF-X1 type zinc finger
  Pfam annotation: Domain name=zf-NF-X1; Domain location=604-623; Score= 30.7; E_value=5.2e-06; Accession=PF01422.8; Description=NF-X1 type zinc finger
  Pfam annotation: Domain name=zf-NF-X1; Domain location=702-721; Score= 16.5; E_value=0.095; Accession=PF01422.8; Description=NF-X1 type zinc finger
  Pfam annotation: Domain name=zf-NF-X1; Domain location=759-777; Score= 14.2; E_value=0.17; Accession=PF01422.8; Description=NF-X1 type zinc finger
  Pfam annotation: Domain name=zf-NF-X1; Domain location=812-828; Score= 13.4; E_value=0.22; Accession=PF01422.8; Description=NF-X1 type zinc finger
  Pfam annotation: Domain name=zf-NF-X1; Domain location=851-872; Score= 15.7; E_value=0.12; Accession=PF01422.8; Description=NF-X1 type zinc finger
  Pfam module annotation: Pfam domain module=C1_3::zf-NF-X1::zf-NF -X1::zf-NF-X1::zf-NF-X1::zf-NF-X1::zf-NF-X1::zf-NF-X1::zf-NF-X1; Domain location=311-341::427-445::482-501::546-565::604-623::702 -721::759-777::812-828::851-872
MTSSSVKNEDEEKGSLAGSSKTEIFRDSAKHSVSNALFCSFFGLIMRLQNDIVEEDYRDMSSQIRRERREWSRVPPQGATRQEWVPRGAAAAAASTNVAQPSNLHSNNNADAGSSNLGVAVAAPSVSRSRSNNHGNDVGSSNQGVAVAALPVSRGRSNNHGNDAGFSNQGVAVAALPVSHGRSNNHGNDAGPSNQGVAVASPPVSHGRSNNPGNGAGSSNQGLAVAAPPVNRGRSKNHGKDSVSSNQGVAVAALGSRGRSNNHGSHWMEMEKDKGSRSGSQVEKGLRVGVRDSSLPQLVQEIQEKLMKGTVECMICYEMVQRSVPVWSCSSCYSIFHLNCIKKWARAPISSDLSLSVEKNHELNWRCPGCQSVKFTSSKEIRYVCFCGKRIDPPSDLYLTPHSCGEPCGKPLQREVLVPGGNRDDLCPHACVLQCHPGPCPPCKAFAPPRLCPCGKKNITTRCSDRQSVLTCGQCCGKLLECGRHRCERICHVGSCDPCKVPSSATCFCSKNMEVVLCGDMTVKGEIEAKGGVFSCSSYCLKILGCGNHVCSEICHPGSCVECELLPSRVKTCCCGKTRLENERQSCLDPIPTCSKVCGKLLHCGMHSCKEACHVGECPPCLVEVSQKCCCGSTSRTVECYKTMMENEKFMCEKSCGIKKNCGRHRCSERCCPFSNSNHYNTFSGDWVPHFCSMPCGKKLRCGQHVCECLCHSGHCPPCFQTIFNELACACGRTSIPPPLPCGTPPPSCQLPCSVPQPCGHSVSHSCHFGDCPPCSVPVAKECIGGHVVLRNIPCGSKDIRCNHPCGKTRQCGLHACGRTCHPPPCDNLSGVVQGFKAPCGQTCGAPRRSCRHTCMAPCHPSSPCPDIRCEFPVTITCSCGRITANVPCDVGGSSSNYNADAIHEASIIQTLPVPLQPVDANGKKVPLGQRKLICDDECSKLERKRVLADAFDITAPNLDSLHFGDNSLSSELLLDFFRREPKWVLAVEERCKILVLGKTRGTGTTHGLKVHIFCPMLKEKRDAVRLIADRWKLAITAAGWEPKRFIVISVTPKSKAPARVIGVKGTTTLNVPLPPVFDPLVDMDLRLVVSFPDLPRDTEINSLVLRFGGECELVWLNDKNALAVFHDPARAATAMRRLDYATVYQGAVLLPMPGEELGQ

SEQ ID NO: 196088 - protein, 133 aa, Glycine max
  Coding DNA Sequence Number=SeqID_79310
MDLRLAHGASRRFKLFIKQAKASHPSINIEREKEIERKIGEAKKSESERRNGSWWPSQILGLDHLSTSHLTSPHSGTPVKLLRKEDSNKAESTQGMLLKKKEKYTGREDAILHALQLERQMLKKQEKIGDASD

SEQ ID NO: 196089 - protein, 50 aa, Glycine max
  Coding DNA Sequence Number=SeqID_79311
MGFLYFLLRLFCLLLMLFHPSIAARYKFPSPPPPPQACCPKHRPDVDASP

SEQ ID NO: 196090 - protein, 102 aa, Glycine max
  Coding DNA Sequence Number=SeqID_79312
MGLAFHHKEAPFTSKRRGLREFHRYIVGRMLKKGFLTLKACLVRVSEHPLSKLVALSARRDKRLTEQADDALSAQMLLKFSSRFSQLAKRAECLAKWAECLA

SEQ ID NO: 196091 - protein, 96 aa, Glycine max
  Coding DNA Sequence Number=SeqID_79313
MTRWMTSKNLVLDDAGTQCSARMCLAPIIRQFVKFQDMPENQKILMHSPKIKSKYFRNASVSDSVEILHRSSPFFIRSSFVLRSSTVFFSSVFNVL

SEQ ID NO: 196092 - protein, 129 aa, Glycine max
  Coding DNA Sequence Number=SeqID_79314
MGRSGTREPAASPAKKESNHCGASTGTMRGSDHPYRRMQWRRVGRGKGRRYRDSDCRKTIEKRLDLRGKGYMDRVNFGVEGVMALGEGSLALGQGSLALGKVLESLFKLVHGDLTSMMFRHGKGAGRTS

SEQ ID NO: 196093 - protein, 129 aa, Glycine max
  Coding DNA Sequence Number=SeqID_79315
MKCEESGVVRLKRNGSSGNHGRTIGKSQAKGEDPWVWVVVMSGGIINGSVAYVEMGGELGGGEGGGGGVDALFTDIGEVRRFFVAGEEEVYQQKFLVPLAVPKQITYKTELKRSLKATPKEKNNNKGPT

SEQ ID NO: 196094 - protein, 1533 aa, Glycine max
  Coding DNA Sequence Number=SeqID_79316
  Homolog annotation: Hit_ID=Q9FHD0; Match level="QueryCoverage=97%, HitCoverage=99%, E-value=0.0, Identity=33%"; Hit description=Genomic DNA, chromosome 5, TAC clone:K24M7
SVSSTFIRKMRTRFLNNDYFALPPPQTFPFLHLPVPRLLPPPPYAVYHHLRFGPPIPLSLHLDPFPVDAVLSTFLSAVLPHRIHTAPSNPPQEAEVIFEECVSEVDIKFSNESKTIALNDKNDDVYEAIQFETPELDAFLENVYVTETERMQMLSQTSEVENSLDMLKPEPSRQYPYEALESVSLVEDVISEYLMGGNAYSLEDNISVHHQPHSDKNKFLILEVDEETLGIPTRFSLGKELLGSMKHNMMEFFSDECVSKKSLELSDLFPERDFMNLLETELVDRNIGLQRTWHANTFYDTKASDDLVTYEWMFKKEFNFKSFDELIVSNEIALTDDTFKSLPVPVIYDHIKMITLHDIIVEQFSSLKTRPLSASDGIYLNWDLLEEDKCNCKISNWYQNILAKIDLNNQDFGGTSFDDGKLVFDLVFCDDTIDECDIKQNEELKKLLSDCMPLLDNHPVEVASGKILEHVSSKQESQEQLPERKERASLLFKSMSEISNLDYFLNPQKATDKGNCNYTVESSNVNVSIPKVSSNESKVGTQSQGFHTVLHRVKLSNNIVTLAGYFEKSYLAILHSDTEMTKMHNSDADYLKLLGLQKHKLIEYHINGNQMAFVVLCAIKQAAWYLCFYGLHPAFFYLDKLCQNLEYLKSKLGFLQSLIKDEKGKVDNNVTMAHPSLTIVKEILQSYIKQNSLKTLIVAEEPCANTVSEDTDTKMKELLISDCLLVSHKHVSPLFPLNKFDIILEYGGSYDSSRISKLSQNLVGLPHLHFLRVELDGHAALKALCEGVEMLPNIEMSMGSETHLIFNHKVSMMNQNLERLLNFCPVEQSYDKKSSKVAPEADNHMPLVPAVKTEHGHKSMEVFPGTVMIVNTQNVDKEMIMSRRSSYLVILAMEKEGIQVVERDLDLPVDIILSSAICLAWYDSRNLGKKSTPATEASSSLPLCIENIATDVLTLLSFYFRGCFLVFEGELNFLSTVMESSDGLYAAATSLGIDLQIFFSYSPELTNEVIVSCIKSANNMNRGLYPKMPDSVTLAESFLTEFPGINPLTAHSILSSGVKLNEFLVWSHEQRMHVLEKYHVPDESISLFSVFCRYGEREDSKSIMTDCSSSVSSGLDSDWCCLYQVENERKRKNPISSHQIDELCLDELLQFETLNQVVEAAPDSSTLPKPFDFVMSKNAGRSSDLANASLSMSEFFGQKQSTGAATMRNLSGVSYSAGNCKAPNKSEQLKQPSLSLKNKELAQNEILGTALMGKGVNWHNFSNSKKLHEDIRGEVVDLTDSPLFDKRFAIPDSMYFTSLMAEKEKDLMRTNKIARKLSFDNSSHPETNSSKIWRSLKDKRGEVDNYPEPDFREDIFPLDFKPRENIGFTQASMRNLEESPFKEELSHLGETPFSYARQSASILKNSPWTIEFINKVKEKSRLRQKSLSSENSGPYFGYPGSMSKTSKRRSPSVIDLFKNQPNRTSGNVPKQKRQKRSGPSSNSVKKARDSTSSCTPCDKKSTKFLGGIVSVDTHRSAVNNVTKYKPLDRSILI

SEQ ID NO: 196095 - protein, 950 aa, Glycine max
  Coding DNA Sequence Number=SeqID_79317
  Gene Ontology: Mol. function=receptor activity; Cellular component =actin cytoskeleton; Biological process=blood vessel endothelial cell migration
  Homolog annotation: Hit_ID=Q9FLL5; Match level="QueryCoverage=96%, HitCoverage=99%, E-value=1e-117, Identity=32%"; Hit description =Similarity to myosin heavy chain
  Pfam annotation: Domain name=M; Domain location=269-289; Score=6.1; E_ value=20; Accession=PF02370.7; Description=M protein repeat
  Pfam annotation: Domain name=M; Domain location=352-372; Score=8.2; E_ value=10; Accession=PF02370.7; Description=M protein repeat
  Pfam annotation: Domain name=M; Domain location=487-507; Score=2.8; E_ value=54; Accession=PF02370.7; Description=M protein repeat
  Pfam annotation: Domain name=M; Domain location=635-655; Score=2.4; E_ value=60; Accession=PF02370.7; Description=M protein repeat
  Pfam annotation: Domain name=M; Domain location=670-690; Score=0.5; E_ value=1.1e+02; Accession=PF02370.7; Description=M protein repeat
  Pfam annotation: Domain name=M; Domain location=739-759; Score=3.0; E_ value=51; Accession=PF02370.7; Description=M protein repeat
  Pfam annotation: Domain name=Pox_A_type_inc; Domain location=348-370; Score=1.2; E_value=54; Accession=PF04508.3; Description=Viral A-type inclusion protein repeat
  Pfam annotation: Domain name=Pox_A_type_inc; Domain location=517-537; Score=5.7; E_value=12; Accession=PF04508.3; Description=Viral A-type inclusion protein repeat
  Pfam annotation: Domain name=Pox_A_type_inc; Domain location=739-761; Score=10.0; E_value=2.9; Accession=PF04508.3; Description=Viral A -type inclusion protein repeat
  Pfam annotation: Domain name=SPT2; Domain location=215-308; Score= -26.6; E_value=0.079; Accession=PF08243.2; Description=SPT2 chromatin protein
  Pfam module annotation: Pfam domain module=M::M::M::M::M::M::Pox_A _type_inc::Pox_A_type_inc::Pox_A_type_inc::SPT2; Domain location=269 -289::352-372::487-507::635-655::670-690::739-759::348-370::517 -537::739-761::215-308
MFKLRRKSNKIKAVFKLQFQATQVPNMKKSVLMVALVPDDVGKPTVKLEKVAVQDGTCLWENPIFESVKLAKDTKSGKLQEKIYHFIVSTVRSRFNCILSFTCLGYVAGKSNLYRFLQGSSKSGFLGESSIDFADFAAETEPLTVSLPLKFANSGAILHVTIQNVEGVHADQSSFRNGEDNGNGSSRHLLSICSADEGSHNVDKDFPQLLPPLRQNSMPSRGTIEAIATRAQMHRRSMGSVSDRSLGDYWRKSLEDTLPQERLQEPPDNVTENLKSEIASLKTKVEESELELQSLQKLMEKECSRGQSMSRQIISLRDERNTIKTKYEQLISQKNLNNVTKSSKALQTEIADARQQLEATKEELVYEREFSSNLQLQLQKTQNSNSELLLAVRELEAMLEQKNKELLENTKEHDYATELGLLKQKTADQNGEIDNCYKQREELNEHIKELHFECELLKKENLGISLRLRHGEAQKIVWQNKHSASLATIEQLESQVQRLEEKIKNQADDFSETLIYINELENQVSDLERELTTQAEKFEKDLHAMQCAKNEQEERATQAEETLIKTRHSNDLTCQCFQKVEENEKKTMDAYAEADELRKQNKLMEEMLQKCNQELRLITNHNESKLQQLLNQIDSKQKAIEMMSQELEIKSKQLEDVQRHRDEQYDALLKQIQLLRIEITKLVAEEHALSKTEPKEHISTMLMQENNDEEIRLGTLMSEVEILKTQHNELKHRLHMEQAEKENMKKKISQLEGELNKKEEDLSAVERRLENSNGQATATNINLASWHYDSAAYCSSTNEYNRISKSEMHKEMDDANTPVDKSEIGRTICISAENKVYLASHTSEVKTCLENEVIVFNNDNAGEFHTNKLLNEVEVLKEMNRYMGTQLKEMEERYSEISLKFAEVEGERQQLVMALRNFRNDTSKIAGNTSHYKYGGKKHYKCYPKQVLRS

SEQ ID NO: 196096 - protein, 136 aa, Glycine max
  Coding DNA Sequence Number=SeqID_79318
MVRGAVVVARGRGSNGGSRVDDGCVRERLRWWWCNEENKRNRMREVRSGGNPMEKRKERGVWLDEEKKRKRMREVNVCGEVGKTLNVWGSGEGSRSVRRSYVLGRLKKKHNWNVEKREVNNWNVGCECCGELERWM

SEQ ID NO: 196097 - protein, 764 aa, Glycine max
  Coding DNA Sequence Number=SeqID_79319
  Gene Ontology: Mol. function=protein-tyrosine kinase activity; Cellular component=integral to membrane; Biological process=protein amino acid phosphorylation
  Homolog annotation: Hit_ID=P93756; Match level="QueryCoverage=98%, HitCoverage=98%, E-value=0.0, Identity=52%"; Hit description =Putative receptor-like protein kinase
  Pfam annotation: Domain name=B_lectin; Domain location=81-182; Score =75.0; E_value=2.3e-19; Accession=PF01453.15; Description=D-mannose binding lectin
  Pfam annotation: Domain name=PAN_1; Domain location=328-408; Score =37.2; E_value=5.8e-08; Accession=PF00024.16; Description=PAN domain
  Pfam annotation: Domain name=PAN_2; Domain location=328-393; Score= -2.5; E_value=0.0024; Accession=PF08276.2; Description=PAN-like domain
  Pfam annotation: Domain name=Pkinase; Domain location=494-732; Score=- 15.8; E_value=1.3e-07; Accession=PF00069.15; Description=Protein kinase domain
  Pfam annotation: Domain name=Pkinase_Tyr; Domain location=495-732; Score=-45.7; E_value=1.1e-09; Accession=PF07714.7; Description =Protein tyrosine kinase
  Pfam annotation: Domain name=S_locus_glycop; Domain location=213-320; Score=-23.2; E_value=0.0019; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=81-182::328- 408::328-393::494-732::495-732::213-320
MLGQENCVLKSPFLLCIFIGFLMHSVVGAEIPLGSKLSVVDNDYWVSSNGDFAFGFYNISDQPNQFSVGIRFNSKSIPYSQQTVAWVAGGDVKVGNKSYFELTQEGELVLFDSIGEGSVWTVKTGNQSVASASLLDNGNLVLMDKEQKIIWQSFDTPSDTLLPGQSLFANETLRAATASKNSKASYYTLHMNASGHLELHWESGVIYWTSENPSASNLRAFLTASGALELQDRSLKPVWSAFGDDHNDSVKYRYLRLDVDGNLRLYSWVESLGSWRSVWQAVENQCKVFATCRQLGVCVFNASGSAECKCPFEVTGGNECLVPYEEECESGSNMIAYKNTYLYAFYPPDNSFITSSLQQCEQLCLNDTQCTVATFSNDGTPQCSIKKTEYITGYSDPSVSSISFVKRCSGPFAVNPGITKSPPPSEPPPRFCVPCLIGASTGTFFILVIFQMGIVLFIYRRKNSTRKRSTLTFTGTNSKGLIVLSFSEIKSLTGDFKNQIGPKVFKGLLPNNHPIAVTDLNASLEERKFRSAVMKMGCIHHKNLVKLEGYCCEFDHRFLVYEYCKKGSVDKYIDDDALCKVLTWRKRVEICSSVAKAICYLHSGCREFISHGNLKCENVMLDENLGAKVTEFGFAIADGKATYCGFSAEKDIEDFGKLVLTLLTGCRNHDHIELCEWAYKEWMEERVANVVDKRMEGGYKSEELEHVLRIAFWCLQMDERRRPSMGEVVRVLDGTLSVDPPPPPFAFQRPLQVDDSEENVSELE

SEQ ID NO: 196098 - protein, 513 aa, Glycine max
  Coding DNA Sequence Number=SeqID_79320
  Gene Ontology: Mol. function=tetrahydrofolylpolyglutamate synthase activity; Biological process=folic acid and derivative biosynthetic process
  Homolog annotation: Hit_ID=P08192; Match level="QueryCoverage=52%, HitCoverage=63%, E-value=2e-93, Identity=65%"; Hit description=FolC bifunctional protein [Includes: Folylpolyglutamate synthase (EC 6.3.2.17) ...
  Homolog annotation: Hit description=(Folylpoly-gamma-glutamate synthetase) (FPGS) (Tetrahydrofolate synthase) (Tetrahydrofolylpolygl utamate synthase); Dihydrofolate synthase (EC 6.3.2.12)]
  Pfam annotation: Domain name=Mur_ligase_C; Domain location=147-231; Score=34.2; E_value=4.6e-07; Accession=PF02875.11; Description=Mur ligase family, glutamate ligase domain
  Pfam annotation: Domain name=SPOR; Domain location=433-509; Score =57.7; E_value=3.9e-14; Accession=PF05036.4; Description=Sporulation related repeat
  Pfam module annotation: Pfam domain module=Mur_ligase_C::SPOR; Domain location=147-231::433-509
LDVVILEVGLGGRLDATNIVDADVAVITSIALDHTDWLGPDRASIGREKAGVFRGGKPAVVGEADMPDTIAQVAAEKGAQLLQINRDWQWQREGDTWTLQDAQGELRDLPLPQVPLPNAATAIAALRASGLTVSEALIRQHLPLAILPGRFQTVSTAPRVILDVAHNPHAAYYLASRLAELPAHGTVHAVVGMLHDKDIAGTLAALAPQVNRWYCAPLDGPRGASADELMAHLQGGSAWQSVEAAWQAARQQAQPDDVILVCGSFHTVAQNRLVGTVILVAIGVIVLPGLLDGKKKHYKEEFAAIPLVPKPDDQQDSEMVPPVTQPLPSQPPEGASAAQQAPASSATQSSAASGSTQPAQNSQPSVVTPPPVHQQQKPAEQVKPKPVEQPKPKPVEQPKPKPAEQPKATEQPKTTEQPKAAETPKQSEPAAPAGQAYVVQLGALKNAAKVNEIVAQLRLSGYRAFTVPSTPVQGQITRIYVGPDASKAKLQGALGELKGISGLGGVVKPYSTR

SEQ ID NO: 196099 - protein, 410 aa, Glycine max
  Coding DNA Sequence Number=SeqID_79321
MQEEEERPLIRKRKLPTTSTKSADQTEAGNSQAQMPKKKKKVKQVEPEPSVAVEGGEPAKKKKKKTKSSKEQGNKQPVDVQPPSTDIDGTEVEAAPSIAEMGNPVEQPNLPQEQTAVEVQRNVSAEEIPLCARTSPAPEADAVNVEEWDEGHGIGSSSPHGWAEVDDQHEPNQSDNTISHESSQKSLSEENFFDEDAIKEAEAGGSDIYPVSSTSKLSASIGIAEDTFIQMQNEDPAAALRLLLNTSQANTSSDKIPGASTSSDAEINSSVRQDSLLLKLSTEYALKDVLKSIEENPSAAFGHLNFLKKLHNPLTSDETLGKVIQIEAIIDQFASAVQKKRENGTRLDAQKQAHTLLLEKARAAQHEVERLTKEAKEGSSEIKDCDDNISSWEATITDLLFQVDDLRQKI

SEQ ID NO: 196100 - protein, 77 aa, Glycine max
  Coding DNA Sequence Number=SeqID_79322
MGKEMKKGICKWVNKEEGPKFLKEVMKLDAKGINHVEESSGKTNETIDKKWKVQTIGRKQLEKDISQPIIAATRPQY

SEQ ID NO: 196101 - protein, 108 aa, Glycine max
  Coding DNA Sequence Number=SeqID_79323
MECTFSCVVVNVEHLSVNEINSFATLSIGLMWPCARVFFEPQFQEQCRVFFEFSSIGGSVGSSERFPADFKWEEKEKRDCMVFERAGLGGFEEAAMADEDLDEFRVEL

SEQ ID NO: 196102 - protein, 122 aa, Glycine max
  Coding DNA Sequence Number=SeqID_79324
MNPICAKVQNLQTKTVNKTIKNGAREWDSVMYRSFLRCDDPKGVVECGIIRKYKTRSHKVKDKTKILKTGENLETSLSLMNKRYKEENKVPKGCDGNLIDPSSYRDIMFDEKSEDIAEGIAK

SEQ ID NO: 196103 - protein, 105 aa, Glycine max
  Coding DNA Sequence Number=SeqID_79325
  Gene Ontology: Mol. function=transition metal ion binding
MCDSIIDTLLNIKGKTKDGLNTRQDLAEMSIRDQLHPSNIIDPLKLDGLENEAIIILCQLEMEIKLCSRIYLWWMYPVERYMKILEGYTKNLHHLEASIVERYIV

SEQ ID NO: 196104 - protein, 111 aa, Glycine max
  Coding DNA Sequence Number=SeqID_79326
  Subcellular localization annotation: CTP_CleavageSite=78; ConfidenceScore=5.87e-01
MTDCRNTSSGNASSTSRTSQSLTNSSQALRIASSSSSGGSIRSHALSAILNRLARLFSLSGWTKAVRLARLSFTQRTCTSYPSSGFILMLSRGLLHLADGLLSQQIGLARG

SEQ ID NO: 196105 - protein, 280 aa, Glycine max
  Coding DNA Sequence Number=SeqID_79327
  Gene Ontology: Mol. function=RNA binding
  Homolog annotation: Hit_ID=Q1RT02; Match level="QueryCoverage=66%, HitCoverage=35%, E-value=1e-18, Identity=32%"; Hit description =Cyclin-like F-box
  Pfam annotation: Domain name=F-box; Domain location=112-159; Score =31.7; E_value=2.5e-06; Accession=PF00646.23; Description=F-box domain
MVALSLVWRTFMGAELFALTEASKMALYVVLGKFGRRNDPGFHPMASSPQTSAGLGSPIFDKLEAELAKAVMSLLATNILKLAYASPEGKESEGKLVVKMKEELNLSKDDWDKISELPDNILLHMMNFMDTREAVQTCVLSKRWNNLWKRLTSLLFNSSEFESVFKFNKFLSKFLSDRDDSISLLNVDLDFRPPHEIACLSDCTLYYLGFLGRPRFELEPLNRLMEYAVSRNCQRFSINVGFDCRLDVDPVCFCPSLTILRLSFTPYGANCKLPKSLQLP

SEQ ID NO: 196106 - protein, 306 aa, Glycine max
  Coding DNA Sequence Number=SeqID_79328
  Gene Ontology: Mol. function=RNA binding
  Homolog annotation: Hit_ID=Q1RWD7; Match level="QueryCoverage=83%, HitCoverage=66%, E-value=4e-21, Identity=28%"; Hit description =Cyclin-like F-box; Agenet
  Pfam annotation: Domain name=F-box; Domain location=29-76; Score =30.9; E_value=4.5e-06; Accession=PF00646.23; Description=F-box domain
MASPERKESEEKLVVKMNEGLNLSKDDRDKISEMPDNILLHMMNFMDTREAVQTCVLSKRWNNLWKRLTSLLFNSSKFGSVVKIINFLYMFLSDRDDSISLSTVYLDLSQRPRDSTSCLGFLITHAYDWECLNRCSLDQYAEVICISNSNLSCLILDNAMEDADTIVLSTPKLSLLTIKDDFCRNKYSSTCNLSFLEKVYVDASGYNEDSSEHLSWLQLVTNIKEMILSADTISFIRKGLEVLDSVRIQPPGFVNLESLVVKRDSFDFISDEEVNCVVRFLLQNSIQTLDEEKTECAVTLWNVAET

SEQ ID NO: 196107 - protein, 51 aa, Glycine max
  Coding DNA Sequence Number=SeqID_79329
MRMPTTIEGSSQNGRKQGTDETATAKNSASYIGKRLLESLVAVAGLLIWLS

SEQ ID NO: 196108 - protein, 92 aa, Glycine max
  Coding DNA Sequence Number=SeqID_79330
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=98%, HitCoverage=23%, E-value=1e-19, Identity=38%"; Hit description =Kinesin, motor region; Prefoldin
MQLSSQEEAIKQKDVLATEVSSLRGELQQEKCSLKDNQIKALEEQLATTEKKLQELKGNIRVFCRVRPLLADESCSTEGKIFSYPTSMETSG

SEQ ID NO: 196109 - protein, 36 aa, Glycine max
  Coding DNA Sequence Number=SeqID_79331
MEKVPGNGAKILDGFALGYYLSVWMRNLPASAPGRQ

SEQ ID NO: 196110 - protein, 92 aa, Glycine max
  Coding DNA Sequence Number=SeqID_79332
MTKARQKGVRKGKEGEACHPARPGELGCFLQKAPPSGGTSWKAQIVQQCFLLTSGMSQNFTDCATMLSFDFRHEPIGKITKTVFSPHRRLRT

SEQ ID NO: 196111 - protein, 108 aa, Glycine max
  Coding DNA Sequence Number=SeqID_79333
MTCDHSLVLVRCLAPIIRQFVKFQDMPKNQKNIDAQSHPGPLGPSGIFLQKAVASGGSNPARLGELGGNHLPYFAINRGGRQEGRGSAPEALLSLSNLLGKIVSVKKI

SEQ ID NO: 196112 - protein, 130 aa, Glycine max
  Coding DNA Sequence Number=SeqID_79334
  Gene Ontology: Mol. function=nucleic acid binding; Biological process= DNA integration
MEKFSASPIPIQKKDKFSLEQCPKTDLARRQMETIHYAPVVGSIMYAKICTQQDICFATEMLGRYQSNLGMEHWRAAKKRKGEKAKIDGPKRLSLREKTSGRHQRLFEENDKKMKKTVDFENEGSGVVYA

SEQ ID NO: 196113 - protein, 86 aa, Glycine max
  Coding DNA Sequence Number=SeqID_79335
MESLPRLRSHYCLPKTRTHYRFQVRNENIIRKQQHLLVGWVIFDCGGSGYNDVKKQFSSSDNTPKLSFKHTTETKSPREDHYELAI

SEQ ID NO: 196114 - protein, 137 aa, Glycine max
  Coding DNA Sequence Number=SeqID_79336
  Gene Ontology: Mol. function=GTP binding; Cellular component =intracellular
  Homolog annotation: Hit_ID=Q8L7L0; Match level="QueryCoverage=52%, HitCoverage=12%, E-value=8e-16, Identity=68%"; Hit description=GTP -binding protein obg-like
MAVMRCFDRAKIYVKVGDEGNDVVAFRREKYVPMGGHRGRRREGWDVYVERAFPGRERGPPVGEHAEWGKRRRCGGEASSIQRERGFGGGGTLTVAMAMSVMRGSEKGTVASSHHKLLTNAFGHCCDNIWSVDEHSS

SEQ ID NO: 196115 - protein, 699 aa, Glycine max
  Coding DNA Sequence Number=SeqID_79337
  Homolog annotation: Hit_ID=Q1SGA8; Match level="QueryCoverage=27%, HitCoverage=60%, E-value=4e-25, Identity=40%"; Hit description=2OG -Fe(II) oxygenase
  Pfam annotation: Domain name=Transposase_23; Domain location=182-245; Score=-14.5; E_value=0.044; Accession=PF03017.5; Description =TNP1ENSPM transposase
MATKVDSTIIGSSKTNCIGGCRNWPRIGPTQREIPQLSWGQDEQDPSVKYDVDKETWEQFAASRKTPNWQASLEEQLSQGTFVLNGRQDILNTAIGGPDHGGRVRAAGSRVTITQYFRKTAHGSSSSRRSFSQQQGSTVSAPIQPDIQLLGARVSTKGSNAEAVVNPSSPDHVSPVKPTIRLYVHRQLCTELVALGKTYDEGSTIHSVAYADDVVRVSVDLVIKGEAEVPFPTSDIKYVSQALDTFIAWPTSLVKLVSNKLTSSTPNKDNEPFQPVNDVPVEGPLRELIKSLVDIYEKPIEFVWDPARFGIPNGCQQNHIRRTMFEHNYSTLVNHLVLCPAENCVVWFCSLRRKPDVHIKSAINNAFKTLNSTSEGKSDQTTPRWLEIKSHIQSGGYECGYYVMQWMWNIIGEEVKTDWTMPTFAESKGASHIPSTNHSITDLYDDVADELAASIPVDDLSLLTSHDPQIHTKALYQLGKAYAKWGFFMGEGETGELTNDETLEKLVEDVKKKSREFHDFPVEEKEFSDKCPFTPIRYGTNFYPEAENVHYWRDYLKVITFPEFNFPQKPPGYRLPMIIDKKFRVWLAAFDCKPVPTMFAATPCSWDASTLLPDLGVAEIDIQTKKMKEEQKMKEAQATAVAEHGEVALITVEGIQSANRKITIEATNVAGFLTPLFFSPFLNLTLFRNYEEGTKILTT

SEQ ID NO: 196116 - protein, 122 aa, Glycine max
  Coding DNA Sequence Number=SeqID_79338
  Homolog annotation: Hit_ID=Q9FMY9; Match level="QueryCoverage=44%, HitCoverage=14%, E-value=8e-18, Identity=78%"; Hit description =Arabidopsis thaliana genomic DNA, chromosome 5, P1 clone:MJB21
  Pfam annotation: Domain name=Omt_N; Domain location=60-121; Score= -12.9; E_value=0.0062; Accession=PF02409.9; Description=O -methyltransferase N-terminus
MYTMMQGILSNSKPIAIKQLSPKSEQGTHEFINDIGISVVLRENNSHAAALFDKEVVVNGLSEDQAWSACQTAAGRALWKHAIHDPLADVLAGETYLRNLHEKIKKDIVNNARETSGVIVAV

SEQ ID NO: 196117 - protein, 103 aa, Glycine max
  Coding DNA Sequence Number=SeqID_79339
MTMAVRSKTMARRLEAFLVPRSDHHEMYLGLTETTQTYKNLILARARLPQTNSLQHTQTNILAVSKSSPNKETKKKKKKKKKKKKKKTNTKVLAVTKKKKKKL

SEQ ID NO: 196118 - protein, 71 aa, Glycine max
  Coding DNA Sequence Number=SeqID_79340
MSLPSAVHVPSTFESGAQRMSLPSARGASGDWEICFSVIFRIGSFAKPFVAQYVKSRHVPKNQKEAGLRDP

SEQ ID NO: 196119 - protein, 95 aa, Glycine max
  Coding DNA Sequence Number=SeqID_79341
MKLASTEASNGPPPSREYICFLEKTLLRTREAFVEALHDTTHVERETKRWKVLRKFFFKMFVEAPMDSSSDHESGGEFFHKLGKEEEAAKQKEEK

SEQ ID NO: 196120 - protein, 58 aa, Glycine max
  Coding DNA Sequence Number=SeqID_79342
MNKRPQWKAKNSTIEYLLAGVSRNPKNESKMQPKVAWGSKNSKPRVARPGELTYQIFF

SEQ ID NO: 196121 - protein, 343 aa, Glycine max
  Coding DNA Sequence Number=SeqID_79343
  Gene Ontology: Mol. function=transporter activity; Cellular component= integral to membrane; Biological process=transport
  Homolog annotation: Hit_ID=Q82MF2; Match level="QueryCoverage=84%, HitCoverage=64%, E-value=2e-78, Identity=51%"; Hit description =Putative integral membrane transport protein
  Pfam annotation: Domain name=MFS_1; Domain location=19-341; Score =41.0; E_value=4e-09; Accession=PF07690.6; Description=Major Facilitator Superfamily
  Pfam annotation: Domain name=Sugar_tr; Domain location=15-343; Score=- 40.9; E_value=1.4e-05; Accession=PF00083.14; Description=Sugar (and other) transporter
  Pfam module annotation: Pfam domain module=MFS_1::Sugar_tr; Domain location=19-341::15-343
MMSSAVAPAVNQKRVLIAGSVGNFIEWYEFAVYGFMATLIAKHFFQLEGESALTSLILTYAAFAVAFFFRPLGAVLFGRLGDRYGRKPVLIAVLVLMTLATVAIGLVPVYASIGVAAPLLITLLRILQGLFAGGEYGGAVSLMTESAPPGKRGFYGAWQSLTVALGLLAGAGVVAVLPLLLGDAAMNAWGWRIPFLLALPLGAVALWLRSGLDESPQFSQTPAAPQQQASLGVTLRAIVLGIGRLMIWSAAGYTYLVIMPTYLQAALHTGFNQALLIAVISNLGFAATILPAGILSDRYGRRTLMLLATFLLLVLAFPLLKVLQHPESGMAIKALVVFIAECV

SEQ ID NO: 196122 - protein, 165 aa, Glycine max
  Coding DNA Sequence Number=SeqID_79344
  Gene Ontology: Mol. function=nucleic acid binding; Cellular component= nucleus; Biological process=meristem development
  Homolog annotation: Hit_ID=Q6J739; Match level="QueryCoverage=91%, HitCoverage=17%, E-value=2e-69, Identity=84%"; Hit description=AML1
DLTDSENYGQPVDVNLITLDKVHKEDEGHDPFDDFETNAIGSMLPDDEEDLLAGIMDDFDLSKLPSQLEDLDENDLFVNGGGFEMDFEPQESLNIGVSKISISDGVASNGIGQYAIPNGVGTVAGEHPYGEHPSRTLFVRNINSNVEDSELRTLFEVLDICLMLQ

SEQ ID NO: 196123 - protein, 217 aa, Glycine max
  Coding DNA Sequence Number=SeqID_79345
  Gene Ontology: Mol. function=hydrolase activity, acting on glycosyl bonds; Cellular component=intracellular; Biological process =regulation of transcription, DNA-dependent
  Homolog annotation: Hit_ID=Q0JY41; Match level="QueryCoverage=82%, HitCoverage=36%, E-value=2e-62, Identity=63%"; Hit description=DNA-3- methyladenine glycosylase II, adenosine deaminase
MEHQPAGGGPLTARAAAAQRRRDQAIARLEQLVETPQAAETGGERHLAERQIGVRQQAFGLQQPVRLRVIDRRSAKLFGEDAPQVAIGNTEPRRQRFAAVFGQIALLDELHRHLRIAIAQIDQRQAGCQLRPAFKTGAKARQLGRRRARIKGAVFQLRRAGAAHRAAIDAGGRDADEKAAVEFAVTRAQRVVQRLLLSIHGNARVRFFLHYGARLAR

SEQ ID NO: 196124 - protein, 61 aa, Glycine max
  Coding DNA Sequence Number=SeqID_79346
  Subcellular localization annotation: CTP_CleavageSite=35; ConfidenceScore=5.08e-01
LRSAPHLALSAFRSRAGRAMHAGPVLLLDRALGACASVGSGAGRLAGLARVTVSATPSASS

SEQ ID NO: 196125 - protein, 225 aa, Glycine max
  Coding DNA Sequence Number=SeqID_79347
  Gene Ontology: Mol. function=sequence-specific DNA binding; Cellular component=nucleus; Biological process=regulation of transcription
  Homolog annotation: Hit_ID=Q2PJS2; Match level="QueryCoverage=77%, HitCoverage=75%, E-value=1e-42, Identity=53%"; Hit description=WRKY40
  Pfam annotation: Domain name=WRKY; Domain location=157-198; Score =5.7; E_value=0.00014; Accession=PF03106.6; Description=WRKY DNA -binding domain
MMSTTSQTNVNHSLFEEQDQIPTQMGLFNIPFPPNQTYPPLGCQTGTLKSISAIAPSLSSATSFSETLLSTAVQRPREDLTSNLLAGGGGQLLSLNRSRVNSWAWEEVSDCLMGKRIGGDDNHHLGVSAMKMKKMKARRKVREPRFCFKTMSDVDVLDDGYKWRKYGQKVVKNTQHPSTKIQLFLHFDGIATLEIINFFFAGRTDQIDPKGLVGDRLTVIVGPEL

SEQ ID NO: 196126 - protein, 57 aa, Glycine max
  Coding DNA Sequence Number=SeqID_79348
MGAKYLEAVKQRLHAIKQWSPDEIRGLRDRESLVVKKSEHKGRLSLCGSELVKGFAR

SEQ ID NO: 196127 - protein, 80 aa, Glycine max
  Coding DNA Sequence Number=SeqID_79349
MEVSVGLCRSDIGIVPTRHPVDPEKSNRVLGFPTLVTGLWITPSGPKEVQQGPGVSSSDYQPLSVLRSARHPRQGHQASY

SEQ ID NO: 196128 - protein, 208 aa, Glycine max
  Coding DNA Sequence Number=SeqID_79350
  Subcellular localization annotation: CTP_CleavageSite=47; ConfidenceScore=5.65e-01
MENNKKKVGGGSSSSSFTNFDHLFGPKDPSTTSSSSTSIFGSIFPPPSTMVFERVVRKYKADPAEWMQKGEGRELEGEIQQNRTRDAKIMEHQEITVTKVKAALAVSPTTIILLVPIIIRMRQWSPATTVHQSIMVVKKIIPQEPGPLNPTIFLRKIRMMMIQMVMIQTVLQGGTGGKVLFIINICQSMQARHPVYQLSNMDFLHVAG

SEQ ID NO: 196129 - protein, 170 aa, Glycine max
  Coding DNA Sequence Number=SeqID_79351
MKLTRKIVWVSLNNVSKKLFKFDSNVIRQFKDCFFKLNPTRFKSFDEDLLTLVERVDKAILEQLSASLDARAIFTLPSTGNLLSSLDDIMGDFAWRPLVKQVGPTNDDVPSSAFGPPIREKGEPTTRVDPSDDEVAKVTSSMPHFVLAKRKCDDRVGVSGRKKSRVPFSL

SEQ ID NO: 196130 - protein, 234 aa, Glycine max
  Coding DNA Sequence Number=SeqID_79352
VAGQIIETCFQHRVHVASSSIQLYKDNAEIDMKSGMAGYTHEEVRTLVEMRADSLGQNISPSTFNLALEQLGFFVKQLVCNGSDGFGTIVPGPVELTYILDNGIPDNVSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 196131 - protein, 158 aa, Glycine max
  Coding DNA Sequence Number=SeqID_79353
  Gene Ontology: Mol. function=methionyl aminopeptidase activity; Cellular component=ribonucleoprotein complex; Biological process =proteolysis
  Homolog annotation: Hit_ID=A0EVX1; Match level="QueryCoverage=82%, HitCoverage=32%, E-value=3e-66, Identity=95%"; Hit description=Cold -induced cell cycle-related nuclear protein
  Pfam annotation: Domain name=Peptidase_M24; Domain location=48-158; Score=-83.0; E_value=0.016; Accession=PF00557.14; Description =metallopeptidase family M24
MECKNPTPSTAISPNLPTRSQGLKRCTTMSDDEREEKELDLSSAEVVTKYKTAAEIVNKALKLVISECKPKAKIVDICEKGDSYIREQTGNVYKNVKRKIERGVAFPTCLSVNNVVCHFSPLASDEAVLEEGDILKIDMACHIDGFIAAVAHTHVLQE

SEQ ID NO: 196132 - protein, 137 aa, Glycine max
  Coding DNA Sequence Number=SeqID_79354
  Gene Ontology: Mol. function=chromatin binding; Cellular component =chromatin; Biological process=chromatin assembly or disassembly
  Homolog annotation: Hit_ID=Q1SAV4; Match level="QueryCoverage=55%, HitCoverage=22%, E-value=5e-12, Identity=48%"; Hit description =Integrase, catalytic region
MGKIFELCRMVIQYVMPFKLWKPFNIPQYIVRTSDVAAIDDMLTSREVVFTEVRKKLLKAQAIMKHNADKKRRDVNFNEAYIPLPLSETIIDNQPVVIPLVIFGTRQDSDSRLSINEESIVGFMKAINSSFSCLVKF

SEQ ID NO: 196133 - protein, 84 aa, Glycine max
  Coding DNA Sequence Number=SeqID_79355
MARNIKEGTDKNNRELETKSGILDKASTTTLDFPDRAIGCLFCERITPIPTPEVSVSKVKGRMKFGRSKTGDEVKVAFNASKAV

SEQ ID NO: 196134 - protein, 104 aa, Glycine max
  Coding DNA Sequence Number=SeqID_79356
MVTSMLQLDSMNLFVKERAWFNPITQGMAILIANTSTTFHRGEILENEKDARSPQWSRQLGTPRIQRMCDGMMQMHMHEMERKHNKGVIYIYETKKIHLFNTTF

SEQ ID NO: 196135 - protein, 100 aa, Glycine max
  Coding DNA Sequence Number=SeqID_79357
MAAEWRRKRERRRHFKEKMSLEEAHHHRRPWIRAWRKKEMNEGRGREEHEILCSKGALKSEVRVDMRRIFRLKLREKRGNVSQQVKRGLQTKKQSGEQQN

SEQ ID NO: 196136 - protein, 155 aa, Glycine max
  Coding DNA Sequence Number=SeqID_79358
MFSRFTLATLTATLLLTGCARHAASDSSADAAAAEAPATASAPVENNDSASPFASGPTVINVSHLVTRTDDGSSVYVTVDGQEAGLLQKGESKELRVPAGKHQIGGYVQTLFGFGKVTIPAVDVTTDTNGPKNVVYSVTRQKPQFSESAATPNNS

SEQ ID NO: 196137 - protein, 127 aa, Glycine max
  Coding DNA Sequence Number=SeqID_79359
MYKQNHKDFLRLVVRLGYKNSLVFLGFKAYKRSKGYNYLARDSCKDYYSQLAIHSQSNVTLLPVLVQAFLSQSICLLTNNSTREFAKRDTQWLSARKKPEDDELSGSLSAPLQVIKHTASAHSLSER

SEQ ID NO: 196138 - protein, 41 aa, Glycine max
  Coding DNA Sequence Number=SeqID_79360
ENAIEQPLIDHTENEKNVIKQPPIDNTDNDVEHLPRDDTDN

SEQ ID NO: 196139 - protein, 85 aa, Glycine max
  Coding DNA Sequence Number=SeqID_79361
MENVIQGVKSSFSFTERFAHVKVSTPDLFGLKALEQLMTPQQCRDFVDTYGKILNLDMIEVLTAAITALVQYYDQQMGCFTFRDF

SEQ ID NO: 196140 - protein, 84 aa, Glycine max
  Coding DNA Sequence Number=SeqID_79362
MTLNQGGDFLFLDDRRERQGGGQPWSCGPDGEEILDTSIYDGEGSRTPFHGYKLIDPLKNLRSTPVLRTKELSLVILRITKLRM

SEQ ID NO: 196141 - protein, 166 aa, Glycine max
  Coding DNA Sequence Number=SeqID_79363
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=1e-30, Identity=34%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=26; ConfidenceScore=5.70e-01
MWSPLKVRTCNPLKARTCSPLKARACSSLKTRTCSPLKARMCSPLKARTCSPQKARTCSPLKRRVCSPLKARTCSPQKARTCSPLKARTCSPMKASTCSPLKARVCSPLKARTCSPLKVRACSPLKAKTCSPLKVMTCSPLKARACSPLKARTCSPLKARMCSPLK

SEQ ID NO: 196142 - protein, 114 aa, Glycine max
  Coding DNA Sequence Number=SeqID_79364
MELAATRRHSGDCTAARGLHAPKNVREKGGAWQRVEAPLEAQLPGVGRAFRGDPNPGLASENWPEMAAAGSGRDGGQRTVDKPALRIQERERRAVTVTAHCCPSEQAYQLSYQK

SEQ ID NO: 196143 - protein, 108 aa, Glycine max
  Coding DNA Sequence Number=SeqID_79365
  Homolog annotation: Hit_ID=O49571; Match level="QueryCoverage=59%, HitCoverage=5%, E-value=2e-16, Identity=61%"; Hit description=DNA topoisomerase like-protein
MNPLLVFLVIAENRYIAKTLYGTEEEEDASQPNSRVEEPKLLGVTSGSYEKVLLKSGPYGVYVQLGEDRKGYIPKRASVSHVVVLVVAVERGGMIAVLGADPSLRSEI

SEQ ID NO: 196144 - protein, 136 aa, Glycine max
  Coding DNA Sequence Number=SeqID_79366
  Homolog annotation: Hit_ID=Q47522; Match level="QueryCoverage=45%, HitCoverage=82%, E-value=4e-22, Identity=76%"; Hit description=LacZ protein
VPPVQLLTGWCVTAKAPPDISAGKCSGHAARRVPFAIQAAQLLGRAIGAGLFAITPAGERGMCCKAIKLGNARVFPVTTLIPAAFATYDQCSQERDGSMSYNVQAAFLPEGFFRKPGHLPNIPEGWNNMMKKAAKV

SEQ ID NO: 196145 - protein, 195 aa, Glycine max
  Coding DNA Sequence Number=SeqID_79367
MDDMFGRLHVLLNNLQALGQTYTKAQINLKVLDNFPKEVVQGLLIAGKICGLRELEERWRISKFYDKLDTSSKALKVKMIEFDGSNNNYGRSPDDEVVVMSRKFKKMLKKKGKFKHSSRRKDTRFKKKYKEKSNEIISFECRKPKHMKASKIDKSSIVDKLREEEKARVLAGILMVAAQDKCWGEKVYVPRPKAN

SEQ ID NO: 196146 - protein, 157 aa, Glycine max
  Coding DNA Sequence Number=SeqID_79368
  Gene Ontology: Mol. function=RNA-directed DNA polymerase activity; Biological process=RNA-dependent DNA replication
MESMTRLVVGHVDQNMSVALSETFTKMEVKEAFFQIHLIKVPSLDGTLGLFYQKFWHIVDDVVSRLVLQVLNRGANPTEFNKTLFVLIPKQQLMRLILKRYEEASRQHINFNKSELSCSQNVPNTIINELVELLNVKVVESPQKYMGLPTIVACSKT

SEQ ID NO: 196147 - protein, 161 aa, Glycine max
  Coding DNA Sequence Number=SeqID_79369
  Gene Ontology: Mol. function=nucleic acid binding; Cellular component= nucleus; Biological process=DNA integration
  Homolog annotation: Hit_ID=Q1RXN8; Match level="QueryCoverage=88%, HitCoverage=11%, E-value=1e-16, Identity=33%"; Hit description =Peptidase S8 and S53, subtilisin, kexin, sedolisin; Integrase, catalytic region; Zinc finger, CCHC-type
MDLKGYSCWVNGGVMHIKGKIMFFVMQGTNHASNGSSDDSLWYLRLGPMSEKGLNILSKRGLVGNHKVELLQFFEHCAYGKQHWRKFLKVVHITKAMLEYVHSDYLGPLRVPSLGGPRCLDVRHTIMQVKVILSRDVIFEELFMMHSKSDEDLGKVEDVTK

SEQ ID NO: 196148 - protein, 83 aa, Glycine max
  Coding DNA Sequence Number=SeqID_79370
  Gene Ontology: Mol. function=DNA binding; Cellular component =mitochondrion; Biological process=DNA integration
EVISYFEVEEWAVTINEDMDSLQKNQTWDFVELPEGKKEVGCKWIFKKKSLLSTKEVVFYKARLIAKCYNQKEGMDYNEIFSL

SEQ ID NO: 196149 - protein, 78 aa, Glycine max
  Coding DNA Sequence Number=SeqID_79371
MAAQLIRDRVEMECLEGAWETLKGNTRCRFRGTIRFTATSLVHPDEPARTLQRTVEWTTPWISFVYFLGHHYGHLCSG

SEQ ID NO: 196150 - protein, 104 aa, Glycine max
  Coding DNA Sequence Number=SeqID_79372
HKVQHNVDKGANMIANLKGDGTHPSIEVLNPYWNYIVDETHQPSKTFCALPEYIYLKELKSNSLQTPSLPNNLPKKKNKVFTEKDYQERQREKINEEAEEDIKW

SEQ ID NO: 196151 - protein, 209 aa, Glycine max
  Coding DNA Sequence Number=SeqID_79373
MVAKRRGEEWREGRRRRVSRKNTSWTEMVEARELHALECGGKHGCDSRRWVHRRGVLLVRGSHWRDDNAVPGQGRSQPFMDTFIVTANGLGCWIAILAFWHGLTIQLNIGNPDKSIILRSSSSRVEFPGYRAVFTVWIVLSDIVTEAVQDKDSDEFSRDQTFGVLNSLKQYTPSCVDNMVDDLLNGSMIDFNTILECGLGADSTPKASS

SEQ ID NO: 196152 - protein, 428 aa, Glycine max
  Coding DNA Sequence Number=SeqID_79374
  Gene Ontology: Mol. function=nucleic acid binding; Biological process= DNA integration
  Homolog annotation: Hit_ID=Q0KIN0; Match level="QueryCoverage=95%, HitCoverage=63%, E-value=3e-36, Identity=43%"; Hit description =Integrase core domain containing protein
  Pfam annotation: Domain name=zf-CCHC; Domain location=237-254; Score =11.0; E_value=0.015; Accession=PF00098.13; Description=Zinc knuckle
  Pfam module annotation: Pfam domain module=RVT_2::zf-CCHC; Domain location=270-423::237-254
MTTKSTTTSVVTFTTIPLIPCEKLIGTNYSTWAAAVQLWFQGQGRTDHLTTKSTDVPTDNRARWKQIGASSCNVLWFSLVPNLQAQYQAFTTSYDVGTKAKKVYSNDVHRFYSVLTSLINIKMANMDMQSYLGKLDRLIVEYSTLMPFTSDAETFYKQHGQFFMVIALAGLTPDLQAVHNPILLTPTIHNYDLDQDQLLRLTIPQTFRPSSTSVEDSSALVSHSSYRGGRGGGGCGIRCHYCKNWGHIETDCHIKARELSRSINVAQVITFASNITITVVEYNKLRAANEPASPVTSVAQSNIGHFTSWTSKMSSYMVTCKKTIHGSAPGFTVSGDATLLEFGMTRETDHLVFSPHSPSSLCIYLVVYVDDIVITGDDSNGILRLKSHLHNQFQTKDLGPLRYFQGIEVTQSSSGSHFPTEVCYRHSD

SEQ ID NO: 196153 - protein, 138 aa, Glycine max
  Coding DNA Sequence Number=SeqID_79375
  Gene Ontology: Mol. function=ionotropic glutamate receptor activity; Cellular component=integral to membrane; Biological process=ion transport
  Homolog annotation: Hit_ID=Q9SW97; Match level="QueryCoverage=73%, HitCoverage=10%, E-value=1e-34, Identity=67%"; Hit description =Glutamate receptor 3.5 precursor
MATYRNVIEALMQSYPAKVLDRRLQVDWARDVREGPKMYAIADFVDYYRWKKVIAIYVDDDNGRNGVSVLGDAMSRKRAKISYKAVFPLGATESDISDLLNEVNLVESRVYVLHVNPDHGLTLFSIAKRLRMMDSGYV

SEQ ID NO: 196154 - protein, 111 aa, Glycine max
  Coding DNA Sequence Number=SeqID_79376
  Homolog annotation: Hit_ID=Q7X971; Match level="QueryCoverage=48%, HitCoverage=3%, E-value=5e-09, Identity=55%"; Hit description =Putative Splicing factor 3B subunit 3
MVNPRTFVCYCCKDWGTRGHLRYISSRGHSWSQGLILIERVSPILILLFFMVPHQRLWGKDLLVATSDSGKLLLLTFCNEMHRFVPVTHIQLSNPGNQIDLPGRKLAVDSR

SEQ ID NO: 196155 - protein, 213 aa, Glycine max
  Coding DNA Sequence Number=SeqID_79377
  Pfam annotation: Domain name=zf-CCHC; Domain location=91-108; Score =28.5; E_value=2e-05; Accession=PF00098.13; Description=Zinc knuckle
MSLTTLFGKLQEHEMELQRLNQNEETDKRKQSIALKASLSMQEENKDEESEDKEDFSLFVKKFHKFVKNKRSERRQNFNDGKRFQEGSPTLRCYKCNQLGHIKENCPSNKQWPEKNDKKSHEERRTKKAYISWDDNDSSEGSEKEEINLLTKDYESEEDITQRGFVIIKKGRLWKQSYHDDSPRCFDDTKAQRVVSRLKNQAFKIPLKDSRIK

SEQ ID NO: 196156 - protein, 119 aa, Glycine max
  Coding DNA Sequence Number=SeqID_79378
MLMFALKNNIKVDWHVVVMENILKARKLSDVIKEVSDFTRLVHEITMEALEQIGLKKTYDGWVVDIITQVGEEAIVGVVAGEKDRQVVEDNMKSSRLCLPLRQMFYSRWVRSLGSKGNT

SEQ ID NO: 196157 - protein, 234 aa, Glycine max
  Coding DNA Sequence Number=SeqID_79379
  Gene Ontology: Mol. function=nucleic acid binding; Cellular component= nuclear speck; Biological process=RNA splicing
  Homolog annotation: Hit_ID=Q6K9C3; Match level="QueryCoverage=57%, HitCoverage=51%, E-value=6e-34, Identity=55%"; Hit description =Putative splicing factor RSZp22
  Pfam annotation: Domain name=RRM_1; Domain location=4-70; Score=71.0; E_value=3.9e-18; Accession=PF00076.12; Description=RNA recognition motif. (a.k.a. RRM, R
  Pfam annotation: Domain name=zf-CCHC; Domain location=119-136; Score =34.7; E_value=3.2e-07; Accession=PF00098.13; Description=Zinc knuckle
  Pfam module annotation: Pfam domain module=RRM_1::zf-CCHC; Domain location=4-70::119-136
MSRVYVGNLDSRVTERDLEDEFRVFGVIRSVWVARRPPGYAFIDFDDRRDAQDAIRELDGDLHCYRELHFCCIMGLFYEMCASTLNLWGPCKNGWRVELSHNSRGGGGGRGGRSGGSDLKCYECGEPGHFARECRMRGGSGRRRSRSPPRFRRSPSYGRRSYSPRGRSPRRRSLSPRGRSYSRSPPYRGREEVPYANGLFFNSGMDLIFQYAFYSEMALGNDAEAEVDFETWYL

SEQ ID NO: 196158 - protein, 58 aa, Glycine max
  Coding DNA Sequence Number=SeqID_79380
MAVLDLDGDGGPQSWCGGDGLGGEPIANVVGANNNSLHTMKRSLGKFQAPDSICFYKL

SEQ ID NO: 196159 - protein, 105 aa, Glycine max
  Coding DNA Sequence Number=SeqID_79381
MIVDTRESWMALDMQDNIVQTELGSNRVGTRGQGGVKAEECIWTWLVRLLTLVVVQGRCWRVVVLAEARDEGTVEEKDHDSGVVETRESQGVYASSLEGEDPCWR

SEQ ID NO: 196160 - protein, 134 aa, Glycine max
  Coding DNA Sequence Number=SeqID_79382
  Homolog annotation: Hit_ID=Q1T159; Match level="QueryCoverage=25%, HitCoverage=27%, E-value=3e-07, Identity=76%"; Hit description=Beta tubulin
  Pfam annotation: Domain name=DUF1723; Domain location=39-98; Score =24.6; E_value=0.00036; Accession=PF08330.1; Description=Protein of unknown function (DUF1723)
MTEDVPAPSVKASDVAKGLAGDDAEGSAGDDAEGFPGGPRDPSVLTSFVDHVAHSIWNGERWHKETSSFHLPVGELTITLDYVVSLLHLLIIGAFHSFEPLHVDKPVVATGYLSEEMQGLTLDCCSSCVSPTLG

SEQ ID NO: 196161 - protein, 192 aa, Glycine max
  Coding DNA Sequence Number=SeqID_79383
MSEIEEVQEQMKADMEAMKEQMATMMEAMMSMNKMIEANRATIIATRIATDEDPTYPSSFTQVKRPASNMVGQEGKELGSAGDPHFVHAQNKHSFPPYGLPPNYTPPNVAHAPNENVNNSNPILIESQQPHFGQVHEAPQDHNLADFEPYLEYATKGQAVGGVPLPNTLGALSTTHNYNPFLLQWEESLLPW

SEQ ID NO: 196162 - protein, 118 aa, Glycine max
  Coding DNA Sequence Number=SeqID_79384
MVALCSTFHSSTSGIQDASAKIIWYLKKWIRWNQDWTLRLEIVAKQRWLGKAQRGRRRRKRGLNHFHTKEKKKKRSGHEGRVRGSRRVGAPTVVFVASNPGGESKSERESHNTGSARE

SEQ ID NO: 196163 - protein, 289 aa, Glycine max
  Coding DNA Sequence Number=SeqID_79385
MDFSNTFSVLGDENLVNHGINTTNQALLPSQPTSATVDDTDEHVIKLEKKVDVLLLMKKGFQKLAETRNRGEEVDKKSDIMLWKIAKLETTSNVSRSTMHTKHNNNFVFNAKPHPIVHKPPIGASPTTLKQPHNVRSTNNGSFFGASKDVAQGKAIVAPTSIYELVTTTNDTLIDSGWNVNNIAFCIKIPVPHMAHSTSKGNVGCRISIPIPRKSNHVQQQSVNQRSTHGVDHKNQEYYKTIGHIMPKLNFHATLRLARAFALSAPLCFFVGLLRAKLELATKRGMHWA

SEQ ID NO: 196164 - protein, 250 aa, Glycine max
  Coding DNA Sequence Number=SeqID_79386
MTRVQLREVQHKCDLIVCKRARLNTTSNVLVITNALNSFAMQPKLHKEQQLNECFISSSVKDFGNQMVSYFWMPVTSAEKACCFLIGLFIIKCIAMADQIHKEKTYVVFKGLKPGIYHSWAECAKHVVVAWERHCKFPALDKPCKFETKNSPTKQYTSFSEKNTSSQNKAEECNSTRFYDSMFIDQIGSNVVCLGKFANNDEDAKEDVVASLIDRLLSTSGKKIQDLNFYTIRKLEVQLHQALHEKSNCK

SEQ ID NO: 196165 - protein, 264 aa, Glycine max
  Coding DNA Sequence Number=SeqID_79387
  Gene Ontology: Mol. function=zinc ion binding
  Homolog annotation: Hit_ID=Q1SPG0; Match level="QueryCoverage=41%, HitCoverage=27%, E-value=5e-36, Identity=59%"; Hit description=Zinc finger, SWIM-type
MVEEVDCHGFVQEFCDSDYGKGFIEGLDGLQYKGAKGFFEYNCAESLVEGMDHFDCDDEHGFTEGIDDSMVLLQGKVRLLRTPMVKLYNRLICVTEKALNKIREYGERRMLASHKSMTEFDMLQMNNMRAVGIGTPQIYGSLARFNLFGDILVFNTTYRKNKYDCPLIVFFGFNHHNQTIVFATTIIANEIEETCVWLLENFLEAMKGKLPLSVITNGDLAMKTSIRRVFPNSHHRLCIWHILCNATTNLGNVEFNRVHKMLAK

SEQ ID NO: 196166 - protein, 124 aa, Glycine max
  Coding DNA Sequence Number=SeqID_79388
MVFLTRHEESIKIQRTNRLRIICPDTLEGTSFVVQVEGTSTWVVILRTREDTSLVDQFKWRVHPLGCSKRTREGTSHVDLWLVKDFTRLKEISRTVGCLGTGCRHGLWPNQYKSCACLLLPYTL

SEQ ID NO: 196167 - protein, 227 aa, Glycine max
  Coding DNA Sequence Number=SeqID_79389
  Homolog annotation: Hit_ID=Q9FLX1; Match level="QueryCoverage=89%, HitCoverage=94%, E-value=1e-07, Identity=24%"; Hit description =Arabidopsis thaliana genomic DNA, chromosome 5, P1 clone:MXC20
METTPPLATDSFSYSWLPNCKPLANDLKEPLRESTYNSCEGTTNYPLMEEWQNFNFDISITQSPAVLSHADELFSNGLIKPLFAGPSTLESCDTTTNSTQSKPISSFSSRIVSPRTVQIHHGFLTKWKTSTCRTLRNLSRYVNQLCQKVGSSRKSTKVDDIDKEEWLVNSSWSSSQQPSPKSSTVNPVGALLDHENSIYEAVLHCKRSIVNTVFNKEINLYSSEVQD

SEQ ID NO: 196168 - protein, 211 aa, Glycine max
  Coding DNA Sequence Number=SeqID_79390
  Gene Ontology: Mol. function=nucleoside-triphosphatase activity; Cellular component=membrane
  Homolog annotation: Hit_ID=Q1SHI2; Match level="QueryCoverage=43%, HitCoverage=23%, E-value=1e-14, Identity=41%"; Hit description=AAA ATPase
MGKEYYWPKEQTQNSLTTTLDQGRSFQNVVIFNRMELVQIRLHLVLQLRVHRHCVKARWMRERRQAPLTGVGVHIQLDVLFSSLLDLVSNRENVLESKDELVAGGVGSREPGAEEGVMNGVVRVEVEEGGGRDWGRRRGLHNRNLQRREENRVVVAGYKQAGEGTLYEKEIVSLLKDDSTFIQELFARLKLPTTSQESKKNLVSRLLSSVL

SEQ ID NO: 196169 - protein, 120 aa, Glycine max
  Coding DNA Sequence Number=SeqID_79391
  Subcellular localization annotation: CTP_CleavageSite=23; ConfidenceScore=5.21e-01
MSSSFFQTQQLVPRALKHLCNTSSHSNKYNQHNLRPTNFPITNGGIQDFFPISNEALEFSTSNHHSQLSALTVTVTLRGSTSQVSLPLLTSNPHSHSPRRHFSSLTLHGLYTVSHERLAS

SEQ ID NO: 196170 - protein, 215 aa, Glycine max
  Coding DNA Sequence Number=SeqID_79392
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=99%, HitCoverage=76%, E-value=2e-75, Identity=64%"; Hit description=Class III chitinase
  Pfam annotation: Domain name=Glyco_hydro_18; Domain location=26-215; Score=23.4; E_value=2.6e-08; Accession=PF00704.18; Description =Glycosyl hydrolases family 18
MAMKSAITVTFLSLVSLALASDSDGGIIAIYWGQKDNEGTLAEVCATGNYDYVIIAFLPTFGNGQTPMIYLADHCDPYSNGCTGLSSDIKSCQDKGIKVLLSLVGGVGSYSDTNSTQDACQVAAYLWNNFLGGQSSSRPLGPAVLDGFDFGIVYDIEGGPKQYWRDLAKFLKWYNPKEIPLQLAFLTLFGSQFYNSPPCQYSSGEISNLEDSWKQ

SEQ ID NO: 196171 - protein, 311 aa, Glycine max
  Coding DNA Sequence Number=SeqID_79393
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=93%, HitCoverage=97%, E-value=1e-134, Identity=78%"; Hit description =Class III chitinase
  Pfam annotation: Domain name=Glyco_hydro_18; Domain location=26-282; Score=193.1; E_value=6.7e-55; Accession=PF00704.18; Description =Glycosyl hydrolases family 18
MASKSSLSIRFLCLLLLALANGSNAGKIAIYWGQNGNEGTLAEACATGNYDYVIIAFLPTFGNGQTPMINLAGHCDPYSNGCTGLSSDIKSCQAKGIKVLLSLGGGAGSYSIASTQDASQVATYLWNNFLGGQSSSRPLGPAVLDGIDFDIEGGSNQHWGDLAKFLKGYGKQVYITAAPQCPFPDAWIGNALTTGLFDFVWVQFYNNPPCQYNSGAISNLEDAWKQWITSIPANKIFLGLPASPLAAGSGFIPPADVTSKVLPAIKGSSKYGGVMLWSRFSNICLSWTSNLALSSSDNQMQTSVPVCYREC

SEQ ID NO: 196172 - protein, 674 aa, Glycine max
  Coding DNA Sequence Number=SeqID_79394
  Gene Ontology: Mol. function=protein kinase activity; Cellular component=integral to membrane; Biological process=protein amino acid phosphorylation
  Homolog annotation: Hit_ID=Q1RVJ1; Match level="QueryCoverage=50%, HitCoverage=54%, E-value=1e-122, Identity=65%"; Hit description =Protein kinase domain, putative
  Pfam annotation: Domain name=Pkinase; Domain location=116-387; Score =41.7; E_value=4.8e-11; Accession=PF00069.15; Description=Protein kinase domain
  Pfam annotation: Domain name=Pkinase_Tyr; Domain location=115-387; Score=-19.7; E_value=2.9e-11; Accession=PF07714.7; Description =Protein tyrosine kinase
  Pfam annotation: Domain name=tRNA-synt_1; Domain location=228-670; Score=-295.6; E_value=6.7e-07; Accession=PF00133.12; Description =tRNA synthetases class I (I, L, M and V)
  Pfam module annotation: Pfam domain module=Pkinase::Pkinase_Tyr::tRNA- synt_1; Domain location=116-387::115-387::228-670
MSPCNEIGRNESRSEVPNPNSPQRKGNKHRILITVIIVVAVVVVASIVALLFIRNQRRKRLEPLILSKKENSKNSGGFKESQSSIDLTSDFKKGADGELNFVREEKGGFDLQDLLRASAVVLGSGSFGSTYKAMILNGPTVVVKRFRHMNNNVGKQEFIEHMKRLGSLTHPNLLPLAAFYYRKEDKFLIYDYAENGSLASHLHGRNNSMLTWSTRLKIIKGVARGLAYLYESLPSQNLPHGHLKSSNVILDHSFEPHLTEYGLVPVMSKSHAQQFMAAYKAPEVIQFGRPNVKSDVWCLGIMILELLTGKFPANYLRHGKGRNNNADLATWVDSVVREEWTGEVFDKDIMGTRNGEGEMLKLLRIGMFCCKWSVESRWDWREALGKIEELKEKDSDEEYYSSYLNVGTYIGSRGGFNIAVVGLVIGILIEKKHFLGQRNDDGYPITILGGGNLKISYNFDAILVDPNFETSVVKITSAHDPNDFEVGKRHNLEFINGLYRGSENNEMRPGVCLRRNDVLEPMIKPRWYVNCNDLEKQALPTVVDEENKRIEIIPKQYLADWKRYLYLCLLFANSCNEHGKIYPTEHFSIMIYLHPMVCDAHGHKMSKPLGNVIDPIEVINGISLEGLHKRLEVGNLDPKELATTIESQKKDFPNGIDECGVDALRFALVSYIAQ

SEQ ID NO: 196173 - protein, 74 aa, Glycine max
  Coding DNA Sequence Number=SeqID_79395
  Gene Ontology: Mol. function=RNA-directed DNA polymerase activity; Biological process=RNA-dependent DNA replication
MGDLLDQLLGALMVSKIDLRSGYHQIRVKSKGIPSTAFRTRKFIKGFSRLALPLTKLTRKEKPFEWDKECEASF

SEQ ID NO: 196174 - protein, 144 aa, Glycine max
  Coding DNA Sequence Number=SeqID_79396
  Homolog annotation: Hit_ID=O49571; Match level="QueryCoverage=80%, HitCoverage=7%, E-value=1e-21, Identity=48%"; Hit description=DNA topoisomerase like-protein
MWLLSEYAAHAFVQLLVDVLSFFIKDVDSITLKDALEVLQYPLTLPHHLVQIGNRPADILICYSFPATSSGNHPKDGQPVILKLARAGLCVRHRRTVASVPKNVKPSDVTLEKALEYLSGDDVRRSGRPKGKSKVQEVEVIEAF

SEQ ID NO: 196175 - protein, 77 aa, Glycine max
  Coding DNA Sequence Number=SeqID_79397
  Subcellular localization annotation: CTP_CleavageSite=38; ConfidenceScore=5.56e-01
MDLKKKKKVASSKHNKIGAFSNLLNPSLFKLHNVGMLNSSNKSSLQFPKQSTMVKSQNSKQINKQEIEETKNLPLDQ

SEQ ID NO: 196176 - protein, 129 aa, Glycine max
  Coding DNA Sequence Number=SeqID_79398
  Gene Ontology: Mol. function=protein serine/threonine kinase activity; Cellular component=membrane; Biological process=protein amino acid phosphorylation
  Homolog annotation: Hit_ID=Q5NAH9; Match level="QueryCoverage=84%, HitCoverage=18%, E-value=4e-34, Identity=58%"; Hit description =Protein kinase CDG1-like
  Pfam annotation: Domain name=Pkinase_Tyr; Domain location=28-129; Score=-144.7; E_value=0.0014; Accession=PF07714.7; Description =Protein tyrosine kinase
MNFIALLLIQDLLRLNGTKDIEKATDNFHASRIPGEGVFGLVYSGILEDGMKVAFKVLKREDPHGDHEFLAEVEMLSRLHHRNLVKLIGVDREISPLDWGARMKIALGAAPGLAYLHEDSSPRVIHRDF

SEQ ID NO: 196177 - protein, 511 aa, Glycine max
  Coding DNA Sequence Number=SeqID_79399
  Gene Ontology: Mol. function=nucleic acid binding; Cellular component= nucleus; Biological process=meiosis
  Homolog annotation: Hit_ID=Q69NK8; Match level="QueryCoverage=98%, HitCoverage=82%, E-value=1e-157, Identity=57%"; Hit description=CwfJ / zinc finger(CCCH-type)-like protein
  Pfam annotation: Domain name=CwfJ_C_1; Domain location=381-497; Score= 134.1; E_value=3.9e-37; Accession=PF04677.5; Description=Protein similar to CwfJ C-terminus 1
  Pfam annotation: Domain name=zf-CCCH; Domain location=321-347; Score =21.2; E_value=0.0021; Accession=PF00642.15; Description=Zinc finger C-x8-C-x5-C-x3-H type (and similar)
  Pfam annotation: Domain name=zf-CCCH; Domain location=355-379; Score =13.4; E_value=0.022; Accession=PF00642.15; Description=Zinc finger C- x8-C-x5-C-x3-H type (and similar)
  Pfam module annotation: Pfam domain module=CwfJ_C_1::zf-CCCH::zf -CCCH; Domain location=381-497::321-347::355-379
MAPRILLCGDVLGRLNQLFKRVSSVNKSAGPFDALLCVGQFFPDSPEQLEDFTKYIEGGSHFPLPTYFIGDYGVAAPKLLLQASKDSANQGFKMDGFKVCHNLYWLKGSGKFPLFGLSVAYLSGRKSSSGQQFGNYTEDDVDALRAIAEEPGVVDLFLTYPSIPVHYSRRENTDSDIPAGLSDGSDSTVSELVQEIKPRYHIAGTKGIYYAREPYSNVDAVHVTRFIGLASVGNRDKQSCNILFASAFQKFIHAISPTPASTMSSTEIAMKTTNTTLSPYTFKEKRTSPMDSAKRSSDSISDPQYWRYDVAQKRQKHEAGHGDKLCFKFVSSGSCPRGEKCNFQHDTDAREQCMRGVCFDFLNKGKCERGPDCNFKHSLQDEGNRLPSRRPGSGSPNVESHLIISIGENYYLALAKGPLVEDHVLIIPVEHMPSTLSMPPESEIELSRFQNSLRSYCKSQEKEFIFFEWVSIRGTHANLQAIPIPSSKAIMVEKVFNLAAQKLGFEFVAKK

SEQ ID NO: 196178 - protein, 103 aa, Glycine max
  Coding DNA Sequence Number=SeqID_79400
  Subcellular localization annotation: CTP_CleavageSite=46; ConfidenceScore=5.22e-01
MVNSLFSLHLRNLNLTRSNTLTVRHSHVLRSLPPYTPTPHVLPALACMQRIQSINFLRLYKSDSTHREIRKSASGRRKRRSRSGGRRRRDLLKRRRRGERTKK

SEQ ID NO: 196179 - protein, 354 aa, Glycine max
  Coding DNA Sequence Number=SeqID_79401
  Gene Ontology: Mol. function=intramolecular transferase activity, phosphotransferases; Cellular component=chloroplast; Biological process=carbohydrate metabolic process
  Homolog annotation: Hit_ID=Q9SM59; Match level="QueryCoverage=96%, HitCoverage=55%, E-value=1e-176, Identity=87%"; Hit description =Phosphoglucomutase, chloroplast precursor
  Pfam annotation: Domain name=PGM_PMM_II; Domain location=4-97; Score =63.0; E_value=9.8e-16; Accession=PF02879.6; Description =Phosphoglucomutasephosphomannomutase, alphabetaalpha domain II
  Pfam annotation: Domain name=PGM_PMM_III; Domain location=99-217; Score=91.3; E_value=3e-24; Accession=PF02880.6; Description =Phosphoglucomutasephosphomannomutase, alphabetaalpha domain III
  Pfam annotation: Domain name=PGM_PMM_IV; Domain location=238-343; Score=73.0; E_value=9.6e-19; Accession=PF00408.10; Description =Phosphoglucomutasephosphomannomutase, C-
  Pfam module annotation: Pfam domain module=PGM_PMM_II::PGM_PMM _III::PGM_PMM_IV; Domain location=4-97::99-217::238-343
MSGELDLSVAIGRFIFDAMHAVTGAYAKPIFVDKLGASLDSISNGIPLEDFGHGHPDPNLTYAKDLVNILYAENGPDFGAASDGDGDRNMILGRSFFVTPSDSVAVIAANAREAIPYFKNGVKASHIFRHSSQITRDGPWIQVPTGWKFFGNLMDAGNLSVCGEESFGTGSDHIREKDGIWAVLAWLSIIAHRNKDKNPGEKLISVSDVVMEHWATYGRNFFSRYDYEECESEGANKMIEYLRDILSKSKPGDQYGSYVLQFADDFTYTDPVDGSVVSKQGVRFVFTDGSRIIYRLSGTGSAGATVRVYIEQFEPDVSKHDVDAQIALKPLIDLAISVSKLKDFTGREKPTVIT

SEQ ID NO: 196180 - protein, 213 aa, Glycine max
  Coding DNA Sequence Number=SeqID_79402
  Gene Ontology: Mol. function=cytokinin dehydrogenase activity; Cellular component=endoplasmic reticulum; Biological process =electron transport
  Homolog annotation: Hit_ID=Q9FUJ2; Match level="QueryCoverage=89%, HitCoverage=39%, E-value=4e-41, Identity=45%"; Hit description =Cytokinin dehydrogenase 4 precursor
  Pfam annotation: Domain name=FAD_binding_4; Domain location=66-213; Score=42.1; E_value=1.8e-09; Accession=PF01565.13; Description=FAD binding domain
MASYYYRFSKALIMLCLTCIVLITQAQSQTWSLLQAPKEITLKLIRDPVTLSLASIDYGHIVHDNPFAIFAPSSISDISLLINFSNSLAIPITIAPRGQAHSVHGQAMTNHGVVVNMTELNGFRNGDGIVVVVDDTTIGPYADVGGEQIWIDVLHATLERGLTPLSWTDYLYLSVGGTLSNAGISGQTFRFGPQISNVHQLDVVTGMYGYSLP

SEQ ID NO: 196181 - protein, 170 aa, Glycine max
  Coding DNA Sequence Number=SeqID_79403
  Gene Ontology: Mol. function=cytokinin dehydrogenase activity; Cellular component=endoplasmic reticulum; Biological process =electron transport
  Homolog annotation: Hit_ID=Q9LTS3; Match level="QueryCoverage=98%, HitCoverage=32%, E-value=2e-59, Identity=60%"; Hit description =Cytokinin dehydrogenase 3 precursor
  Pfam annotation: Domain name=Cytokin-bind; Domain location=1-169; Score=217.4; E_value=3.2e-62; Accession=PF09265.1; Description =Cytokinin dehydrogenase 1, FAD and cyto
MFEKDVSYEEFLNRVHADELFLRSQGLWDVPHPWLNLFVPASRISDFDEGVFKGIILQQNITAGLVIIYPMNRTKWDDNMSAVTPHDDVFYVVSFLRSTGFDKLEEFKAQNRQILQFCANAGMGIKQYLPQNKTREKWEEQFGPKWKTFKQRKAQFDPNRILSPGQGIFN

SEQ ID NO: 196182 - protein, 224 aa, Glycine max
  Coding DNA Sequence Number=SeqID_79404
  Gene Ontology: Mol. function=intramolecular transferase activity, phosphotransferases; Cellular component=chloroplast; Biological process=carbohydrate metabolic process
  Homolog annotation: Hit_ID=Q9SM59; Match level="QueryCoverage=98%, HitCoverage=35%, E-value=5e-64, Identity=59%"; Hit description =Phosphoglucomutase, chloroplast precursor
  Pfam annotation: Domain name=PGM_PMM_I; Domain location=84-224; Score= 100.7; E_value=4.3e-27; Accession=PF02878.6; Description =Phosphoglucomutasephosphomannomutase, alphabetaalpha domain I
  Subcellular localization annotation: CTP_CleavageSite=54; ConfidenceScore=5.59e-01
MAFSCKLDSFILSAYKPQNSILPLSIQPSSFLPSPSSLKPQKLPFRIRYGSTIRATSSSSTPSATIAEPEGIKIKSIPTKPIDGQKTGTSGLRKKVKVFMQDNYLANWIQALFNSLPPEDYKNGLLVLGGDGRYFNQEAAQIIIKIAAGNGVGKILGRYFVNTSRFCCYKKEKGMPANGGFIMSASHNPGGPEYDWGIKFNYSSGQPAPESITDKIYGNTLSDE

SEQ ID NO: 196183 - protein, 535 aa, Glycine max
  Coding DNA Sequence Number=SeqID_79405
  Gene Ontology: Mol. function=cytokinin dehydrogenase activity; Cellular component=endoplasmic reticulum; Biological process =electron transport
  Homolog annotation: Hit_ID=Q9LTS3; Match level="QueryCoverage=96%, HitCoverage=96%, E-value=1e-175, Identity=57%"; Hit description =Cytokinin dehydrogenase 3 precursor
  Pfam annotation: Domain name=Cytokin-bind; Domain location=249-527; Score=589.8; E_value=2.5e-174; Accession=PF09265.1; Description =Cytokinin dehydrogenase 1, FAD and cyto
  Pfam annotation: Domain name=FAD_binding_4; Domain location=70-217; Score=90.1; E_value=6.7e-24; Accession=PF01565.13; Description=FAD binding domain
  Pfam module annotation: Pfam domain module=Cytokin-bind::FAD_binding _4; Domain location=249-527::70-217
MALNYPFLTYFILLLVTITRLIFTVGKTEQWKAPILPELDIDNISHKLHDDPETIQMASRDYGHLTHEFPLAVFRPSSIDDIVTLIKSSYNSFAPFDIAARGQGHSTHGQAMARDGIVVDMASLRKQRNGVAISVSKDPLMGHYADVGGEQLWIDVLHATLEYGLAPVSWTDYLYLTVGGTLSNAGISGQSFRYGPQISNVHEMDVITGKGEFVTCSSQKNLELFHAVLGGLGQFGVIARARIALEPAPKRVKWVRLLYSDFSAFTKDQERLISINGRKQKNALDFLEGMLLMNQGPINNWRSSFFPLSDHPRIASLITEHSILYCLEVAKYYDEQTELNVDKEIEVLLQGLAYIPGFNYEKNVSYVEFLNRVRSGELKLQSQGLWEVPHPWLNLFIPKSQILDFNSGVFKDIVLKRNISSGPVLVYPMNRNKWDDRMSASIPDEDVFYTVGFLHSSGFDTWKAYDAQNREILEFCRDAGIMVKQYLPNHSTQEDWTNHFGAKWMKFLERKHQFDPRMILSPGQKIFHKKLQPVF

SEQ ID NO: 196184 - protein, 804 aa, Glycine max
  Coding DNA Sequence Number=SeqID_79406
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q6K4E4; Match level="QueryCoverage=75%, HitCoverage=62%, E-value=0.0, Identity=56%"; Hit description =Putative CRS1
  Pfam annotation: Domain name=CRS1_YhbY; Domain location=201-284; Score=91.5; E_value=2.6e-24; Accession=PF01985.11; Description=CRS1 YhbY domain
  Pfam annotation: Domain name=CRS1_YhbY; Domain location=404-498; Score=30.5; E_value=5.9e-06; Accession=PF01985.11; Description=CRS1 YhbY domain
  Pfam annotation: Domain name=CRS1_YhbY; Domain location=627-715; Score=108.9; E_value=1.5e-29; Accession=PF01985.11; Description=CRS1 YhbY domain
  Pfam module annotation: Pfam domain module=CRS1_YhbY::CRS1_YhbY::CRS1_ YhbY; Domain location=201-284::404-498::627-715
  Subcellular localization annotation: CTP_CleavageSite=44; ConfidenceScore=5.74e-01
MALQPIPLNCSSSTPCSYSSLHFLKFRVSCSNQTSQLDTPQRVKVANKTKNSSHRPSFLHQIQDKWSLKLGSQREKFPWQEQKHEVEQQQQIEEEKEEKKREQFQNQKKPSASNFQFPKRVSPWAQAINPSSALLDSESDDSEDEEDNEDVKGKALQHNSIGSVREERKGMASEVSSNEAERVNGERKKRRSNTELAERTIPEHELRRLRKIALRMMERFDVGVKGITQELVASVHQKWRDAEVVKFKFGIPLSAHMKKAHQILESKIGGIVIWRSGSSIVLYRGMAYKLPCIENYKKVNLAKENAVDHSLHVGNGSDGQASVNETVGTAESVIQESAEYLKDMSEEELMEMCDLNHLLDELGPRFKDWTGRQPLPVDADLLPAVVPGYKTPFRLLPYRIRPCLTNKEMTNFRRLARTTAPHFALGRNRELQGLARAMVKLWETSAIAKIAIKRGVPNTCNDRMAEELRPNGGCISYMQKLTGGTLLSRNKEYIVFYRGNDFLPPVVTNTLNERQKLTLLQQDEEDKARQIASSITVSNSKAAQVPLIAGTLTETRAATTNWGHQPSKQEIENMIRDSAMNKLSALVKHHEKKLALAKSKFRKAEKALAKVQRDLDPADIPSDLETLTNEERFLFRKIGLSMKPYLLLGRRDVYAGTIENMHLHWKYRELVKLIVKGRNSAQVKHISISLEAESGGVLVSVDKDTRGHHTIIVYRGKNYFSPRVVRPKNLLTRRQALARSVELQRREALKHHISDLEERIGLLKSELEDMKNGKEIEDSKTLYPALENPVSSDDDLEELNIFFP

SEQ ID NO: 196185 - protein, 194 aa, Glycine max
  Coding DNA Sequence Number=SeqID_79407
  Homolog annotation: Hit_ID=Q3SC87; Match level="QueryCoverage=99%, HitCoverage=74%, E-value=3e-48, Identity=56%"; Hit description=ACI13
MKLTAGPKKAALEHLRKKIEESTERIRVAKLKEEQAQKVWESASKVVRDEEALKQKLCEDLSNLVQESSNSQFARLEELKRRLEALNPTRPSTNLYHDGRSGASSQNSTPQPGSSVPNAKESNEGSTESIPNQSNGQKVAVTNGPNQQPHNEGEGRSKKKVNFQPKGKGIGAVAKGRSSTPDWTGAGFDVDGRT

SEQ ID NO: 196186 - protein, 539 aa, Glycine max
  Coding DNA Sequence Number=SeqID_79408
  Gene Ontology: Mol. function=transcription regulator activity; Cellular component=nucleus; Biological process=regulation of transcription
  Homolog annotation: Hit_ID=Q5Z610; Match level="QueryCoverage=99%, HitCoverage=97%, E-value=3e-31, Identity=27%"; Hit description=Basic helix-loop-helix protein-like
  Pfam annotation: Domain name=HLH; Domain location=346-395; Score =41.7; E_value=2.5e-09; Accession=PF00010.16; Description=Helix-loop -helix DNA-binding domain
MDGVFALPEAARADCLRSLVQSCGCTYVSLWQYDSNLSNLFFLDGFYDATNNQQSSSLGSVAERLLHQYRALTFDVNDHEYVPGVVFRNQLPYIELQLLDLLRLTSTEIQTKFFQEAGIEIAVFMGCKNGEIELGFSNISQVDIQTTLKNLFPQDFYIHSQSTTDQNPPLSSSSSSSSFMSLSTGRPDQCSSSLLLSSIPGTSQYHFPQTLPTQTQTQTQTSPQYQALDLVPVIPSYFPTPEGEHEAIVKAFISVMSSSSTSTSQQHQPHQIVPKYTSVVHPGATAFNKCRPDTLNPNITPQLGSNFRSQSLQKRSFEFFRNLNNLTRMRERVTQPAPRPISTQHQYQQHTISERRRREKLNENFQALRTLLPPGTKKNKATILTTATETMRSLMDEIEKLNMRNQQLMTVLSVKEATATSTEENKAKPSSSYERLNVGVSHVSESSSSEEQMVNLQVTVRGESCLVDLLIQLLEFLERVQNVNFVSMDANNHITGETAINQLTFRLRIIEGIEWDEHAFEEAVRRVAADTIQWQPLEQ

SEQ ID NO: 196187 - protein, 160 aa, Glycine max
  Coding DNA Sequence Number=SeqID_79409
MAQIHYFREYFLSFGHKRTGKDKIWAILHLLREGRGEKFDMEAVTSTHAKVQTGYKLLEILVTSCLRLRFLRPYEVVDSSKTSNSKQPKEKKERIFQKYIDCKMLPDIDQCRMQTNTQAENHNDIIPKKEERRLYREMNNTPHGIKQKPGRQLKEQQPVQ

SEQ ID NO: 196188 - protein, 90 aa, Glycine max
  Coding DNA Sequence Number=SeqID_79410
MNPPRVLKKSSQTLKAACSIEMFVPEPYYHSEKVLVGPESQRLNQFKHKVTSKKAPPPPPTSIQIFINFSDVGKKIEEYQLGQPVNHIYY

SEQ ID NO: 196189 - protein, 472 aa, Glycine max
  Coding DNA Sequence Number=SeqID_79411
  Gene Ontology: Mol. function=protein serine/threonine kinase activity; Cellular component=cytoplasm; Biological process=protein amino acid phosphorylation
  Homolog annotation: Hit_ID=Q1SRR9; Match level="QueryCoverage=93%, HitCoverage=98%, E-value=0.0, Identity=72%"; Hit description=Protein kinase
  Pfam annotation: Domain name=Pkinase; Domain location=9-278; Score =152.5; E_value=1.1e-42; Accession=PF00069.15; Description=Protein kinase domain
  Pfam annotation: Domain name=Pkinase_Tyr; Domain location=9-273; Score=-113.0; E_value=1.6e-05; Accession=PF07714.7; Description =Protein tyrosine kinase
  Pfam module annotation: Pfam domain module=Pkinase::Pkinase_Tyr; Domain location=9-278::9-273
MEPRVGNKFRLGRKIGSGSFGEIYLGTNIQTNEEVAIKLENVKTKHPQLLYESKLYRILQGGTGIPNVRWFGVEGDYNVLVMDLLGPSLEDLFNFCSRKLSLKTVLMLADQMINRVEFIHSKSFLHRDIKPDNFLMGLGRRANQVYAIDFGLAKKYRDSSTHQHIPYRENKNLTGTARYASMNTHLGIEQSRRDDLESLGYVLMYFLRGSLPWQGLKAGTKKQKYEKISEKKVSTSIEALCRGYPTEFASYFHYCRSLRFDDKPDYAYLKRIFRDLFIREGFQFDYVFDWTILKYQQSQLATPPTRAIGPSAGTSSGMPPAVTNADRHTGGEEGRPPALVSVDSSRRRMSGPILNTLSSANVLGQSSGSSRRAAVSSSRDAFVGAESDIRTRTAEASPGAAHRGLSGQRSSPIGSSDPKRVVSSGRNASHVKNYDTALRGMEDVYSFTHVDCKCQNYQIPAKNVISHCTLVG

SEQ ID NO: 196190 - protein, 530 aa, Glycine max
  Coding DNA Sequence Number=SeqID_79412
  Gene Ontology: Mol. function=nucleic acid binding; Biological process= metabolic process
  Homolog annotation: Hit_ID=O64851; Match level="QueryCoverage=98%, HitCoverage=99%, E-value=1e-159, Identity=56%"; Hit description =Expressed protein
  Pfam annotation: Domain name=IQ; Domain location=129-149; Score=16.9; E_value=0.072; Accession=PF00612.17; Description=IQ calmodulin -binding motif
MGLSLSLLQSAWEEIVRHFPFSDLPLSISFASKDGTLILRASSFKRRESESAITVLSNGSRSSNRLRDNRPQHVILERNFSFVQDEENNKMGWDTLASKGGELKHKPVPVLSLPQAAIFSHSRPASELDAAATKLQKVYKSYRTRRNLADCAVVVEELWWKALDFAALKRSSVSFFDVEKPETAASRWARARTRVAKVGKGLSKDDKAQKLALQHWLEAIDPRHRYGHNLHMYYDIWFESQSTQPFFYWLDVGDGKEINLKKCPRSTLQSQCIKYLGPKEREEYEVIVENGKLVYKKDGRLVDTDEKSKWIFVLSTTRALYVGRKQKGTFQHSSFLSGGATTAAGRLVAHQGALEAIWPYSGHYHPTEENFKEFISFLEEHNVDLTNVKRCAIDDDNPSLIGTNSFTATNESQQAMGPTLNSHTGPASAINVNDSKTHKKDDAATFNLSKRLSCKWTTGAGPRIGCVRDYPEHLQSRALEQVNLSPRPTSARLSNYGPIPSPRPSPKVRMSPRIAYMGLPSPRNPIPAAS

SEQ ID NO: 196191 - protein, 110 aa, Glycine max
  Coding DNA Sequence Number=SeqID_79413
  Homolog annotation: Hit_ID=Q6K4E0; Match level="QueryCoverage=70%, HitCoverage=27%, E-value=7e-30, Identity=71%"; Hit description=WD-40 repeat protein-like
MRNIKVIDVMQQNYGSAKFFGNDIKPVLDVVNPQHKGPWGALSPIPENNAIAVNTQGGSVFAASGDSCAYCWDVETGKVKMVFKGHMDYLHCIVARNSLDQVLILDLIVI

SEQ ID NO: 196192 - protein, 110 aa, Glycine max
  Coding DNA Sequence Number=SeqID_79414
  Homolog annotation: Hit_ID=Q8L4M1; Match level="QueryCoverage=41%, HitCoverage=12%, E-value=7e-12, Identity=72%"; Hit description =Putative WD-40 repeat protein
MDALMLRGGDGGRDGVGCDGTVARGKDESVEVRGVGWGPSGSENGSGLDFPLLENGFSVCVFVPVRGVTAHRYSPLAAFVLQLLRQQQSSALNDDVLKRMMTRGFGQRPG

SEQ ID NO: 196193 - protein, 302 aa, Glycine max
  Coding DNA Sequence Number=SeqID_79415
  Gene Ontology: Mol. function=acyltransferase activity; Cellular component=endoplasmic reticulum; Biological process=triacylglycerol metabolic process
  Homolog annotation: Hit_ID=Q1MW30; Match level="QueryCoverage=97%, HitCoverage=55%, E-value=1e-140, Identity=92%"; Hit description =Diacylglycerolacyltransferase-1b
MAISDEPESVATALNHSSLRRRPSATSTAGLFNSPETTTDSSGDDLAKDSGSDDSINSDDAAVNSQQQNEKQDTDFSVLKFAYRPSVPAHRKVKESPLSSDTIFRQSHAGLFNLCIVVLVAVNSRLIIENLMKYGWLIKSGFWFSSKSLRDWPLFMCCLSLVVFPFAAFIVEKLAQRKCIPEPVVVVLHIIITSTSLFYPVLVILRCDSAFVSGVTLMLFSCVVWLKLVSYAHTNYDMRALTKLVEKFLNQNILLDLAVAYGSWRSTARYSEHGLSLQRKLQELGIFPGCPYIMLPGSSTFK

SEQ ID NO: 196194 - protein, 537 aa, Glycine max
  Coding DNA Sequence Number=SeqID_79416
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=Q8W4M7; Match level="QueryCoverage=99%, HitCoverage=74%, E-value=0.0, Identity=84%"; Hit description=DNA repair helicase UVH6
  Pfam annotation: Domain name=DEAD_2; Domain location=1-59; Score= -33.2; E_value=0.00048; Accession=PF06733.6; Description=DEAD_2
  Pfam annotation: Domain name=DUF1227; Domain location=60-216; Score =333.8; E_value=3e-97; Accession=PF06777.2; Description=Protein of unknown function (DUF1227)
  Pfam module annotation: Pfam domain module=DEAD_2::DUF1227; Domain location=1-59::60-216
MVQFANVVVYSYQYLLDPKVAGIISKEMQKESVVVFDEAHNIDNVCIEALSVSVRRQTIEGARRNLNRMRQEIDKFKATDAGRLRAEYNRLVEGLALRGDLPATDAWLANPALPDDILKEAVPGNIRRAEHFIHVLRRLVQYLEGRLDTENVEKESPVSFVVSILNHAGIDQKALKFCYDRLHSLMMTLEITDTDEFLHIQTICDFATLVGTYARGFSIIIEPFDERMPHIPDPVLQLCCHDASLAIKPVFERFQSVVITSGTLSPIDLYPRLLNFNPVVSRSFTMSLTRDCICPMVLTRGSDQLPVSTKFDMRSDLGVVRNYGRLLLEMASVVPDGIEIMQHKLVFIETQDVVETTLALDNYRKACDCGRGAIFFSVARGKVAEGIDFDRHYGRLVIMFGVPFQYTLSKILLARLEYLRDTFQIKEGDFLTFDALRQAAQCVGRVIRSKADYGMMIFADKRYSRHDKRSKLPSWILSHLHDAHLNLSTDMALHIAREFLRKMAQPYDKTGGTGRKTLLSQEDLEKMAVSGLDDMMY

SEQ ID NO: 196195 - protein, 176 aa, Glycine max
  Coding DNA Sequence Number=SeqID_79417
  Gene Ontology: Mol. function=oxidoreductase activity; Cellular component=vacuole; Biological process=hydrogen peroxide catabolic process
  Homolog annotation: Hit_ID=Q42517; Match level="QueryCoverage=95%, HitCoverage=51%, E-value=2e-51, Identity=59%"; Hit description =Peroxidase N precursor
  Pfam annotation: Domain name=peroxidase; Domain location=25-176; Score=209.8; E_value=6.4e-60; Accession=PF00141.13; Description =Peroxidase
MKRSLKSELTTDFYKSSCPNVSKIVRREVKKALTNEMRMAASLLRLHFHDCFVNGCDGSILLDGGDDGEKSAVPNLNSARGYDVVDTIKSSVESECDGVVSCADILAIAARDSVFLSGGPSWKVLLGRRDGTVSNGTLANEALPAPFDPLDTIISKFANMGLNLTDVVSLSGYKER

SEQ ID NO: 196196 - protein, 198 aa, Glycine max
  Coding DNA Sequence Number=SeqID_79418
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=Q8W4M7; Match level="QueryCoverage=78%, HitCoverage=20%, E-value=8e-71, Identity=83%"; Hit description=DNA repair helicase UVH6
  Pfam annotation: Domain name=DEAD_2; Domain location=72-188; Score =12.7; E_value=8.5e-08; Accession=PF06733.6; Description=DEAD_2
MKFEIEDITVYFPYDNIYPEQYSYMVELKRALDAKGHCLLEMPTGTGKTIALLSLITSYVLSKPHSPLKLLYCTRTVHEMEKTLAELRLLHDYQLRHLGPAAKILALGLSSRKNLCVNPRVLAAENRDSVDAGCRKLTASWVRAVAAENPGVPTSRFQIMVMVAVSLRSLILWEIVNKCRIVVAIDTLKPLTLWLKVV

SEQ ID NO: 196197 - protein, 338 aa, Glycine max
  Coding DNA Sequence Number=SeqID_79419
  Gene Ontology: Mol. function=oxidoreductase activity; Cellular component=vacuole; Biological process=hydrogen peroxide catabolic process
  Homolog annotation: Hit_ID=Q42517; Match level="QueryCoverage=92%, HitCoverage=95%, E-value=9e-98, Identity=59%"; Hit description =Peroxidase N precursor
  Pfam annotation: Domain name=peroxidase; Domain location=51-300; Score=474.3; E_value=1.5e-139; Accession=PF00141.13; Description =Peroxidase
MSRGINESNRHPQCQSIKKNSDWTVILSCQIRSQLTTDFYKSSCPNLSKIVRREVQKALMNEIRMAASLLRLHFHDCFVNGCDGSILLDGGDDGEKSAAPNLNSARGYEVVDTIKSSVESACSGVVSCADILAIAARDSVFLSGGPFWKVPLGRRDGTVSNGTLATEVLPAPFDPLNTIISKFTNMGLNLTDVVSLSGAHTIGRARCTLFSNRLFNFSGTGAPDSTLETGMLSDLQSLCPQNGDGNVTTVLDRNSSDLFDIHYFKNLLSGKGLLSSDQILFSSDEANSTTKPLVQSYSNDSGQFFGDFANSMIKMGNINIKTGTDGEIRKNCRVINSQ

SEQ ID NO: 196198 - protein, 91 aa, Glycine max
  Coding DNA Sequence Number=SeqID_79420
  Gene Ontology: Mol. function=protein binding
  Homolog annotation: Hit_ID=Q949G7; Match level="QueryCoverage=73%, HitCoverage=11%, E-value=2e-09, Identity=49%"; Hit description =HcrVf3 protein
MASKMTLACCLPRGTMTIIEIVANGEAFNAMMKLVTYNNNDFLRCYIPEAMGSFTNLRYLNLSYSVFGGRIPSKLGNLSQLRYLELGGNHL

SEQ ID NO: 196199 - protein, 1149 aa, Glycine max
  Coding DNA Sequence Number=SeqID_79421
  Gene Ontology: Mol. function=protein binding; Cellular component =integral to membrane; Biological process=defense response to fungus
  Homolog annotation: Hit_ID=Q1T435; Match level="QueryCoverage=81%, HitCoverage=93%, E-value=1e-136, Identity=35%"; Hit description =Leucine-rich repeat; Leucine-rich repeat, cysteine-containing type
  Pfam annotation: Domain name=LRRNT_2; Domain location=214-256; Score =52.5; E_value=1.4e-12; Accession=PF08263.3; Description=Leucine rich repeat N-terminal domain
  Pfam annotation: Domain name=LRR_1; Domain location=1021-1042; Score =11.4; E_value=2.1; Accession=PF00560.23; Description=Leucine Rich Repeat
  Pfam annotation: Domain name=LRR_1; Domain location=315-337; Score =12.7; E_value=1.2; Accession=PF00560.23; Description=Leucine Rich Repeat
  Pfam annotation: Domain name=LRR_1; Domain location=339-361; Score =11.2; E_value=2.3; Accession=PF00560.23; Description=Leucine Rich Repeat
  Pfam annotation: Domain name=LRR_1; Domain location=363-386; Score =9.9; E_value=3.9; Accession=PF00560.23; Description=Leucine Rich Repeat
  Pfam annotation: Domain name=LRR_1; Domain location=388-410; Score =14.3; E_value=0.46; Accession=PF00560.23; Description=Leucine Rich Repeat
  Pfam annotation: Domain name=LRR_1; Domain location=489-512; Score =7.4; E_value=12; Accession=PF00560.23; Description=Leucine Rich Repeat
  Pfam annotation: Domain name=LRR_1; Domain location=514-536; Score =12.4; E_value=1.4; Accession=PF00560.23; Description=Leucine Rich Repeat
  Pfam annotation: Domain name=LRR_1; Domain location=539-561; Score =12.7; E_value=1.2; Accession=PF00560.23; Description=Leucine Rich Repeat
  Pfam annotation: Domain name=LRR_1; Domain location=563-585; Score =8.3; E_value=8.1; Accession=PF00560.23; Description=Leucine Rich Repeat
  Pfam annotation: Domain name=LRR_1; Domain location=596-618; Score =18.2; E_value=0.029; Accession=PF00560.23; Description=Leucine Rich Repeat
  Pfam annotation: Domain name=LRR_1; Domain location=620-643; Score =12.5; E_value=1.3; Accession=PF00560.23; Description=Leucine Rich Repeat
  Pfam annotation: Domain name=LRR_1; Domain location=645-673; Score =10.4; E_value=3.2; Accession=PF00560.23; Description=Leucine Rich Repeat
  Pfam annotation: Domain name=LRR_1; Domain location=693-716; Score =8.1; E_value=8.8; Accession=PF00560.23; Description=Leucine Rich Repeat
  Pfam annotation: Domain name=LRR_1; Domain location=730-748; Score =6.8; E_value=15; Accession=PF00560.23; Description=Leucine Rich Repeat
  Pfam annotation: Domain name=LRR_1; Domain location=756-777; Score =5.6; E_value=26; Accession=PF00560.23; Description=Leucine Rich Repeat
  Pfam annotation: Domain name=LRR_1; Domain location=780-802; Score =19.3; E_value=0.014; Accession=PF00560.23; Description=Leucine Rich Repeat
  Pfam annotation: Domain name=LRR_1; Domain location=804-826; Score =14.4; E_value=0.43; Accession=PF00560.23; Description=Leucine Rich Repeat
  Pfam annotation: Domain name=LRR_1; Domain location=828-850; Score =8.8; E_value=6.3; Accession=PF00560.23; Description=Leucine Rich Repeat
  Pfam annotation: Domain name=LRR_1; Domain location=853-875; Score =8.5; E_value=7.3; Accession=PF00560.23; Description=Leucine Rich Repeat
  Pfam annotation: Domain name=LRR_1; Domain location=877-899; Score =12.3; E_value=1.4; Accession=PF00560.23; Description=Leucine Rich Repeat
  Pfam annotation: Domain name=LRR_1; Domain location=949-971; Score =12.0; E_value=1.6; Accession=PF00560.23; Description=Leucine Rich Repeat
  Pfam annotation: Domain name=LRR_1; Domain location=973-995; Score =13.9; E_value=0.59; Accession=PF00560.23; Description=Leucine Rich Repeat
  Pfam annotation: Domain name=LRR_1; Domain location=997-1019; Score =16.2; E_value=0.12; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1; Domain ...
  Pfam module annotation: Pfam domain module=location=214-256::1021 -1042::315-337::339-361::363-386::388-410::489-512::514-536::539 -561::563-585::596-618::620-643::645-673::693-716::730-748::756 -777::780-802::804-826::...
  Pfam module annotation: =828-850::853-875::877-899::949-971::973 -995::997-1019
  Subcellular localization annotation: CTP_CleavageSite=34; ConfidenceScore=5.52e-01
MAAIASTMAAIQPTMLSATQPTLWSATATRLNLSATADSPCNRQGMLRTAILVVWIENTKPDTQTEQGRVDFVEIAVSNVFDGRMDLGGGMFLKGKSQYVEVGFPHIARIPEFLVQNENELEQRESQIRKAFDAQYQSGGGGFVSVEGLHQVHRETNIKLPQEKLEHLCSDGFIVWSEFWQVILDLDKSSGGLKDSSGLMGFNGSSKSAEAKCVERERQTLLNFKQGLIDASGMLSSWRDDDNNKDCCKWKGIECNNKTGHIDMLDLRGSEKHYLTGAINLTSLIDLQNMEHLDLSSNYDSSEMQIPEHIGSFKNLRYLNLSYIGLSGRIPYELGNLSKLEYLDLKANFLDGAIPSQLGNLTTSRYLDLSYNSEIEGQIPYQFRNLSQLQYLDLEGTYLSGAIPFKIGNLPILHTLMLGQDLDVKSMDTAWLSSLYSLTHLGLDSINNLGSSQHLLLTISKFFPNLRELSLTDRSFIVSSTSTVNSSSSLDTLHLSFNLLKSSVIFHWLFNFTNLRRLHLVANLLEGSIPDGFGKIMNYLEDLVISSNRLQGEIPASLGNICTLQRLYLKKNNLSGEISSLIKKISWCNKTGMLPNLSNLDLSFNRLTGEIPKSIGLLYELESLHLEENYLEGDIIESHLTNLTKLEELDLTGNLLSLKFGNTWVPSFQLYVLGLASCKLGPSFPSWIQTQSHLQFLDISDAGIDDFVPDWFWNKLQSIYAMNMSYNNLKVSILDLSENKISDLNAFFCGKGATANMLILDLSSNQIMGKLPDCWEHHNSLKVLDLSNNRLSGKIPESMDTLVNLKSLVLRNNSLIGELPLTLKNCTSLVTFDVSENLLSGPIPSWIGESLQQLKILSLRVNRFFGSVPVHLCYLRQIRLLDLSRNNLSEGIPTCLSNFTAMRERTVIRRKIVTGQRWTYGVISSDVYDSNVLLMWKGQEYLYLNPEFLLKSIDLSSNDLTGEIPKEVRYLLELVSLNLSRNRLSGEILPEIGNLTSLEFLDLSRNHLSGEVPSTLSKIDRLAVLDLSNNYLVGRIPWGRQLQTFSASTFEGNTDLCGEPLNKSCPGNGTATKPQGPAIQGHDDNSVFCEALYMSLGLGFFTGFWGLIGTILLWQSWRNAYLMFLNKLTEYILVMVEVNIAKCHRWLKG

SEQ ID NO: 196200 - protein, 56 aa, Glycine max
  Coding DNA Sequence Number=SeqID_79422
MDNCDGVVSSEVVVAFCGVVLIYSNGKFIKVFFRRFGFCSMLEAELWGHNLKWKEQ

SEQ ID NO: 196201 - protein, 690 aa, Glycine max
  Coding DNA Sequence Number=SeqID_79423
MRTSGPEFLERVSITAGIPDKDGDVGCWRGFHKLGLALAFEHGCPDATVPLFYHSSKTWKPLIKRGLYKAEWLNEAIFDLFNEPVYFDELKTHRPCLLIGGRGTGKTTVLRGLSYEGQYASFSAHKKNVEEWPFYGMYHRVNTNRVTAFRGPEIDESSWTRYFSHYINLTFCKQILDFVKWFNLITKLDIELNKSSIKKICLSLGINEVDTLEELSEELEYAVIDFEISVNSIIDNPPKNLSILAAPIDILTESLCSLSIFKGKQFYFLIDEFENFEDYQQIILNTIIKHSNNYYTFKIGVRELGWRQRGTLNSNESLISPADYALISISERLQKNNFELFAKKVIIDRLKKEFTEVKDECIDPTNLLTSITEREEAEILIGSEDYNKTIESLSTIVSKKDLDKIRSIERELVHAAFINHIENDGVLFEPISPKTQTDAATQIGKKNLSELEGLSVDGAKLTKLVLSLGRIFQVMASDGKGHSPEVNQFHIKTDSIPSEANEADFIPEDNSIYIFGRSGEERSKHINSVYTNTPNVEFREIFAEDLYGFTSENEHKFYLRSERSILDFIGLVEINQCVYIDITGLTHSVWARLIQVSLNQKYKVRVVYVEPDQYSRSTAPVEGQIYDLSEKIQGIAPLTGFAKISDDSEKDFQFIPLLGFEGTRLSFITEQVQPNTENIIPIIGTPGFKP

SEQ ID NO: 196202 - protein, 117 aa, Glycine max
  Coding DNA Sequence Number=SeqID_79424
  Subcellular localization annotation: CTP_CleavageSite=31; ConfidenceScore=5.07e-01
HFVSKRPFRGNTGSNKDRRKSLKVYQSHTVRGEKVASAQDFVGNQRERTTLGCGFLFLVHLVTILYRLDIVWTRIYDKLGFWLKACRTVGHDICQGLASGSGIKGMSYIISMIHMQQ

SEQ ID NO: 196203 - protein, 179 aa, Glycine max
  Coding DNA Sequence Number=SeqID_79425
  Gene Ontology: Mol. function=isochorismate synthase activity; Cellular component=chloroplast; Biological process=biosynthetic process
  Homolog annotation: Hit_ID=Q1SBX7; Match level="QueryCoverage=72%, HitCoverage=22%, E-value=2e-54, Identity=83%"; Hit description =Isochorismate synthases, putative
  Pfam annotation: Domain name=Chorismate_bind; Domain location=1-168; Score=-143.2; E_value=2.4e-05; Accession=PF00425.8; Description =chorismate binding enzyme
PEQLFHRKCLHITSEALAGTRARGASQALDLQIELDLLTSPKDDIEFTIVRETIRRKLEAVCEKVVIKPEKMIRKLSRIQHLYSQLSGRLRSEEDEFEILSSLHPSPAVCGFPTEEAQLLIADAGESENGGVHYHTQSQHSVNSARHGPSPSHQRAPPSFTCYPMPALDRRFTSSDGVS

SEQ ID NO: 196204 - protein, 70 aa, Glycine max
  Coding DNA Sequence Number=SeqID_79426
  Gene Ontology: Mol. function=serine-type endopeptidase activity; Biological process=proteolysis
  Homolog annotation: Hit_ID=Q6Z806; Match level="QueryCoverage=94%, HitCoverage=11%, E-value=1e-17, Identity=64%"; Hit description =Putative DegP2 protease
MAQAGGGALLFIGRVLVSDIDIGYEEIVNTLVLAFNGKPVKNLKSLDNMVESCDDDYLNFDLEYQQVFSH

SEQ ID NO: 196205 - protein, 184 aa, Glycine max
  Coding DNA Sequence Number=SeqID_79427
MEINGDPVSEDMIVETIQEQSEQKPKRLEVEKLKSSIYIGTWCSCLHDLEDDIIETDSGVELVRPRPVSETDKQALVVVLFEEMDEDMIIHFESIYGSFASVNMKEMQVHLERRKVLQMTEKLIILMDLFQRLDHRLMRKDLYQATTWLPPSRTMPLPPLQIVPVEPNVNVQYYHGFRGHRVPE

SEQ ID NO: 196206 - protein, 87 aa, Glycine max
  Coding DNA Sequence Number=SeqID_79428
MHNAVHEEHHDRGEMGDYGCGGSDDSGSDLESGAFLFGVVLGSKGLGLDEGCFLGFLVGFEGSGLDVSGGGSFLLMGRLDLGWLGLV

SEQ ID NO: 196207 - protein, 290 aa, Glycine max
  Coding DNA Sequence Number=SeqID_79429
  Gene Ontology: Cellular component=endoplasmic reticulum
  Homolog annotation: Hit_ID=Q2PGG6; Match level="QueryCoverage=57%, HitCoverage=33%, E-value=2e-61, Identity=52%"; Hit description =Generative cell specific-1
MVFPLQALVRMLISLEGSPGQPQDLGRNISMWMLLERVRFTLDGIECNKIGVSYEAFNQQPNFCSSPFWTCLHNQLWNFRESAGSYSFSIGITEVLNTNLVLELSVNDVEYVYQRIPGKIISVSVPTFEALTQFGVATITTKNTGEFNCSKDITLMEPVLKDSDYNEVDRAECQFATTTTVLDNDTKCLCYYGFCARKGHHHIHDNKHHKQEHRHSNYSAQNRRRTTYEHMHKHSERNFGYFDDLHHVHKEMHKYGHKKQNMDNVQHIVDHPAHHKHRKKRDSSKGELKR

SEQ ID NO: 196208 - protein, 149 aa, Glycine max
  Coding DNA Sequence Number=SeqID_79430
MASSSLQAKHVSEHIWNGEEDRKLHIIQVVLMYQGFRVDGSPLIGPTNLDWADLCEKLLGVRPQEGELQECSTYAWGPAVLAYLYREMCSATDYKTKSIGVFVEVLHNKCYVSVTSNLFGWKCSVAWCTVVSLICFHVVDWHQPDKVLR

SEQ ID NO: 196209 - protein, 76 aa, Glycine max
  Coding DNA Sequence Number=SeqID_79431
AIKGLDDAPQRKSKAPARWIVVKSNRQKGTTKCGYYVMHWMSTIILGSFRNNWEATIGAREIKSIADSVGTILSPS

SEQ ID NO: 196210 - protein, 188 aa, Glycine max
  Coding DNA Sequence Number=SeqID_79432
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=87%, HitCoverage=69%, E-value=1e-33, Identity=46%"; Hit description =Protein ULTRAPETALA2
MGQELQSLLIFFRAIFLLFKVVNVTLEAFEKHALRERSGRWKRNIWVHFEDEDKVPLWKTPLIKYYTHQSNVVNRKDSAMRKQNIHRDEFLRCTKCGKECRFHLKSRPDIKNYHDALNNKCWTCSLWPYQKITCDDYEERSSLKASRGCSCSSTCQDCSTCYCEGCIKCRFQDCNCQECRDFMLYAEP

SEQ ID NO: 196211 - protein, 88 aa, Glycine max
  Coding DNA Sequence Number=SeqID_79433
MPNPEKFITETFITRLAGVTSTNRCWGVMMTSVSRTMPFFAAAKSNEAHVDGGVGFVCELLEYRRELDHEMWRDSYLIRVHDIEGRMR

SEQ ID NO: 196212 - protein, 69 aa, Glycine max
  Coding DNA Sequence Number=SeqID_79434
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=81%, HitCoverage=25%, E-value=1e-13, Identity=54%"; Hit description =Protein ULTRAPETALA2
MYNLSVQILGFLITCDDDEERSSLKASRGCSSSSTYQGCSTCYCEGCIKCRFEDCNCQECRDFMLYAEP

SEQ ID NO: 196213 - protein, 84 aa, Glycine max
  Coding DNA Sequence Number=SeqID_79435
MAKEESGLPIVIHPQQKTSQGNEKKKEDEYITQGDPPQQERSRKIGIKKKFKNIAQDDAPQWERSQKIQKNKELKNITQVYWAH

SEQ ID NO: 196214 - protein, 97 aa, Glycine max
  Coding DNA Sequence Number=SeqID_79436
MARIEKVVKISEQELDRLKQNRNEVAEIPRKCLEEKAKAFGQPRRMGNIHQRISSASVWDSTIPECRRVGGSSGDRRLSCLSPQQGKLDHCCFGRYM

SEQ ID NO: 196215 - protein, 74 aa, Glycine max
  Coding DNA Sequence Number=SeqID_79437
MACTHIPVEAKIDSPQISASPHQLDFAPYALRSYSAQWNVPELLHDMHMLHSSRILRKWRLRKPSGGYGYHCII

SEQ ID NO: 196216 - protein, 74 aa, Glycine max
  Coding DNA Sequence Number=SeqID_79438
MTTQALESPTTMHRLHTRFRIARTLALGAVRGGTQGQISRAREFSELIQYEHPLKYADVTTPRTDETQYTYTKC

SEQ ID NO: 196217 - protein, 175 aa, Glycine max
  Coding DNA Sequence Number=SeqID_79439
  Gene Ontology: Mol. function=nucleic acid binding; Cellular component= proton-transporting two-sector ATPase complex; Biological process=DNA integration
  Homolog annotation: Hit_ID=Q1S0G7; Match level="QueryCoverage=80%, HitCoverage=64%, E-value=7e-45, Identity=56%"; Hit description =Polynucleotidyl transferase, Ribonuclease H fold
MAVKDILKYLRRGGRFVFGLWGYRVEIRRLHGILVFQSDVDDSKSNSGSSKQGTTADSTTEAEYIAASDASKEGSWIRKFIQELGVFPNASDPVRLYCDNNGAVAQAKEPRAHQKSKHVLRKYHVIREIIERGEVKLDRVTSEDNIADPFTKPLSGSVHEKHRESMGLRFMSSWL

SEQ ID NO: 196218 - protein, 316 aa, Glycine max
  Coding DNA Sequence Number=SeqID_79440
  Gene Ontology: Mol. function=nucleic acid binding; Cellular component= intracellular; Biological process=DNA integration
LYIDTVMKRFSMEESKKGFLPMSHGVRLSKSMCPQTRSEIEEMKRTPYASAIGSIMYGMLCTRPDIAYVVSVISRYQSNPGPAHWKAVKDILKYLRRTKDIFLVYGGAELKLQGFTDSSFQSDVDDSKSNSGFIFTLNGGAVCWKSSKQSTTADSTTEAEYIAASEAAKEGTWISKFIQELGVIPNASDPVTLYCDNTGAVAQAKEPRSHQKSKHILRKYHVIREIIDRGEVKVERVTSEENVADPFTKPLPRSVKWEIVGVVNGIVISACTSGCSPYDLDITVTSLEDQLYRDLSLSSTEDHPKGQCSCSPKSSG

SEQ ID NO: 196219 - protein, 353 aa, Glycine max
  Coding DNA Sequence Number=SeqID_79441
  Gene Ontology: Mol. function=nucleic acid binding; Cellular component= cytoplasm; Biological process=DNA integration
  Pfam annotation: Domain name=rve; Domain location=205-353; Score =135.4; E_value=1.6e-37; Accession=PF00665.16; Description=Integrase core domain
  Pfam annotation: Domain name=zf-CCHC; Domain location=114-131; Score =22.9; E_value=0.00017; Accession=PF00098.13; Description=Zinc knuckle
  Pfam module annotation: Pfam domain module=rve::zf-CCHC; Domain location=205-353::114-131
MITLLEKLLNLDVTLLAELSLDLILFSLPSSYESFIVNFNMNKLDPPLDELMNMLVSFESTIKKEKSVLIAATSGKKSSSQKKRKERVPFPNSKFEVGEGSGGPKEKVIKQVDDACHHCGKKGHWRRNCKAYLKQKSSEKAKRKELDQNPAQLWHARLGHDSLRRMNDFVSEGLFSLEDVKSLQTCESCLKGKMTKSPYKGKMERAEGLLDLIHTDVCGPLSVSAKGGYNYFATFTDDYSRYGYVYLMNYKSETFERFKDFRHEVEKQLGRSIKKLRSDRGGEYLSIEFIDYLKENGIQSQWTPPGTPQLNGVSERRNRTLLDMVRSMMGFTNLPAYLWGHALRTAAYLLNRG

SEQ ID NO: 196220 - protein, 44 aa, Glycine max
  Coding DNA Sequence Number=SeqID_79442
MGSRSRRPPEHAIEDSRGPHKDVEEAPLRGRGEERDPRRHVWLV

SEQ ID NO: 196221 - protein, 98 aa, Glycine max
  Coding DNA Sequence Number=SeqID_79443
  Subcellular localization annotation: CTP_CleavageSite=44; ConfidenceScore=5.03e-01
MNLLPSVVHASSTIESGAPRIDCLALFAYPPPSNLIRRPMNRLQSAVRQSSTLKSYPEPYELIFIHASSTNESEASRIDCLALFAYPPHSNLIRSPMN

SEQ ID NO: 196222 - protein, 140 aa, Glycine max
  Coding DNA Sequence Number=SeqID_79444
MVHLLWISSSGGYIHLVFFKENKGGYIPCGSLACKGFYKVERNLKNRWLLGDWIKLLAYEHKLTQQFYAEEIEWERKGIALKVNSSKEEYKDSSSSKEDAENFNLMLMDDPLSYPNFVWGPLFGGMQLSFDHFEVLGTHR

SEQ ID NO: 196223 - protein, 116 aa, Glycine max
  Coding DNA Sequence Number=SeqID_79445
MGGNLGLLPERLLQQRNNLIIQDGGLMRTTQCNVTRHVTREPQTAMVERLSSVSMIYIPSGRVKLMQAPLELIGLGSSSSMDSFAPWKMNGSGMENEEREETPLQGEDESRRSSPP

SEQ ID NO: 196224 - protein, 611 aa, Glycine max
  Coding DNA Sequence Number=SeqID_79446
  Subcellular localization annotation: CTP_CleavageSite=47; ConfidenceScore=5.25e-01
MAWACAASRRTSGGISRPRRRTRPFTAFREPILVIVIFPYFASGGVRRGSGGGDVRASPRTGLSSSTPVVASYEWVKLASPEDTCKLVVQACGSDDFPFWKAASGSPPSSFMYMCLFEVLGLILPLIAFPYALLEHLNVASSQLHPNIWDMMKLTNNIGWVYLNNVPKKLFELDSNVFHRFKDHFFKVLATGVVADGLPQMFNKDGEPRFSFYWYYRSDLQAGLCHRLLLLLLMENEVNLLVTSSAPSSILEKRKQNYGVGSSGRNKSKVFMSLRALRQAVGLAHSTGHPSIMEDVSLAPSTVEAPTTVVSAVPVQEATPATGVNVPATSAGSVVVPSSTITASLFSSCSVGVATASAHIVSPPPSSAPPFVVLAMASPSSSSCPHVSLDHLYTSSDTNSLWGCKLQVGAKDPNWLCVRLRQKFDSVSRGAECYKFCQCLSPEKFGDSGGERTTSLKDFAPGGVLRGGGCQMKEIKDLAGKVEGIVAKRDKLTKVVADLETQLKELPRKGRPKKSLWSSCSFTRRRPWSGGFQKVVRQARFFTKDLDLGLFDAFKDVKDGFLLDEEEITAKEEVVDEEQGSEEQDDDATVRLPFVYLLFFCMVGFLAIQAL

SEQ ID NO: 196225 - protein, 94 aa, Glycine max
  Coding DNA Sequence Number=SeqID_79447
MVTSKKIVKVRLSFVLYRNLKTSLEDSTPIKGFLLRPPVVVGGGEEAWDVGNGFGEEDEKGKTIFSKATRKIRLATFKCFLLSGKEASRTHQKS

SEQ ID NO: 196226 - protein, 111 aa, Glycine max
  Coding DNA Sequence Number=SeqID_79448
MTKLGLCLSSGPPPLDDKRVRITIRMTKLGLCLSSGPPPLDDKRVRITIRMTKLGLCLSSGPPPRDDKRVRITIKGQYDKDYGAADKSKALAPTYPPMRNSDLRSSGTCET

SEQ ID NO: 196227 - protein, 172 aa, Glycine max
  Coding DNA Sequence Number=SeqID_79449
MPSPVQPSHSPSSAEGEKHARKQLDREIRDMVSAITDRVTDFHKPGSTNHMENDGEHGLSMVTLVGNNNGATMKSEFDEKSGNPSHGDEPEALSTYVNSNFQAINNSVMLGGSYQTNDPGVHMDISDFSTEHEQHHRSHYQKEEKHGKKGKKIEKKASKSRHLSSSSSEDSD

SEQ ID NO: 196228 - protein, 118 aa, Glycine max
  Coding DNA Sequence Number=SeqID_79450
  Subcellular localization annotation: CTP_CleavageSite=58; ConfidenceScore=5.01e-01
MAEQAKQVFYVQDPCDERWQMTTPPRSPPFSPPPPIDATSHSPPTLKRTRKATGLRSLAATRPVGAERPLVHVDPTTGKADGPHRKKLRTYLGIIARDKVDVTYENWKQVPIAQKNLI

SEQ ID NO: 196229 - protein, 185 aa, Glycine max
  Coding DNA Sequence Number=SeqID_79451
MSKWELVADKDSVDDIVCEKYDINKEKWTQFCQSRRDPLWEDVQKKAQKLADERKKKQLEEAAQSRSTNTTIDPSSPIRRHVKWKMTRTKKTEQMTSEAAKEIANKIASHFQFLIAIIYDSLEDHASQGSFVAHGHQDVLTVAIGRQEHPGRVHAVGVGVTIKQYFGPAPRTSRTSSSMAPEDLE

SEQ ID NO: 196230 - protein, 129 aa, Glycine max
  Coding DNA Sequence Number=SeqID_79452
MTTLRVINIVNGEKATKGAHQIEEMMLLLHGQKKKKQQEGVKVVNDELPGGGGSSGFGGGCGFNGTVVVVDMVVGVMVADIVVVEVRQGFGKGRSQGAEDGVARQHAGHHETRRQENQWHILRKNPQSP

SEQ ID NO: 196231 - protein, 331 aa, Glycine max
  Coding DNA Sequence Number=SeqID_79453
  Subcellular localization annotation: CTP_CleavageSite=58; ConfidenceScore=5.13e-01
MVRSLRRKQQRKLRGLTTKSNSIPHRFLPFYFTTYLLLMNTQFNPYFASTKNCLLGLCGAMETLHPPSPPSHPKLETNIHVEITDFSGGACVDEGDDSLRDSPWPKPQSSITIIPTTTITETIESLDLPFASINNIHSGNHLYPSMCSVKKVIMDSACFFLEDATDSLDAGFRDALHVVAQHYHVSLDSSLSQTLASLPQPPYPPLSPLAPYPPPPWLYPLKPQPPPPPRLTQVCASLTMVFGCQGLSRVVRRSQLSLPLVAFSSFYHAATTSSLQFGEFHSWPAPIGTEVRVASASKSHSQAKKRHRDRINALRRRSPPNPLAFHDVDNP

SEQ ID NO: 196232 - protein, 63 aa, Glycine max
  Coding DNA Sequence Number=SeqID_79454
MPTYFSACRWLRTLVMVTQPEVFTIRQSFRIQDFLDLLTTLLITALATIAEHVLKVATNFYMT

SEQ ID NO: 196233 - protein, 141 aa, Glycine max
  Coding DNA Sequence Number=SeqID_79455
MSKFVGVFLLLLITVTVAEYDHSYPEHENEKNGPCGKFSTLRILTHKLRHCEKAARNAWAPVSSQCCNDLVESRNHHSPSLPFLQQAIDHNLPTYHKCQHIFQLVDGWERWLWLRNLRFLQFVKASGYSSMFAIWVLGLAA

SEQ ID NO: 196234 - protein, 49 aa, Glycine max
  Coding DNA Sequence Number=SeqID_79456
MPTYFSACRWLRTLVMVTQPEVFTIRQSFRIQECVLCIMLAIWVLGLAA

SEQ ID NO: 196235 - protein, 61 aa, Glycine max
  Coding DNA Sequence Number=SeqID_79457
  Homolog annotation: Hit_ID=A0FK53; Match level="QueryCoverage=79%, HitCoverage=17%, E-value=2e-20, Identity=100%"; Hit description =Guanylyl cyclase
MAEFPDIAKDTTKHKRISSKSLEEARKAFGTDEDLLLISLEKSSNHHQPFMQLSNDVNTDS

SEQ ID NO: 196236 - protein, 35 aa, Glycine max
  Coding DNA Sequence Number=SeqID_79458
TNKVPGDSTLGLPRALLLVTIWYTCQRVNKFFASL

SEQ ID NO: 196237 - protein, 168 aa, Glycine max
  Coding DNA Sequence Number=SeqID_79459
MIRGDTLRLSAPFCHPEAAGPMTSRDQIWSFCTLVSSRGGGPDDTRRYLAVIRTLLSSRGGGSDDKQRPKAAGPMIRGDTLRLSAPFCHPEAAGPMTSRDQVWSFCTLVSSRGGGPDDTRKYPSDRMLDSMQRLTQSSAPFVPPGTTSQLHAEISWSPATLVNREERN

SEQ ID NO: 196238 - protein, 123 aa, Glycine max
  Coding DNA Sequence Number=SeqID_79460
  Gene Ontology: Mol. function=protein serine/threonine kinase activity; Biological process=protein amino acid phosphorylation
  Homolog annotation: Hit_ID=Q10RH3; Match level="QueryCoverage=38%, HitCoverage=12%, E-value=5e-14, Identity=75%"; Hit description =Protein kinase APK1B, chloroplast, putative, expressed
  Subcellular localization annotation: CTP_CleavageSite=35; ConfidenceScore=5.37e-01
MRKLVFQDSMTSQLQFSPTKSSAQQSIQIYQQNVSSSARTSIKSYLSICKITSTKSNKETDDNYNAKLSAFGLAKDGPVGDKSHVSTRVMGTYGYPAPDHMATEFGPRGSMLQGSFLVTSVTG

SEQ ID NO: 196239 - protein, 70 aa, Glycine max
  Coding DNA Sequence Number=SeqID_79461
MECTIILLENMFGDISNSVASPTSVDPTADSNSNSSSPINVDSSPTIEPAAPIFEVGSTSVQANSPQPLD

SEQ ID NO: 196240 - protein, 76 aa, Glycine max
  Coding DNA Sequence Number=SeqID_79462
MEALTVKLSEKDPREISEAVPIGDVAGGRYYNGLDHFSWKNMTLNYGLKSHGSNIRLRSVPKGTNSWVQILLTFQS

SEQ ID NO: 196241 - protein, 188 aa, Glycine max
  Coding DNA Sequence Number=SeqID_79463
MAKRWEDFKKIMKDDQENLLKQFDLFENSAIHVATRSNSPRLLRELIEMLPKEERWQALCKENREGNTVLHEVVFCKKKKMADVVFEIEDELLLQQQSSSLEEKRTLLDMRNHRGETPLFMAAMHGKLKMLKHMANRTGTRNMEDFRKHLHRSDKYSALHASVMGQHFAYQRKEIQIILRFGRKINKI

SEQ ID NO: 196242 - protein, 59 aa, Glycine max
  Coding DNA Sequence Number=SeqID_79464
MKDHIRISRCCLCTDNHLGISACHLTHGSGSTDAVRPKKSRPEDADISGKGADDHIGLR

SEQ ID NO: 196243 - protein, 79 aa, Glycine max
  Coding DNA Sequence Number=SeqID_79465
MAISFPIDDHFNGDLMLFWTHIILGFNFQVYWLQFGRYFARGPVNEMACIIVFDYVTLNPKIALQERDDYALELAMADE

SEQ ID NO: 196244 - protein, 50 aa, Glycine max
  Coding DNA Sequence Number=SeqID_79466
MGWSSRFDVCVCGSCEGGVKGGEGWFCCSKEAVVVVVDMRVVETMVVVEE

SEQ ID NO: 196245 - protein, 56 aa, Glycine max
  Coding DNA Sequence Number=SeqID_79467
MPTSSVRGGGFEIQKLGFGDDGSGDSFRWVSWPLRTKEWGEEIGGGLVTQGGFLCR

SEQ ID NO: 196246 - protein, 155 aa, Glycine max
  Coding DNA Sequence Number=SeqID_79468
MGMEEEEWGWRRREEMALERGFPLYEMLKLWPRDLALSATYVLSEYDGDHALSMSFALNVPSIIKHKPPRRDILIVWHCHVHDCGHHGHIVEPHCNDKGADATVDVEVEYMWKRNFEASSWNMFWSKPEPGGGDDFVGDGEEEDEWWNKGIGGTT

SEQ ID NO: 196247 - protein, 170 aa, Glycine max
  Coding DNA Sequence Number=SeqID_79469
  Gene Ontology: Mol. function=phosphoprotein phosphatase activity; Cellular component=nucleus; Biological process=multicellular organismal development
  Homolog annotation: Hit_ID=Q8LAU3; Match level="QueryCoverage=66%, HitCoverage=36%, E-value=1e-40, Identity=65%"; Hit description =Similar to eyes absent protein
MATASGMPEQETQVFSGNNDQYPRLDVYVWDMDETLVLLNSLLKSSYAEAFNGLKDVQKGVEIGRTWENLILQICDDYFFYEQIENYNKPFLDALAQYDDGRDLSDYDFNQDELGSPHEDDANNRKLAYRHRVIAQKYLQYIPLYFQFFMVEWFSYEAMALFWFMDLVYK

SEQ ID NO: 196248 - protein, 113 aa, Glycine max
  Coding DNA Sequence Number=SeqID_79470
MGYRPLTKDKECDSPVTVVVGKENRVFLVDPFILQENPFRVLMDTSMRKQLEEDQEDNNKDHHHNNLHQPSKVVFVDVDAILFEHMLWLMHNDCSSLFELNLKEIIDFYAQDI

SEQ ID NO: 196249 - protein, 58 aa, Glycine max
  Coding DNA Sequence Number=SeqID_79471
  Homolog annotation: Hit_ID=Q9AYM0; Match level="QueryCoverage=64%, HitCoverage=9%, E-value=6e-11, Identity=86%"; Hit description =Putative AT-Hook DNA-binding protein
MAFSQQGPRTVCILSAIGAIGNVTLRQPAMSGGIATYELCLCCIGNDLGLISVMIIYE

SEQ ID NO: 196250 - protein, 181 aa, Glycine max
  Coding DNA Sequence Number=SeqID_79472
  Gene Ontology: Mol. function=protein binding; Cellular component =clathrin vesicle coat; Biological process=intracellular protein transport
  Homolog annotation: Hit_ID=Q6ZGX8; Match level="QueryCoverage=96%, HitCoverage=40%, E-value=5e-66, Identity=72%"; Hit description =Putative Clathrin coat assembly protein AP50
MPVAASAIYFLNLRGDVLINRLYRDDVGGNMVDAFRTHVMQTKELGTCPVRQIGGCSFFYMRISNVYIVIVVSNNANVACAFKFVVEAVALFRSYFGGVFDEDAIRNNFVLIYELLDGVLHCEEIMDFGYPQNLSPEILKLYITQEGVRSPFSSKPTLLLLLASGYHEERVQIGENMEMMT

SEQ ID NO: 196251 - protein, 147 aa, Glycine max
  Coding DNA Sequence Number=SeqID_79473
MQNYYVPLLEHRMLYSNCFNQPSLLLMMQLCITTGSGTYHVKGCGMEKLKDLIKQVAPIGVPPNGIHGSQLIRRLFFRQPGHSKYSKNLIEYEITELKKDENVLKVLAQSNYWKRFCTIEILVIFSKPVIQIEEEDMYSAPHILDPH

SEQ ID NO: 196252 - protein, 137 aa, Glycine max
  Coding DNA Sequence Number=SeqID_79474
MAAQLIRDRVEMECLEGAWETLEGNTRCRFRGTIRFTATSLLHPDEPARTLQRTVEWILPTPTPYRLVEPVQVIERVMRIHFLRWILPRKSCRHLRQTLRRIAARGRWRSAEALHPSGQLFGFVLYILRVGVSRTNC

SEQ ID NO: 196253 - protein, 84 aa, Glycine max
  Coding DNA Sequence Number=SeqID_79475
  Gene Ontology: Mol. function=cysteine-type endopeptidase activity; Cellular component=endoplasmic reticulum; Biological process =proteolysis
  Homolog annotation: Hit_ID=Q108P0; Match level="QueryCoverage=84%, HitCoverage=40%, E-value=2e-23, Identity=69%"; Hit description =Papain family cysteine protease
MEGSCWALSAPAAIQGIHQITTSKLMFLSKQKLVDSVKGESEGCIGGYVEDAFEFIVKKGGILSETHYPYKGVNIVRLRRKLIV

SEQ ID NO: 196254 - protein, 104 aa, Glycine max
  Coding DNA Sequence Number=SeqID_79476
GLARRPALFFWRGGASAAQEPVSEEPPAPALAPAEDEDELTPPEPSYFDAGTHMVQEEETTPDQTPQPSPVPAPVAKPKQLIQDSLVAPAVDLNEDQPQEEQDV

SEQ ID NO: 196255 - protein, 76 aa, Glycine max
  Coding DNA Sequence Number=SeqID_79477
PLQLLHLDLFGPTRTTSTTGKRGPITRLMARRLQEDWSRDAGKGPRVLMSLKEHLEGLGGPMARATTKKAKEALQQ

SEQ ID NO: 196256 - protein, 137 aa, Glycine max
  Coding DNA Sequence Number=SeqID_79478
MGVVGILRKCLEAKARILAGRGEWAPFIDILALLSFGGSSSFQMWDGLVDLAAIDAFLAYHDHKENSVVTMLADLYDTFDRRCEKSSTRIVCCTPALYRKEAQIGTNSYQTKKKRLSTGSLNGKKEEPEFLSRAEDF

SEQ ID NO: 196257 - protein, 257 aa, Glycine max
  Coding DNA Sequence Number=SeqID_79479
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=1e-42, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=33; ConfidenceScore=5.27e-01
MSQSLAFSKGWTFGGLHALAFRGLHTLTFRGPLALTFRGLHVLVIRGLQVLAFRGLHVLTFRRLHALAVIGLHAHTFRGLHVLPFRELHVLAFKGLHVLTFRELHVLAFRGLHVLAFRGLHVLRFRGLHVLAFRGLHALTFRGLHVLAFRGLHILAFRGLHVPAFRGLHVLTFRGLHVLPFRGLHVPAFKGLHVFPFRGLHVLAFRGLHVLAFRGLHVLAFRGLHVLAFRGLHALAFRGLHVLAFVGLHALTFRGLR

SEQ ID NO: 196258 - protein, 43 aa, Glycine max
  Coding DNA Sequence Number=SeqID_79480
MRWQLAAGTGPATRVVHRAAVFPSQAEKTSKESLSMALPGNPS

SEQ ID NO: 196259 - protein, 78 aa, Glycine max
  Coding DNA Sequence Number=SeqID_79481
MAAPTPPPRKSTDFSAIATHGDPTLLATAHHPPPNAVGREKSTQGHNSNPHLGYNRVAYPYGLLPNYMPPVMHDDAGH

SEQ ID NO: 196260 - protein, 188 aa, Glycine max
  Coding DNA Sequence Number=SeqID_79482
MATSKVLGAAFIVLLIVDLAFAARVTDRLLGGRGGGGGGGGGGGGGGGGGSLGRGSGYGSGYGSGGGEGYGGGSLGGSGGGGGGGRGGGGGGGGGTGGSGYGSGYGSGYGSGYGSGGGANGGGGGGGGGKGGGGGGGGGSNGSVVAGGGGGGGGGGGGGGSGGSGYGKWLRIWGPGWGGGENNESPLN

SEQ ID NO: 196261 - protein, 148 aa, Glycine max
  Coding DNA Sequence Number=SeqID_79483
MIFIEIKQQYATLDVSIKTTVESVYFSGYQGVPYTYVLPSVAPPAYNAVNYRPNGAAGGKLQNSKLYILFLEIEIPKIALLPPKQSNRKVESQGLILRLQSCAVVQFAVKPWDLISITTKAPMLCFMAKNASENRATEKNGDIHKFVF

SEQ ID NO: 196262 - protein, 91 aa, Glycine max
  Coding DNA Sequence Number=SeqID_79484
MKYEVGKELLRRGGVWTVGGTVRGLCEAEVVDVIVVMCGSLDLDRGGVAHDIDEEEPITNGIRDNNNSPCPYFLAFEADCPTYCNLHSSLK

SEQ ID NO: 196263 - protein, 48 aa, Glycine max
  Coding DNA Sequence Number=SeqID_79485
MAGHDWSCIVCLLLTGIRPMLYSEAMGHATLPSFSCNLCPNVRPPSAR

SEQ ID NO: 196264 - protein, 113 aa, Glycine max
  Coding DNA Sequence Number=SeqID_79486
  Gene Ontology: Mol. function=microtubule motor activity; Cellular component=microtubule associated complex; Biological process =microtubule-based movement
  Homolog annotation: Hit_ID=Q0WN69; Match level="QueryCoverage=76%, HitCoverage=14%, E-value=9e-09, Identity=37%"; Hit description =Kinesin-related protein
GEKIKEKVNNVDENEVVRLIKEQEDKNLEISALKVELETTKRTYEVQFSQMEEEANSFKAALTRKVREYEHQLEELRNELEEDAKDAKVELTQKAQEYENQLEALGNKFAAQG

SEQ ID NO: 196265 - protein, 84 aa, Glycine max
  Coding DNA Sequence Number=SeqID_79487
LEDFVKAIYIFDIGQNDIVAVINRVGQEDSHAVISDIVDYFENQLQVKTPHQFLGLPQGAWFQDGGFEIAVLDLGLQTSKNSTP

SEQ ID NO: 196266 - protein, 112 aa, Glycine max
  Coding DNA Sequence Number=SeqID_79488
MGLNQAHVFKERFIKSRSSMEVTSLQKLGKECALRCPYQTCARAKVMSEIEEVQEQMKADMEAMKDQMAAMLSMKKIMESNAAAVATTSAPIEEDPTHPSGLNKVNPPVSDM

SEQ ID NO: 196267 - protein, 75 aa, Glycine max
  Coding DNA Sequence Number=SeqID_79489
MTLQILAGKINSLIRKTCRTIERSCHACRSGKCPYAPFHLLIPPSFANHCRVDGSSADAISTPVLTPTPAVVPSL

SEQ ID NO: 196268 - protein, 123 aa, Glycine max
  Coding DNA Sequence Number=SeqID_79490
  Homolog annotation: Hit_ID=Q1SB98; Match level="QueryCoverage=36%, HitCoverage=8%, E-value=9e-07, Identity=51%"; Hit description=Zinc finger, CCHC-type; Peptidase aspartic, catalytic
MGWDRFLIVASEEGLVEAKIFKVQREGSDTLLDEEFEHIEPSCDLMLGGGVGEICCHGTLYALRDLMSSAGVGSLFMRKKNVSQCSLTNAPECDAKEGVGGLWKGVHWEWAEAWCRVHSYGDL

SEQ ID NO: 196269 - protein, 235 aa, Glycine max
  Coding DNA Sequence Number=SeqID_79491
  Homolog annotation: Hit_ID=Q8LRM1; Match level="QueryCoverage=28%, HitCoverage=16%, E-value=3e-15, Identity=58%"; Hit description=Nam -like protein 4
MSSAEVEFQAMVHRICEDTQSFNKAPFDVNKLPIETQNLLAVCKRESMAEYPSPEKDDNNCKHMDDYPSPQTDNPKPFSQIYKRRRHNLNSNNSHVSGDSIRTSQDPCSSTITTAATALPTTNAAAGTATNTAPKKHFLSALVEFSLLESLESKDSLASIKTPDFDVENLESSMPPSCAKFIKEMKSEMQKLSVEKETMRFEMMSTQAMINILQSRVDVLSKENEDLKRMVAQNP

SEQ ID NO: 196270 - protein, 72 aa, Glycine max
  Coding DNA Sequence Number=SeqID_79492
MPLILGNSGSGSTSQVRKWNMNSTRWEDTKNEVTLSKKGNRNEEKEGILKQAQPNSGAKCASGAKRATKCRR

SEQ ID NO: 196271 - protein, 40 aa, Glycine max
  Coding DNA Sequence Number=SeqID_79493
MAEAQSISSLMASSCKLQKEGSESCAGWVVFWEDFWEACE

SEQ ID NO: 196272 - protein, 90 aa, Glycine max
  Coding DNA Sequence Number=SeqID_79494
MKEFEEEGGVNPIIIGYGGHHALIVNLQAKFDNVFSFSIVISSIVGREYQSQFSTTIIESSLTTTLIFALFTSSGGEGGRDYLWPLDLIL

SEQ ID NO: 196273 - protein, 125 aa, Glycine max
  Coding DNA Sequence Number=SeqID_79495
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=fatty acid biosynthetic process
  Homolog annotation: Hit_ID=Q1SBJ5; Match level="QueryCoverage=99%, HitCoverage=43%, E-value=8e-26, Identity=81%"; Hit description=Fatty acid desaturase, putative
MSVKSFPQQILGRRVTEIPGLESSSPKGLKSPKIGLNKCQTPIRQIVLLAKVNHQRCWMEQTAKLAKTNMTLSPQFGRDEINRGNQIQNTRIPIMLKALSGTFLLENNSNKVWRYKLTLAKHKTG

SEQ ID NO: 196274 - protein, 357 aa, Glycine max
  Coding DNA Sequence Number=SeqID_79496
MASVLALQCYVKLENPKDSCKMVVQACTKIGRVSLNSMSKKLFEFDSNVFPRFKDRFFKVLAIDAMVDGLPLMFNRDREPYFPFYWQSDLTKFKSLDEDLLTLVEKIDKVILELLPSFLEVRAIFISFLGIMGNLSWRPLVKQVGPVSGILPPSVVAPTAREERQTTSKVDPVSVVAKVTPNALTSILEKRKQDDSARPFGHKKSRSPMSLSVLRQVAGLTPGLGCLLSLQDLPLAPSGVEASGPTIVVAATLAPPPLLVVLVQEVTPIAGVDALVTSTDSIAASTSTIATPLLSAYVVTTSASMMLPLSSSTPPIPSFVVLATMLPSSSSRPHVSLDHLYTSNDANSLWGSNYKPE

SEQ ID NO: 196275 - protein, 141 aa, Glycine max
  Coding DNA Sequence Number=SeqID_79497
MMVNGRPCIPCILVEMELSKGRAHQGDTYKRHGALEYMALMKWHILNTRCRAIAYMARMKWPVLETWCSCIHGTYEVALQKTWCCALAYMTLMKWHILEAWCPALAYMALIKWHILEAWCHTLAYISLAVGGTYWRHDDVL

SEQ ID NO: 196276 - protein, 133 aa, Glycine max
  Coding DNA Sequence Number=SeqID_79498
  Subcellular localization annotation: CTP_CleavageSite=40; ConfidenceScore=5.14e-01
MVITWELLCAPSIIAGAPSEVAKLPFSNSSFGRIPTNYFRKNVIQNVSGRTFFRKFPEKASSGISIGGPVKYLKIWWSRVPYLKFCIAGGRSEMTTSGRPSSGSNLGLFRKKCFRKTDLPEVTKTHSGRSASG

SEQ ID NO: 196277 - protein, 488 aa, Glycine max
  Coding DNA Sequence Number=SeqID_79499
  Gene Ontology: Mol. function=RNA-directed DNA polymerase activity; Cellular component=intracellular; Biological process=RNA-dependent DNA replication
MERLSLTQGNSLIDVTLRHGAFNSHGVTVETRGYMDLMITSGHGQLSRSFLITYLLVDANTSYFALISRKTLNELGAIVSTLHLKMKFPTLTGEIVTIKVAPYPPTRDPAKPHPTAAEGTQVMSVDEPIKELVKLQLRPKPKRCMQLSKDLTSHEHRHIADVLHRKKPGIHPIIICHKLPICPQAKPVSQKKMKIREERRKAVREEVDKLLNVNFIREVKYFTWLANVIVKKEKKNGELLCFLDAYSEYNQIRTHTPKKEKMKLITEDVNFCYKVYVDDMVVKSQSIAQHIAYLEEVFGEFYKYNMCLNPEKCTFRVGGGKFFGFMITHRGIEANPNKCIAILEMHSPINVQEVQKLNERLASLSKFLPKLAEKVKSFYKLLKKTGPFLWDETYKQAFLAFKKTIATPSEEKHQLPIYFTNRILHDTEKPYQMIEKVLLKPELVGRMVAGFVKLSEFDIQYEPRGLMKTQFMAEFLAKFVGNNQTTLD

SEQ ID NO: 196278 - protein, 108 aa, Glycine max
  Coding DNA Sequence Number=SeqID_79500
MDKCCLMLRAIILTSVDMLSVLQARYNMSGILILIMYSFLSDFAIGIGGIDSGGSIQQLLMDWEVISIGGSSSEDTRCGASDNESSSSERLRASRRTSGGTSCLYGRA

SEQ ID NO: 196279 - protein, 185 aa, Glycine max
  Coding DNA Sequence Number=SeqID_79501
  Gene Ontology: Mol. function=serine carboxypeptidase activity; Biological process=proteolysis
  Homolog annotation: Hit_ID=Q1S459; Match level="QueryCoverage=76%, HitCoverage=27%, E-value=2e-26, Identity=49%"; Hit description =Peptidase S10, serine carboxypeptidase
MGPPSCGSRHQFKLMICAIGVQEQEQVDKKAIDGLNVYNILEPCYHFLDAAIAKENGTLPKSFKQLGVTERPLLVRKRMFGRAWPFRAPVKPGFVTLWPQLAQMRHVTCVDTFFVVQVEGTSTWVVINKNKRGYISCGSVQVEGTSTWLFKENKGGYIPCGFVLVKDFTRLKRNLKDRRSLGDWM

SEQ ID NO: 196280 - protein, 414 aa, Glycine max
  Coding DNA Sequence Number=SeqID_79502
  Gene Ontology: Mol. function=acyl-CoA binding; Cellular component =intracellular; Biological process=lipid transport
  Homolog annotation: Hit_ID=Q6K9X9; Match level="QueryCoverage=96%, HitCoverage=74%, E-value=1e-102, Identity=47%"; Hit description=Acyl- CoA binding protein-like
  Pfam annotation: Domain name=Kelch_1; Domain location=140-185; Score =4.3; E_value=1.3; Accession=PF01344.15; Description=Kelch motif
  Pfam annotation: Domain name=Kelch_1; Domain location=38-84; Score =28.8; E_value=1.9e-05; Accession=PF01344.15; Description=Kelch motif
  Pfam annotation: Domain name=Kelch_1; Domain location=89-135; Score =11.3; E_value=0.2; Accession=PF01344.15; Description=Kelch motif
  Pfam annotation: Domain name=Kelch_2; Domain location=140-185; Score =7.7; E_value=3.7; Accession=PF07646.5; Description=Kelch motif
  Pfam annotation: Domain name=Kelch_2; Domain location=38-84; Score =28.4; E_value=2.5e-05; Accession=PF07646.5; Description=Kelch motif
  Pfam annotation: Domain name=Kelch_2; Domain location=89-135; Score =20.8; E_value=0.0048; Accession=PF07646.5; Description=Kelch motif
  Pfam annotation: Domain name=M; Domain location=293-313; Score=4.8; E_ value=29; Accession=PF02370.7; Description=M protein repeat
  Pfam annotation: Domain name=M; Domain location=314-334; Score=5.3; E_ value=25; Accession=PF02370.7; Description=M protein repeat
  Pfam annotation: Domain name=M; Domain location=370-390; Score=7.9; E_ value=11; Accession=PF02370.7; Description=M protein repeat
  Pfam module annotation: Pfam domain module=Kelch_1::Kelch_1::Kelch _1::Kelch_2::Kelch_2::Kelch_2::M::M::M; Domain location=140-185::38 -84::89-135::140-185::38-84::89-135::293-313::314-334::370-390
MVTLRKLTIFIELLAVRYIDIETCQFGVIKTSGDVPVARVGQSATMVGSRVILFGGEDMSRKLLNDVHVLDLESMTWEMIKTTQTPPSPRYDHSAAIQGERYLLIFGGCSHSIFFNDLHLLDMQTMEWSQPQTQGDLVSPRAGHAGITIDESWFIVGGGDNRSGCPETLVLDMPKLVWSVLTVVKQKDSLSSEGLSVCSAKIDGEKYLLAFGGYNGRYSNEVFVMRPKAKDTMRPKIFQSPAAAAAAASVTSAYALSKSEKLDFIQLDDINSKLSANGHPKDDVTDKVEAIKEEKRLLELSIAEVRAENSKLGGEIEEINNTHAELTKELQSVQAQLVAERSRCFNLEAEYINSNVPFQAKIAELQKLLESMQSVEDEVQALREKKSALDQEMELAATAERKSSGWRWFGGSET

SEQ ID NO: 196281 - protein, 45 aa, Glycine max
  Coding DNA Sequence Number=SeqID_79503
MGKGVEPVARERCKISKHRRQLRRRRSDGGGSKATVEISMDTSSS

SEQ ID NO: 196282 - protein, 330 aa, Glycine max
  Coding DNA Sequence Number=SeqID_79504
  Gene Ontology: Mol. function=peroxidase activity; Cellular component =vacuole; Biological process=response to oxidative stress
  Homolog annotation: Hit_ID=Q1SAT8; Match level="QueryCoverage=91%, HitCoverage=91%, E-value=6e-97, Identity=55%"; Hit description=Haem peroxidase, plant/fungal/bacterial
  Pfam annotation: Domain name=peroxidase; Domain location=40-290; Score=372.0; E_value=9.5e-109; Accession=PF00141.13; Description =Peroxidase
  Subcellular localization annotation: CTP_CleavageSite=51; ConfidenceScore=5.07e-01
MAFPFPILFLLFLSLTPSFSSATLNVDYYKKSCPLFEKIVMENVFHKQSTSVATAPGLLRLFFHDCITDGCDASILITSNSYNPHAERDADLNLSLAGDAFDIIFRIKNALELACPGVVSCSDIVAQATRDLVKMVGGPYYPVRLGRKDSTESVAARVSASLPTPDMTMDQLLEKFTSKGFTVKEMVALSGAHTIGFAHCKEFINRIYNFSKTSDADPLMHPKLVKGLRVVCQNFTKDISMAAFNDVRSPGKFDNVYYQNVMKGLGLLTSDSILAVDPRTKPIVELYANDQQAFFKDFAAAMEKLSVFRVKTGNKGEVRNRCDQFNHIPV

SEQ ID NO: 196283 - protein, 117 aa, Glycine max
  Coding DNA Sequence Number=SeqID_79505
  Gene Ontology: Mol. function=nucleic acid binding
  Homolog annotation: Hit_ID=Q9LKA4; Match level="QueryCoverage=69%, HitCoverage=20%, E-value=5e-16, Identity=54%"; Hit description =Similarity to RNA-binding protein
MCLLGSQRMRSAPFDFDKGILEVIEDGEERAEAIGGGLPAKATDEELALGDVVVRDGTHNSKDVEVAHHRILKDVEELVGSEALDELVGFEGGELENEKASIKGKLKHNIKIQHRFL

SEQ ID NO: 196284 - protein, 111 aa, Glycine max
  Coding DNA Sequence Number=SeqID_79506
  Gene Ontology: Mol. function=nucleic acid binding; Biological process= metabolic process
  Homolog annotation: Hit_ID=Q2HTC3; Match level="QueryCoverage=51%, HitCoverage=33%, E-value=6e-08, Identity=51%"; Hit description=RNA -binding region RNP-1
MTVTQLAAVENSTSNANHARVFTAPKCSPIAYYAVMAAANAIFYLFEIGESRGGAYVTMESINSARKAIVALDASDVGGRQVQVRFFVEMNPKRRNLETMNSSPRSVGPKT

SEQ ID NO: 196285 - protein, 295 aa, Glycine max
  Coding DNA Sequence Number=SeqID_79507
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=99%, HitCoverage=99%, E-value=1e-143, Identity=82%"; Hit description =Class III chitinase
  Pfam annotation: Domain name=Glyco_hydro_18; Domain location=26-282; Score=190.2; E_value=4.8e-54; Accession=PF00704.18; Description =Glycosyl hydrolases family 18
MALKSAISVSFFCLVLSALANGFNAGKIAIYWGQNGNEGTLSEACATGNYDYVIIAFLPTFGNGQTPMINLAGHCDPYSKGCTGLSSDIESCQAKGIKVLLSLGGGAGSYSIASTQDASQVAIYLWNNFLGGKSSSRPLGPAILDGIDFDIEGGSNQHWGDLAKFLKGYGKQVYITAAPQCPFPDAWIGNALTTGLFDFVWVQFYNNPPCQYTSGAISNLEDAWKQWISGIPANKIFLGLPASPQAAGSGFIPSADLISNVLPAIKGSSKYGGVMLWSRYYDVQSGYSSSIRSHV

SEQ ID NO: 196286 - protein, 57 aa, Glycine max
  Coding DNA Sequence Number=SeqID_79508
RGADGLIYCGGEHGVVDDLVELLHAEIVEENTMLYEEVVHDGIVNVAHSDGGFVVDL

SEQ ID NO: 196287 - protein, 732 aa, Glycine max
  Coding DNA Sequence Number=SeqID_79509
  Gene Ontology: Mol. function=protein binding; Cellular component =nucleus; Biological process=cell cycle
  Homolog annotation: Hit_ID=Q1SBK0; Match level="QueryCoverage=98%, HitCoverage=98%, E-value=0.0, Identity=91%"; Hit description=Cullin family
  Pfam annotation: Domain name=Cullin; Domain location=29-631; Score =905.1; E_value=3e-269; Accession=PF00888.12; Description=Cullin family
MSNQKKRNFQIEAFKHRVLMDPKYADKTWEILKHAIHEIYNHNASGLSFEELYRNAYNMVLHKFGEKLYSGLVATMTGHLKDIAQSVEAAQGGSFLEELNRKWNDHNKALQMIRDILMYMDRTYIPSTQKTPVHELGLNLWKENVIYSSQIRTRLLNTLLELVHSERTGEVIDRGIMRNITKMLMDLGPSVYGQEFETHFLQVSAEFYRVESQKFIECCDCGDYLKKAERRLNEEMERVSHYLDSRTEKKITNVVEKEMIENHMLRLIHMENSGLVHMLCDDKYEDLSRMYNLFRRVTDGLSKIREVMTSHMRESGKQLVTDPERLKDPVEYVQRLLDEKDKYDKIINLAFVNDKSFQNALNSSFEYFINLNPRSPEFISLFVDDKLRKGLKGVSEDDVEVTLDKVMMLFRYLQEKDVFEKYYKQHLAKRLLSGKTVSDDAERSLIVKLKTECGYQFTSKLEGMFTDMKTSQDTMQGFYGCHPELSDGPTLTVQVLTTGSWPTQSSVTCNLPAEMSALCEKFRSFYLGTHTGRRLSWQTNMGTADLKATFGKGQKHELNVSTYQMCVLMLFNNADRLGYKEIEQATEIPASDLKRCLQSLALVKGRNVLRKEPMGKDIGDDDAFYVNDKFSSKLYKVKIGTVVAQKESEPEKQETRQRVEEDRKPQIEAAIVRILKSRKQLDHNNLIAEVTKQLQSRFLANPTEVKKRIESLIERDFLERDDSDRRLYRYLA

SEQ ID NO: 196288 - protein, 1726 aa, Glycine max
  Coding DNA Sequence Number=SeqID_79510
  Gene Ontology: Mol. function=DNA binding; Cellular component=nucleus
  Homolog annotation: Hit_ID=UPI0000E810AC; Match level="QueryCoverage =21%, HitCoverage=13%, E-value=1e-19, Identity=24%"; Hit description =PREDICTED: similar to silencing mediator of retinoic acid and thyroid hormone receptor alpha
  Pfam annotation: Domain name=Myb_DNA-binding; Domain location=1046 -1091; Score=40.7; E_value=5.2e-09; Accession=PF00249.21; Description= Myb-like DNA-binding domain
  Pfam annotation: Domain name=Myb_DNA-binding; Domain location=831 -876; Score=43.6; E_value=6.7e-10; Accession=PF00249.21; Description =Myb-like DNA-binding domain
  Pfam module annotation: Pfam domain module=Myb_DNA-binding::Myb_DNA -binding; Domain location=1046-1091::831-876
LELRGSPRLLAALLFGCRVFDLRAVGPCETASCVAAHAIGLVLMPPEPLPWDRKDFFKERKHERSESLGSVARWRDSSHHRDFNRWGSAEFRRPPEKSFPVVNDLVDSPLRVRYVFEGHGKQGGWHLFSEEPGHGYAISRSSSDKMLEDDSRPSISRGDGKYGRSSRENRGGPFGQRDWRGHSWEPNNGSMNFPRRLQDVNNDQRSVDDALAYSSHPHSDFGNAWDQHHLKDQHDKMGGVNMFGTGPRSDRDNSLGDWKPLKWTRSGSLSSRGSGFSHSSSSRSMGGADSHEVKAELLPKSVAANESHSGEAAACATSSVPSEDTTSRKKPRLGWGEGLAKYEKKKVEVPDASANKEGPVLSTSNTEPCNLLSPSLVDKSPKLLGFSECASPATPSSVACSSSPGMDDKLFGKTANVDNYASNLTGSPAPVSESHFARFSFNLEKFDIDSLNNLGSSIIELVQSDDPTSLDSGPMRSNSINKLLIWKADISKVLEMTESEIDLLENELKSLKSESGETCPCPCPVTLGSQMVGSDEKSCEEHVGVSDQVIRPVPLKIVDDPNTEKMPLSTNLHSIHENGKEEDIDSPGTATSKFVEPLPLIKAVSCDTRGHDNFSRDLDTVLSTAVKCLVPCTTRKEASVPACVDGNISMELKDSMDILYKTIISSNKESANRASEVFDKLWPKDCCKIEKMEASSDACTHTFIMEKFAERKQFARFKERVIALKFRALHHLWKEDMRLLVLKSELDGNDLNMLRGLVVKLAGNQLSLVSTSEIINFTSKLLSESQVKVQRNTLKMPALILDEKEKMISKFVSSNGLVEDPLAIEKERTMINPWTPEEREVFLEKFAAFGKDFRKIASFFDHKTTADCVEFYYKNHKSDCFEKIKKQDGDKLGKSYSAKTDLIASGKKWNRELNASSLDILSAASLMADGIAGNKKLRAGSSLLGGYGKVKTYRGEDFIEKSSSFDILGDERETAAAADVLAGICGSLSSEAMSSCITSSVDPVEGNRDRKFLKVNPLCKLPMTPDVTQDVDDETCSDESCGEMDPTDWTDDEKTAFLRAVSSFGKDFAKIARCVGTRSQEQCKVFFSKGRKCLGLDLMRPIPENVGSPVNDDANGGESDTDDACVVETGSVVETDKSGTKTDEDLHLYGTNTYHDESHPVEARNLSAELNESKEINWTEVDLEDANVTSGACQINIDSKQGCDGSEVFLCGSNKSGSVGERADIIMSDSTEVENDKANKLGGAATELISAPNTREPCQSNSIAEDRMVVSEVSSGGLGNELERHRVSSTLCVDDRDNKHEADSGVIVDMKSSVHDLSTMINSSISSLGNSCSGLSFSSENKHVPLGNPRVSALSMDNLHALLQNTVAVDVQCEKTASQDQMSSTCDIRGGRDMHCQNSISNGDHQHITGNLSDHVDAVSILQGYPLQVPVKKEMDSDMNCTSSATELPLLPQKIEHDDDHIKAFQSSDSDKTFRNGDVKLFGKILTNPSTTQKPNVGAKGSEENGTHHPKLSSKSSNPKITGHHSADGNLKILKFDHNDYVGLENVPMRSYGYWDGNRIQTGLSTLPDSAILLAKYPAAFSNYLTSSAKLEQPSLQTYSKNNERLLNGASTFTTRDINGSNALIDYQMFRRDGPKVQPFMVDVKHCQDVFSEMQRRNGFEAISSLQQQSRGMNGVGRPGILVGGSCSGVSDPVAAIKMHYSNSDKYGGQTGSIAREDESWGGKGD

SEQ ID NO: 196289 - protein, 71 aa, Glycine max
  Coding DNA Sequence Number=SeqID_79511
MNLDRKKNQGPMTSRKKFGIPWPECNDADCLRLIEIIFYRFLQLIEIIAPLPSTLRTAEEAKEITTMQQTA

SEQ ID NO: 196290 - protein, 338 aa, Glycine max
  Coding DNA Sequence Number=SeqID_79512
  Homolog annotation: Hit_ID=Q5XWK4; Match level="QueryCoverage=86%, HitCoverage=74%, E-value=1e-118, Identity=68%"; Hit description =Expressed protein-like
  Pfam annotation: Domain name=DUF616; Domain location=91-338; Score =385.6; E_value=7.6e-113; Accession=PF04765.4; Description=Protein of unknown function (DUF616)
MESKFSTIPHSIQEERNLQENIVVSDDGKTSKENIVVSDDGKTSKENIVVSDDGKMSKGKRRKHFPCEVGLLESVDGLVEPKNYTNFTWFSLEYVDREDRTSKIDLFEPRFGGHQTLEERETSFYAKNQTLHCGFVKGPPGHPSTGFDINEKDKAYMYRCKVAVSSCIFGSSDFLRRPTSRLMSQYSKDNVCFVMFLDDQTLSKLSSEGSSPDEKGYIGLWKIVVVKNLPYEDMRRTGKVPKFLSHRLFPNSRYSIWLDSKMRLNSDPMLIIEYFLWRRKAEYAISNHYDRHNVWEEVLQNKRLNKYNHTAIDEQFNFYQSDGLPKVDPSKPNDPLPS

SEQ ID NO: 196291 - protein, 119 aa, Glycine max
  Coding DNA Sequence Number=SeqID_79513
MANMGQGQKAHRAKRPTYKKSHKALWARAIPWAKNFNDGELKTQLQHRSRIHNLKDRATKRQAIKDPPEKGINADAAFPVANDGAPPGDSLLAVAVGSRCRRETCKKNFDDSNQKHQSC

SEQ ID NO: 196292 - protein, 356 aa, Glycine max
  Coding DNA Sequence Number=SeqID_79514
MEAFTLLKYWRGGGGALGHPPSSDTPSSDTATTTILTGVENENATESDDDNDNNDDDGPFFDLEFTVPDEDANENPNANHTQEEEDISLEESDGEREFKFTLSPSSNDRSDPNLSLQSPSEDIFFKGKLVHVDPNSEPNSKPQFTASLLKSATKFRVFMLGLKKPKPNDGSDSTPAAIPEAHKGKKHFTVKFKVEEVPIVSLFSSKGNKKQSSEDQPSEEKRFSKEVMQKYLKMVKPLYIRVSRRYGDKLSLNSAAPEGVSVGGGETNVMKTSTQSQKLPAGLSVVCKHLGKSRSASSAAVAAAPPAAFVSSKRRDDSLLQQQDGIQGAILHCKRSFNASRPECESSQLPRSVSHQ

SEQ ID NO: 196293 - protein, 204 aa, Glycine max
  Coding DNA Sequence Number=SeqID_79515
  Homolog annotation: Hit_ID=Q19QU4; Match level="QueryCoverage=62%, HitCoverage=53%, E-value=2e-08, Identity=30%"; Hit description=Plant cell wall protein SlTFR88
  Pfam annotation: Domain name=Hin1; Domain location=43-188; Score=7.9; E_value=0.00033; Accession=PF07320.4; Description=Harpin-induced protein 1 (Hin1)
MTTEEVITMFPSRKEEKQSSSKCLVYALVVLVAILFIWLVFASIVLRVVDPQIQLKSARLMHNTKNHSFSSTSSLNVTMIARVSLTNPNLFGRFYYGNSRVSVLYGASIVGAWELEGARLEGRETKEIDFMVHMRFSTKLLVIMRNLTNDTAHSDSAGMLKLRSYAKLSGTVHVLNMVNKKKTLGMACIMNLNLTSYSTQHFQC

SEQ ID NO: 196294 - protein, 140 aa, Glycine max
  Coding DNA Sequence Number=SeqID_79516
  Gene Ontology: Mol. function=binding
  Homolog annotation: Hit_ID=Q338F8; Match level="QueryCoverage=95%, HitCoverage=42%, E-value=1e-13, Identity=37%"; Hit description =Expressed protein
MATEMEELVSFLSSPSPQIRKAAVDIVRGLTGSVEGLQSLANYSNALLPALSRLLTLPKEVSEAAAEALVNLSQNSSLAEVMVRMGLVKTAMDVLYKPDCGIARLLVMLLVNLTQLEAGAASLLQKLEALSFSELKSRLT

SEQ ID NO: 196295 - protein, 177 aa, Glycine max
  Coding DNA Sequence Number=SeqID_79517
  Homolog annotation: Hit_ID=Q19QU4; Match level="QueryCoverage=97%, HitCoverage=85%, E-value=5e-12, Identity=23%"; Hit description=Plant cell wall protein SlTFR88
  Pfam annotation: Domain name=Hin1; Domain location=32-160; Score=8.7; E_value=0.00028; Accession=PF07320.4; Description=Harpin-induced protein 1 (Hin1)
MAKSIEQEGRSGKCFVYFLGAFVILCALVLVFASILRLKNPYLKLRSATFNQIRYSASPSPSFNATLIIFLALNNPTFGAFTYENNSLSVLYAGLKIAHSQINGGRVSFRQTKEIHVTVKFMSAIDITSGSLNLTTNVFFSGKVHLFKIINIRKTIEMPCSMNLNFTSHATQAIQCQ

SEQ ID NO: 196296 - protein, 210 aa, Glycine max
  Coding DNA Sequence Number=SeqID_79518
  Gene Ontology: Mol. function=binding
  Homolog annotation: Hit_ID=Q338F8; Match level="QueryCoverage=86%, HitCoverage=52%, E-value=3e-69, Identity=71%"; Hit description =Expressed protein
  Pfam annotation: Domain name=DUF383; Domain location=3-145; Score =113.7; E_value=5.3e-31; Accession=PF04063.4; Description=Domain of unknown function (DUF383)
  Pfam annotation: Domain name=DUF384; Domain location=146-203; Score =76.6; E_value=7.6e-20; Accession=PF04064.4; Description=Domain of unknown function (DUF384)
  Pfam module annotation: Pfam domain module=DUF383::DUF384; Domain location=3-145::146-203
MFSLWAEAPVLESSDSKISESVFLTDDAFEHVGSILVNISKQRKGRELLLDPKRGLLKQIIRQFDSNSSLRKKGVSGTIRNCCFEAENQLQNLLLVSEFLWPALLLPVAGNKIYSEQDRSKMPLELGTALSIERELVNDPEIRIQALEAIYLIILQEAGRRAFWSVNGPRIVQIGYEDEEDPKVMEAYEQLGSLLVHSSSAEEPSSQTTK

SEQ ID NO: 196297 - protein, 139 aa, Glycine max
  Coding DNA Sequence Number=SeqID_79519
  Homolog annotation: Hit_ID=Q0KIN0; Match level="QueryCoverage=90%, HitCoverage=7%, E-value=1e-22, Identity=39%"; Hit description =Integrase core domain containing protein
MTSAGPAFSFSGTPTITTVKLNWKNYLSWSASVELWFLGQGHHDHLEKGIDTVPSDRKSEWEKLDYQLCAVLWQSVETDVLEILRSFKTCSFWKKAREIFANDIQSLFDATMKVTALKQTSHDMIAHIGKARVAVEELK

SEQ ID NO: 196298 - protein, 96 aa, Glycine max
  Coding DNA Sequence Number=SeqID_79520
MTITTVMNVFITNIMIVITTTITIVIASMIVIATINIISIDGNGHGGDSDSNDNHDRDHVVGNNDGHDDNHDNNSSESIVIIIMMIVTIDYSGDRP

SEQ ID NO: 196299 - protein, 660 aa, Glycine max
  Coding DNA Sequence Number=SeqID_79521
  Gene Ontology: Mol. function=NAD(P)H oxidase activity; Cellular component=integral to membrane; Biological process=abscisic acid mediated signaling
  Homolog annotation: Hit_ID=Q9XEG2; Match level="QueryCoverage=90%, HitCoverage=60%, E-value=0.0, Identity=78%"; Hit description=NADPH oxidase
  Pfam annotation: Domain name=FAD_binding_6; Domain location=304-394; Score=-15.4; E_value=0.018; Accession=PF00970.14; Description =Oxidoreductase FAD-binding domain
  Pfam annotation: Domain name=FAD_binding_8; Domain location=302-418; Score=200.4; E_value=4.1e-57; Accession=PF08022.2; Description=FAD -binding domain
  Pfam annotation: Domain name=Ferric_reduct; Domain location=104-261; Score=159.1; E_value=1.2e-44; Accession=PF01794.9; Description =Ferric reductase like transmembrane component
  Pfam annotation: Domain name=NAD_binding_6; Domain location=424-611; Score=271.4; E_value=1.8e-78; Accession=PF08030.2; Description =Ferric reductase NAD binding domain
  Pfam module annotation: Pfam domain module=FAD_binding_6::FAD_binding_ 8::Ferric_reduct::NAD_binding_6; Domain location=304-394::302 -418::104-261::424-611
MVVVLPQLWQLETLLLQKDTYLNYSQALSYTSQALSQNLQGLRARSPIRRMSRRMLYYLQENWRRLWVLALWISAMIGLFTWKFIEYKRKNAYHIMGNCLLAAKGAAETLKFNMALILLPVCRNTITWLRSTKLAYVAPFDDNINFHKTIAAAVMIGVILHAGNHLACDFPRLVSSSEKDYKTYLDGVFGDHRPSYGDLVKGVEGVTGILMVILMAIAFTLATKWFRRNLIKLPKPFNRLTGFNAFWYSHHLFVIVYVLLIIHGVSLYLERRWHRQTTWMYLAVPILLYAGERTLRFFRSGFYTVRLIKVAIYPGNVLTLQISKPSQFRYKSGQYMFVQCPAVSPFEWHPFSITSAPDDDYLSVHIRQLGDWTQELKRVFSAACEPPVAGKSGLLRADETTKKCLPKLRIDGPYGAPAQDYRNYDVLLLVGLGIGATPFISILKDLLNNIIKMEELADSVSDSSRGSDLSTGSADSISSNKISPKRKKTLKTTNAYFYWVTREQGSFDWFKGVMNEVAELDQRGVIEMHNYLTSVYEEGDARSALITMVQALNHAKNGVDIVSGTRVRTHFARPNWKKVFSRICSKHCNGRIGVFYCGAPVLAKELSKLCFEFNEKEYEALYIPAGRQDGWALIIHVAAAQRRYCPYKAPATSDTFCRTA

SEQ ID NO: 196300 - protein, 75 aa, Glycine max
  Coding DNA Sequence Number=SeqID_79522
MASKDRKDFHCHRKPREGHKGNSLALAKLRFHTYLSFFVNWEHLPIINDQEDGFLVINPPSDNEATKKDPKKDPR

SEQ ID NO: 196301 - protein, 153 aa, Glycine max
  Coding DNA Sequence Number=SeqID_79523
MSSKILHEVQAHQPMSLMQAMAFSKLQEDKVNDQHCSSCAPSHVVSAPSPSTLLSLSTPPKAPFKDISPKEIAYCCDHGFCYYNDEKFHIDHHCKGRLLLLLSDDVEGIPDLTQIPLIDIPSFDPIAACRPWIFFINGVLCFLKINGSGMDRM

SEQ ID NO: 196302 - protein, 1049 aa, Glycine max
  Coding DNA Sequence Number=SeqID_79524
  Gene Ontology: Mol. function=zinc ion binding
  Homolog annotation: Hit_ID=O04238; Match level="QueryCoverage=74%, HitCoverage=94%, E-value=0.0, Identity=49%"; Hit description =Transcription factor
  Pfam annotation: Domain name=DUF567; Domain location=29-228; Score =168.1; E_value=2.2e-47; Accession=PF04525.3; Description=Protein of unknown function (DUF567)
  Pfam annotation: Domain name=zf-MIZ; Domain location=553-595; Score =24.3; E_value=7.3e-07; Accession=PF02891.10; Description=MIZ zinc finger
  Pfam module annotation: Pfam domain module=DUF567::zf-MIZ; Domain location=29-228::553-595
MRVFPRLKSLSRAVHEEQEREHDDEEKKKAAEKLYTSLTVWRKSLLMSCNGFTVIDSYGNLVYRVDNYIGRPNEVTLMDASGKSILTMCRRRRLGLLDSWFVYEGEVGNNINNMRTRTRRRSSNLSKSSKTPICCVRKHVNILHGNTNVQAYVYRGASSHSDKRCAAFTIEGSYAHRTCKVLDECGRVVAEIKRKEANAKSVSFGIEIFQLIVHPGFDPAFAMALVYNEAKLKPSLVLAKKTTTDGSLVRVRVQMNNSSPALTLPSDTSPSVVNMFRINKVADRLAWIAQPGNRGEPHEFYNLCLSLSRGIDYALANGETPPKAHDLPLLVKQNACEIGWFQTKESEELVSIADEIGKVYSSLGTINVRPRSCSTVISTIMQKFYPKFKLGPILASIEAQPGYGASAVDFHITKSEVLKDKIAPEHQPPLAPLSVPMSLHMVGQDHPASIAPLNPNDLPILHQTFLLNGKGVLNRTNVQMDPGAQVPTNVTGMLKFGTNLLQAVGQFNGRYVVLVAYMSVTPLLEDPVLQDYLQPAVTSVDLDSDIIEGASRISLNCPISFTRIKTPVKGHSCKHFQVTIPALASLNVQQIVAATYAFLSLILKNVGENITEVIVFANGSWKAVLEKDHDVDKMQKKAPNCEKEQTQPQESTCPPSTVDLTKDDDGLDTVGSCDIVERKPPPASIHSHFVSPNLTSLGMNSTGVNQNVAAQTDDFWTGVYIGRSSSDTPTVGNSELPVLPDTVSPAFSQESAGRDNNPVVNSAMHNQFSGPSNLQMQMNHMNSVNEYGRSSSAPRHIHRTPVAVQALPVQSQALGPQENSITNLNSSLLPSNSSAAPHISLSNPASVDTLNAILSDTERQQHFSRTPVNPPQVSGVNSPAFQHHTATQQALNRWPPPSTSSNTQWSHIQQSVPQSGNFQVAARGGALAARQGSSHARNVPTAGATTHRGMVPNQPARWTQSVSVQNLSTVAGTPFQGLTGEQRGNTAQSVSRPEELFSPQSEQNWTPTGRMRGSLDLSQLYDESIAQRIITPTQGQNSKPPGPQPVRRT

SEQ ID NO: 196303 - protein, 394 aa, Glycine max
  Coding DNA Sequence Number=SeqID_79525
  Gene Ontology: Mol. function=binding; Cellular component=thylakoid; Biological process=photosynthesis
  Homolog annotation: Hit_ID=Q2HPC2; Match level="QueryCoverage=99%, HitCoverage=99%, E-value=3e-98, Identity=50%"; Hit description=SGT1
  Pfam annotation: Domain name=CS; Domain location=176-246; Score=25.3; E_value=7.2e-05; Accession=PF04969.6; Description=CS domain
  Pfam annotation: Domain name=SGS; Domain location=311-392; Score =181.4; E_value=2.2e-51; Accession=PF05002.5; Description=SGS domain
  Pfam annotation: Domain name=TPR_1; Domain location=2-35; Score=8.0; E_value=0.6; Accession=PF00515.18; Description=Tetratricopeptide repeat
  Pfam annotation: Domain name=TPR_1; Domain location=36-69; Score =25.1; E_value=0.00025; Accession=PF00515.18; Description =Tetratricopeptide repeat
  Pfam annotation: Domain name=TPR_1; Domain location=70-103; Score =14.3; E_value=0.11; Accession=PF00515.18; Description=Tetratricopepti de repeat
  Pfam annotation: Domain name=TPR_2; Domain location=2-35; Score=9.6; E_value=2.5; Accession=PF07719.7; Description=Tetratricopeptide repeat
  Pfam annotation: Domain name=TPR_2; Domain location=36-69; Score =22.9; E_value=0.0012; Accession=PF07719.7; Description =Tetratricopeptide repeat
  Pfam annotation: Domain name=TPR_2; Domain location=70-103; Score =9.9; E_value=2.4; Accession=PF07719.7; Description=Tetratricopeptide repeat
  Pfam module annotation: Pfam domain module=CS::SGS::TPR_1::TPR_1::TPR_ 1::TPR_2::TPR_2::TPR_2; Domain location=176-246::311-392::2-35::36 -69::70-103::2-35::36-69::70-103
MATVPEKKAKEAFFDDEFALAVDLYSEAIRLDPNDANLFADRAQAHIKLNAFTEAVSDANKAIQLNPSLSKAYLRKGTACIKLEEYHTAKVALQNGAAFAQDDSRFANLIQQCDRFIEAEESSGLTSTLSSNGSITSVPSGNGSHFSNRNDGMTKEAEGDSLVSQKNEATLKRPKYRHEYYQKPEEVVVTLFAKGISASDVVVDFGEQMLSVTIDVPGQDAYHYQPRLFGKVLISWYLFPCLLAAKEWHRWWQRHYCVPPGLVTKASAQPTRMGSVAVECGGMLRSNCKVWDLSPTIQSERSAYPSSKPRTRDWDKLEAQVKKEEKEEKLDGDAALSKLFRDIYQNADEDMRRAMSKSFLESNGTVLSTDWKEVGSKKVEGSAPEGMELKKWEY

SEQ ID NO: 196304 - protein, 179 aa, Glycine max
  Coding DNA Sequence Number=SeqID_79526
  Gene Ontology: Mol. function=small conjugating protein ligase activity; Cellular component=cytosol; Biological process=protein modification process
  Homolog annotation: Hit_ID=Q9LIY1; Match level="QueryCoverage=90%, HitCoverage=83%, E-value=2e-43, Identity=58%"; Hit description =Putative cyclin-selective ubiquitin carrier protein E2-C
  Pfam annotation: Domain name=RWD; Domain location=37-152; Score=-1.6; E_value=0.057; Accession=PF05773.12; Description=RWD domain
  Pfam annotation: Domain name=UEV; Domain location=42-156; Score= -24.5; E_value=0.0029; Accession=PF05743.3; Description=UEV domain
  Pfam annotation: Domain name=UQ_con; Domain location=41-178; Score =196.5; E_value=6.4e-56; Accession=PF00179.16; Description=Ubiquitin -conjugating enzyme
  Pfam module annotation: Pfam domain module=RWD::UEV::UQ_con; Domain location=37-152::42-156::41-178
  Subcellular localization annotation: CTP_CleavageSite=59; ConfidenceScore=5.36e-01
MEVRSNPAADNSSDHLRPPAVSSKQPLPSPTAVDTSAVSQRLQKELMALMMSGGDLGVSAFPDGESIFTWIGTIEGGKGTQYEGLSYKLSLRFPLDYPFKPPQVKFETMCFHPNVDQFGNICLDILQDKWSSAYDCRTILLSIQSLLEEPNLESPLNSYAAALWNDKEGLENYFLNCQH

SEQ ID NO: 196305 - protein, 139 aa, Glycine max
  Coding DNA Sequence Number=SeqID_79527
  Gene Ontology: Mol. function=ferric iron binding; Cellular component =extracellular region; Biological process=iron ion homeostasis
  Homolog annotation: Hit_ID=Q206Z4; Match level="QueryCoverage=52%, HitCoverage=17%, E-value=3e-10, Identity=39%"; Hit description =Transferrin protein
MKAIANVMYYDHSKTYEAVAVVNRRACEKNEKISLMDFKSHKSCHGEVEGFDICSACSKENETCPEKGLYSDHSGAFRCLVEELGDIAFVKGDTVLLYSMEGPHSQLWSTKSVRDFMYLCPQGGCRENQWLSWRLFVSF

SEQ ID NO: 196306 - protein, 845 aa, Glycine max
  Coding DNA Sequence Number=SeqID_79528
  Gene Ontology: Mol. function=protein kinase activity; Cellular component=plastoglobule; Biological process=protein amino acid phosphorylation
  Homolog annotation: Hit_ID=Q10ZC0; Match level="QueryCoverage=65%, HitCoverage=74%, E-value=7e-78, Identity=34%"; Hit description=ABC-1
  Pfam annotation: Domain name=ABC1; Domain location=266-383; Score =152.5; E_value=1.1e-42; Accession=PF03109.7; Description=ABC1 family
  Pfam annotation: Domain name=APH; Domain location=280-521; Score= -4.9; E_value=0.012; Accession=PF01636.13; Description=Phosphotransfer ase enzyme family
  Pfam module annotation: Pfam domain module=ABC1::APH; Domain location= 266-383::280-521
  Subcellular localization annotation: CTP_CleavageSite=14; ConfidenceScore=5.12e-01
MATVLAPPPSLTVRASSCRRHSKKKQQQKRALGDFSLFAQVVRKDVEFLKRGIDNGVAWAKETFRIPEVAKKIDDVVWLRNLEDPTSPPLPSPSWPQPCYPGLTGVDLLMYDLKAFEAYASYFYYFSKLWTRPLPQDYDPQQVAQYFSVRPHLVTLRVLEVLFSFATAMISIRTSGFSKFLRLIPEEDVDDTSSQYNFGMVLKETLLNLGPTFIKVGQSLSTRPDIIGVEMSKMKLLTKYTVTALSELHDQIPPFPRTVAMKIMEEEFGCPLESFFSYISEEPIAAASFGQVYFARTTDGNNVAVKVQRPNLHHVVVRDIYILRLGLGLLQKIAKRKSDPRLYADELGKGFVGELDYTLEAANASKFLEVHSSFTFMNVPKVFPHLTRKRVLTMEWMVGESPTDLLSVTAGNSVGNVSEYSERQKLDAKRRLLDLVSKGIESTLVQLLETGLLHADPHPGNLRYTSSGQIGFLDFGLLCQMEKRHQLAMLASIIHIVNGDWASLVRALVDMDVVRPGTNIRLVTLELEQALGEVEFKEGIPDVKFSRVLGKIWTVALKHHFRMPPYYTLVLRSLASLEGLAIAADTNFKTFEAAYPYVVRKLLTENSAATRNILHSVLLNQRKEFQWQRLSLFLRVGATRKALRLVASNSETSLDHSTSKATDTIDIAYLVLRLLPSKDGVAIRRLLMTACSSMPSNRYLDGASLIKAMVSKEGEFFREQLCKIIVGILYQWMIKLFGQGITITQYSRMVLANGPSSKESGLSPRSSLPTYDYNSIFRDRRLRVIFSKVLKSASRDKILMLRFSWASLKIIITASTLACHQLVVSLSEAYLSKIFDAPKRYAVSA

SEQ ID NO: 196307 - protein, 47 aa, Glycine max
  Coding DNA Sequence Number=SeqID_79529
MDLTNYTSQMDVACVSVDKTMESILPLADTSHNNWLENPMWADKKEK

SEQ ID NO: 196308 - protein, 230 aa, Glycine max
  Coding DNA Sequence Number=SeqID_79530
  Gene Ontology: Mol. function=DNA topoisomerase (ATP-hydrolyzing) activity; Cellular component=chromosome; Biological process =regulation of transcription, DNA-dependent
  Homolog annotation: Hit_ID=Q9M4A1; Match level="QueryCoverage=100%, HitCoverage=56%, E-value=3e-78, Identity=67%"; Hit description =Putative topoisomerase VIA
  Pfam annotation: Domain name=TP6A_N; Domain location=89-173; Score =75.2; E_value=2e-19; Accession=PF04406.4; Description=Type IIB DNA topoisomerase
MEDLRNLTLKFFSDQELCYADIVPLAQVRARIEVSVLNFLKILNASSPAISDLPLIQRKYSNSRVNHGLLTELSRVFLSNSVSTRSLMRPNAAKAFVRVWKVMEMCYQILLQEKRVTQRELFYKLLCDSPHLFPSQTHVNRTIQGYYQWEYINLCQTDLVALLRCSRFSLGIMASSRGLVAGRLILQEPGKEAVDCSLCGSSGFAISGDLNLLDSLVLNADARYVIIVEK

SEQ ID NO: 196309 - protein, 58 aa, Glycine max
  Coding DNA Sequence Number=SeqID_79531
MTSHIPLTKRGERGADEIDCTGWCWVHGKTLRRNNGGECGGITEVERAEVQWRRKGEE

SEQ ID NO: 196310 - protein, 100 aa, Glycine max
  Coding DNA Sequence Number=SeqID_79532
  Gene Ontology: Mol. function=DNA topoisomerase (ATP-hydrolyzing) activity; Cellular component=chromosome; Biological process=DNA topological change
  Homolog annotation: Hit_ID=Q9M4A1; Match level="QueryCoverage=86%, HitCoverage=22%, E-value=3e-30, Identity=72%"; Hit description =Putative topoisomerase VIA
MLETNLRNAMHYLACNVKWLGLRGHDLPLLPNQSFVPLKPKDLQIAQSLMSSGILQDNYKEEVALMVQSGRRAEIEALYFNGYDYLGKYIAKKIVQSDYV

SEQ ID NO: 196311 - protein, 640 aa, Glycine max
  Coding DNA Sequence Number=SeqID_79533
MSSFLSDSTIGMSGRYSGGSIEQPIMNWEVILIGDSSYEDIRQGASNNESSFSERVRVSRCASGDTSRPCRRVWPSTSTRGVRRGSDYRDIRASPCVRCSQSVGSLSSIPIVVGYEWVRKDILKYKSCLTLAACGSDDFLLLRVASGHPPFFFMYRCLFEVLGLILPLTVIQCAVLEHLNVALSQLHPNSWAMVLAFEILCSFFNILPSVLVFLFFFRLKLNGKIGWVSLNSMSRKLFAFDSNIFHRFKDHFFKVLALDGGQPAGEVDPFAVVAKVTPSARSSVLAKRNRGDGVGPFGRKKSKASMSLRALRQAIGLMPSAGRLSTVQDVPLNPPPIKASIVAVTTSAPSPPPTIVVQEVTPTIAEVTMSATQSDSARAPSSTSAPTVLPISSSAQLYTSSDADSLWGATYKPEQKTLIGFVSTFDKSLIRSARVMNATDSAKVFLQRSLAILEENGLWYHEAMQNVVSLEAEVAKWRAITDTLWRVEHPKVGNASIAFVEVVRSNHQLSFKVGGVLAKFLRTWLDGDELFKHYKDLQSVAAERDELAKVVVDLEARLKESKSRLEESELRAAKEREANKELEDESSSKPFFAKDLDLGLFDPFKDVKDGVLLDEEDIVAKEEAGNERQGSAKQGNDAYV

SEQ ID NO: 196312 - protein, 452 aa, Glycine max
  Coding DNA Sequence Number=SeqID_79534
  Gene Ontology: Mol. function=RNA-directed DNA polymerase activity; Biological process=RNA-dependent DNA replication
MVKGLVTHLVGIPSILWSFFHDGCKELCLTCPWLKVLPTSQGVILTCESTPLMVIRIKCGLHLIEVLVEIGLSNRKGSPRANLGFVEPWIEDVITKYKACVQCKHCALAYMDAGWAEHLQYGSAFVEAHVVFAEFPEDFFQVCHMLGYSLRLDDHVVHIYLDISSDLLFEDSVHQSLLYPEYASRKLSTGTRTFHQLAYRCWAKGTYSKFVADYAGVDSRHHVDDVPVLGTSEVPTKSCALLRFRSELQLDKLFNGFRVYVKDGQGSDLGPSSMITTLVVSATVTISFASVENVIVKWGVETVAPTPGEIALSEGGHQVHVVSGLDFLACKAEEWTGVRDINETALVIEDPGHHEICNDDGDNHRVILNDGVDALEVHVVAHAVVVGVFVCLHLPLFSRLLPGSYFASLDDLRVMLLLGDCLYFVASDPDLGGFIWGSRMGTSSLKASSKIV

SEQ ID NO: 196313 - protein, 187 aa, Glycine max
  Coding DNA Sequence Number=SeqID_79535
  Gene Ontology: Mol. function=transferase activity, transferring nitrogenous groups; Cellular component=cytoplasm; Biological process= ethylene biosynthetic process
  Homolog annotation: Hit_ID=P31531; Match level="QueryCoverage=70%, HitCoverage=27%, E-value=9e-60, Identity=80%"; Hit description=1 -aminocyclopropane-1-carboxylate synthase
MKRTTYEEVSSQCPPSRKLHIIFGPAGFSPLKINANLREHAINTSHGVVVHSQIHVLMSVNEPQLLSKIATGDGHGENSPYFDGWKAYEDDPFHPIKNPNGVIQMGLAENQLASDLVQNWLTNKPRASICTPEGVRDFKAIANFQDYHGLPKFRKAVAKFMARTRGNRVTFDPDRIVMSGGATGAHE

SEQ ID NO: 196314 - protein, 330 aa, Glycine max
  Coding DNA Sequence Number=SeqID_79536
  Gene Ontology: Mol. function=transferase activity, transferring nitrogenous groups; Cellular component=cytoplasm; Biological process= ethylene biosynthetic process
  Homolog annotation: Hit_ID=P31531; Match level="QueryCoverage=97%, HitCoverage=67%, E-value=1e-147, Identity=76%"; Hit description=1 -aminocyclopropane-1-carboxylate synthase
  Pfam annotation: Domain name=Aminotran_1_2; Domain location=1-281; Score=234.5; E_value=2.3e-67; Accession=PF00155.11; Description =Aminotransferase class I and II
MTKSRFDRDLRWRTGVELVPVKCESSNDFKLTRKALQEAYEKGKENNIRIKGLLITNPSNPLGTIMDRETLRTVVSFINEKHIHLVSDEIYAGTVFCHPGFTSIAEVIEEDTDIECDRDLIHIVYSLSKDMGFPGFRVGIIYSYNDAVVNCARKMSSFGLVSTQTQYLLASMLSDDEFVERFLEESAKRLAKRYGVFCRGLAQVGIKCLASNAGLFLWMDLRRLLKKPTFEAEMELWKVIIEQVKINISPGSSFHCSEPGWFRVCYANMDDRTVEVSLARMRTFVNQNTEAKKSCSQRNLRLSFSFRKMDEYLVSPHSPFPQSPLVKAST

SEQ ID NO: 196315 - protein, 68 aa, Glycine max
  Coding DNA Sequence Number=SeqID_79537
YILCGTSREYIYLGLTETREVSDGGSWWPLVVVDGGGRGISLNKFVSLSENSLLALSATSHAKHDFSH

SEQ ID NO: 196316 - protein, 90 aa, Glycine max
  Coding DNA Sequence Number=SeqID_79538
MAKRLQEDWARDAGESPRPLQSPFLLFHSTAIDLFKKQNTPLMKKIQGLQALLGATSYVYLPPSFHNSYGLGNMLSIDYIFPHLGNHEVY

SEQ ID NO: 196317 - protein, 195 aa, Glycine max
  Coding DNA Sequence Number=SeqID_79539
  Homolog annotation: Hit_ID=Q9LTF2; Match level="QueryCoverage=48%, HitCoverage=53%, E-value=1e-45, Identity=90%"; Hit description=40S ribosomal protein S10-3
  Pfam annotation: Domain name=S10_plectin; Domain location=18-113; Score=262.8; E_value=6.9e-76; Accession=PF03501.5; Description =PlectinS10 domain
MVESAYANPNLICFVQIIPEKNRKEICKYLFQEGVCFAKKDFNLAKHPEIDVPNLQVIKLMQSFKSREYVRETFAWMHYYWFLTNDGIEFLRTYLNLPSEIVPATLKKQAKPAGRPFGGPPGDRPRGPPRFDGERRFGGDRDGYRGGPRGPGGDFGDKGGAPADYRPSFGGGPGGRPGFGRGSGGYGAPTSSNIP

SEQ ID NO: 196318 - protein, 188 aa, Glycine max
  Coding DNA Sequence Number=SeqID_79540
MEDIDRTLFEKIVNVIKIEKFIGKNSFNLWRIKMQALFKEKGIWDPVSGKDFITLEEVKSNFYSIEFRLKASENGDEAFTYRLSVTDFAIEQKKKKGKGRKKTKADPKGICNYGKESGQRKRDSPKKAKKDFLALIQNDSALENDLVLVVGEQLQQHSKQCKKIVGLKVKEMMKGVIADPEWRVAVGV

SEQ ID NO: 196319 - protein, 71 aa, Glycine max
  Coding DNA Sequence Number=SeqID_79541
MCWLNLVQMQAIDKIARPLGSESRLYMYYYDFNKCLRDEPSASPCLATSHLVQRRSKGALSAKVRAKRKFA

SEQ ID NO: 196320 - protein, 378 aa, Glycine max
  Coding DNA Sequence Number=SeqID_79542
  Gene Ontology: Mol. function=protein serine/threonine kinase activity; Cellular component=nucleus; Biological process=protein amino acid phosphorylation
  Homolog annotation: Hit_ID=Q84XZ6; Match level="QueryCoverage=90%, HitCoverage=92%, E-value=1e-155, Identity=78%"; Hit description =Mitogen-activated protein kinase 4
  Pfam annotation: Domain name=Pkinase; Domain location=18-300; Score =277.0; E_value=3.8e-80; Accession=PF00069.15; Description=Protein kinase domain
  Pfam annotation: Domain name=Pkinase_Tyr; Domain location=18-300; Score=6.8; E_value=6.9e-13; Accession=PF07714.7; Description=Protein tyrosine kinase
  Pfam module annotation: Pfam domain module=Pkinase::Pkinase_Tyr; Domain location=18-300::18-300
YVQYNVYGNLFEVSSNYVPPIRPIGRGAYGIVCAAVNCDTHEEVAIKKIGNAFNNIIDAKRTLREIKLLRHMDLENIIAIRDIIRPPRKDAFDDVYIVYELMDTDLHQIIRSDQPLNDTTVRALLRGLKYVHSANILHRDLKPSNLLLNANCDLKIADFGLARTTSETDFMTVYVVARWYRAPELLLNCSEYTSAIDVWSVGCIFGEIMTREPLFPGKDYVHQLRLITELLGSPVDASLGFLQSENAKRYVRQLPQYRKQNFSARFPNMSSEALDLLEKMLIFDPIKRITVDEALCHPYLSSLHDINDEPVGPGQFKFDFEQPTCTAEHIKELIWREASRIMPMDKLSFGKENASSSLVPGMATYCATQESHNLKCQQ

SEQ ID NO: 196321 - protein, 141 aa, Glycine max
  Coding DNA Sequence Number=SeqID_79543
MGGCKLVVALEYGPVDEKGDKIKDATKLHRQSSVGGDLLGPWNPSQVKPPKTQLQGRHGSYRIHAWTFCTCIAACKMQSGETCKCLLATLTPKKQEKNEADETGLATKEMIDPIVVYSRLPPLIGPLLCSLVVRNMVEPWL

SEQ ID NO: 196322 - protein, 175 aa, Glycine max
  Coding DNA Sequence Number=SeqID_79544
  Homolog annotation: Hit_ID=Q9AVH2; Match level="QueryCoverage=77%, HitCoverage=60%, E-value=1e-44, Identity=68%"; Hit description =Putative senescence-associated protein
ILPAARWELRFKASRRANPPHEGHQRHVPLGGRGPPTAVIIQRTVASRHWLFNQARCPIVRINGSSRTRLNYYCDTVIRRADIEGSKSNVAMNAWLPQASYPCGNFSDTSSFNRSSTKGSIGHAFTVRIRTGNQNQTSFYPFVPHEISVLVELILGHLRYLLTDVPPQPNSPPDN

SEQ ID NO: 196323 - protein, 118 aa, Glycine max
  Coding DNA Sequence Number=SeqID_79545
  Subcellular localization annotation: CTP_CleavageSite=66; ConfidenceScore=5.69e-01
MASYVTPPLSLPSPFGCHSSSKKQRNPLMKNILGLQAPMELTSTFMPTISITARKTLNKGFNRRTTSSMVYKLTWVTYTLKCSSGTMLVKRFFEEWYTCMKHSNIQVRFRLRAINADE

SEQ ID NO: 196324 - protein, 504 aa, Glycine max
  Coding DNA Sequence Number=SeqID_79546
  Gene Ontology: Mol. function=transferase activity, transferring glycosyl groups; Cellular component=membrane
  Homolog annotation: Hit_ID=Q9FN55; Match level="QueryCoverage=98%, HitCoverage=96%, E-value=0.0, Identity=63%"; Hit description =Arabidopsis thaliana genomic DNA, chromosome 5, P1 clone:MYC6
  Pfam annotation: Domain name=DUF604; Domain location=231-485; Score =620.3; E_value=1.6e-183; Accession=PF04646.3; Description=Protein of unknown function, DUF604
  Pfam annotation: Domain name=Fringe; Domain location=97-345; Score= -98.1; E_value=0.062; Accession=PF02434.7; Description=Fringe-like
  Pfam module annotation: Pfam domain module=DUF604::Fringe; Domain location=231-485::97-345
  Subcellular localization annotation: CTP_CleavageSite=52; ConfidenceScore=5.52e-01
RGGMKDSDKLTWDQGRCLSPAQARSSASQKLMVSLMFLVSLTYMAYTLKLVSTSTSSSTCSHAPFIINHLFPSSNVTEWPSSSQTSRTGKGKRPGRQKTELRHLVFGIAASSKLWEHRKNYIKTWYKKDKMRGVVWLDDRVKTNPKEGLPPTKVSTDTSNFVYTNKLGHRSAIRISRIVTETLRMGHKDVRWFVMGDDDTVFVTDNLLRILNKYDHNYMYYIGSLSESHLQNIFFSYGMAYGGGGFAISYPLAKALSKMQDRCIQRYPALYGSDDRMQACMAELGVPLTKEIGFHQYDGYGNLFGLLAAHPGTPLVSLHHLDVVEPIFPNATRVEAIKRLTIPMKLDSASLIQQSICHDRNRRWTISVSWGFAVQIFRGIFTQREMEMPSRTFLNWYRRADYTAYAFNTRPFSRNPCQKPFVFYFSKAKLNSTLQQTVTEYERDPIPPPECRWNMADPSALDKIEVHKKQDPHLWDRAPRRNCCRVMKSNKTGILKIEVAVCRD

SEQ ID NO: 196325 - protein, 286 aa, Glycine max
  Coding DNA Sequence Number=SeqID_79547
  Gene Ontology: Mol. function=binding; Cellular component =mitochondrial inner membrane; Biological process=transport
  Homolog annotation: Hit_ID=Q1RYX7; Match level="QueryCoverage=82%, HitCoverage=74%, E-value=7e-98, Identity=54%"; Hit description =Adenine nucleotide translocator 1
  Pfam annotation: Domain name=Mito_carr; Domain location=190-282; Score=120.7; E_value=4.1e-33; Accession=PF00153.17; Description =Mitochondrial carrier protein
  Pfam annotation: Domain name=Mito_carr; Domain location=96-184; Score= 127.3; E_value=4.4e-35; Accession=PF00153.17; Description =Mitochondrial carrier protein
  Pfam module annotation: Pfam domain module=Mito_carr::Mito_carr; Domain location=190-282::96-184
MAEILPYKHSIAPWWASLHKLPMVVGKKIWHAILPWRGNSGYLTTLVLYMGNFVDVIGLVHIARSLRGFATIGRLLAYETVNKNLSPKPGEHSKLPIPASLIAGACAGVCSTICTYPLELLKTRLTIQRGVYDGLLDAFLKIVREEGAGELYRGLTPSLIGVIPYSATNYFAYDTLRKAYRKIFKKEKIGNIETLLIGSAAGAFSSSATFPLEVARKHMQVGALSGRQVYKNVIHALASILEQEGIQGLYKGLGPSCMKLVPAAGISFMCYEACKRILVEDDDDEE

SEQ ID NO: 196326 - protein, 640 aa, Glycine max
  Coding DNA Sequence Number=SeqID_79548
  Gene Ontology: Mol. function=sequence-specific DNA binding; Cellular component=nucleus; Biological process=regulation of transcription, DNA-dependent
  Homolog annotation: Hit_ID=Q7Y0Z9; Match level="QueryCoverage=83%, HitCoverage=99%, E-value=1e-154, Identity=56%"; Hit description=Bell- like homeodomain protein 3
  Pfam annotation: Domain name=Homeobox; Domain location=400-458; Score= 0.6; E_value=0.0043; Accession=PF00046.19; Description=Homeobox domain
  Pfam annotation: Domain name=POX; Domain location=220-348; Score =219.3; E_value=8.4e-63; Accession=PF07526.2; Description=Associated with HOX
  Pfam module annotation: Pfam domain module=Homeobox::POX; Domain location=400-458::220-348
MARQVCDDKLSTGFCYSDVSSGNPTMLVNQIQGFVSDPEMYNLTTGMEMIGFPKSDTNAVMWRSFIPEPGPSSSKTINDSSTTFYHHDYNNKNADFTPAGNISETSAENLIVGNHDSAPWQDNDYNRFDDSSLRCVFPCETNERPSQGLSLSLSSTNPSTIGLQSFELRQTGHHPDFVSSSSREGFFGKPVSLQQQQMLSQDGYVSSNSKVASVYQQGHFLVKNSKFLVPAQDLLNEFCSLCAKQSDLGKPTKSLKKQWEDQENNGVGSSKKHSLTSLEFVELQKRKTKLLSMLEEVDRRYKHYRNQMKSVVSSFEAVAGNGAATVYSALALKAMSRHFRCLKDGILSQIQATRKAMGEKDPVAPGTTRGETPRLKVIDQTLRQQRAFQQMSMMETHPWRPQRGLPERAVSVLRAWLFEHFLHPYPSDVDKHILARQTGLSRGQVSNWFINARVRLWKPMVEEMYLEEVKDPENNIASSEGATDQDNDINPNNVEYPPPPSSSRSEDQKPSLVRIDSECASSIINNHSTPDNKNDPKGHEQCFGSVELDFSSYTHHSSGIVSYGSNDQNGNNNQSGVSLTLGLQQHGVSLAFPPATQSSLYYPRDQIEDCQPVQYSLFDGEGQNLPYRNLMGAQLLHDLA

SEQ ID NO: 196327 - protein, 1178 aa, Glycine max
  Coding DNA Sequence Number=SeqID_79549
  Gene Ontology: Mol. function=RNA-directed DNA polymerase activity; Cellular component=chromatin; Biological process=chromatin assembly or disassembly
  Pfam annotation: Domain name=RVP; Domain location=337-442; Score= -8.1; E_value=0.024; Accession=PF00077.10; Description=Retroviral aspartyl protease
  Pfam annotation: Domain name=RVP_2; Domain location=321-453; Score= -40.6; E_value=0.0014; Accession=PF08284.2; Description=Retroviral aspartyl protease
  Pfam annotation: Domain name=rve; Domain location=1071-1178; Score= -2.8; E_value=0.01; Accession=PF00665.16; Description=Integrase core domain
  Pfam module annotation: Pfam domain module=RVP::RVP_2::RVT _1::Retrotrans_gag::rve; Domain location=337-442::321-453::577 -746::102-192::1071-1178
MAEHTTRKTTTDRLEDAISRLSIHHDSLSDKHDTLASKVDSILDRLNQLTSLPPPPSPVSPQHRPPVKLDVPRFDGTDPLGWIFKITQFFDFQSTPDEDRITMASFYMDGPALSWYQWMYRNGFITSWNGLLQALETRFAPSYYDDPRGALFKLNQRGSVNDYLTDFERLANRIVGLQPQFLLSCFISGLSPEIRREVIALQPISLPQAAALAKLQEDKLNDRRRSFRPGPPTPSHPPPPPALGPPSSTHPKTPTAKPIFTHCTPEEMAFRREKGLCYNCDEKWNSSHRCKGRILLFIADEPIPSPPPSPPSVSPPQDLETPSSPTLPHISLHALSGLSAPETFRLYGFINGARLTVLVDSGSTHNFVQPCVAKFLHLQVTETKPLRVMVGNGSVLECHQVCTTTLLLQSHSFTVPLHLLPISGANVVLGIAWLKGLGPVITDYTTLTMQFTHLGLPITLRADVAFGPTPISATQMRRLIQTHSTSAFFHLALLPEPPPTLTHPIPEIQSLLDRFTPIFQTPTQLPPPRQIVHHINLQPSAPPVNVRPYRYPYCQKTEIEKQVAALLNAGLIRLSQSPFSSPVLLVKKKDGSWRMCIDYRALNSITIKDRFPMPTIDELLDDLGTASWFSKLDLRQGFHQILMAEDDIPKTAFRTHQGHYEYRVMPFGLCNAPSTFQATMNALLQPFLRKFTVVFFDDILVYSSTLADHLFHLTLVFEALLQGQFYLKQSKCLLAQRQLEYLGHIISARGIEPEQTKITAMLSWPVPSSQKALRGFLGLTGFYRRFIKGYASIASALTPLLCKDKFLWSSTAQEAFDQLKKAMTRAPVLAPPDFTIPFVLETDASGSAMGVVLMQKGHPIAFFSKQFSPRMQRASTYVRELHAMTTAIRKWRHYLLGHQFTILTDHRSLKDLMSQIAYKPGTSNVVANALSRIDTDHDSTLLILSYPHFDFMTQLRQSLQSSPDFQQMRDSILRDPSAYPDYRIQDELIICKGSIWLDSRNPFIQTLLSEFHSTPLGGHLGVAKTLHRLQANFVWSSMRDDVKLFVRQCSTCQQLKHLTRRPAGLLQPLPVPTGIWEDLSLDFITHLPKSHGYTVILVVVDRFTKGVHLGALPAQFTASKVATLFFDIVCKIHGFPHSLVSDRDPVFVSAFWRELFKLSGTLLRLSTAYHPQTDGQTE

SEQ ID NO: 196328 - protein, 615 aa, Glycine max
  Coding DNA Sequence Number=SeqID_79550
  Gene Ontology: Mol. function=transmembrane receptor activity; Cellular component=integral to membrane; Biological process=defense response to bacterium
  Homolog annotation: Hit_ID=Q1SI21; Match level="QueryCoverage=95%, HitCoverage=92%, E-value=0.0, Identity=76%"; Hit description =Nonaspanin
  Pfam annotation: Domain name=EMP70; Domain location=61-595; Score =1081.3; E_value=0; Accession=PF02990.7; Description=Endomembrane protein 70
MARVLLARNNLCLWIHVYFLLLVHLHVGTSFYLPGVAPEDFHKGDLLRVKVNKLSSTKTQLPYSYYSLPYCHPGHIVDSAENLGEVLRGDRIENSPYVMCNVVCRLTLNAKTAKEFKEKIDDEYRVNMILDNLPLVVPLRRPDRESSLVYLHGFLVGLKGQYAGNKDEKHFVHNHLTFIVKYHRDPVTEMSRIVGFEVKPFSVKHEYDGGWDNTTRLTTCDPHAKKLVSGSEPPQEVEDKKEIIFTYDVEFQESNVKWASRWDSYLLMADDQIHWFSIINSLLIVLFLSGMVAMIMLRTLYRDISKYNQLETQEEAQEESGWKLVHGDVFRPPSNSDLLCVYVGTGVQFFGMILVTMIFAALGFLSPSNRGGLMTAMLLLWVLMGLYGGYSSARLYKMLKGTEWKRIALKTAFMFPATAFAIFFVLNALIWGQRSSGAVPFGTMFALVFLWFCISVPLVFLGGHFGYKKPVTEDPVKTNKIARQIPEQPWYMNSLFSILIGGILPFGAVFIELFFILTSIWLHQFYYIFGFLFIVFLILIVTCAEITIVLCYFQLCSEDYRWWWRSYLTSGSSALYLFLYAAFYFFTKLEITKPVSGVLYFGYMLLLSYGFFVVT

SEQ ID NO: 196329 - protein, 511 aa, Glycine max
  Coding DNA Sequence Number=SeqID_79551
  Gene Ontology: Mol. function=RNA-directed DNA polymerase activity; Cellular component=chromatin; Biological process=RNA-dependent DNA replication
MIAVSTVSYRFNVNGYKTEIMGARRGLRQGDPISPMLFVIVMECLNRYLGDKISVGMMMRAYESFSKATGLLVNPQKCSLLCAGIDAVTKREILEVSGFQEGQLPFKYLGVPVTSKKLSTIHYSPLIDKIVGKIKHWTARLLSYAGRLQLVNSVMFALTNYWLNCFPFPKSVLQKIEAICRIFLWTGGFEGSRKSPVAWKQICSPRSCGGLNIIDIDIWNKANLMKLLWNLSSKEDSLWVKWIQAYYVKRSELMHIEMKNTDSWIMKAILKQREDLEKIDNMEELMIRGSINMGKLYRKLQDCGQRKEWKNLLYGNTARPRANFILWLACHGRLSTKDRLCKYGMIDDKSCCFCSEEESMNHLFFVCDNSKRVWMEVLQWVQIRHDPSDWPNELHWLTHHTKGKGTRAAVLKMAIAETIYEIWNIRNNKIFGQAIDINTVGKKIINTLVNRGKVTSFIIVGVATYPSAGGRRETRGMRVPRKEYARSRHQRLFEENVGKTGKDAIYELLSE

SEQ ID NO: 196330 - protein, 380 aa, Glycine max
  Coding DNA Sequence Number=SeqID_79552
  Gene Ontology: Mol. function=catalytic activity; Biological process =metabolic process
  Homolog annotation: Hit_ID=Q01CB8; Match level="QueryCoverage=52%, HitCoverage=64%, E-value=8e-47, Identity=47%"; Hit description =Homology to unknown gene
  Pfam annotation: Domain name=PGAM; Domain location=77-253; Score =113.5; E_value=6e-31; Accession=PF00300.12; Description =Phosphoglycerate mutase family
  Subcellular localization annotation: CTP_CleavageSite=61; ConfidenceScore=5.57e-01
MAVLPFSYSRSPTLSLPSSQQIRPKTKPNSKTNTCSLIHCCHSQTEPIELNGQARFREKNPATAVASPVVVPPRPRRIILVRHGESEGNVDESVYTRIPDPKISLTEKGKVQAEECGNRIKQMIENDHDQHWQVYFYVSPYRRTLQTLQHLARPFQRSRIAGFREEPRIREQDFGNFQNREKMRMEKELRQRYGRFFYRFPDGESAADVYDRITGFRETLRTDINIGRYQPPGEKKTDMNLVIVSHGLTLRVFLMRWYKWTVQQFEGLNNMGNGNMLVMEKGFGGRYSLLMHHGEEELRRFGFTDEMLIDQEWHKFAKPADLNYDCPMVNSFFPHLSDSEETCRKRKSNLFEYNTNLTLYNKIPRVVEEVQHFTCAEMMI

SEQ ID NO: 196331 - protein, 36 aa, Glycine max
  Coding DNA Sequence Number=SeqID_79553
MELDLDGRIVKTSLIGWSGWHMPDWVAYENFTDTGS

SEQ ID NO: 196332 - protein, 57 aa, Glycine max
  Coding DNA Sequence Number=SeqID_79554
MKVISVVPPIFLFGRPLLYLRVVADEAGHEYAKEWERKTRVTVIDMVVGCETDGDQK

SEQ ID NO: 196333 - protein, 292 aa, Glycine max
  Coding DNA Sequence Number=SeqID_79555
  Homolog annotation: Hit_ID=Q2HU26; Match level="QueryCoverage=70%, HitCoverage=78%, E-value=2e-22, Identity=37%"; Hit description=CCT
  Pfam annotation: Domain name=CCT; Domain location=219-257; Score =73.9; E_value=5e-19; Accession=PF06203.4; Description=CCT motif
MSSDLYTFDISYQRHSSPDNMVSYDGNGNFVFFSDPHSFPFLTGSPIDDVVQGNFNTSLDPFSSSFCSFSPQENPVQPLSNIKGEFRSFSYLHGSEVTSKECQMGVDYTYNQHFISQTCHGSESASKLIQRSFSCTSFDEKPRFPFEPHPDTLMDFQWHALNSPENTFFAASMRRVCSTGDLQNMKAADMSQTESPLLEEGNFKVRRYSAEERKEKISKYRAKRSQRKFNKTIKYACRKTLADNRTRIRGRFARNDEIREIPKAPCSSSTTEEYEDEFWVEFIEGLNEEVNG

SEQ ID NO: 196334 - protein, 119 aa, Glycine max
  Coding DNA Sequence Number=SeqID_79556
  Homolog annotation: Hit_ID=Q67YE3; Match level="QueryCoverage=70%, HitCoverage=32%, E-value=2e-38, Identity=77%"; Hit description=MRNA, , clone: RAFL25-03-N20
  Pfam annotation: Domain name=PLAC8; Domain location=20-119; Score= -11.0; E_value=0.042; Accession=PF04749.7; Description=PLAC8 family
MASQQHIEKMQLRQNFRNLWHSDLFSTIQADTPYCCFSLWCAPCVSYLLRKRALYDDLSRYTCCAGYMPCSGRCGESKCPELCLGVENEYLNMPRRYIFGFHRQEVKLIFKRQVHSVFC

SEQ ID NO: 196335 - protein, 187 aa, Glycine max
  Coding DNA Sequence Number=SeqID_79557
MESNIHIDVAESAIDRIEAAIAKLTPNQLILVAATDTMATTIDDLIQRLSLHHPTPHFPFSSLLQSPPPVDPISTMPPMPTPFPRPEIMHVYSIHSQSGALTIHSLDRFHKVVIGVSFGQLEARFGWSDKSFTELLELLTSTCPNDCLLYKNEFAEMSKYPTNGVSRYKVKDDECSDEPSRSISHPV

SEQ ID NO: 196336 - protein, 462 aa, Glycine max
  Coding DNA Sequence Number=SeqID_79558
  Homolog annotation: Hit_ID=Q6K6Z8; Match level="QueryCoverage=88%, HitCoverage=99%, E-value=4e-68, Identity=39%"; Hit description =Hydroxyproline-rich glycoprotein-like
MRGANGGAVNNTLETINAAATVIASVENRLDQPHPHVQKKSWGNWLSIYWCFGHRKNRQRIGHAVLVPERIPSGTDNATVNSTQAPIIPFHFVAPPSSPASFLHSEPPSVAQSPSAILSLTPGGPFSIFAIGPYAHETQLVSPPVFSTFTTEPSTAPFTPPPESNHLTTPSSPEVPFAQLLDPNNKNSETYQRFQIPQYDFHSYQLHPGSPVGQLISPRSAFSASSTSSPFPDTDTEFNSRASLLLNFQTDDKLSTNENHKSHQGSGSLTPDSIRSTTQASFLPSHWVSIEVSAQEVFNCVENKAVAWTKPLSKLKTDAPGEDNSREVLVIETPSDAPQQTADDGDVERVHHKDECITFSAAKEFNFDNAEGGDSPTPNLVADWWAKEKVASKEGGSSNNWSFFPMIRPGVGMQLQNLEKGRKPCVKHFSNVLKFHSSNFQKNTIVIKFDMELMDPTEYMDK

SEQ ID NO: 196337 - protein, 999 aa, Glycine max
  Coding DNA Sequence Number=SeqID_79559
  Gene Ontology: Mol. function=nucleoside-triphosphatase activity; Cellular component=membrane; Biological process=defense response
  Homolog annotation: Hit_ID=Q2L3S2; Match level="QueryCoverage=83%, HitCoverage=82%, E-value=1e-155, Identity=37%"; Hit description =Putative ATPase
  Pfam annotation: Domain name=TIR; Domain location=164-296; Score= -32.2; E_value=0.067; Accession=PF01582.10; Description=TIR domain
  Subcellular localization annotation: CTP_CleavageSite=83; ConfidenceScore=5.80e-01
MDIQEESPMFGSLKAMTTRNMSSSSSAFFSANQSPFFSPRSPSSCQLSESARLDVPSNRIHLGLAPSSTTSEIPEPNSLVNVRCTLSDVSASPAGCNSVDLQKLDRISSSVGISSSSISSYSNRHEDGYSGQKEKRIKKDRNHRTSSTPGSTSFSSYRLRSCDVFIGLHGCKPPLLRFAKWLCAELETQGISCFVSDRARSRSSRKLGIAERAMDAASFGIVIITRKSFKNQYTIEELQFFCSKKNLIPIYFDLSPADCLVRDIIEKRGELWEKHGGELWLSYDGLEQEWKDAVHGLSRLDECKLEAQDGNWRDCILRAVTLLAMRLGRRSVAERLTKWREKVEKEEFPLARNENFIGRKKELSQLEFILFGDVTGDAEQDYIELKARPRRKSVRIGWGKSNVIDERWRERHMGNGSRKDKEPIVWKESEKEIELQGIEFSNRHNHLRLKRGMYSKRKRGMKILYGKGIACVSGDSGIGKTELILEFAYRFHQRYKMVLWIGGGSRYIRQNYLNIRSLLEVDVGVENGLEKTQIRGFEEQEVAAISRVRKELMRNIPYLVVIDNLESEKDWWDHKLVMDLLPRFGGETHVIISTCLPRIMNLEPLKLSYLSGVEAMSLMLGSGKDYPVAEVDALRIIEEKVGRLTLGLAIISAILSELPITPSRLLDTINRMPLKEMSWSGKEAHSFRKNTFLLQLFDVCFSIFDHADGPRSLATRMVLVSGWFAPGAIPVSLLSLAAQKVPERCQGKCFWKKVKQLLTCGFTSSYAKKSELEASSLLLRFNIARSSTKQGYIHINDLIKLYAQRRDDTGAAQAMIQAIINHGPISQNLEHLWAACFLLFGFGHDPVVVEVKVSELLYLVKRVVLPLAIHTFITYSRCTAALELLRLCTNALEAADQAFVTPVDKWLDKSLCWRSIQTNAQLNPCLWQELALCRATVLETRAKLMLRGAQFDIGDDLIRKAVFIRASICGEDHPDTISARETLSKLTRLNANVQIHTST

SEQ ID NO: 196338 - protein, 139 aa, Glycine max
  Coding DNA Sequence Number=SeqID_79560
  Subcellular localization annotation: CTP_CleavageSite=92; ConfidenceScore=5.25e-01
MAVTSSSSLESSSIGVPAGDAYREDNSSTGVVTGDGCGVVSRVAGSVSGMSSAGISSLLSSLLLWLRLLGCGGLTSPKRRRPDSWPGHLSTSADRGKEAGAIEAGGANEDGPSDPQALALRVLGKVTEGSSRFQKFFFI

SEQ ID NO: 196339 - protein, 73 aa, Glycine max
  Coding DNA Sequence Number=SeqID_79561
MSHSQGGSTASNSGSWWPPIIVGGGEGGVRVWVAFGKEERGEIVLFMHNDLKGDILPWKAKPPQLGNPAENLM

SEQ ID NO: 196340 - protein, 432 aa, Glycine max
  Coding DNA Sequence Number=SeqID_79562
  Gene Ontology: Mol. function=protein serine/threonine kinase activity; Biological process=protein amino acid phosphorylation
  Homolog annotation: Hit_ID=Q1T627; Match level="QueryCoverage=100%, HitCoverage=51%, E-value=3e-90, Identity=45%"; Hit description =Protein kinase
  Subcellular localization annotation: CTP_CleavageSite=34; ConfidenceScore=5.11e-01
MSSWWEKSSSKDVKRKEKRKSIIDTIQRKLNKSRGSRRNHSHTNSEKGTTSLVPTTSPSPSTHVSRLQSFAERPLAQPLPLPGTHCSSTNRANSGTSVTSKPQSTWGLKSSLYFPLPKPGCVFNRGEPTDAEEDIATASISSGSSIDSDDQCDSHFLSPLASDSENGNQATVHNTVSVVHKDQPPITIQKNSRVSSKPAPQLCNHQLLYNTPKGASLHLPNPQIASSGGLWSAPDSSMSSPSRSPLRMFGSEQVLNSGFCTGKLYPDLATRHCSSPGSGHNSVGGDLTGHNSPIPSPGMKSPGFSSRIHSGAVTPLHPRAGSAALESPTRRPDDVKQTHRLPLPPITIPNHCPFSPTYSATTTPSAPRSPSIAENLTYPGSRWKKGQLLGRGTFGHVYLGFNSESGEMCAMKEVTLFSDDAKSRESAQQLGQ

SEQ ID NO: 196341 - protein, 115 aa, Glycine max
  Coding DNA Sequence Number=SeqID_79563
MAAQDVVRQPNFGRKKGGKWKVRSGMVKAQSLNKVIDCGGHGVCSSDKYELIGGEFRDGCFDAVNSGLRNIYVDITFHFRGGWVLQKWLLVGDCVERMSWEKMVWAGMEAMEGSH

SEQ ID NO: 196342 - protein, 447 aa, Glycine max
  Coding DNA Sequence Number=SeqID_79564
  Gene Ontology: Mol. function=protein serine/threonine kinase activity; Cellular component=prospore membrane; Biological process =protein amino acid phosphorylation
  Homolog annotation: Hit_ID=Q6UY78; Match level="QueryCoverage=90%, HitCoverage=46%, E-value=1e-119, Identity=57%"; Hit description=YDA
  Pfam annotation: Domain name=Pkinase; Domain location=3-222; Score =220.0; E_value=5.4e-63; Accession=PF00069.15; Description=Protein kinase domain
  Pfam annotation: Domain name=Pkinase_Tyr; Domain location=4-222; Score=75.9; E_value=1.3e-19; Accession=PF07714.7; Description =Protein tyrosine kinase
  Pfam module annotation: Pfam domain module=Pkinase::Pkinase_Tyr; Domain location=3-222::4-222
MHQLCIVTQTSCILQEIALLSHLRHPNIVQYYGSETVDDKLYIYLEYVSGGSIYKLLQQYGQLSEIVIRNYTRQILLGLAYLHAKNTVHRDIKAANILVDPNGRVKLADFGMAKHISGQSCPLSFKGSPYWMAPEVIKNSNGCNLAVDIWSLGSTVFEMATTKPPWSQYEGVAAMFKIGNSKDLPAMPDHLSEDGKDFIRQCLQRNPVHRPSAAQLLLHPFVKKATLGRPVLSADPLEAKPDFVNTMRSLAIGPAKHNLGLVSEAAGTYLSRSLRTGSGSSEAHTPRNISYPVSPTGNPLLPPRLLHVSGRLSPSSPHTASGSSTPLTGGIGAVPFHQTKQPMFSHEGISVIQRPQSYQEPMHDPLWGILKSTLACPDIVSSNNDALGNHNRRVGQGLPRDFYDGKSYLADRVSQQLLNDHPIYSLGPQRWCQILNFRVDALGDMQL

SEQ ID NO: 196343 - protein, 263 aa, Glycine max
  Coding DNA Sequence Number=SeqID_79565
  Gene Ontology: Mol. function=glutamate-cysteine ligase activity; Cellular component=chloroplast; Biological process=glutathione biosynthetic process
  Homolog annotation: Hit_ID=Q6XXZ2; Match level="QueryCoverage=80%, HitCoverage=53%, E-value=8e-76, Identity=56%"; Hit description=Gamma- glutamylcysteine synthetase
  Pfam annotation: Domain name=GCS2; Domain location=1-216; Score=90.5; E_value=5.1e-24; Accession=PF04107.4; Description=Glutamate-cysteine ligase family 2(GCS2)
MEGDNIIGLKNGKQSISLEPGGQFELSGMPLKTLHQTCDEINSHLYQAKTVAEEMGIGFLGLGFQPKWRLEDIPGVPKVRYNIMQNHLHKFGPPAIESLFMTCSVQNLNQLAAALFANSPFKEGVPNGYLTIRRFEQYVDYALDVPMLFVYRKKQDFMASKLPAIPGQVPTLGDWENHLITIFPEVRLKRYMEMRGADDGPLEMLCALPAFWDEWCGGKQGRTALPPLTPYVYHVYVWGVDSQIVPVGIPFVFYRSIMGLHSH

SEQ ID NO: 196344 - protein, 95 aa, Glycine max
  Coding DNA Sequence Number=SeqID_79566
MTGGVVTMIVNGRDVSGDSSSDGGNNNHDRNNVASTMVLVGGHGSNDNDDVWTGAMEVEMTVAAMTSGSGHSDSNDDSGDNQWWWSVVKAAAADR

SEQ ID NO: 196345 - protein, 734 aa, Glycine max
  Coding DNA Sequence Number=SeqID_79567
  Gene Ontology: Mol. function=translation elongation factor activity; Biological process=transcription
  Homolog annotation: Hit_ID=Q1RY74; Match level="QueryCoverage=95%, HitCoverage=54%, E-value=0.0, Identity=58%"; Hit description=Bromo adjacent region; Transcription elongation factor S-II, central region
MGQELEFDLNDKSCVGLSPDTVLPPHQYCLNVKKRCKNGKPTGKDEFLQLKENFADINFGRFRSTSPKSLPCRSHGLEGNIEMTQGSKYPSSEQVINIKKMGTMRGRKKIEISSRSSDASFSGSVVDSLCGSDDENLSDSPSPSVSGSWTSIENNTSNGYIEFCINSDVWDEKYGAVEGIGSTEIRSEKVSGSPIDGNFHPKKETVHGLQKPLSSMVEISHMQSPSESDCSPRSSPKVSLTSIRKRLNSFTKSKSLTSPVSCVLETTVVKLTDTRNGTRNRTYQRSLLNDFFNTAKHSDIISDFINRDIQFSGLSCSPVHLHGNLKLKNKQGLPFFEFKVKCPEDVFVAKTWKSGNAFNWVYTFHSMDNRKKSTASDLGSHYCDEDSSMVAQMLVSSNSCSKLEGGVFDNSIVTQFVLYDLTHSSKHVSPEKKCYSEQHCSKTLKASHGGMKGETFRPDEETLSTKNKLLSGNADFDNSNSYPLSSTELHSNPEMAAIVLQIPFRKRESLKYKRRDRINAEAHSKLGDLSSGVDQSRKSLHDRKVLEQVKVVLPTGSHGLPSAESQGPSSLLDRWKHGGGCDCGGWDMACPLILLGNPSIQFAEDRTLMEGYQTLELFTQGAKERTPTFGMTMVEEGQYAVDFHANLSPLQAFSICVAILHGNSTFSGAGQEKNQQISRCNSLKMLLEEEVELFINSVTKEGNKNSLKGGAIAVAGLTLKLVASATFSACAYLN

SEQ ID NO: 196346 - protein, 466 aa, Glycine max
  Coding DNA Sequence Number=SeqID_79568
  Gene Ontology: Mol. function=translation elongation factor activity; Biological process=transcription
  Homolog annotation: Hit_ID=Q1RY71; Match level="QueryCoverage=94%, HitCoverage=78%, E-value=1e-131, Identity=55%"; Hit description =Bromo adjacent region; Transcription elongation factor S-II, central region
  Pfam annotation: Domain name=BAH; Domain location=88-207; Score=86.0; E_value=1.1e-22; Accession=PF01426.8; Description=BAH domain
  Pfam annotation: Domain name=TFIIS_M; Domain location=360-455; Score=- 21.8; E_value=0.055; Accession=PF07500.4; Description=Transcription factor S-II (TFIIS), ce
  Pfam module annotation: Pfam domain module=BAH::TFIIS_M; Domain location=88-207::360-455
MVNRRRLTRVATSDDEDEAPPRPQRTRKRMRLIEEDNDDDENEEEKEEEVPEPPQLAEDAKPLGQPVRVSGKGRGRKRHHDSFEFDGIQYTLEDPVLLVPEEKGQKPYVAIIKDITQSINGNVKVTGQWFYRPEEAEKKGGGNWQSCDTRELFYSFHRDDVPAEAVMHKCVVHFVPRHKQLPKRKDHPGFIVQKVYDTVERKLWRLTDKDYEEFKQQEIDVLVEKTQQRIGELLDLEPEEAPDDDGDQLKNKKSFRRKSVSPLDVSKEEEETLKSEQHPKSETPTGCITNGSEYYRILVDFNALTGDSHRDKWLERLLQRIQYMCDSNDSKERDKGLGNANSDEINNESKHRSSESATDCQDKVQKSSKSFNWPDVAVSAMVALEKASHDALSSDSMKYNQKLRQLAFNFQKNAVLARRLLSGELEPSKILNMTPNELKMNIQPFETTHIGTLVLILVLVLFGIAL

SEQ ID NO: 196347 - protein, 364 aa, Glycine max
  Coding DNA Sequence Number=SeqID_79569
  Gene Ontology: Mol. function=D-alanyl-D-alanine endopeptidase activity; Cellular component=integral to membrane; Biological process=cytochrome complex assembly
  Homolog annotation: Hit_ID=Q945B8; Match level="QueryCoverage=95%, HitCoverage=66%, E-value=1e-141, Identity=71%"; Hit description =Growth-on protein GRO10
  Pfam annotation: Domain name=PA; Domain location=78-175; Score=46.2; E_value=1.1e-10; Accession=PF02225.12; Description=PA domain
  Pfam annotation: Domain name=Peptidase_A22B; Domain location=229-364; Score=-92.9; E_value=1.6e-05; Accession=PF04258.4; Description=Signal peptide peptidase
  Pfam module annotation: Pfam domain module=PA::Peptidase_A22B; Domain location=78-175::229-364
MASEKISSILLFSAVILLVRDAPSAIAGDIVHDDDSTPKKPGCENQFVLVKVQTWVNGVEDVEFVGVGARFGRAIVSKEKNAKHTRLILSDPRDCCIPPKNKIVGDVIMVDRGNCTFTKKANIAQNANASAILIINNQKELYKMVCEPDETDLNIHIPAVMLPLDAVSVQLYSPFRPAVDIAEVFLWMMAVLTILCASYWSAWTTREAAIEQDKLLKDASDEIPNTKYASVSGVVNMNVKAAVLFVVFASCFLFMLYKLMSSWFIDVLVVLFCIGGIEDQDALIPCTGENHVIRWFKHAGESYIKVPFLGAISYLTLAVSPFCITFAVLWAVYRNVSFAWIGQDILGIALIITVLQIVHVPNLK

SEQ ID NO: 196348 - protein, 377 aa, Glycine max
  Coding DNA Sequence Number=SeqID_79570
  Gene Ontology: Mol. function=RNA-directed DNA polymerase activity; Biological process=RNA-dependent DNA replication
  Subcellular localization annotation: CTP_CleavageSite=44; ConfidenceScore=5.17e-01
MYSFQIVARSPLCFRLKIKSISNRFFQQRFSEPMQCRPQLNGISFSNIGQQQNQMLALLGKWRWEMLQQSNKLWSKILDSKYGGWRSLVEGSRRNNESGWWKDLMEVTHDQQMNSILQDGTTWRVGCGDKIKFWEDSWAGHRQALKMKYPRLYRISLQQHKLIQQVGSFNDSSWEWNLSWRRSLFDNEIASAAGFLEEICQITIRRHIADCWKWEAEPNGCYSTRSAYNMLQESSVGANPDEALIQQEDAAHLFFNYTKSLALWWESLAWTGIVGAFPIIPRYHFLQHQNGMNGGKRNNRWKCWWVALTWRAHKPWGFDDVEDVDEEKDKEEQNKKKIKEVSHECSLVNKHKAIWMTKPEEITKEEYSAFYKSLTND

SEQ ID NO: 196349 - protein, 191 aa, Glycine max
  Coding DNA Sequence Number=SeqID_79571
  Gene Ontology: Mol. function=hydrolase activity, acting on ester bonds; Biological process=nucleobase, nucleoside, nucleotide and nucleic acid metabolic process
  Homolog annotation: Hit_ID=Q9M3H7; Match level="QueryCoverage=73%, HitCoverage=90%, E-value=4e-44, Identity=72%"; Hit description =Hypothetical 19.6 kDa protein
  Pfam annotation: Domain name=UPF0081; Domain location=19-128; Score= -30.3; E_value=0.0017; Accession=PF03652.6; Description =Uncharacterised protein family (UPF0081)
MRYMKPLQLFHDLKNQQRGRLLGLDVGDKYVGLALSDFDNNIASPFSVLVRKKTNITLVASDFESLCSDLSNKTSKHVIGISFDKHQVSSDAMQVKVFTDHLCKTKMLEECGVAVKAFKLESFSSLQDYARQVCCSRNTSAGGMHQKSQLDTSEFKVGWRTVGEGKSCSMGDQTSIINITFIFCRPELMSI

SEQ ID NO: 196350 - protein, 157 aa, Glycine max
  Coding DNA Sequence Number=SeqID_79572
  Gene Ontology: Mol. function=transferase activity, transferring glycosyl groups; Cellular component=membrane
  Homolog annotation: Hit_ID=Q10RW1; Match level="QueryCoverage=74%, HitCoverage=23%, E-value=2e-25, Identity=45%"; Hit description =Xyloglucan galactosyltransferase KATAMARI 1, putative, expressed
  Pfam annotation: Domain name=Exostosin; Domain location=1-85; Score= -109.3; E_value=0.048; Accession=PF03016.6; Description=Exostosin family
SEFCLQPPGDSPTRKSVFDSLISGCIPVLFDPFTAYYQYPWHLPHDHDKYSVFMDKKEVVQMNVNVVERLTNISSRERENMRRYITYELLPGLVYGDYNAELDKFQDAFAITMNNLFERVNSVNIENIPLHCILVILNLEASRTTDCGPQVVVLYLP

SEQ ID NO: 196351 - protein, 45 aa, Glycine max
  Coding DNA Sequence Number=SeqID_79573
  Gene Ontology: Mol. function=DNA binding; Cellular component=nucleus; Biological process=regulation of transcription, DNA-dependent
  Homolog annotation: Hit_ID=O65409; Match level="QueryCoverage=93%, HitCoverage=12%, E-value=3e-14, Identity=81%"; Hit description=Myb -related protein
MAKSSTEKNGLKKGPWTPEEDQKLIDYIQKHGHGKWRTLPKNADS

SEQ ID NO: 196352 - protein, 276 aa, Glycine max
  Coding DNA Sequence Number=SeqID_79574
  Gene Ontology: Mol. function=transferase activity, transferring glycosyl groups; Cellular component=membrane
  Homolog annotation: Hit_ID=Q5Z9Y2; Match level="QueryCoverage=38%, HitCoverage=21%, E-value=7e-23, Identity=44%"; Hit description =Putative xyloglucan galactosyltransferase
MAVSISRKRSKSSRKPEAKQSYFCLTIVYNFLSRISALVFLIILIYMWSSFSTLITGNIIHVCFSTRKVNSLYCLSAGTHPSLEIPTSTTNNSSSIITPGIDQGNATNEPAKFPDISYLVTTSSRVDIKDRDDKVANAVKVVEEQLQLHRSWRSKSSKNQATCDAQGIYVYDLPSKFNKDLVGQCRDMVPWQNFCGYLSNEGLGEPIAKLGKGWYKTHQYSLELIFHSRVMKHPCRVYDENVAKLFYVPFYGGLDILRWHFKNVSNDVKDSLSLEL

SEQ ID NO: 196353 - protein, 46 aa, Glycine max
  Coding DNA Sequence Number=SeqID_79575
MGSMCDEMSSSPSSVKKLPSEVPTGKVGKRVAVAENMINSGGEKFM

SEQ ID NO: 196354 - protein, 1006 aa, Glycine max
  Coding DNA Sequence Number=SeqID_79576
  Gene Ontology: Mol. function=transferase activity; Cellular component= integral to membrane; Biological process=response to oxidative stress
  Homolog annotation: Hit_ID=Q8H2Q5; Match level="QueryCoverage=99%, HitCoverage=99%, E-value=0.0, Identity=59%"; Hit description =Putative anthranilate phosphoribosyltransferase
  Pfam annotation: Domain name=C2; Domain location=272-352; Score=90.6; E_value=4.8e-24; Accession=PF00168.20; Description=C2 domain
  Pfam annotation: Domain name=C2; Domain location=436-518; Score=86.7; E_value=7.1e-23; Accession=PF00168.20; Description=C2 domain
  Pfam annotation: Domain name=C2; Domain location=598-688; Score=79.7; E_value=9.4e-21; Accession=PF00168.20; Description=C2 domain
  Pfam annotation: Domain name=C2; Domain location=6-91; Score=90.0; E _value=7.4e-24; Accession=PF00168.20; Description=C2 domain
  Pfam annotation: Domain name=PRT_C; Domain location=851-1006; Score =418.8; E_value=7.4e-123; Accession=PF08372.1; Description=Plant phosphoribosyltransferase C-terminal
  Pfam module annotation: Pfam domain module=C2::C2::C2::C2::PRT_C; Domain location=272-352::436-518::598-688::6-91::851-1006
MNNFKLGVDVVSAHNLLPKDGQGSSNAFVELYFDGQKYRTTIKERDLNPVWNESFYFNISDPSNLHYMALDVYIHCHTKATNSTSFLGKVSLTGTSFVPYSDAVVLHYPLEKRGIFSRVRGEIGLKVYITNDPTIKSSIPTPVVESMPTNYSSSTHSEVRAPASTMTNSLPNEKVESRHTFHHLPNTNHHQHQQHSSGFADTHYVTKYEADAMKSEPQPMKLVRTATSVQPVDFALKETSPYLGGGRVVGGRIVHKDKTASTYDLVERMYFLYVRVVKARELPAMDVTGSLDPFVEVRIGNYKGITRHFDKNQSPEWNQVFAFSKDRMQASVLDVVIKDKDLIKDDFVGIVRFDINEVPLRVPPDSPLAPEWYRLEDKKGEKNKGELMLAVWIGTQADEAFSDAWHSDAATPVDSTHAISAVMRSKVYHAPRLWYVRVNVVEAQDLVPTEKNRFPDVYAKVQIGNQVLKTKTVPARTLSALWNEDLLFVAAEPFEDHLIISVEDRVSPGKDEIIGRIIIPLNSVERRADDRIIHSRWFNLEKPVAIDVDQLKKEKFSSRIQLRLCLDGGYHVLDESTHYSSDLRPTAKQLWKPPIGVLELGVLNAVGLHPMKTRDGRGTSDTYCVAKYGHKWVRTRTIADNLCPKYNEQYTWEVFDHATVLTVGVFDNSQLGEKANGSSKDLKIGKVRIRISTLETGRIYTHSYPLLVLHPTGVKKMGELHLAIRFSCTSFANMLYLYSRPLLPKMHYVRPFSVTQLDMLRHQAMNIVAARLGRAEPPLRKEVVEYMSDVDSHLWSMRRSKANFFRLMTVFSGVFAVGKWFGDICMWRNPITTVLVHVLFLMLVCFPELILPTIFLYMFLIGVWNFRYRPRYPPHMNTRISQAEAVHPDELDEEFDTFPTSRSPDLVRMRYDRLRSVAGRIQTVVGDLASQGERIQALLSWRDPRATSIFITLSLLSALVLYVTPFQAVAGLAGFYIMRHPRFRHRLPCTPVNFFRRLPSRTDTML

SEQ ID NO: 196355 - protein, 334 aa, Glycine max
  Coding DNA Sequence Number=SeqID_79577
  Homolog annotation: Hit_ID=Q6CQE3; Match level="QueryCoverage=9%, HitCoverage=26%, E-value=2e-08, Identity=87%"; Hit description =Kluyveromyces lactis strain NRRL Y-1140 chromosome D of strain NRRL Y- 1140 of Kluyveromyces lactis
VGHDGALTSLRPLQGTWARSATEDASPDYNSDAEGDRFSWWAFPGLVGSVRARKRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVVESHNLSPCARSAGVCVVARTRSGRTGRRGHPLPPDGIDNDPSAGSPTETLLRLLLPLNDKVQWTSHNVAGSEPLTSPQSEHFTGPFNSARSDGRLRSRSLTELTRQIAPPTKNGHAPPPIESRKSSQSVNPYYVWTCLATILPPEPKDFDFSYGASGVLKQHPLIL

SEQ ID NO: 196356 - protein, 347 aa, Glycine max
  Coding DNA Sequence Number=SeqID_79578
  Gene Ontology: Mol. function=motor activity; Cellular component =myosin complex
  Homolog annotation: Hit_ID=Q1T0L3; Match level="QueryCoverage=99%, HitCoverage=28%, E-value=1e-130, Identity=70%"; Hit description=IQ calmodulin-binding region; Myosin head, motor region; Myosin, N- terminal, SH3-like
  Pfam annotation: Domain name=IQ; Domain location=12-32; Score=23.3; E_ value=0.00089; Accession=PF00612.17; Description=IQ calmodulin -binding motif
  Pfam annotation: Domain name=IQ; Domain location=35-55; Score=21.1; E_ value=0.0039; Accession=PF00612.17; Description=IQ calmodulin-binding motif
  Pfam annotation: Domain name=IQ; Domain location=72-92; Score=26.8; E_ value=7.8e-05; Accession=PF00612.17; Description=IQ calmodulin -binding motif
  Pfam module annotation: Pfam domain module=IQ::IQ::IQ; Domain location=12-32::35-55::72-92
IGALEDRRQHLLQGILGIQKSFRGYQARCHYHELKNGVTILQSFVRGEIARRKYGVMVKSSMTITFENIEEIQAATTLQSVIRGWLVRRHASGLHKSKKSPENARSRRRSRVKMPEVKDVSSERGQNLPSALAELQRRVIKAEATIEQKEEENAELKEQLKQFERRWIEYEKRMKSMEEMWQKQMSSLQMSLAAARKSLASENVSGQIARRDVASPLGYDSEDAASMGSRTPRTPHASTPLKYSSSLTEAGAGRDVNGTLTSVSNLMKEFEQRRHTFDDDARALVEIKTGQSANTNSVEELRKLKHRFEGWKKEYKARLRETKARLHKSEMEKSRRRWWGKLSSRAL

SEQ ID NO: 196357 - protein, 849 aa, Glycine max
  Coding DNA Sequence Number=SeqID_79579
  Gene Ontology: Mol. function=motor activity; Cellular component =myosin complex; Biological process=negative regulation of actin filament polymerization
  Homolog annotation: Hit_ID=Q1T0L3; Match level="QueryCoverage=96%, HitCoverage=71%, E-value=0.0, Identity=76%"; Hit description=IQ calmodulin-binding region; Myosin head, motor region; Myosin, N- terminal, SH3-like
  Pfam annotation: Domain name=Myosin_N; Domain location=137-178; Score= 35.2; E_value=2.3e-07; Accession=PF02736.9; Description=Myosin N -terminal SH3-like domain
  Pfam annotation: Domain name=Myosin_head; Domain location=190-820; Score=894.0; E_value=6.9e-266; Accession=PF00063.11; Description =Myosin head (motor domain)
  Pfam module annotation: Pfam domain module=Myosin_N::Myosin_head; Domain location=137-178::190-820
MMITASMSSLTRSSLEEMLESLRRRDEEEKPKDLPPALPSRPPSRARLPPGRRSLPNNFKVDGENGLMGHRRKGSFGTKKVKLNVESPYEVQSEEIVSEQLSPCPVSTSDDASAGCEAPPPTGELEDDNVVYFIKKKLHVWCRQPKGKWELGTIQSTSGEEASVSLSNGNVMKVSRSELLPANPDILEGVEDLIQLSYLNEPSVLHNLQSRYSQDMIYSKSGPILIALNPFKDVQIYGDDYISAYRQKLMDKPHVYAMADAAYNEMMRDEVNQSIIISGESGSGKTETAKIAMQYLAALGGGCSGIENEVLQTNFILEAFGNAKTSRNDNSSRFSRVVQLALGERSYHIFYQLCAGSSSDLKERLNLRAASEYKYLNQSDCMTIDGVDDAKKFHRLMKALDVIRMCKEEQELVFKMLAAILWLGNISFQDTDNENHIEVVNDEAVTNAALLMGCSSHELMEALSTRKIQAGKDTITKTLTLRQAIDARDALAKFIYASLFDWLVEQVNKSLEVGKRRTGRSISILDIYGFESFQNNSFEQFCINYANERLQQHFNRHLFKLEQEDYELDGIDWTKVDFEDNQACLDLFEKRPLGLLSLLDEESNFPRASDLTLANKLKQHLHANPCFKGERGRAFSVCHYAGEVLYDTSGFLEKNRDPLPSDSIQLLSSCSCELLQLFSKTLNQSQKQSNSLYGGALDSQKQSVGTKFKGQLFKLMHQLESTTPHFIRCIKPNTKQHPGIYDEDLVLQQLKCCGVLEVVRISRAGYPTRMTHQEFSQRYGFLLSEANTSQDPLSISVAILQQFNIPPEMYQVGFTKLYLRTGQPKSHRIGSWIMLLGWQLGPLSMTLHI

SEQ ID NO: 196358 - protein, 120 aa, Glycine max
  Coding DNA Sequence Number=SeqID_79580
  Gene Ontology: Mol. function=actin binding; Cellular component =intracellular; Biological process=cell division
  Homolog annotation: Hit_ID=Q1RY49; Match level="QueryCoverage=96%, HitCoverage=76%, E-value=4e-45, Identity=82%"; Hit description=Actin- binding, cofilin/tropomyosin type
  Pfam annotation: Domain name=Cofilin_ADF; Domain location=14-117; Score=56.9; E_value=6.6e-14; Accession=PF00241.10; Description =Cofilintropomyosin-type actin-binding pr
MGQANAASGMAVHDDCKLRFQELKAKRVYRFITFKIEQQQVVVDKIGESTESYDDFQASLPADECRYAVYDFDFTTDENCQKSKIFFIAWYWSITGHTNLHLVTRHFKGEDEDGVCKFQG

SEQ ID NO: 196359 - protein, 350 aa, Glycine max
  Coding DNA Sequence Number=SeqID_79581
  Gene Ontology: Mol. function=protein-tyrosine kinase activity; Cellular component=integral to membrane; Biological process=protein amino acid phosphorylation
  Homolog annotation: Hit_ID=Q8GY10; Match level="QueryCoverage=94%, HitCoverage=49%, E-value=1e-108, Identity=59%"; Hit description =Putative receptor protein kinase
  Pfam annotation: Domain name=LRRNT_2; Domain location=25-66; Score =39.7; E_value=9.9e-09; Accession=PF08263.3; Description=Leucine rich repeat N-terminal domain
  Pfam annotation: Domain name=LRR_1; Domain location=119-141; Score =14.1; E_value=0.52; Accession=PF00560.23; Description=Leucine Rich Repeat
  Pfam annotation: Domain name=LRR_1; Domain location=143-165; Score =13.1; E_value=1; Accession=PF00560.23; Description=Leucine Rich Repeat
  Pfam annotation: Domain name=LRR_1; Domain location=167-190; Score =11.6; E_value=1.9; Accession=PF00560.23; Description=Leucine Rich Repeat
  Pfam annotation: Domain name=LRR_1; Domain location=212-234; Score =6.0; E_value=21; Accession=PF00560.23; Description=Leucine Rich Repeat
  Pfam annotation: Domain name=LRR_1; Domain location=71-93; Score=5.2; E_value=31; Accession=PF00560.23; Description=Leucine Rich Repeat
  Pfam annotation: Domain name=LRR_1; Domain location=95-117; Score =13.4; E_value=0.83; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=25-66::119-141::143-165::167 -190::212-234::71-93::95-117
MKPCTSLLFLALISALSFVVSDMVPSNEVWALRSFKEAVYEDPYQVLSNWDTVESDPCNWFGVLCTMLRDHVIKLNISGSSLKGFLAPELGQITYLQELILHGNSFIGTIPRELGVLESLKVLDLGMNQLTGPIPAEIGNLTQVVKINLQSNGLTGRLPPELGNLRYLQELQLDRNRLQGPVPAGGSANFASNMHGMYASKENVTGFCRSSQLKVADFSFNFLVGSIPKCLEYLPRLNFQGNCLQGQDLKQRSSIQCAGASPASAKSQPVVNPNHQPAEYVSKHHRASKPVWLLALEIVTGTMVGSLFLVAVLAAFQRCNKKSSIIIPWKKSGSQKDHTAVYIDPELLKM

SEQ ID NO: 196360 - protein, 180 aa, Glycine max
  Coding DNA Sequence Number=SeqID_79582
  Gene Ontology: Mol. function=transferase activity; Cellular component= nucleolus
  Homolog annotation: Hit_ID=Q6YWQ2; Match level="QueryCoverage=98%, HitCoverage=99%, E-value=4e-40, Identity=48%"; Hit description =Acidic 82 kDa protein-like
  Pfam annotation: Domain name=Fcf2; Domain location=67-147; Score =122.7; E_value=1e-33; Accession=PF08698.1; Description=Fcf2 pre-rRNA processing
  Subcellular localization annotation: CTP_CleavageSite=35; ConfidenceScore=5.07e-01
MPERKPVVGLSWQPQLPIPSSLKATDGSHTKPQTEASSTVRKSSSELVDGLFVPPNDPKKLNKLLRKQAKDTAGKNWFNMPAQTITPELQKDLKLLKLRAALDPKRHYKKDSPLDFFSGRLTKKERKATLADELLSDQNLAAYRKRKVREIEEQNRPAGNEKWKIKGSNSRKRAKERRIY

SEQ ID NO: 196361 - protein, 115 aa, Glycine max
  Coding DNA Sequence Number=SeqID_79583
  Gene Ontology: Mol. function=DNA binding; Biological process=DNA integration
  Homolog annotation: Hit_ID=Q9L5J4; Match level="QueryCoverage=73%, HitCoverage=18%, E-value=1e-20, Identity=58%"; Hit description =Putative transposase
  Subcellular localization annotation: CTP_CleavageSite=40; ConfidenceScore=5.21e-01
MSSANVKCTKQQAMVSLPVLAYQRGTKINILRLQRGSSMKAANVFVETCHTVYNRRFGKIPRHDFDVHRPVEYDDNLDLIFTIRETRKVSKALTKQCDKMLYLIEEIEYSHLAIG

SEQ ID NO: 196362 - protein, 64 aa, Glycine max
  Coding DNA Sequence Number=SeqID_79584
  Homolog annotation: Hit_ID=UPI0000E692DA; Match level="QueryCoverage =60%, HitCoverage=8%, E-value=2e-07, Identity=65%"; Hit description =sodium:alanine symporter family protein
MQGSGTHDSSAIAVSHPAKQRLLRKTVFTCLNDYEALLAKGYGPIFHPEMLGIKRGYWVGRVWK

SEQ ID NO: 196363 - protein, 93 aa, Glycine max
  Coding DNA Sequence Number=SeqID_79585
  Subcellular localization annotation: CTP_CleavageSite=59; ConfidenceScore=5.31e-01
MGDQAKSMHNISTNRNIEHIKTTSNRYFSSVLHSTLGSRRLFKPLLHSLQFRLKKGFLSAKARLARVCEIWLSAILALSAEETIFSLNELMTH

SEQ ID NO: 196364 - protein, 138 aa, Glycine max
  Coding DNA Sequence Number=SeqID_79586
  Homolog annotation: Hit_ID=Q1SWX1; Match level="QueryCoverage=85%, HitCoverage=33%, E-value=2e-14, Identity=41%"; Hit description=IMP dehydrogenase/GMP reductase
MGSSQMPSLKKRFYQVKVKSLGTTSLKELGQLMGQLQWQAFRKAYGKILDLAMVEVSTEAIASLTQYYDQPMRCFTFGDFQLSPMVEEFEEIIGCPLGGRKPYLFSGYSRTADLRRGPLSECGWVGGPSSNRCFSRLS

SEQ ID NO: 196365 - protein, 84 aa, Glycine max
  Coding DNA Sequence Number=SeqID_79587
  Homolog annotation: Hit_ID=Q1SDS1; Match level="QueryCoverage=94%, HitCoverage=15%, E-value=8e-07, Identity=37%"; Hit description=IMP dehydrogenase/GMP reductase
MGTRGCISYNPVLAIRQLGYPMRGAPLEDELVPVISRGFNKTNVETLQKVHKAWEVLQKKDKELRGSNNGPIGGYRKWLKPSCK

SEQ ID NO: 196366 - protein, 167 aa, Glycine max
  Coding DNA Sequence Number=SeqID_79588
  Subcellular localization annotation: CTP_CleavageSite=69; ConfidenceScore=5.00e-01
GLHTLAFRGLHTLAFKGRRALNFRGLHALAFRGLRVLTFSGLHIHTLRGFKATNCASTTREGGKISPVSLQSDEGCAHKTPSGPGGAQQGPGVFSSGYEPLVLELPALITGLCQFYGVLVAPSKVIRPPTNRAFIKKYYAPRQAQGETPQQPGDGRQWAIDAPPPPL

SEQ ID NO: 196367 - protein, 270 aa, Glycine max
  Coding DNA Sequence Number=SeqID_79589
MSSRKRKSGGSRPTTQYDTRRFHSFEAWTRYTDNVQGRHILAERKVEIYHTVLDEFKAKLERRNFHKHLTKLVDSSIDLALVKEFYANLYSPEGPSPKQGEPLSAYSRYCRMPTDIKEIETALCIPGRGFILNAEGHPRKILIKDLTTLAQVWSVLSYFNLAPTSHSSNLTVDRAKLIFGLVTQLDMNVRALISGQITSMAQSNSSRLEFPALITALCRSRGVASDSLVFERLSPVISLAYIRKNYWNPDDPTIIIRGARRPRAMPAEAP

SEQ ID NO: 196368 - protein, 137 aa, Glycine max
  Coding DNA Sequence Number=SeqID_79590
  Gene Ontology: Mol. function=cysteine-type endopeptidase activity; Cellular component=endoplasmic reticulum; Biological process =proteolysis
  Homolog annotation: Hit_ID=Q6RCL9; Match level="QueryCoverage=98%, HitCoverage=38%, E-value=1e-43, Identity=65%"; Hit description =Putative cysteine protease 1
  Pfam annotation: Domain name=Peptidase_C1; Domain location=28-136; Score=48.6; E_value=4e-15; Accession=PF00112.13; Description=Papain family cysteine protease
RNGLKRTYEFSTTTFKLNGFKYENVTDIPEAIDWRVKGAVTPIKDQGDQCGSCWAFSTIAATEGIHQISTGNLVSLSEQELVDCDSVDDGCEGGFMEDGFEFIIKNGGITSETNYPYKGVDGTCNTTIAASPVAQIK

SEQ ID NO: 196369 - protein, 84 aa, Glycine max
  Coding DNA Sequence Number=SeqID_79591
  Subcellular localization annotation: CTP_CleavageSite=44; ConfidenceScore=5.03e-01
MNSLLEFKATGIIQGSLLNNKEKNKMKDCKTTSGEDVSFTSRISQSLTNSSQALKPALVSSSGLCRSSHIKISQNSLELGPFSL

SEQ ID NO: 196370 - protein, 54 aa, Glycine max
  Coding DNA Sequence Number=SeqID_79592
MGVDDNVCLHAPLDLIVSEMGADDHDLSSGAIRLDCLWIAKRVYDAILLRKGIG

SEQ ID NO: 196371 - protein, 350 aa, Glycine max
  Coding DNA Sequence Number=SeqID_79593
  Gene Ontology: Mol. function=protein serine/threonine kinase activity; Cellular component=spindle pole body; Biological process =protein amino acid phosphorylation
  Homolog annotation: Hit_ID=Q6JJ37; Match level="QueryCoverage=99%, HitCoverage=62%, E-value=1e-133, Identity=68%"; Hit description =Putative serine/arginine (SR) protein kinase protein
  Pfam annotation: Domain name=Pkinase; Domain location=40-341; Score= -25.8; E_value=5e-07; Accession=PF00069.15; Description=Protein kinase domain
  Pfam annotation: Domain name=Pkinase_Tyr; Domain location=40-341; Score=-156.7; E_value=0.0075; Accession=PF07714.7; Description =Protein tyrosine kinase
  Pfam module annotation: Pfam domain module=Pkinase::Pkinase_Tyr; Domain location=40-341::40-341
MAEDRSEASDYSSEDEGTEDYRRGGYHAVRIGDTFKNGSYVVQSKLGWGHFSTVWLAWDTHKSRFVALKIQKSAQHYTEAAMDEIKILKQIADGDPDDKKCVVKLLDHFKHSGPNGQHVCMVFEFLGDNLLTLIKYSDYRGVPLPMVKEICFHILVGLDYLHRELSVIHTDLKPENVLLLSPIDPSKDPRKLGIPLILPNTKDKTVTKNGATIANKSLNGDLTKNQKKKLRKKAKKAAQSCAGRENAEEAEEDSKASDEQDDCSNDVKPSVESGEVKPNSPVRKDESTKTSENKDIPQGSHGNRRGSRSTRKKLLAAVDLKCKLVDFGNACWTYKQFTNDIQTRQYRCPE

SEQ ID NO: 196372 - protein, 414 aa, Glycine max
  Coding DNA Sequence Number=SeqID_79594
  Gene Ontology: Mol. function=metal ion transporter activity; Cellular component=membrane; Biological process=regulation of transcription, DNA-dependent
  Homolog annotation: Hit_ID=Q9FFC4; Match level="QueryCoverage=80%, HitCoverage=70%, E-value=1e-116, Identity=67%"; Hit description =Arabidopsis thaliana genomic DNA, chromosome 5, P1 clone:MRN17
  Pfam annotation: Domain name=CorA; Domain location=121-410; Score =150.6; E_value=4.2e-42; Accession=PF01544.9; Description=CorA-like Mg2+ transporter protein
  Subcellular localization annotation: CTP_CleavageSite=32; ConfidenceScore=5.11e-01
MALFWPHVLQFRSQPSLGHANCVFFSDLTESRSVELSCTDSFTLVRRCKISGPAPAALKPVKCLGRSTGEKQWSDAETAVSDTDEVADEPNDRNQTSVPTNGRVESQRIATTSSGDSLSLGIREPVVEVRSNGKVSTRKINRRQLLKSSGLRPRDIRSVDPSLFMTNSMPALLVREYAILLNLGSLRAIAMQDCVLIFDNNRIGGKAFLETLLPRLNPKNNNGGPSMPFELEVVEAALLSRIQRLEQRLMDLEPRVQALLEALPNRLTGDILEQLRISKQTLVELGSKAGALRQMLLDLLEDPHEIRRICIMGRNCTLSKGNNDMECSVPFEKQNAEEEEEEIEMLLENYLQRCESCHGQAERLLDSAREMEDSIAVSLRKFCALLKPRIYQPWDCVWSAIFGCNVVAQSHNSH

SEQ ID NO: 196373 - protein, 359 aa, Glycine max
  Coding DNA Sequence Number=SeqID_79595
  Gene Ontology: Mol. function=binding
  Homolog annotation: Hit_ID=Q9FFC5; Match level="QueryCoverage=84%, HitCoverage=58%, E-value=6e-68, Identity=42%"; Hit description =Arabidopsis thaliana genomic DNA, chromosome 5, P1 clone:MRN17
MAVPADPIIEVEEVEEDGPTHHPPAPSHEFFDLSTTVDPSYIISLIRKLLPLDSASRRSLSEVASHGTNQGEEERGAAPSSSVSSDENLKSSKNKSENMDVDVSGEISRGECQDTGDGIEHSSVSVGEDAWEEYGCILWDLAASKTHAELMVENLILEVLLGNLLVCKSERVTEISIGIIGNLACHEVPMKHIISTEGLIEIILDKLFMDDPQCLCETCRKYIEPSAFREAILESQQKVVDAILPPMMKLGLANILISLLTFEISKLMTERIPERYSILDLILRAIEALSVMDDHSQEICSSSELFQLLCDLVKFPDKVEVHCYDHPYHRAPQDLPSDLLTPIDSHKMMLTKMVADRMR

SEQ ID NO: 196374 - protein, 330 aa, Glycine max
  Coding DNA Sequence Number=SeqID_79596
  Gene Ontology: Mol. function=hydrolase activity, acting on ester bonds; Cellular component=cellulose and pectin-containing cell wall; Biological process=lipid metabolic process
  Homolog annotation: Hit_ID=Q9FFC6; Match level="QueryCoverage=94%, HitCoverage=99%, E-value=1e-109, Identity=60%"; Hit description=GDSL- motif lipase/hydrolase-like protein
  Pfam annotation: Domain name=Lipase_GDSL; Domain location=29-321; Score=181.6; E_value=1.9e-51; Accession=PF00657.12; Description=GDSL- like LipaseAcylhydrolase
MGFSSYFLTSLLLVVVFNVAKGQPLVPALFIFGDSVVDVGNNNHLYTVVKANFPPYGRDFKNHNPTGRFCNGKLASDYTAENLGFTSYPPAYLNLKAKGNNLLNGANFASAASGYYDPTAKLYHAIPLSQQLEHYKECQNILVGTVGQPNASSIISGAIYLISAGNSDFIQNYYINPLLYKNLYALGARRIGVTSLPPMGCLPAAITLFGSDSNRCVVKLNNDSVNFNKKLNTTSQSLQKSLSGLKLVILDIYQPLYDLVTKPSENGFFEARKACCGTGLLETSVLCNQKSIGTCANASEYVFWDGFHPSDAANKVLSDDLLAAGISLIS

SEQ ID NO: 196375 - protein, 60 aa, Glycine max
  Coding DNA Sequence Number=SeqID_79597
MTQDHEGRNGRGKFCLVILSGLCTATLPPYRIMFNHNTRGFDFLVALMRASGCHLLSFGE

SEQ ID NO: 196376 - protein, 680 aa, Glycine max
  Coding DNA Sequence Number=SeqID_79598
  Gene Ontology: Mol. function=signal transducer activity; Cellular component=membrane; Biological process=response to light stimulus
  Homolog annotation: Hit_ID=Q6JJ40; Match level="QueryCoverage=90%, HitCoverage=97%, E-value=0.0, Identity=66%"; Hit description =Putative non-phototropic hypocotyl 3-like protein
  Pfam annotation: Domain name=NPH3; Domain location=208-471; Score =330.5; E_value=2.9e-96; Accession=PF03000.5; Description=NPH3 family
MAPAGKLSGFRREGSDWFCNGGLPSDITVSVDGVTFHLHKFPLVSKCGKIARAHEESKNTNETLKMVLEEFPGGPDTFLIAAKFCYGYRVELTARNVVSVHCGAEYLEMTDEFGEGNLLSKSESFFHKNTLRNWKDCILALQSSEPVLPRAEKLHLVGKCLNALSMMVCTDPSLFGWPMMMYGSFQSPGGSILWNGINTGARIRSSESDWWFEDISYLSVSLFERLIKTMQARGIRPENLAGAIMYYSRKHLPGLGRWQGGQGGKTRTVASFSLTPATVDQRVLLESIEKLLPDKKGKSYCRFLLGLLRVALILNVSQTCKDSLERRIGMQLELATLDSLLIPTYSDSDALYNTNCIEQIVHYFVSTESNLTPFSPSSLDLQASASPSSESLRKVAKLIDNYIAEIASDVNLKPGKIRKLAEALPESSRLLHDGLYRALDIYFKAHPWLYDREKEELCNIIDYQKLSIHACAHASQNDRLPLRVVLQVLFFEQLHLRTALTRCLNALDGEIAPAAPVPITALGNTAGEIVQRDGWVTVVRENQVLKVDMDRMSSRVGELEEEFGKIKQEMKSATKSHSSRSSPRLVARKIGCKLVPQPSDAQPESLNHTGSTPRASIELKDVVLDPFVKNIIAIEERIIQVPPSADAKLMHKVALAEWLRRVPAKYMGFPRESSNLSGDA

SEQ ID NO: 196377 - protein, 181 aa, Glycine max
  Coding DNA Sequence Number=SeqID_79599
  Gene Ontology: Mol. function=structural molecule activity; Cellular component=clathrin coat of trans-Golgi network vesicle; Biological process=intracellular protein transport
  Homolog annotation: Hit_ID=Q9FNI4; Match level="QueryCoverage=100%, HitCoverage=17%, E-value=5e-95, Identity=94%"; Hit description=Alpha- adaptin
MEAVSLISAPKYPEKQVGYIVTSSLLNENHDFLRLAINTVRNDIIGRNETFQCLALTMVGNIGGREFAESLAPDVQKLLISSSCRPLVRKKAALCLLRLYRKNPDVVNVDGWADRMAQLLDERDLGVLTSSMSLLVALVSNNHEAYRSCLPKCIKILERLARNQDIPQEYTYYGIPSPWLQ

SEQ ID NO: 196378 - protein, 567 aa, Glycine max
  Coding DNA Sequence Number=SeqID_79600
  Gene Ontology: Mol. function=structural molecule activity; Cellular component=clathrin coat of trans-Golgi network vesicle; Biological process=intracellular protein transport
  Homolog annotation: Hit_ID=Q6JJ39; Match level="QueryCoverage=97%, HitCoverage=55%, E-value=0.0, Identity=74%"; Hit description =Putative adapitin protein
  Pfam annotation: Domain name=Adaptin_N; Domain location=1-301; Score=- 120.4; E_value=0.00084; Accession=PF01602.10; Description=Adaptin N terminal region
  Pfam annotation: Domain name=Alpha_adaptinC2; Domain location=465 -562; Score=-5.5; E_value=0.015; Accession=PF02883.10; Description =Adaptin C-terminal domain
  Pfam module annotation: Pfam domain module=Adaptin_N::Alpha _adaptinC2; Domain location=1-301::465-562
MRALQYFPTIEDPNARRSLFEVLQRILMGTDVVKNVNKNNASHAVLFEALALVMHLDAEKEMMSQCVALLGKFIAVREPNIRYLGLENMTRMLMVTDVQDIIKRHQAQIITSLKDPDISIRRRALDLLYGMCDVSNAKDIVEELLQYLSTAEFAMREELSLKAAILAEKFAPDLSWYVDVILQLIDKAGDFVSDDIWFRVVQFVTNNEDLQPYAAAKAREYLDKPAIHETMVKVSAYILGEFGHLLARRPGCSPKELFSIIHEKLPTVLLIHLLIFRYESSIEVEIQQRSVEYFALSRKGAALMDILAEMPKFPERQSALIKKAEDTEVDTAELSAIKLRAQQQSQTSNALVVTGQSHANGTPPVGQLSLVKVPSMSSNADEADQRLSQENGTLSKVDSQPPSADLLGDLLGPLAIEGPPGISVHPQPSSNSGLEGTVVEATAIVPAGEQANSVQPIGNIAERFHALCMKDSGVLYEDPYIQIGIKAEWRAHQGHLVLFLGNKNTSPLVSVQALILHPTHLKMELSLVPETIPPRAQVQCPLEVINLHPSRDVAVSLTSPTSLVTIW

SEQ ID NO: 196379 - protein, 69 aa, Glycine max
  Coding DNA Sequence Number=SeqID_79601
MKVLEKRALDVEASNKLNKEEVEWLEATLATAERERNAEKEERIGPTTPLGETQMTNSTEEDVDEAPRG

SEQ ID NO: 196380 - protein, 1123 aa, Glycine max
  Coding DNA Sequence Number=SeqID_79602
  Gene Ontology: Mol. function=zinc ion binding; Biological process =proteolysis
  Homolog annotation: Hit_ID=UPI0000196E5D; Match level="QueryCoverage =82%, HitCoverage=59%, E-value=0.0, Identity=42%"; Hit description =DNA binding / protein binding / zinc ion binding
  Pfam annotation: Domain name=PHD; Domain location=804-854; Score=6.6; E_value=0.012; Accession=PF00628.19; Description=PHD-finger
MAMLEYWNISEKFLPICVSRLTPMVEEEHKAVSSVKEEYSLMFGNGICGDNLVPSLDASLVTTRSPAPGSSGNARTTVNLKLNEETAMDSTVSTVNHHHSDPKCQNSVNRSAAVSPVKCSLVSRQFNNYGHANDVGLPMNLSLQTKGDQSGFGKCKGSLTNDFVYMGCSYKPQSYINYYMHGDVAASAAANLAVLSSEDSRSEGHVSGNLGKATSGNTYLLAKAFSQTASRFFWPSSEKKLVEVPRERCGWCISCKASVSSKKGCMLNHAAISATKSAMKILSGLAPVRSGEGIIPSIATYVMYMEESLRGLIVGPFLSECYRKHWRKQVERAKSFSDIKPLLLKLEENIRTIAFCGDWVKLMDDWLAEFSTMQSATCTLGTTQKRATCGKRKKQLSINKVTVGGCQENFAWWHGGKFTKSVFQKAVLPKSMVKKGARQGGLRKISGIFYADGSEIPKRSRQLVWRAAVQMSRNASQLALQHVGFGNNLMIPDYLHQVRYLDFHIRWSDLIRPEHNLLDVKGQDTEASAFRNANIRDKKFAEGKFLYRVAFGIQKHLPSRVMKNAEIEQGPEGMEKYWFSETRIPLYLVKEYEVRNGKVLSEKEYMHITSHMHKRRLTATYKDIFFYLTCKRDKLDMLSCSFFLRPQFFSWFNFRNALKCSACEGYCHMGCSVSSTVSTCEEVEFLATCKQCHHAKLLTQKQSCYESPTSPLLLQGQERSTSAVLKGPRPNGDGQGLMSAKTKNSRLDMKRVASDFPLETKGRSRSCSWGIIWKKKNNEDTGFDFRLKNILLKEGSGLPQLDPVCRLCHKPYRSDLMYICCETCKHWYHAEAVELEESKLFDVLGFKCCKCRRIKSPVCPYSDLYMMQGGKKLLTRASKKEHFGAYSDSGTPIDMRTCEPATLIYPAGDVSRQDNDPLFFSLSSVELITELQLDADDAGNLHAEFSTSNAMVSKSVKDLSPVEYGSADCNLLNNSEIVNFDELVDFEPNTYFSLTELLHSDDNSQFEEANASGDFSGYLKNSCTLGVPEECGTVNLASNCGSTNSLQGNVNKCRQCSQKEPAPDLSCQICGIWIHSHCSPWVESPSRLGSWRCVRVLLGMVVLRDAVISGDGESIQTDSQFQH

SEQ ID NO: 196381 - protein, 468 aa, Glycine max
  Coding DNA Sequence Number=SeqID_79603
  Gene Ontology: Mol. function=zinc ion binding; Biological process =proteolysis
  Homolog annotation: Hit_ID=UPI0000196E5D; Match level="QueryCoverage =92%, HitCoverage=29%, E-value=1e-120, Identity=48%"; Hit description= DNA binding / protein binding / zinc ion binding
  Pfam annotation: Domain name=DDT; Domain location=178-237; Score =42.9; E_value=1.1e-09; Accession=PF02791.7; Description=DDT domain
  Pfam annotation: Domain name=PHD; Domain location=385-430; Score =40.5; E_value=5.8e-09; Accession=PF00628.19; Description=PHD-finger
  Pfam module annotation: Pfam domain module=DDT::PHD; Domain location =178-237::385-430
MEPPVVRSRGRPRKRRREDEATVTGDAKTLPEAKKTTPVALIGRYVLKEFRRNTVLLGKVARYVSGLYRVVYESGGFEDLDSNEIRRILLLDSYFDDDLIRRKVELEESVLPKITAEEPEKGSSELQGELSVDNEEERAETDDDEARDSSSGAEMPEKAIPSPLMLPPSSGTIGVPEPCVLNLFSVYGFLRSFSIRLFLSPFTLDEFVGALNCKVSNALLDAIHVSLMRVLKRHLENISPDGSRPATKCLRCSDWSLVDALTWPVFVFQYLAIFGYTKGPEWKGFYDEIFYGEYYLLPASRKLTILQILCDEVLASEELKAEMNMREESEVGIDHDNEDCLPAENGPRRVHPRYSKTTACKDAETKKYVSELNAEEDDVDGNGDECRLCGMDGTLLCCDGCPAVYHSRCIGVMKMHIPEGAWYCPECKIDMIGPTIARGTSLKGAEVFGKDLYGQVFMSTCNHLLVYV

SEQ ID NO: 196382 - protein, 52 aa, Glycine max
  Coding DNA Sequence Number=SeqID_79604
MKNDTGHVGAINTSAIKHMAGRQGKIFLLPIFFPNPWREIRNLGLGFRWGAR

SEQ ID NO: 196383 - protein, 578 aa, Glycine max
  Coding DNA Sequence Number=SeqID_79605
  Gene Ontology: Mol. function=nucleic acid binding; Cellular component= nucleus; Biological process=response to DNA damage stimulus
  Homolog annotation: Hit_ID=Q6JJ38; Match level="QueryCoverage=96%, HitCoverage=55%, E-value=0.0, Identity=67%"; Hit description =Putative DNA repair protein
  Pfam annotation: Domain name=DEAD; Domain location=270-470; Score= -26.9; E_value=0.001; Accession=PF00270.19; Description=DEADDEAH box helicase
  Pfam annotation: Domain name=HIRAN; Domain location=2-103; Score =51.0; E_value=4.1e-12; Accession=PF08797.1; Description=HIRAN domain
  Pfam annotation: Domain name=ResIII; Domain location=202-464; Score= -33.5; E_value=0.03; Accession=PF04851.6; Description=Type III restriction enzyme, res subunit
  Pfam annotation: Domain name=SNF2_N; Domain location=208-577; Score =157.6; E_value=3.2e-44; Accession=PF00176.13; Description=SNF2 family N-terminal domain
  Pfam module annotation: Pfam domain module=DEAD::HIRAN::ResIII::SNF2 _N; Domain location=270-470::2-103::202-464::208-577
  Subcellular localization annotation: CTP_CleavageSite=48; ConfidenceScore=5.31e-01
MTCLSTCKGRTISSGETVVFKFPAKKLSASPSPGKGFGRAATCSEIVRFSTEQAGEIGRIPNEWARCLLPLVRDHKVRIEGQCKYAPKVLGIMDSIVLSVSVFINSSMFGKHHQVSLKDAANSTDESAELTPSDFYSNKRPLTQRERYSLQVTLPCSKSEHPSQNGHESDNEDSISEIDVENIVGVGSSSELEEMDPPGNLMCELRPYQKQALYWMIQMEKGQSMDETATTLHPCWEAYHLADKRELVIYLNAFSGEATIEFPSTLQMARGGILADAMGLGKTIMTISLLVAHSGKGGSIGSQPITQSFIESGEVSDTVHKFSNIPKKATKFAGFDKPMKQKNALTSGGNLIICPMTLLGQWKAEIETHAHPGSLSLYVHYGQSRPKDAKSLAENDVVITTYGILASEFSSENAEDNGGLFSIRWFRVVLDEAHTIKSSKSQISFAAAALISDRRWCLTGTPIQNSLEDIYSLLRFLRIEPWGHWAWWNKLIQKPFEGGDERGLKLVQSILKPIMLRRTKHSTDREGKPILVLPPADTQVIYCEPTEAEKDFYGALFKRSKFFTLFFGTETNHIDPTR

SEQ ID NO: 196384 - protein, 240 aa, Glycine max
  Coding DNA Sequence Number=SeqID_79606
  Gene Ontology: Cellular component=integral to membrane; Biological process=peroxisome organization and biogenesis
  Homolog annotation: Hit_ID=Q94DE5; Match level="QueryCoverage=97%, HitCoverage=54%, E-value=3e-71, Identity=53%"; Hit description =Putative betaine/proline transporter
MSTQSGKSSNGPEKDYSLIGDTTNRLFGIFNAIPIIANTYGSGIVPEIQAKLAPPVEGKMLKGLSISGLWAFGYQAAGLIFSNFIDDYSKPLAPKWLIYLPNICTIAQLLANGVEYLQPTNVILEQIFGDPESTEFSPRNVIPRLVSRSFVVITATTIAAMLPFFGDMNSLIGAFCYMPLDFILPVIFFNLTFKPSKRSSIFWLNSTIAIVFSTLGAMAAVSTVRQIILDAKTYQLFANV

SEQ ID NO: 196385 - protein, 216 aa, Glycine max
  Coding DNA Sequence Number=SeqID_79607
  Gene Ontology: Mol. function=serine carboxypeptidase activity; Cellular component=extracellular space; Biological process =proteolysis
  Homolog annotation: Hit_ID=Q6JJ33; Match level="QueryCoverage=92%, HitCoverage=40%, E-value=2e-69, Identity=65%"; Hit description =Putative serine carboxipeptidase
  Pfam annotation: Domain name=Peptidase_S10; Domain location=31-216; Score=-104.7; E_value=1.2e-07; Accession=PF00450.12; Description =Serine carboxypeptidase
MEKLCEFLATLVFLGILFHGEMVSALRTKDGSEEWGYVQVRPKAHMFWWLYRSPYRVDSPSKPWPIILWLQGGPGSSGVGFGNFKEIGPLDANLKPRNFTWLRKADLLFVDNPVGTGYSFVEDSRLLVKTDKEAATDLTTLITKLFNSDHSLQKSPLFIVAESYGGKFAVTLGLSVTKAIQKRKLKLKLGGVVLGDSWISPEDFVASTRTVAAISL

SEQ ID NO: 196386 - protein, 175 aa, Glycine max
  Coding DNA Sequence Number=SeqID_79608
  Gene Ontology: Mol. function=serine carboxypeptidase activity; Cellular component=endoplasmic reticulum membrane; Biological process=proteolysis
  Homolog annotation: Hit_ID=Q9SJJ9; Match level="QueryCoverage=97%, HitCoverage=37%, E-value=2e-55, Identity=59%"; Hit description =Putative carboxypeptidase
  Pfam annotation: Domain name=Peptidase_S10; Domain location=6-172; Score=-206.0; E_value=0.022; Accession=PF00450.12; Description =Serine carboxypeptidase
MKLKLFKEISMRRYSKHLTSTRYSPGVSGDLYSLLNGVITKKLKIIPEKIRWFEQSDNVFTNLEGDFMKPRIAEVDKLLALGVNVTVYNGQVDLICATKGTEAWLKKLKWAGLPNFLGKDRTPIFCGSDRKTKGFFKSYKNLNFYWILGAGHFVPTDQPCIALNMVGAITQSPAV

SEQ ID NO: 196387 - protein, 519 aa, Glycine max
  Coding DNA Sequence Number=SeqID_79609
  Gene Ontology: Mol. function=magnesium ion binding; Cellular component=chloroplast; Biological process=metabolic process
  Homolog annotation: Hit_ID=Q1T1D0; Match level="QueryCoverage=99%, HitCoverage=91%, E-value=0.0, Identity=70%"; Hit description=Terpene synthase-like; Terpenoid synthase
  Pfam annotation: Domain name=Terpene_synth; Domain location=1-191; Score=84.6; E_value=3e-22; Accession=PF01397.11; Description=Terpene synthase, N-terminal domain
  Pfam annotation: Domain name=Terpene_synth_C; Domain location=195 -464; Score=345.3; E_value=1e-100; Accession=PF03936.6; Description =Terpene synthase family, metal binding domain
  Pfam module annotation: Pfam domain module=Terpene_synth::Terpene _synth_C; Domain location=1-191::195-464
MQLNKRVTEVKGLFVQEASVLQKLELADWIQKLGLANYFQKDINEFLESILVYVKNSNINPSIEHSLHVSALCFRLLRQHGYPVLPDTLSNFLDEKGKVIRKSSYVCYGKDVVELLEASHLSLEGEKILDEAKNCAINSLKFGFSPSSININRHSNLVVEKMVHALELPSHWRVQWFEVKWHVEQYKQQKNVDPILLELTKLNFNMIQAKLQIEVKDLSRWWENLGIKKELSFARNRLVESFMCAAGVAFEPKYKAVRKWLTKVIIFVLIIDDVYDIHASFEELKPFTLAFERWDDKELEELPQYMKICVHALKDVTNEIAYEIGGENNFHSVLPYLKKAWIDFCKALYVEAKWYNKGYIPSLEEYLSNAWISSSGPVILLLSYFATMNQAMDIDDFLHTYEDLVYNVSLIIRLCNDLGTTAAEREKGDVASSILCYMNQKDASEEKARKHIQDMIHKAWKKINGHYCSNRVASVEPFLTQAINAARVAHTLYQNGDGFGIQDRDIKKHILSLVVEPLR

SEQ ID NO: 196388 - protein, 83 aa, Glycine max
  Coding DNA Sequence Number=SeqID_79610
MEKEMITMIVDTIPMFYYEKMMGYMPLSFANLVFAGERIEVGLRSGKFDYPALMNWKPGENGENKKEGETHVVTVVPTRPNSH

SEQ ID NO: 196389 - protein, 112 aa, Glycine max
  Coding DNA Sequence Number=SeqID_79611
MHFAEHVLPAGELCLVPGQAGDQLRDAPAVDPEEYIQPPSPQDPVAFDPPPHVDDYNGYEAIAQRLERVLNLRMVTAGTELYEIVQDCLTIARRGASADGSVRARQRRRTEH

SEQ ID NO: 196390 - protein, 141 aa, Glycine max
  Coding DNA Sequence Number=SeqID_79612
MPRTHDAILYYNGKWNMPPQNKFVRCAFTGKNPKKFQIPSTCTIDELKNLIKQVAPKGIPPLGIHESQTVRRLFFRQPAHLEYSDTLIKYDINELRTNEELLKVLVQSNYWKKYGPIEILAVFAKYVVTIEDEVTGTSLNN

SEQ ID NO: 196391 - protein, 104 aa, Glycine max
  Coding DNA Sequence Number=SeqID_79613
MQTTLPQLLAVGKGDEDMTKSKGKDPLEGLGGPMTRARARKAKEALQQVLSILFEYKPKFQGEKSKVGFNGFSSSCTKGPIGNLGTSLLGDQMVADLLAVGGDF

SEQ ID NO: 196392 - protein, 45 aa, Glycine max
  Coding DNA Sequence Number=SeqID_79614
MAASSWILAPCSVSRGAGLRKDPRGVPATRQASSSGERSHAQVPH

SEQ ID NO: 196393 - protein, 118 aa, Glycine max
  Coding DNA Sequence Number=SeqID_79615
MVTSMLQLDLMNFFVKARAWFNPIIQGMAILIANTSTTFHRDERLGNSYAMHGKCNYERKAQGSCMSKHVEQKVKKVIWTFQPPVTKDETHIQRMCDGMMQMRKSATGGCTEYDNIHK

SEQ ID NO: 196394 - protein, 582 aa, Glycine max
  Coding DNA Sequence Number=SeqID_79616
  Homolog annotation: Hit_ID=Q1SL70; Match level="QueryCoverage=36%, HitCoverage=40%, E-value=8e-72, Identity=51%"; Hit description =Leucine-rich repeat; Leucine-rich repeat, cysteine-containing type
  Pfam annotation: Domain name=LRR_1; Domain location=45-67; Score=6.1; E_value=21; Accession=PF00560.23; Description=Leucine Rich Repeat
  Pfam annotation: Domain name=LRR_1; Domain location=69-88; Score =16.7; E_value=0.085; Accession=PF00560.23; Description=Leucine Rich Repeat
  Pfam annotation: Domain name=LRR_1; Domain location=93-117; Score =4.9; E_value=35; Accession=PF00560.23; Description=Leucine Rich Repeat
  Pfam module annotation: Pfam domain module=LRR_1::LRR_1::LRR_1; Domain location=45-67::69-88::93-117
MRHIELILKGRIIEYMNRIAMHFTIDLSNNDLCGKIPDKLTELIHLGTLNLSWNKLMGNISNNIGLLIDLESLDLSHNFLSGSIPPSMVSITFLSYFNLAYNNLSSQIPVANQFGTFDPSIYVGNPQLCGNSMPTNCSLWLPGNGGEQGTKHEEDNDKTEKLGLYGSITLGYITGFWLVCGSLVLNRSWRHAYFKLVFDLRDKLLVLTGVNLACTTRCACYWHWSRDPPGSAACIFSFWLVAVSTLSAAISSLLCCSITFPAACNCASCVLFITFTCPSKTPCPHGVGILNPDCETTWVNWACYGKDGGVMARGNTSSSNCCSNECKPRRELTKLKRYCCCMLNITVHKAQTHADRARGGGGGFGGGGGGDGSRYSGRRREASEYLLVAWGPNAGGGGGGSVGGQCETPLAKPLAPPRVVTRGGCLAKNSDADTGRDDNHTACAAPCVMGRGGTSDDNCDEPTETSSSMNGIEFGDYGIESHDGMELSGNEVGNESLETVQALGGEQQDLLRPMRGCQLSACYWHWSHDPSGSAAYIFSFWLVAVSTLSAAISSLLCCSITFLVAGAACNVDCDYTFVVYVA

SEQ ID NO: 196395 - protein, 52 aa, Glycine max
  Coding DNA Sequence Number=SeqID_79617
MSHHEEKVPKNKSHKQEEHKMDRISRMLIGAGERRDELYFFKGVRNMRAYKN

SEQ ID NO: 196396 - protein, 110 aa, Glycine max
  Coding DNA Sequence Number=SeqID_79618
  Gene Ontology: Biological process=response to other organism
  Homolog annotation: Hit_ID=O24101; Match level="QueryCoverage=54%, HitCoverage=60%, E-value=2e-14, Identity=61%"; Hit description=MtN5 protein precursor
  Pfam annotation: Domain name=Tryp_alpha_amyl; Domain location=31-95; Score=13.6; E_value=0.0038; Accession=PF00234.12; Description =Protease inhibitorseed storageLTP f
MAQSSCKTLVQWLVAALLIALLGGAQAVAICNIDSSQLNLCRAAVTGQNPPPPDEKCCAVVRQANLRCLCSYKSTLPSFGINPKNALALPGVFMKKLLNGPGLPLFFDID

SEQ ID NO: 196397 - protein, 232 aa, Glycine max
  Coding DNA Sequence Number=SeqID_79619
  Gene Ontology: Mol. function=nucleic acid binding; Cellular component= proton-transporting two-sector ATPase complex; Biological process=DNA integration
  Homolog annotation: Hit_ID=Q1S4N1; Match level="QueryCoverage=98%, HitCoverage=24%, E-value=2e-62, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
GPKFWYDRMNAHLISLGFEKSLSESTLYVKKRDVGIVIVSLYVDDLLMTRSSKELIEELKGGKKEAFEMTDLGKMFFFLGMQVQQDRGEVFVSQEKYAKEILRKFKMEECKPIATPMNQKEKFSNEDGADKAAKRNLRYIKGTIGYGVKFQPKQDVIAQSTAEAEYVAAVAAANQAIWLRKLMADLHMEQKESTQVLVDNQAAISISKNLVFHGKTKHFNIKLYFPREVQNQ

SEQ ID NO: 196398 - protein, 165 aa, Glycine max
  Coding DNA Sequence Number=SeqID_79620
  Gene Ontology: Mol. function=nucleic acid binding; Biological process= DNA integration
  Homolog annotation: Hit_ID=Q1S6N9; Match level="QueryCoverage=53%, HitCoverage=6%, E-value=1e-30, Identity=71%"; Hit description =Integrase, catalytic region; Zinc finger, CCHC-type; Peptidase aspartic, catalytic
MKEEYEGSEKIKGMQALNLIRELEMQRMKDSETIKDYADKLLGIANKIRLLGTEILDSRIVQKILVTIPEKYEATLTSLENSKDLSIITLAELLTALQALEQRRLMRQEAHVKKICKSSQKQENVQDVVEEVDEEELFVVSCFAIARSKESWLIDSGCTNHMTYD

SEQ ID NO: 196399 - protein, 164 aa, Glycine max
  Coding DNA Sequence Number=SeqID_79621
  Homolog annotation: Hit_ID=Q9FJ65; Match level="QueryCoverage=40%, HitCoverage=61%, E-value=4e-08, Identity=45%"; Hit description =Arabidopsis thaliana genomic DNA, chromosome 5, P1 clone:MTE17
MVVKEVSDSILCVVAIWWLLKSTKLVSCYSRNPPPPDEKCCAVIRQANLPCLCRYKSILPSIGINPIKGFGLACVVKQLMKVMFISHYTNLSIQLVSGVSLTLKMQLSFKAAFEFPGIKVQFLLISVLCMPKSLQAGVVWCDVAKVFDVQEYRIALLFSPCLHF

SEQ ID NO: 196400 - protein, 320 aa, Glycine max
  Coding DNA Sequence Number=SeqID_79622
  Gene Ontology: Mol. function=nucleic acid binding; Cellular component= proton-transporting two-sector ATPase complex; Biological process=DNA integration
  Homolog annotation: Hit_ID=Q1S4N1; Match level="QueryCoverage=95%, HitCoverage=27%, E-value=1e-105, Identity=54%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=93-242; Score=37.0; E_value=6.3e-08; Accession=PF00665.16; Description=Integrase core domain
MKGKGTIVIKGCTGLKLIPDILYVPEINQNLLSVGQLLEKGYKVLFEDKSCMIKDSDNKELFRVQMKGKSFVLNLIDEEQLAVHKVEDNMLVWHKRMGHFHHGALLYLRKNDLVQGLLELEEKSPVCAACQYGKQMRLPFPKGKSWRATSKLQLVRTDVGGPQETPSLNGRIEHQLTTPYTPQQNGVVERKNRMVLEMVRCLLHDKDLPKKFWAEASSTFVFLLNRLPTKALSKSTPFEAWYGFKPKLMNLKVFGCLCFSYIPQVKRDKLDKKVEAGIFVGYNSTSKAYRIFLPPSNKVIVTRDVLFFEEEKWSKESEKL

SEQ ID NO: 196401 - protein, 69 aa, Glycine max
  Coding DNA Sequence Number=SeqID_79623
  Subcellular localization annotation: CTP_CleavageSite=38; ConfidenceScore=5.40e-01
MAFGAFGTPSVFQSWIASGQAGRQPPPPFPMKRQKGVVLSVPDSPGYAFQVFWVKKIVFVKKIQAEVLL

SEQ ID NO: 196402 - protein, 80 aa, Glycine max
  Coding DNA Sequence Number=SeqID_79624
MTERWWCSSAVLAQGAVWMGEVWGSGASDGAWVVTRRRGGCAGGEVLGLFGGEVGLAWISLGFHLFDCVALVGGDVKKVE

SEQ ID NO: 196403 - protein, 286 aa, Glycine max
  Coding DNA Sequence Number=SeqID_79625
  Gene Ontology: Mol. function=nucleic acid binding; Biological process= DNA integration
MVILSLMKVVLKVGMRMIMRVFFFKIVKKREQLHGGDVNVEEGDGELSEGYETEELYSAEFEFNEEDIHNLQELKEAIVEHSIMNGIQDKTCRPKHHCGRDFSNKNANSKWVLKIVAKKLKFNNDVKLTQIMDVVKFKYGIGISLAIAWKSKMIAKAIMDGDAIRQYSYLEAHGEELKHVCEGINYKIILERPIGLLLPRFGSFYMCLEGSKLAFKHACKPMISLDGRHLKCKFGEQLLIVVGRDPNDQYLHIAFVAVEDEAKDSWKWFLELLINDIGDIEANIHQ

SEQ ID NO: 196404 - protein, 947 aa, Glycine max
  Coding DNA Sequence Number=SeqID_79626
  Gene Ontology: Mol. function=RNA-directed DNA polymerase activity; Cellular component=chromatin; Biological process=chromatin assembly or disassembly
  Pfam annotation: Domain name=RnaseH; Domain location=722-839; Score= -35.0; E_value=0.1; Accession=PF00075.14; Description=RNase H
  Pfam module annotation: Pfam domain module=RVT_1::RnaseH; Domain location=476-664::722-839
MAEHTTRKTTTDRLEDAITRLTNSQALLSDKYSDLSGKVDSILDHLRLRDVNHNPVTSSAPFNHRNHVKLDISRFDGRDPLGWIFKIQQLFDFQNTPEEERITVASFYLDDAALSWLWNKGLRRPSTRTRKERYSNSRSAVPLTTTSQSSRGLSPEIRREVLALQPISLPQATALAKLQEDKLRDRRSATSRTTNPQQHSSSFSAPNPKPKQPFVQRTPEEMAFRREKGLCYNCDEKWSSGHHCKGKIQLFIVDNSALDSKLDSATLTDSDATNSGDLEATIDTECPHISLHALSGLSSSDTSRLYDTINQAHLTILIDNAVLGIEWLKQFGPITTNYTTFIMKFSHLGRNIELHADVEIGPEPVSAAQVKRLVQTGSTSALFHLAILTPNITHTHPTPPSHPISSIAALLHQFHHLFQTPHGLPPPRDTAHRITLPPTTSPVNVRPYRYPHYQKAEIEKQISELLSAGLIRPSTSPYSSPVLLVKKKDGTWRLCADHRALNSVTIRDRFPILTIDELLDELGHASWFSKLDLRQGFHQIPMHEADVEKTAFQTHHGHYEYLVMPFGLCNAPSTFQSAMNNLLGPFLSQFATVFFDDILVYSDSLDSHITHLRTIFQALRQLEYLGHVVSGKGVAPEPSKVQAILQWPPPSSAKDLRTFLGLADFYRKFVRNYASIAAPLTTLLCKDAFEWSSMSQDAFDQLKLAMTSAPVLALPNFAEPFIVEIDTSGTTMGVVLMQQGHPLAFFSKMFGPRLLHASAYIHELHTIITAVQKWRQYLLGRPFTITADHKSLRELMTQVIQTPEQHYYLSKLLGFDYTIQYKPGASNTVADALSRQPTNSGQLLLLSDNPAILSLLLEHHATPLRGHLVLPKQHIALSQGSFGPVYATMFAVSYENVRFASKPKPALNVRQGSFSPYRHPVAYGRMCRWTSSLTYHPHMALQSYLSS

SEQ ID NO: 196405 - protein, 100 aa, Glycine max
  Coding DNA Sequence Number=SeqID_79627
MGLGLGRWLERSGGESLKGGGRKGVPWLLQPPPLGLMLLMKCEKVTEKLYGFQVSMHYNFHNDKRMEHKVCVSNQKEPKPSTARLARIVTRPKHLRDYVS

SEQ ID NO: 196406 - protein, 237 aa, Glycine max
  Coding DNA Sequence Number=SeqID_79628
  Gene Ontology: Mol. function=sugar porter activity; Cellular component=periplasmic space; Biological process=transport
  Homolog annotation: Hit_ID=UPI00005F7E5C; Match level="QueryCoverage =100%, HitCoverage=76%, E-value=1e-113, Identity=88%"; Hit description=COG1879: ABC-type sugar transport system, periplasmic component
MKLKKLIAASVLMCMLPASVLAKDIKIGVSMAYFDDNFLTILRQSMQNKMKADGNVSGQFEDAKGDIAQQIQQIENFVSQGVDAIILNPVDTQGVKPMIKLAEKAKIPLVFVNRKPEVALPAGMAYVGSDSKLAGKLQMEELAKLMNGKGNVMILMGELSSEATRDRTRGVEEVAANYPGIKIIDKQTAKFFRKEAVDVTTDWILSGQQIDAIASNNDEMAIGAILALKQAKKSGVL

SEQ ID NO: 196407 - protein, 82 aa, Glycine max
  Coding DNA Sequence Number=SeqID_79629
MERETCRHVRATQRSDLTFEGHMKVGPTSVWVPFQRKLKFETWGGRKYPKGITHIRTQRLTAYGNMLFIMSILFHFNHHVDH

SEQ ID NO: 196408 - protein, 241 aa, Glycine max
  Coding DNA Sequence Number=SeqID_79630
  Gene Ontology: Mol. function=peptidyl-prolyl cis-trans isomerase activity; Cellular component=mitochondrion; Biological process =protein folding
  Homolog annotation: Hit_ID=Q7EYT3; Match level="QueryCoverage=98%, HitCoverage=98%, E-value=6e-59, Identity=50%"; Hit description =Peptidyl-prolyl cis-trans isomerase-related-like protein
  Pfam annotation: Domain name=Pro_isomerase; Domain location=80-223; Score=16.1; E_value=2.8e-08; Accession=PF00160.11; Description =Cyclophilin type peptidyl-prolyl cis-
MGRIKPQALLQQSKRKKGPSRISATIVTFYALILVMLVFILFVTYRHWSNRTRLQPESYISVSEDENTSVESKKSDLPGYAVVITSKGSIIVELYKESAPEVVDEFIDLCQKGHFKGMLFHQVIKHYIIQAGHNKGPGATEDWNLLGKKYASMRHEAFMLGTSKGKYFNKGFDLFITTAPIPDLNEKLIVFGRVIKGQDIVQLILTVSQSLCQEIEEVDTDEHYQPKLTIGILDVALKQIV

SEQ ID NO: 196409 - protein, 647 aa, Glycine max
  Coding DNA Sequence Number=SeqID_79631
  Gene Ontology: Mol. function=nucleic acid binding; Cellular component= cytosol; Biological process=positive regulation of transcription
  Homolog annotation: Hit_ID=Q9ZUL5; Match level="QueryCoverage=99%, HitCoverage=86%, E-value=0.0, Identity=65%"; Hit description =Putative helicase (SNF2/RAD54 family (ETL1 subfamily) protein)
  Pfam annotation: Domain name=DEAD; Domain location=204-384; Score= -40.5; E_value=0.015; Accession=PF00270.19; Description=DEADDEAH box helicase
  Pfam annotation: Domain name=ResIII; Domain location=200-378; Score= -24.7; E_value=0.0054; Accession=PF04851.6; Description=Type III restriction enzyme, res subunit
  Pfam annotation: Domain name=SNF2_N; Domain location=206-510; Score =262.7; E_value=7.4e-76; Accession=PF00176.13; Description=SNF2 family N-terminal domain
  Pfam module annotation: Pfam domain module=DEAD::ResIII::SNF2_N; Domain location=204-384::200-378::206-510
MKPELYEISDDEWENHSFKPSQVLKRPRTSSPPSPPPIESFAYTSNSKVDVSSENDDDSDCVEIAPESANFRDNLNDLEDADVDDEPVPASRGRRFVIDDDDEEDGEEENGGRDGHVAELYDVESSEEEEEDVDELNENDVVGRALHKCARISAELKGELFGSSGTACERYSEVESSSVRIVTQEDVDVACGSEEDSDFQPLLKPYQLVGVNFLLLLYRKGIGGAILADEMGLGKTVQAITYLTLLKHLHNDSGPHLIVCPASVLENWERELKRWCPSFSVLQYHGAGRAAYCKELNSLSKAGLPPPFNVLLVCYSLFERHSAQQKDDRKILKRWRWSCVIMDEAHALKDKNSFRWKNLMSVARNANQRLMLTGTPLQNDLHELWSLLEFMLPDIFASEDVDLKKLLNAEDRDLIGRMKSILGPFILRRLKSDVMQQLVPKIQQVEYVIMEKQQETAYKEAIEEYRAVSQARMAKCSDLNSKSVLEVLPRRQINNYFVQFRKIANHPLLIRRIYSDEDVIRFARKLHPMGAFGFECTLDRVIEELKNYNDFSIHRLLLHYGVNDRKGILPDKHVMLSAKCRALAELLPSLKEGGHRALIFSQWTSMLDILEWTLDVIGLTYKRLDGRIILVSTSTNKEKVKSSMIMI

SEQ ID NO: 196410 - protein, 87 aa, Glycine max
  Coding DNA Sequence Number=SeqID_79632
  Gene Ontology: Mol. function=nucleic acid binding
  Homolog annotation: Hit_ID=Q9ZUL5; Match level="QueryCoverage=70%, HitCoverage=8%, E-value=3e-23, Identity=85%"; Hit description =Putative helicase (SNF2/RAD54 family (ETL1 subfamily) protein)
MDFNPQIDRQAEDRCHRIGQTKPVTIHRLVTKGTVDENVYEIAKRKLVLDAAVLESMEEINEVKMRNAASYSYLEEWDRMDFGESKK

SEQ ID NO: 196411 - protein, 84 aa, Glycine max
  Coding DNA Sequence Number=SeqID_79633
MVLGRVQIGRRRRRRIRRRSFGNGDLEGRRCIGGEMDNWEIFGFRIGWKLLCKKQMQDVILDLAYLVYRFMWSGDEWTPGELVN

SEQ ID NO: 196412 - protein, 477 aa, Glycine max
  Coding DNA Sequence Number=SeqID_79634
  Gene Ontology: Mol. function=histone-lysine N-methyltransferase activity; Cellular component=nucleus; Biological process=chromatin modification
  Homolog annotation: Hit_ID=Q9T0G7; Match level="QueryCoverage=67%, HitCoverage=51%, E-value=6e-93, Identity=54%"; Hit description =Probable histone-lysine N-methyltransferase, H3 lysine-9 specific SUVH9 (EC 2.1.1.43) ...
  Homolog annotation: Hit description=(Histone H3-K9 methyltransferase 9) (H3-K9-HMTase 9) (Suppressor of variegation 3-9 homolog protein 9) (Su(var)3-9 homolog protein 9)
  Pfam annotation: Domain name=YDG_SRA; Domain location=266-424; Score =271.2; E_value=2e-78; Accession=PF02182.8; Description=YDGSRA domain
MNSLFSPENLPPPPGIPIPATIAAASTTTPNPILIPKLEPFDEWLNTHTPQQQQQSQDPNSSNGSLDLDLKLFGDESPEDFSGDPNLLSDFNRLSQLFRTAFSNNNAVPDPITQGIQQLGNDAVSNPFAKPPQNETTVVPPPSFQNGTVSDPGMLLQQQQQYPNGAVSDPDSRAIVPVPEDGRSSSVAVTTPRQPRRCKELVRLMDVGGPEQRHFRDVVRRTRMLYDSLRVLATVEDEGRVDARRGRSDLRASAVMRNCGLWLNRDKRIVGAIPGVCIGDVFLYRMELCVVGLHGQPQAGIDYLPASMSSNGEPIATSVIVSGGYEDDVDEGDVIIYSGHGGQDKHSRQVFHQKLEGGNLAMERSMHYGIEVRVIRGVRYEGAASATGRLYVYDGLYRIHECWFDVGKSGFGVYKYKLCRIDGQAKMGTVVMKEALMLRKDPLSFKPMCCLSLDVSNRKENVAIRLFNDIDRNYDPL

SEQ ID NO: 196413 - protein, 235 aa, Glycine max
  Coding DNA Sequence Number=SeqID_79635
  Gene Ontology: Mol. function=histone-lysine N-methyltransferase activity; Cellular component=nucleus; Biological process=chromatin modification
  Homolog annotation: Hit_ID=Q9T0G7; Match level="QueryCoverage=79%, HitCoverage=29%, E-value=3e-80, Identity=71%"; Hit description =Probable histone-lysine N-methyltransferase, H3 lysine-9 specific SUVH9 (EC 2.1.1.43) ...
  Homolog annotation: Hit description=(Histone H3-K9 methyltransferase 9) (H3-K9-HMTase 9) (Suppressor of variegation 3-9 homolog protein 9) (Su(var)3-9 homolog protein 9)
  Pfam annotation: Domain name=SET; Domain location=31-186; Score =137.4; E_value=3.9e-38; Accession=PF00856.18; Description=SET domain
NQSGILLRGKPLVFECGPFCHCPPHCRNRVTQKGLKNRLEVFRSRETGWGVRSLDLIQAGAFICEYTGVVLTRDQAQLLTMNGDSLIYPNRFTDRWAEWGDLSMIDSNYVRPSYPSIPPLDFAMDVSRMRNVACYMSHSSTPNVLVQFVLYDHNNLMFPHLMLFAMESIPPMRELSLDYGVADEWTGKLSIEVKPSSFIDLLVFRIFIIVFPFHFMSYLNLCVVSIISSVNHMRL

SEQ ID NO: 196414 - protein, 75 aa, Glycine max
  Coding DNA Sequence Number=SeqID_79636
MEVYWEVGSSKREVTEAVQQQCRLQCYVWQQKKWRSYYEAHKTLQFAPQMAAQHLQQTGDRQLHYWVWKTGPAQP

SEQ ID NO: 196415 - protein, 51 aa, Glycine max
  Coding DNA Sequence Number=SeqID_79637
MEGGVRVMIIGSRERRWRWEEIGVDVFGFWSLVLMREGLGSVVKIGFRLWK

SEQ ID NO: 196416 - protein, 101 aa, Glycine max
  Coding DNA Sequence Number=SeqID_79638
  Gene Ontology: Mol. function=nucleic acid binding
MSQTIGQSIGNCLGEYLEYDEKNNNPWHPYLRIRVFIDVRKPLKTTKRIKKQGNEVVEVSFKFEHLGTFCYLCGLLGYSDDYCAKLLTLENDDGTRIWVRN

SEQ ID NO: 196417 - protein, 105 aa, Glycine max
  Coding DNA Sequence Number=SeqID_79639
MVLTPWCIFGDFNDLSLNDEKIGLHDHPNWLIQSFHEAIFDFNLHDLPMEGYKFTWAKRKDSYQKELETLREAYYEEPTLQFSIIKYKLNHLLAHEEAYWKQRPK

SEQ ID NO: 196418 - protein, 77 aa, Glycine max
  Coding DNA Sequence Number=SeqID_79640
MVEREKLDHIEERLRAIEGGRDYAFADMAELCLVPDVVIPLKFKVLDFDKYKRTTFPKNYLKMYCRKKGHTRKMKNC

SEQ ID NO: 196419 - protein, 37 aa, Glycine max
  Coding DNA Sequence Number=SeqID_79641
MEKARKTLVFKRSKGPGVGYAKGSYVKISLNAPDPLK

SEQ ID NO: 196420 - protein, 182 aa, Glycine max
  Coding DNA Sequence Number=SeqID_79642
  Gene Ontology: Mol. function=RNA binding; Biological process=response to stress
  Homolog annotation: Hit_ID=Q6D521; Match level="QueryCoverage=76%, HitCoverage=100%, E-value=4e-62, Identity=83%"; Hit description =Osmotically inducible protein C
  Pfam annotation: Domain name=OsmC; Domain location=61-179; Score =118.4; E_value=2e-32; Accession=PF02566.9; Description=OsmC-like protein
ECAAERSRTQPGAPARGALSQAKRRLLSILNSGLTNRRNDMTIHKKGSAHWEGDIKGKGTVSTESGVLSNQPYGFNTRFEGEKGTNPEELIGAAHAACFSMALSLMLGQAGHPPKSIDTTADVSLDKKGDGFAITKIALNSTIALPGIDDAKFDEIIQKAKAGCPVSQVLNAEITLDYTLNN

SEQ ID NO: 196421 - protein, 934 aa, Glycine max
  Coding DNA Sequence Number=SeqID_79643
  Homolog annotation: Hit_ID=Q6CYR9; Match level="QueryCoverage=34%, HitCoverage=92%, E-value=1e-108, Identity=62%"; Hit description=LacI- family transcriptional regulator
  Pfam annotation: Domain name=Aldedh; Domain location=573-933; Score =364.0; E_value=2.3e-106; Accession=PF00171.12; Description=Aldehyde dehydrogenase family
  Pfam annotation: Domain name=Peripla_BP_1; Domain location=43-313; Score=49.9; E_value=8.8e-12; Accession=PF00532.11; Description =Periplasmic binding proteins and sugar b
  Pfam module annotation: Pfam domain module=Aldedh::Peripla_BP_1; Domain location=573-933::43-313
TVSRVLAGNRYVSKSTQQKVFQAIEETGYRPNLLARSLATQKSQNIGLIVTHSLFNGPYFSELLYQTATLTNNYGRQLILADGKTSADDERAAIEFLLDLRCDAIIIYPRFLDTAALEAIIDQHDIPIMVVNRRLTQHAANCVWASHQQNTRDAVNYLIARGHHDIAFITGLAGSPTAAARLAGYQQALADHQLPYEAARVLPGAWTPESGQAAARQLLSAGVPFSALMASNDDMAIGAALALNAAGKRLPQDISLMGFDDIRMAEFFLPPLTTVHVPVAEMIQHTLAQLVAMLEGEAIAPLPPFSGRLIERASVADGPFRRNRCAGHSPAGNPPWRSACPPSAPLPPARAAPAQSPALQWRPDRPAPNFPSAAGAAARPFPRQMLRTSAASHQDVRAPAAGYAAPARPDACWRAGQPSGGTPAPARFSPAAWRAAADHAHVNRRMRQLKLCQPRNQPAGGEGGEGVQPDDRAAGIALQRGARLANTVEVLADLQKIGIAGQRQYQPAPLTLKQRRAKVLFQQTNLTTHRAWRHRQGISRCPHAAATGNIFKCQQGIQGQPDSADCQVVTLILTLEHTGMIKVTNPADGSLVGEAPFMRHDEVAAAIDRTCAAFPAWAAKSAKQRSDLLRGWYDLVRADKHLFAELMVRENGKCLSEALGEIEYGLGFIEWYAEEAKRVNGDTLPSHDANASVLVVKEPVGPTAAITPWNFPFMMITRKIATALAAGCTMIIKPAEETPLTAYKLLEYARQAGIPAGVFEMVTGDPQAIGEAFTSDTRIHKISFTGSTRVGKLLAQQCGATLKKMTMELGGNAPFIVFADSPLEESVAGLVSAKLRNSGQVCISPNRIFVHDAIYDAFVQQLVKTVSEIRVDQGMQQEFVVGPLINRMALDKVTALVDDAVAQGATLRLGGKPHAKGGLFYEPTILCDLDASFA

SEQ ID NO: 196422 - protein, 222 aa, Glycine max
  Coding DNA Sequence Number=SeqID_79644
  Gene Ontology: Mol. function=chitin binding; Cellular component =extracellular region; Biological process=chitin metabolic process
  Homolog annotation: Hit_ID=UPI000044A8F0; Match level="QueryCoverage =84%, HitCoverage=99%, E-value=5e-28, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTDPLIESISCFLIRVDPWVLVPSPSEGYMPSPSEEYTPSPSEDYIGLHVILTFRGLHVLAIRGLHVLAFRGPHALTFRGLHALAFRGLHVLSFRGLHTLAFRGLHILTFRGLHALAFRGLHALAFKGLHILAFGGLHVLAFRGLLALAIRGLHVLAFRGLHALTFRGLHVLTFRGLHALAFIGLHALAFIGLHALAFRGLRVFTFSGLHIHTLREFKALCP

SEQ ID NO: 196423 - protein, 86 aa, Glycine max
  Coding DNA Sequence Number=SeqID_79645
MVTKRTCRASKQRKGNIGSKGLSKELIQGRLIWLEAYKNKMPKSSPNMHVKQEVSTRVKPRLLCKQSMGQNTPNKTDDDGSNSHQG

SEQ ID NO: 196424 - protein, 113 aa, Glycine max
  Coding DNA Sequence Number=SeqID_79646
MEIDEQGIEKGRCVPATKYTNNNILRIQNYFQQPKLPEKLKVFKACSLLKPSAANSSPLTPLGFLDRAATVHATSLPLFITTSPSRGPRRAADEHILSEKRPRERSEYRKREE

SEQ ID NO: 196425 - protein, 156 aa, Glycine max
  Coding DNA Sequence Number=SeqID_79647
  Homolog annotation: Hit_ID=Q69TU8; Match level="QueryCoverage=73%, HitCoverage=26%, E-value=5e-29, Identity=59%"; Hit description=Sac domain-containing inositol phosphatase-like
MMLRREFANDVGYLNQILPVENHLRFIHWDFHKFAKSKSANVLEVLGAVASEALDLTGFYYSGKPSIIKRANKSNQTSTGRDTSPRDLRASSVDLVRIGNSNEMINSVVNQDKETDMNLNIAPSLSKKRVNGSVIHSPSEFDAASVAFEIPLLTYG

SEQ ID NO: 196426 - protein, 96 aa, Glycine max
  Coding DNA Sequence Number=SeqID_79648
  Homolog annotation: Hit_ID=Q9LW49; Match level="QueryCoverage=52%, HitCoverage=22%, E-value=2e-08, Identity=60%"; Hit description =Ethylene-responsive transcription factor 4
MPAHRTASYYKKGFAIAPRRRGIGGDIAVAARGLDDAALAGAQVLNIFQREREVCLGLRATKLSCCGVVGTRCRLRSVEGSEPDAGLLAGISNLRG

SEQ ID NO: 196427 - protein, 202 aa, Glycine max
  Coding DNA Sequence Number=SeqID_79649
  Gene Ontology: Mol. function=molecular_function; Cellular component =cellular_component; Biological process=defense response
  Homolog annotation: Hit_ID=Q2VC78; Match level="QueryCoverage=57%, HitCoverage=82%, E-value=6e-45, Identity=73%"; Hit description =Thaumatin-like protein
  Pfam annotation: Domain name=Thaumatin; Domain location=28-193; Score= 34.0; E_value=8.1e-11; Accession=PF00314.8; Description=Thaumatin family
MWVSRERFSTDFRREEKEKSDFRQEDDKEKREGKEHQTLYVDLPSPWSSAFRARTECSNNNGRFNCATVDCTSNQVACNGAGSILPATKAEITVAENRGQDFYDMSNVDDFNIPMSLTAQGGSGDYKTLGCLRNINHVCPSQLQQPGPSGNVIACKSACVAFNADRYCYLGDYLGDRYCFGQRENFINQEKYKEYWLSTSFR

SEQ ID NO: 196428 - protein, 253 aa, Glycine max
  Coding DNA Sequence Number=SeqID_79650
  Homolog annotation: Hit_ID=P49208; Match level="QueryCoverage=25%, HitCoverage=31%, E-value=1e-24, Identity=90%"; Hit description=50S ribosomal protein L1, chloroplast precursor
  Pfam annotation: Domain name=Ribosomal_L1; Domain location=72-214; Score=-108.6; E_value=0.021; Accession=PF00687.11; Description =Ribosomal protein L1pL10e family
YSNNDGFGKEFVGEVKKKIEWPKEAWILGQDVSAGFTPSIIFVILVPALPLKPLKRDRTRSKRSLEIQQLRERKKEYDLKTAISLVKETAKTKFVETVAAHFRLNIDPKYNDQQLRATDICVIQICHHEQVRTTTGFEKVKAFIYLCCFFRTVSTGISGASYYTGTFNIVNRSPDGSHSGCHVIEQLPEESRTCDGELMVEMILEGNFCLMERSLLTQWQIMWNSQIVTDSWIENAVNGLMGKQNMVLTGLSS

SEQ ID NO: 196429 - protein, 241 aa, Glycine max
  Coding DNA Sequence Number=SeqID_79651
MGTNQIGKRFYQVKIKGLDVTSLKELGQLMGQLLRQAFHKAYGKIWELAMVEVSTEAIASLAQGKETIPLLRILSIKAHVQGLDWLPSLRTAKREEVEAPEEDEEALEQETKRVRREEHGRDKFRGALWGSNSELKRRREERDQSRVHSMVFKEELATCSRSKKSLAQHLEATEQSMLAIIGQYKEELNQSLTHEQKLVEDFAQAYAEKEARGRVIDALHQEATMSMDRFALTLNGSQDLP

SEQ ID NO: 196430 - protein, 96 aa, Glycine max
  Coding DNA Sequence Number=SeqID_79652
MDRHIDVALVKEFYSNLYDPEDKSPKQVRVRGRLIKFDAASLNAFLETPPVIQPGEQYLSYSIFCKSHTDPQELASKLCIPGRDLFLMLKEHPGSS

SEQ ID NO: 196431 - protein, 73 aa, Glycine max
  Coding DNA Sequence Number=SeqID_79653
MKSDKASQDIHSISQVSRLLFTLEAPMKTNTTLTLQNSKIDKQLDKHMHMRIKRSLKVVMGPRTSTHLQNCSN

SEQ ID NO: 196432 - protein, 132 aa, Glycine max
  Coding DNA Sequence Number=SeqID_79654
  Gene Ontology: Mol. function=chromatin binding; Cellular component =chromatin; Biological process=chromatin assembly or disassembly
  Homolog annotation: Hit_ID=Q2R2X7; Match level="QueryCoverage=66%, HitCoverage=28%, E-value=1e-25, Identity=65%"; Hit description=MRG family protein, putative, expressed
  Pfam annotation: Domain name=MRG; Domain location=1-106; Score=-53.1; E_value=9.1e-08; Accession=PF05712.4; Description=MRG
MAFVAVRCRLWTPYTNYESMCYFDKALPMMLLYKKERKQYNDAIVDNVSPSTIYGAEHLLRLFVKLPELLAYVTIEEETLNRLQQKLLDFLKFLQKNQSTFFLSAYDGTKVSEGKAYTVLLYTMETFGGSAF

SEQ ID NO: 196433 - protein, 199 aa, Glycine max
  Coding DNA Sequence Number=SeqID_79655
MLRQPHSHAHVANVMINLSCGYCTPAQLDGDIDLNVSPQALDKLLGYFLALKVKVQPNFKNVVVLRCSNDLHLISVVMDMLYDAEVMFCKACSKIHILMLDSNDSSQVESQFVFVTVDHDPLLGLSLTPTKRMTSDECEILLKIFCKEPSASRIPKMNITSSTMSSRDYILIPAFYHEQWAPDYPDFAHFSYDGVMYKI

SEQ ID NO: 196434 - protein, 134 aa, Glycine max
  Coding DNA Sequence Number=SeqID_79656
  Gene Ontology: Mol. function=chromatin binding; Cellular component =chromatin; Biological process=chromatin assembly or disassembly
  Homolog annotation: Hit_ID=Q2R2X7; Match level="QueryCoverage=82%, HitCoverage=36%, E-value=3e-26, Identity=57%"; Hit description=MRG family protein, putative, expressed
  Pfam annotation: Domain name=MRG; Domain location=24-134; Score= -131.7; E_value=0.011; Accession=PF05712.4; Description=MRG
MIIITCNNAKGYKESLSLVQHISNSWDEWVGEERLMKHTEENVMKQQALDKKQNVDKNVKSGRSSQGKAKSSTDAKMDKEDVKNNVSKGKKRKHDAGVEKGSGTVEKLVKIQIPATLKKQLVDDWDSVTQQDKS

SEQ ID NO: 196435 - protein, 93 aa, Glycine max
  Coding DNA Sequence Number=SeqID_79657
  Gene Ontology: Mol. function=hydrolase activity
  Homolog annotation: Hit_ID=Q559Z8; Match level="QueryCoverage=46%, HitCoverage=14%, E-value=4e-19, Identity=90%"; Hit description =Protein phosphatase 4 catalytic subunit
MGSVLPQMDREICGDIHGQFYDMKELFKVGGDCPKTNYLFLGDFVDKGFYSVETFLLLLALKVLKYFCMVMRINIDYNGCYIKVKRALLDMPV

SEQ ID NO: 196436 - protein, 119 aa, Glycine max
  Coding DNA Sequence Number=SeqID_79658
  Homolog annotation: Hit_ID=Q7XHZ2; Match level="QueryCoverage=48%, HitCoverage=10%, E-value=1e-20, Identity=82%"; Hit description =Putative phosphoglucomutase, chloroplast
MSSHATSLEPKYQFTINLHLHVRAFRSFREYGEVVLKHLENSIGSDPSLLKAPVNYEGVRVSGYGGWFLLRLSLHDHVLPLNIERKCITEVDLEYLSIFTLYPNHDPVYTVGVSDYHND

SEQ ID NO: 196437 - protein, 208 aa, Glycine max
  Coding DNA Sequence Number=SeqID_79659
MVSTKASLRETEGVGSEVRGLNEGVLEVFSNTSVSVTVSLASTSEKDRLLTIVGSGTMKTSAHVDGEKDDLVRRHSTTEFVFMNKEVPFDDFTIGVLCILNLAPSQLHPNRVATIAQHLQGSSNIDKLKAKSPLNSALQANITLVGNNSNMKGCILDLKSKMKELEKCALITKASNKTNKEEVARLEVVLATVERERDNEREVKLWIE

SEQ ID NO: 196438 - protein, 75 aa, Glycine max
  Coding DNA Sequence Number=SeqID_79660
  Gene Ontology: Mol. function=peptidyl-prolyl cis-trans isomerase activity; Biological process=protein folding
  Homolog annotation: Hit_ID=Q01AE8; Match level="QueryCoverage=77%, HitCoverage=28%, E-value=2e-07, Identity=38%"; Hit description=[O] KOG0865 Cyclophilin type peptidyl-prolyl cis-trans isomerase
MVTHSDGLDVITAIASIPTYLPSERIRQFNDLAQFFGDERAQNARNIWNRPLKSVYISDCGELKVTKPSLTPSLP

SEQ ID NO: 196439 - protein, 95 aa, Glycine max
  Coding DNA Sequence Number=SeqID_79661
MKRKQLTDSRDGGYEVSRQWEWRNPCMKKPLFIMAGYLNPLLVLAGSLKKKTPSQICLQTNPLRIKLCKTTPLTSFCQTEPCVWSPNQIKVPNLY

SEQ ID NO: 196440 - protein, 64 aa, Glycine max
  Coding DNA Sequence Number=SeqID_79662
MVNNIFTQTRQTSWCRGARPGELKLSSPGRANLYFTFFFKGRHKYGPLRAGVRLLEPPQGRLGI

SEQ ID NO: 196441 - protein, 112 aa, Glycine max
  Coding DNA Sequence Number=SeqID_79663
MEELVEYRNQVQAEASPTKKKVENNEALQNLLKSLLFVPTYPSAGGRRGAHGCVFQERKMHGVATNVYLRKTLEKPERFGLRTLIVKGSGVVFTHGEGCFPRSYVSSIAMRK

SEQ ID NO: 196442 - protein, 50 aa, Glycine max
  Coding DNA Sequence Number=SeqID_79664
MKNMRKKRGEMAAFALVAMTSQSVVYEVHIVISVEVKVLWRFIGGDCCGG

SEQ ID NO: 196443 - protein, 113 aa, Glycine max
  Coding DNA Sequence Number=SeqID_79665
MAPGWMHTPSNNSIELRSGTSLFTFYNCEFGSKVMCVNNLSTDSLKWLLEADGAATATERSNVKVFSSHKDGAMKAITQQPSLDNTETDIMQQSDTIGTSTSMNQRPRRNTTN

SEQ ID NO: 196444 - protein, 582 aa, Glycine max
  Coding DNA Sequence Number=SeqID_79666
  Gene Ontology: Mol. function=RNA-directed DNA polymerase activity; Cellular component=chromatin; Biological process=RNA-dependent DNA replication
  Pfam annotation: Domain name=zf-H2C2; Domain location=438-475; Score =6.3; E_value=0.052; Accession=PF09337.1; Description=His(2)-Cys(2) zinc finger
MDRDEAPFTALESSVAALKTTTSELKVLKQCDDIKDLCKMMKMLMEQKGITYNDAENASTEQNSGLEDEESAMEPEPSSTSEDEESKSEADSILNSSCHYWAKGVKMPVFEGEDPLGWITCAEKFFAVQHVQQSPKVRLAFISMEGNTLHWFQCWKQKTKRKSWFVFKAVLIKRYGGTGRGDVDERIRGAGGSSLGYKGSGIERIFFGGTSQGDPGKNSSPQTEGSVKCHGGTWIHNVGGSAMNTFHNNQCQNRTLTGEAHSSANVMAANQSESTSSGTWNSGVRNLSYQEYLRRRGAKLCYHCGVPFVAGDKCLEKTLVAPTQTYGVRLGDGNKKNAQGCCEQMKVQLGQMTITEKFFLFDLGGVDVILGVAWLEKLGDVKHIDVELVMFLWVLDTMDSHGKYTLENDILYFKGKLVLPTNSSWISLSHLMNFTLPWQEATQGCRTYRRLAQSLHWKGMLKTITYLVAACHICQRSKYLTSSLAGLLQPLPIPNVVWEDISLDFIVGLPNSKGHDAILVMVDRLSKYGHFLLLKHPYTTRSVVDMFTKEVIRLHGIPSSIVNDRDALFLSNFWQELFKNKE

SEQ ID NO: 196445 - protein, 222 aa, Glycine max
  Coding DNA Sequence Number=SeqID_79667
  Homolog annotation: Hit_ID=Q9SWS9; Match level="QueryCoverage=47%, HitCoverage=82%, E-value=4e-38, Identity=72%"; Hit description =Ribosomal protein S26
  Pfam annotation: Domain name=Ribosomal_S26e; Domain location=1-120; Score=272.9; E_value=6.5e-79; Accession=PF01283.9; Description =Ribosomal protein S26e
MTFKRRNGGRNKHGRGHVKFIRCSNCGKCCPKDKAIKRFLVRNIVEQAAVRDVQEACVYEQYTLPKLYVKMQYCVSCAIHSHVVRVRSRTDRRKREPPQRFIRRRDDAQRPGQPGQAPRPAGTGAPILLNFIILRLLIFYAIGQGNLEIHYAYAPSHNHLFTLDLAIYICEPPHIVPGKPNAKACFSKFAQLPKLSSWHMDEMRNPTKDFYVARLPIWFCRG

SEQ ID NO: 196446 - protein, 281 aa, Glycine max
  Coding DNA Sequence Number=SeqID_79668
  Gene Ontology: Mol. function=transferase activity; Cellular component= beta-galactosidase complex; Biological process=DNA integration
  Homolog annotation: Hit_ID=Q1S5C0; Match level="QueryCoverage=69%, HitCoverage=25%, E-value=3e-71, Identity=66%"; Hit description =Polynucleotidyl transferase, Ribonuclease H fold
  Pfam annotation: Domain name=rve; Domain location=1-106; Score=3.7; E_ value=0.0029; Accession=PF00665.16; Description=Integrase core domain
MIKNQFGVNIKRIRFGNAKDYFNLVLNSFCQKERIIHESSCVNTPQQNGIAERKNGHLLDQTRELFLLQNNVPKKLWGEAILTATYLINRLPSKILESKSPMEVLSSFYSHVALTNKLQPRIFGCVYFMHVHRNESRKLDPRAVKCIFLGYSTTQKGYRCFHPPSKKFFMSRDVTFNKQKSHFKQPHLQGENVRKEDKPLMLLNMSFGPEIKGNGVVESENGGQEIGTDSAIVPEIEKGMEQALELITMGPIPELAPNSRKFEKNRTYSRREKAIPGFVHV

SEQ ID NO: 196447 - protein, 83 aa, Glycine max
  Coding DNA Sequence Number=SeqID_79669
MHAGPKPPEPVASLVSLSKSPASMAIRACRDQIASPNGDMHRCLGTASQTGEFHGVRVQAREGELQLPLASCLQVATPIGDLG

SEQ ID NO: 196448 - protein, 79 aa, Glycine max
  Coding DNA Sequence Number=SeqID_79670
  Gene Ontology: Mol. function=nucleic acid binding; Biological process= DNA integration
MDMELEQLNKKTFFLHGKLEEEVLTKQPESFKVQGKENSSCRSPYDSCVYDSEVEDGTYFYLFLYMDDMLIASQDKYEI

SEQ ID NO: 196449 - protein, 182 aa, Glycine max
  Coding DNA Sequence Number=SeqID_79671
  Homolog annotation: Hit_ID=Q2HRX8; Match level="QueryCoverage=66%, HitCoverage=17%, E-value=8e-13, Identity=35%"; Hit description=IMP dehydrogenase/GMP reductase
  Pfam annotation: Domain name=DUF1723; Domain location=120-169; Score =25.3; E_value=0.00021; Accession=PF08330.1; Description=Protein of unknown function (DUF1723)
MARTKQTSRHHRVIASACDRLVDGRQQQPTTNPELEPHPQPRLATDRIIGPPFGGGLVDSSLIRSYKTYCVGHVWIHQKWLELKLVSYCAQVLMYLTHLQARAYIDQSGLSTLVTMWYPTTNKGLVNASVERCHYETSSFHLPIREMIITLDYVSCLLHLPVTDRGCRHEVDVAGILVSEIC

SEQ ID NO: 196450 - protein, 80 aa, Glycine max
  Coding DNA Sequence Number=SeqID_79672
MEEEGAGVSGGAEVVRASDLLPLAFLGPLNVTIGSSRFQQFFLIYAKLMAGLKFSKDLESDWTPLALHRVVIKAGNPSLD

SEQ ID NO: 196451 - protein, 69 aa, Glycine max
  Coding DNA Sequence Number=SeqID_79673
MDEFYAQVAWLGAQPSPSGGGGASAAQEPVPEEPPLEENEHVIGSVTENVSQFVRLIVKECINRIPVRV

SEQ ID NO: 196452 - protein, 63 aa, Glycine max
  Coding DNA Sequence Number=SeqID_79674
TGFHITVNKPVLSQKINCYKGKEFFLEDEEVGVSVCFVKARPGRMLKHELAMLQHKYELTFLD

SEQ ID NO: 196453 - protein, 409 aa, Glycine max
  Coding DNA Sequence Number=SeqID_79675
MEDFMLYKKQCPKSSDKKGLILRNNGIGISVMEPSRGTTQLKGLTFVKMGIFDNFPENAQKHIRRKNHLSKLRGRKLKRSLNPPNLASPNLNSLPKEKIHLHHLTQNPLTYPKDPRNNHFPTFLNNTQEEGIKSVYEPESQPPPKRSTIKIKHPQPQPLPISPPKQPSPSSTQDYELEILDTPTPQPLPSLVLPLQPTPKPTSPITSKKKRKNALQIEVGIIAFVEAMTIEENKKKAAEETTIFVVNDEPIPKDQLQFAIGHDTEVFSIDAASRQVELEVAVVLEDLDPLEKEAREEELVQSVIKASLQESEDHVIETNSGDTIRQMDIVLSKVLSADTIRRFKVIYGPSNSNSIEDIQEGLEHMKWLLPSRSFPSSITSFVVSVELDVNVRFYPGFRGHRILEWQTYK

SEQ ID NO: 196454 - protein, 54 aa, Glycine max
  Coding DNA Sequence Number=SeqID_79676
MEPRNPSPSLSPVRVLIRPCRLRPPPPPPPTIPLWHQCRGSLAPPTARIISNWA

SEQ ID NO: 196455 - protein, 97 aa, Glycine max
  Coding DNA Sequence Number=SeqID_79677
  Homolog annotation: Hit_ID=Q6AUZ6; Match level="QueryCoverage=48%, HitCoverage=12%, E-value=3e-12, Identity=58%"; Hit description =Putative phosphodiesterase family
MVGYGRNLQLAQQELSVIINLINIVCTCYSLSFMGKTSISQDHLPFFNVVHPYTYRNEFPYMHFNFSQDRYMEYDYWINKTSVDGLFTIFTSSLHHY

SEQ ID NO: 196456 - protein, 58 aa, Glycine max
  Coding DNA Sequence Number=SeqID_79678
MENCLVKLQTKFREDPTVNEGWAAFLPRQLHGVTVGAGVGVAVDDIGGLGCGGKSIRV

SEQ ID NO: 196457 - protein, 148 aa, Glycine max
  Coding DNA Sequence Number=SeqID_79679
MNTSSSNASDVELRRTHGIHESVVMHFVAWDKNTTFSVDVVGPLHRQTHQRAATTTRRHVFTIDVSEDMIQHNYQLVDCGRGRHHEWMITMNNGLSCVSESWIHYLADFHLKPGDEVVFFYNIDQHLWEFLYRKQVKWDQEEDEADST

SEQ ID NO: 196458 - protein, 143 aa, Glycine max
  Coding DNA Sequence Number=SeqID_79680
  Gene Ontology: Mol. function=protein serine/threonine kinase activity; Biological process=protein amino acid phosphorylation
  Homolog annotation: Hit_ID=Q94KF3; Match level="QueryCoverage=75%, HitCoverage=34%, E-value=9e-41, Identity=77%"; Hit description=Pto -like kinase SG5-3f
MAPKSTLRLMRTLGLSLASPVQSSWSLLSNALGGAQIDQNSLRKFSDTVEKCLQEDGSDRPSMDDVLWDLGYALQLQRGANAIHKVQHEDSSSSVSASFQLPNVRHLPSFSTLSEADDSVVRGDKSNSAEDFVFSQLKMEDAR

SEQ ID NO: 196459 - protein, 909 aa, Glycine max
  Coding DNA Sequence Number=SeqID_79681
  Gene Ontology: Mol. function=DNA binding; Cellular component =chromatin; Biological process=DNA integration
  Pfam annotation: Domain name=rve; Domain location=380-479; Score= -5.5; E_value=0.017; Accession=PF00665.16; Description=Integrase core domain
  Pfam annotation: Domain name=zf-CCHC; Domain location=245-262; Score =16.6; E_value=0.0018; Accession=PF00098.13; Description=Zinc knuckle
  Pfam module annotation: Pfam domain module=RVT_2::rve::zf-CCHC; Domain location=551-707::380-479::245-262
MNIHNFKEYEIPIGVIEQPYVEMAVLVYHNTTGVFGGNGGFPENFPILDGKNWEQWSVQMNVLFQFQDVLKIVQNGYQEIGDNPTVAQRVIHKDAVKSDNKALFLIHQSLDASIFDKISKHLQLRKRGIYWRGGSLVDRRFESLTNAMKGCSEQITNQMIIDKIMCTQTQNFDHIVVAIEESKDAQVKGDFAKWKGKKLQGNFFKRNWNSNQRKTKVEDKVESSHRGEVGSSDQGKRKKEDRRKIQCFVCDKFGHYVEECWLRKGKGKQKVEDQEANVAHEDSDLDPVLLMVTTTECASSLEACYLDTGCSNHMTRHMEWLIDLDTSRYTKCNLMSVGQLVENGFSVIMQNESLQLFDSNKRFSHLNFRSLSQLQSKDMVIGLPNVHVLDKMCKVARLGGNKYFVSFVDEHSRMMWLYLIKAKNGGGEYTSREFEDFYEKCGIQHAKCLPHNFWGELVTTAAYLLNKCPTKRLKEKLIHGIGKMELAAVKIQVFKFSYKMERHIPSRLSDYEILHDSEVTPDGDLVHFARIADAEPIDHEEAMQEDVWKKAMLEELETIKRNHTWELTKLPPHKKAIDPRVDYIEVFAPVARLETMRLVITLASRNGHSLFHLDVKSTFLNGFLDKLVYVTQPLGFEIKGNERMNEFKVVMMVKFKMSDLGKLSYFLGMEFLTTSKGIIIHKRKYATDVLKRFSMIECNLATTLAKVNLKLDATSDDDEEVDPTLFKQLIGCLRYLCNSRTNIALSIGLVSRYMSKPRKSHLMAAKRILRYINDTLEYGVLFSSKLVQQKNELIGYSNSDWCGDKSNKKSTSGYVFKFLEAPISWCSKKKPVVVLSTCEAEYIAGDFAACQAMWLVSVLKKLKIEVKNPIQLLVDNKSTIDLPKNPVSHGRVCQVLSQPRANGKVSNMC

SEQ ID NO: 196460 - protein, 400 aa, Glycine max
  Coding DNA Sequence Number=SeqID_79682
  Gene Ontology: Mol. function=RNA-directed DNA polymerase activity; Biological process=RNA-dependent DNA replication
MEIQPPRPSPYITFTNANFKGVSPHDNDPIVIYTVLMAFNVLPILIDGGVKTKVRDYVNLETTFGDKGAKTPTIQYMVVNTPSTYNILLRRPLMNKLEEIVLTAYLKVKFPLDHGLVGVISVHREITCRCYYEILRAKRELYGLAKHYGVHFVELDPRRDFIDQYSTSMEEVKELEIGKGKKVKIGTTLTHHLEDNLLEVLKHNSNDFAWSSSDMLKNARATYQRLMDKVLAKLMEKIIEAYVGDMVPVIVQEVAAEQCSIYFMSQVALAFLKLSEYDIIFDPVGLYTSLVHQKGRKKIIKPRIPSWQILGENKELAQSFTRFDPDNLLRDENDRADILFRLGVEAKLSKFILKMPKTQVENQESNKFQESKSRSIKNQDSSEDSREDSRYARTSRKASR

SEQ ID NO: 196461 - protein, 95 aa, Glycine max
  Coding DNA Sequence Number=SeqID_79683
MRLSVLLLVFLAVLAATRPSLVDCRVLPSPKNTEKAPHEPLKVIRFLINLVMAEKANTSEGNISNRVLTENKFQTMSSGPSRRGDVSAKSNQQGD

SEQ ID NO: 196462 - protein, 137 aa, Glycine max
  Coding DNA Sequence Number=SeqID_79684
MKRMVDIRRESTKEKRVAVEQTRDFNPFTMVMLNTEIPMNIQIPKLPLFDVQALCWNPDWVALDWFTRLPNNSIVRFDDLSHAFVTQFVANNERPPSTADLFDGRSVTPICCQPDTMTDVCSQVTCHIEVKDSMARK

SEQ ID NO: 196463 - protein, 195 aa, Glycine max
  Coding DNA Sequence Number=SeqID_79685
  Gene Ontology: Mol. function=RNA-directed DNA polymerase activity; Cellular component=mitochondrion; Biological process=RNA-dependent DNA replication
MKEFLGSILEVNRWGLKLSEQGIIGLHFNLTTWNFLRNAMHINDTPICMVFQPSICILGLPRGLSTSGKWAKAESVAKITTERVKKFLWQSIICRFEVPNTLIANNNTQFNHDNVKEFYEIHNIRLISTLVEHPQSNGQSKGDQLVDLDTVREVHGVTPVQEAMTKLRAKLRYNSRVVSREFKEVDLVMKKAQPN

SEQ ID NO: 196464 - protein, 484 aa, Glycine max
  Coding DNA Sequence Number=SeqID_79686
  Gene Ontology: Mol. function=protein serine/threonine kinase activity; Cellular component=membrane; Biological process=protein amino acid phosphorylation
  Homolog annotation: Hit_ID=Q1T642; Match level="QueryCoverage=97%, HitCoverage=75%, E-value=3e-41, Identity=29%"; Hit description =Protein kinase
MAILQLHRIQHSVCVLLVFLIHFSSLQFPSHGYTVPDKYFNNCGSDSSASKSGKNYVGESNLKTSFGSSNTERSESQVPSPLYQTAKKFRSEASGYKFNINVAPTCFNVSVPGFWLLRNFNGRNDSDNNSAVVKEFFMQITSGSFKITFRPLPSSFAFVNAIELFILPIHLTANQVSRFTYSGNTSLDPLSGDDSYILNTENAKNRSPYLGPIQYRVGNDSDGSNANEYTAPSDVYGTAKEINSSSSSAGNITWALLVDNNADHLLRLHFCDYWSPQNDLKYFDLSIYDTYVMSVNIDNQELPAPYYYDFVVHSDDSGFMKVSIAPDASAPIPNAFLNGLEIMKVIMTSSSVPLDQEPYSNHNSLPVVLGSVIGGLVVVFAVVILGFLWRFKMRKEKPVENSDWLPIPITAGGSSHGRLTDGTSHGSPLPNISLRLKSPLIDLQLATKNFHASQLIGEGDFGNVYKGVLRNGIIFAVKRSQPGS

SEQ ID NO: 196465 - protein, 139 aa, Glycine max
  Coding DNA Sequence Number=SeqID_79687
  Gene Ontology: Mol. function=structural constituent of ribosome; Cellular component=ribonucleoprotein complex; Biological process =translation
  Homolog annotation: Hit_ID=Q9XF97; Match level="QueryCoverage=72%, HitCoverage=32%, E-value=3e-22, Identity=48%"; Hit description=60S ribosomal protein L4
MEITVVGFHDRVAVEIIVGFAMTYYGFHVWRVGGVNAISFCFLDTLGGVPNNEWELCDKLDAVATGGDGGGSDGKDDDVALLAPWPGAVCFAAGNTGDTGDDMTSSLRLVEGLVASAVADDVGLSIVLGDVGVYEVDYV

SEQ ID NO: 196466 - protein, 67 aa, Glycine max
  Coding DNA Sequence Number=SeqID_79688
MTLAKLESTFGAKRNSSQLTFHSKGDVKKCYFAYPNGQTMGIWVTNQQSKYKGDATVNESWIMVLPE

SEQ ID NO: 196467 - protein, 61 aa, Glycine max
  Coding DNA Sequence Number=SeqID_79689
MAVLWWLLVAERGEGNDVFPRLHEKQRLKHSSASSHGKGSIPHMPDVVSKISTVRSWTSVL

SEQ ID NO: 196468 - protein, 70 aa, Glycine max
  Coding DNA Sequence Number=SeqID_79690
MAVDNIGTNEAKENGSTNEQAIWPTRPIKVAINDHLPFSPIRPSVRNATSGNVSQLLRVRTTLKSLESKL

SEQ ID NO: 196469 - protein, 148 aa, Glycine max
  Coding DNA Sequence Number=SeqID_79691
  Subcellular localization annotation: CTP_CleavageSite=36; ConfidenceScore=5.20e-01
MAFLGETSSQTVVNSTLGFIFPNGSIVHNDSGVSFQASTPVPIRVPNGIARTPDGILNLLEATMTPTHDALLYYNGRWNMSRQNEFVGYSFIGKNPKNFDIPTGCTMDELKDLIKQVAPRGIPPYGVDETQMITRLFFRIVNQLKNEK

SEQ ID NO: 196470 - protein, 160 aa, Glycine max
  Coding DNA Sequence Number=SeqID_79692
  Homolog annotation: Hit_ID=Q5G7T2; Match level="QueryCoverage=21%, HitCoverage=17%, E-value=3e-07, Identity=68%"; Hit description=U-box and ARM repeat protein
MEGERKEKKPPRRSTPSAPSVITGVKRWSAAPFPFCFEAPILDLRGACADSYACFAGFVKIQRGEGADGTVLRVCADSYACFQEWKLKGSSDWDSQFVCSTVKKKGNEKKKEDLVRAVCQLEASMIQTCNLTPEGACGKLSHDMKAIQHQISLKLYSLSP

SEQ ID NO: 196471 - protein, 108 aa, Glycine max
  Coding DNA Sequence Number=SeqID_79693
MEPGKTPMVALLTWRTVRLVRRVAARARQSEGEAEERRREIKGERRSSTMRPTLASSSRERWRRREREGGDEGANVDATNEYVRQGKEAVVEDDVELVAEAGDALVRA

SEQ ID NO: 196472 - protein, 145 aa, Glycine max
  Coding DNA Sequence Number=SeqID_79694
MVAITLAKVHQPPFLREYDSNATCACHGEAPGRSIEHCRALKRKVQGLIDTGWLKFEENRLLNPNINKQHHTWGNSGSCCYDSSGFSIDIFVPHPLTNACLLIQLSPECGCKPLVCLLKQPALLSVDFQDRSIRDYSSCTLVGVP

SEQ ID NO: 196473 - protein, 98 aa, Glycine max
  Coding DNA Sequence Number=SeqID_79695
MVGAGLKKDLRVSRVVPGGSLNAFLFLLIGVISQRLAMLLFPLVRVNFELGVIMVIAVSFGKPVVPAALMNRPTRGERRFAYWALAECILAYYVGTDE

SEQ ID NO: 196474 - protein, 88 aa, Glycine max
  Coding DNA Sequence Number=SeqID_79696
MPKIIAHKWKFGNLLQAPNTLPMKGLFVTKLESNEVLLSPIALKVVGAMLIDSNSSWDGTNLPSNSLYGNPQTWKQRDKQQPKTKKLK

SEQ ID NO: 196475 - protein, 52 aa, Glycine max
  Coding DNA Sequence Number=SeqID_79697
MSMNLGSIMEREEKRKRKWRRESVFPEPQSVIGFNSKNPCAFLMVLPFEGVV

SEQ ID NO: 196476 - protein, 159 aa, Glycine max
  Coding DNA Sequence Number=SeqID_79698
INNVNNVQTGESMRAITSPDDGSERSEIPPTGEVGRSAVSPAGESEGATASSDDASEMIIRGGDGGTTSRSGEDSGFTTGDCGSAGSGSTCTGVGSSGAASLHMRINCPQNKLCNIGIKECACWASGSMDAVEGNGLDDEGMSSVLALFLDSICNLKRT

SEQ ID NO: 196477 - protein, 59 aa, Glycine max
  Coding DNA Sequence Number=SeqID_79699
MVTEKVLTVKMWMEDSCEGPSGFNDIDEATLEAVGDISMEMEELGEDDLSEYEFDYEDS

SEQ ID NO: 196478 - protein, 489 aa, Glycine max
  Coding DNA Sequence Number=SeqID_79700
  Homolog annotation: Hit_ID=Q4ZUE8; Match level="QueryCoverage=31%, HitCoverage=41%, E-value=1e-32, Identity=48%"; Hit description=Major facilitator superfamily
  Pfam annotation: Domain name=Rrf2; Domain location=329-453; Score =44.7; E_value=3.1e-10; Accession=PF02082.10; Description =Transcriptional regulator
ARRLSGYCRAAVSGGAAGLPVCAAGAAHAIDAKNQATAYRTEFTGSHAVLAAVQHIYPRVGDHDGDIGAADYPAAGERAFAERRAGNQHAAGAVPGGVAHCRYGVQTRPSHLDHFLLGRAGGTGITAAGLLSRVGAGEYGAVRCREWLAGYRARYAAAGDGKTGRVRHCGWPHGATGADWSGAHTADWRLYFPAFRCAGYAVAVMCAGAYQRAFGGGAEAEIAGRRSGIRRQHNALNSRVQPAETMKGSGAIRTHCHKVGAFRQLVAAVMMPTVSGRTVAHTAHHACRNYLPFVTTSFASPQLQRWGQKSDTSRILLRKAQSAKAETEMLDYRFPTALQMVLSVAMAEQLGKRSTSAILAYGLEANPSFIRKLMVPLTRDGIIVSTLGRTGSIHLGRPAAEITLRDIYTSVIEDKKLWASRPDVAPRCLVSANLCWYFKSIAEQTEEASLKVLETRTVADALNELKKHDTSNCEPLPDLEIAELCKKDR

SEQ ID NO: 196479 - protein, 71 aa, Glycine max
  Coding DNA Sequence Number=SeqID_79701
MVGAFSQNIVTLTGLPMILLSESDLTNPLCGVSCYVLLSAPGWFFTDMMNRWMTIKNLMLEDTGTQRSDRM

SEQ ID NO: 196480 - protein, 73 aa, Glycine max
  Coding DNA Sequence Number=SeqID_79702
MVQGKFVPNLGEVLSRYESYVPKKKGKYGEGMNEKVTVILWMNALLEPKLLNPRKTMNCWQPNPITSLESPSN

SEQ ID NO: 196481 - protein, 313 aa, Glycine max
  Coding DNA Sequence Number=SeqID_79703
  Gene Ontology: Mol. function=transcription regulator activity; Cellular component=nucleus; Biological process=regulation of transcription
  Homolog annotation: Hit_ID=Q1SJ77; Match level="QueryCoverage=93%, HitCoverage=96%, E-value=5e-68, Identity=47%"; Hit description=Helix- loop-helix DNA-binding
MEQTTLEAIQFNEEIQGLMAAPAPETANSFTALLELPPTQAVELFHSPERAGKPPRHSPKSYPLTSFAASASAPATATATANANLTFPSNAALIDRAARFSVFAGQSSNSNSPEVKRELPETDSNPSSTHGGGGGGSVSDLAVENQNLKTAKRKEREKKVKASSKKSKSVAAADEISGDGEKLPYVHVRVRRGQATDSHSLAERARREKINARMKLLQELVPGCNKGVTPMDCNFPPTVAPVMWPEIPQNGNRQQYQQPWPFDALHQPLWGREEDNTNFMTPENSLLSYDSSANSVEDGALKGNYKGGGTSSN

SEQ ID NO: 196482 - protein, 132 aa, Glycine max
  Coding DNA Sequence Number=SeqID_79704
  Gene Ontology: Mol. function=DNA binding; Biological process=DNA integration
  Homolog annotation: Hit_ID=Q1S3H4; Match level="QueryCoverage=50%, HitCoverage=13%, E-value=1e-16, Identity=50%"; Hit description =Integrase, catalytic region
MANYKAKKFFHDAHFYVWDDPHLFKIGADNLLRRCVTMEKAIGTLWHCHNSPCGGYYSGDMTVAKYILVVVDYVFKWVEVVATPKNDSNIVIDAILPRKGPFTRAMSKRLQKDWARAAEEGPRVLMNLRVDF

SEQ ID NO: 196483 - protein, 315 aa, Glycine max
  Coding DNA Sequence Number=SeqID_79705
  Pfam annotation: Domain name=DUF1723; Domain location=48-98; Score =6.5; E_value=0.086; Accession=PF08330.1; Description=Protein of unknown function (DUF1723)
MACTKQTLYVAEAKAKPQPGLAIVRIVGPPFGGGLAKGEACQSRCSGVTVPYLFASMGLRGQIGEMSSFHLPVREMVITLDDVSYLLHFPMTCRPINHVLSLFDKEAVKILLMSHLGILIETEASAATNTGVRVRLMWQEDLYHYYVESDSTIFGDKSSTHVHLTNAHYINKLDACHEYTWGVTAMAYLYDHLAYASKTDVRPYCLERVLRQFGLVQMIPCQPPPHPTYQLCGQTWRTSNSISFLLTMLCHLGTIIAWATTNRLCTRWRVILPGLIPDIIRSYTELVGPKSCARGHKSSSTHTTSYATVAEGFSS

SEQ ID NO: 196484 - protein, 215 aa, Glycine max
  Coding DNA Sequence Number=SeqID_79706
  Gene Ontology: Mol. function=DNA photolyase activity; Biological process=DNA repair
  Homolog annotation: Hit_ID=Q1RUS6; Match level="QueryCoverage=53%, HitCoverage=25%, E-value=8e-43, Identity=70%"; Hit description =Deoxyribodipyrimidine photolyase, class 1
MYNIQDKINLSLVMKIRHLGELHQHRLGLLDAHDEIGVARLEAAAEVGDRVDKEGGTIGPSLVKVGCRLAVVRWVEEVDGEDGEGVVVGGGEALIVKEAEVVAEPDEGGAAEGGGIGRVAGAVGSNGERGVEGIGGFEGGFGRRRSGGGERKVCAVQLGFHATFAPSTITALSEYGGIRVQCVSRAKRAFTFQKYLYFLALSVCCPLSLCIALSA

SEQ ID NO: 196485 - protein, 64 aa, Glycine max
  Coding DNA Sequence Number=SeqID_79707
MKNSEESPRNRSRKRHGSVTEGKRGRSPSSPRRAGLLPPEGTAFCWNPLECPSGPGCYLHTLFY

SEQ ID NO: 196486 - protein, 529 aa, Glycine max
  Coding DNA Sequence Number=SeqID_79708
  Gene Ontology: Mol. function=oxidoreductase activity; Cellular component=membrane; Biological process=electron transport
  Homolog annotation: Hit_ID=P93147; Match level="QueryCoverage=93%, HitCoverage=92%, E-value=0.0, Identity=63%"; Hit description =Cytochrome P450 81E1
  Pfam annotation: Domain name=p450; Domain location=30-513; Score =303.9; E_value=3e-88; Accession=PF00067.12; Description=Cytochrome P450
MTPFYFLLFAFILFLSINFLIQTRRFKNLPPGPFSFPIIGNLHQLKQPLHRTFHALSQKYGPIFSLWFGSRFVVVVSSPLAVQECFTKNDIVLANRPHFLTGKYIGYNNTTVAVSPYGDHWRNLRRIMALEVLSTHRINSFLENRRDEIMRLVQKLARDSRNGFTKVELKSRFSEMTFNTIMRMVSGKRYYGEDCDVSDVQEARQFREIIKELVTLGGANNPGDFLALLRWFDFDGLEKRLKRISKRTDAFLQGLIDQHRNGKHRANTMIDHLLAQQQSQPEYYTDQIIKGLALLCLWPQETQVLTCEPALVLRPMGVLETKTWKVMLLAGTDTSAVTLEWAMSNLLNHPEILKKAKNELDTHIGQDRLVDEPDIPKLPYLQSIVYETLRLHPAAPMLVPHLSSEDCTIGEYNIPQNTILLVNAWAIHRDPKLWSDPTHFKPERFENESEANKLLPFGLGRRACPGANLAQRTLSLTLALLIQCFEWKRTTKKEIDMTEGKGLTVSKKYPLEAMCQVCQSLTVKDIYNF

SEQ ID NO: 196487 - protein, 683 aa, Glycine max
  Coding DNA Sequence Number=SeqID_79709
MDDAKKLYESLFDQLNSTFRRFFSALPQRHHDPYARSLRPPPPPPHPRLWPIVQELSLVLRSCLLLLTLPRSDQKFLLLKCRFLLRVLKSFLSLDVAEHGGLRFRNFLSGVDLELPDSCRSYLCALLEDFAKGVVRCMRLLPDELLRNQSLRRYLMKVDSVSSTSEKLFMCHFNQGDIASVLEVITTHFIMSVSNEKAFEDFTSGLFLQCNMDFRFPKLSLAPSMMLLLDPVVLSAPKMFQAHTFSMVSEAIGSGLSSEILAPDMNCHLTALQKSVILYSTHVSSLQINGFCVELKCSYNSYLLERGQPTFEAYILQGTRNRLNQVLSKLDNSWDSYHCKMSSKSKADLLADYIAFMKERQHIFVDSCRDATTLILDCIIHQAFSQDATGDAVYHIKENTSAQDIHLLASILKLMSVSLLQTIKYLSNSGDSDCLKSMGSASVREKYDFLISIIDHFQQFKFCLPIQTLLYDAMKTQQSNYKVSKSMLVHFIGLLSLSFSNGFDLLAKGCILVLMALMCLFVFEEGDLVALGSLRGLSLQPCSSEIPSDKNGKGSRDKRPVYKVAAEFRRIQACNLRTVSFTSYNLQDGTEKTCNGEVFLNCILEDPKKVSDYDDLADFLECKTGKNYSKWLNGREVYRNRRYQRKIDLRKKKKETFWNSSKYRKIGKSLKRQNICTFMKHWK

SEQ ID NO: 196488 - protein, 274 aa, Glycine max
  Coding DNA Sequence Number=SeqID_79710
  Homolog annotation: Hit_ID=Q9M644; Match level="QueryCoverage=28%, HitCoverage=36%, E-value=4e-26, Identity=71%"; Hit description =AP2/EREBP-like transcription factor LEAFY PETIOLE
  Pfam annotation: Domain name=AP2; Domain location=29-95; Score=113.7; E_value=5.4e-31; Accession=PF00847.10; Description=AP2 domain
MKPYTSSPSSSKSKKKPTTTQQDHETAWGGRYLGVRRRPWGRYAAEIRDPSTKERHWLGTFDTAEEAALAYDKAARSMRGSRARTNFIYPDTPPGSSVTSILSPDEQTQTQIHQAQEELSSLFNPNPFPQPDPNPQFSLCGFSGIPNTPTFSATEEIASSGGYSYSYGYTEGGTGVESSHFKLFDDGETQLPPLPPDITSSMGYEMSNGLYGNDVGFSDPSCGANASGSGYPYSGFESGDYVVHSPLFSAMPSVSDNVATGHEGFDLGSSSYFF

SEQ ID NO: 196489 - protein, 77 aa, Glycine max
  Coding DNA Sequence Number=SeqID_79711
MIWENIDPHPHTEVTLAMKFFSERSLVKSKSAAMTSSIVQNRVTTWIPLPPGFVKCNLDAAIFKEQLSFNVGMWPSG

SEQ ID NO: 196490 - protein, 103 aa, Glycine max
  Coding DNA Sequence Number=SeqID_79712
  Gene Ontology: Mol. function=potassium ion transporter activity; Cellular component=integral to membrane; Biological process =potassium ion transport
  Homolog annotation: Hit_ID=Q7XIV8; Match level="QueryCoverage=94%, HitCoverage=12%, E-value=5e-26, Identity=57%"; Hit description =Probable potassium transporter 9
MVKVINYTCDYDTLLLGGTFALYSLLCRHANISLLPNQQAADEEMSCYKNGLSPEAAESSSLKRFLENHRSLKTALLVVVLLGACMVIGDGVFSPAISSKILL

SEQ ID NO: 196491 - protein, 374 aa, Glycine max
  Coding DNA Sequence Number=SeqID_79713
  Gene Ontology: Mol. function=potassium ion transporter activity; Cellular component=integral to membrane; Biological process =potassium ion transport
  Homolog annotation: Hit_ID=Q9LD18; Match level="QueryCoverage=96%, HitCoverage=46%, E-value=1e-134, Identity=64%"; Hit description =Potassium transporter 4
  Pfam annotation: Domain name=K_trans; Domain location=2-374; Score= -1.3; E_value=6e-21; Accession=PF02705.7; Description=K+ potassium transporter
MNMHLLKLWYWAGLACMTVMFVTTFLMALVIMFVWQKNILIATIFLLFFWVIEGLYLSAALIKVFQGGWVPLVLSFIFMLVMHVWHYGTCTKYNYDLSNKVSLKWLLALGPSLGVARVPGIGLIYTELATGIPAIFSHFVTNLPAFHMVLVFVCVKTVPVPHVLTKERFLIGRVCPRPYRMYRCTVRYGYKDIRRDDRDFDNHIIRCIAEFIQIEAQELQLSISETSSFDGGTTIISVRSFESVSSWTVSENEDVGVDNNIASGRSFSRQPSISTYDKENPHSRRRHVSFLVPDDPALDHEVKQELLDLAQAMEAGVAYIMGHTHVKARKSSSLLKRLVINVGYAFLRTNCRGPATALNIPHISLIEVGMIYYV

SEQ ID NO: 196492 - protein, 298 aa, Glycine max
  Coding DNA Sequence Number=SeqID_79714
MSSNLTIEQRLEQLQKAKERAQPQPPKGAKIQRVAHHLRDRKHFTKHYEPKLMSLGPIHHGAEKLQLGEQCKQRWAATYIESTGKTPQTLHKRVVDDFENQKKLFDDDLLLASTQQEKRNLLGPIRHKCTLLETQAPWKVMSTKFHSKKSPSLIEQTNDINVSEARLHNHGRKDSVDAVRGRVCPAANSGTCKSSRTGENENQGRSTGSGDGGRALVREPASFLFAETVVEKRRERVDENNEKVSSRSIILYDPNKRKQTQNNDNQNQDTNKGNEAQNDPNINMANMGNPTPNENPVQ

SEQ ID NO: 196493 - protein, 106 aa, Glycine max
  Coding DNA Sequence Number=SeqID_79715
MRKGKEGTYKYAKASDICKGSGQCNTCKGEFAKMTDQPSSMTPPVAKTVTLRPQPLPYQGYEKVKNEGHPLVFFYDFSCKKCVPSNKRISPRQNRQCSDYSRDRDD

SEQ ID NO: 196494 - protein, 104 aa, Glycine max
  Coding DNA Sequence Number=SeqID_79716
  Gene Ontology: Mol. function=drug transporter activity; Cellular component=membrane; Biological process=multidrug transport
  Homolog annotation: Hit_ID=Q9C9M8; Match level="QueryCoverage=74%, HitCoverage=16%, E-value=8e-23, Identity=57%"; Hit description=MATE efflux family protein, putative
MAGALETQCGQSFGTEQFHKLGNYVFCAILFLILSSAPISILWIFMDKLLVLLGQDHAISLVAGNYCIWLIPTLFGYSRFDCSRPWICGGSKPCNNFLYNWGGQ

SEQ ID NO: 196495 - protein, 69 aa, Glycine max
  Coding DNA Sequence Number=SeqID_79717
MYGGHGKVKVEGRKGDGKTCAYQDLIKITTNETKAVFVKNRSNRLTNKGGFIKTAFVTFVSKAVYKTRR

SEQ ID NO: 196496 - protein, 512 aa, Glycine max
  Coding DNA Sequence Number=SeqID_79718
  Gene Ontology: Mol. function=nucleoside-triphosphatase activity; Cellular component=membrane; Biological process=amino acid transport
  Homolog annotation: Hit_ID=P14175; Match level="QueryCoverage=48%, HitCoverage=62%, E-value=1e-105, Identity=80%"; Hit description =Glycine betaine/L-proline transport ATP-binding protein proV
  Pfam annotation: Domain name=ABC_tran; Domain location=1-111; Score =56.3; E_value=1e-13; Accession=PF00005.17; Description=ABC transporter
MELAGVALQERQEKALDALRQVGLENYAHAWPDELSGGMRQRVGLARALAINPDILLMDEAFSALDPLIRTEMQDELVKLQAKHQRTIVFISHDLDEAMRIGDRIAIMQGGEVVQVGTPDEILNNPANDYVRTFFRGVDISHVFSAKDIARRSAGALIRKAAGFGPRSAIKLLQDEDREYGYVLEKQKFIGVVSTDSLKAALAAGEGLDNALLDAPLAVPADTSLNDLLSHVAQAPCAVPVIGEDQQSPAMSAQNANPWESASQTSAPSATSNAAAASSDPWSTTGSSTPADSSASAADAWGNAAGSAPDAASSGAHDAVSSAASSSDWLSSAPAPAPEHFSLLDPFHTTLIPLDRWVTEGIDWVVTHFRPLFQGIRVPVDYILSAFQQLLMGLPAPVAIVVFALIAWQIASPAMSLATLISLVLIGMIGAWSQAMVTLALVLTALLFCVLIGLPLGIWLARSERAARIVRPLLDAMQTTPAFVYLVPIVMLFGIGNVPGVVVTIIFALPPV

SEQ ID NO: 196497 - protein, 103 aa, Glycine max
  Coding DNA Sequence Number=SeqID_79719
MDNRWGITVRHLTSQVRRTKSTEDNIANETYTDNHLGISACHLTSWVMINRNCLCTDNHSGYLRTSPDFTGYLRTSPDFTGQDERKHERRRKSPRVNGLVGHD

SEQ ID NO: 196498 - protein, 143 aa, Glycine max
  Coding DNA Sequence Number=SeqID_79720
  Homolog annotation: Hit_ID=Q2R0W4; Match level="QueryCoverage=49%, HitCoverage=4%, E-value=5e-12, Identity=46%"; Hit description=AT hook motif-containing protein, putative
MYNIKDVLDEDIIIGIKNMLDNNNHYAQKFKIARDKLQSSAVSNLKLKLICDRQSDGRLYNMPNTAEVVALIIGDEHIDCNQGTMKLKQYYIQGDCFNNGLLMASELRVDKYMNLSAYNNDPETLGNQKGMRVILPSSFVSGK

SEQ ID NO: 196499 - protein, 183 aa, Glycine max
  Coding DNA Sequence Number=SeqID_79721
  Gene Ontology: Mol. function=DNA binding
  Homolog annotation: Hit_ID=Q1SDS1; Match level="QueryCoverage=81%, HitCoverage=26%, E-value=2e-18, Identity=40%"; Hit description=IMP dehydrogenase/GMP reductase
MDGLVDLAAIDIFLTFHDRNESLVVAILADLYDTFDRRCEKNSTRIVCCTPALYVWLVSHLFRQEVRHACPLEGHRSCTEKKEASWDRLLASKEGASVNWFPRWKEGRTEILISCGGFPNVSLMGTRGCINYNPILAIRQLGYPMRGAPLEEDLTPIIARGFNSTNAQGMGDGAKEGQGTQRQ

SEQ ID NO: 196500 - protein, 77 aa, Glycine max
  Coding DNA Sequence Number=SeqID_79722
SCVDPSPTDPETGDSDECGLYIEENPSRLVALGRVYEGSTAVHNTPLLHGQVKVGVKEVKDAEAPVPVATDEVQLVG

SEQ ID NO: 196501 - protein, 61 aa, Glycine max
  Coding DNA Sequence Number=SeqID_79723
MTTICQCPLQWNLKWVGSKIHIASNSLCNFQIQTAIAQTSEWTEAQGIHRYQNSPLAYMFQ

SEQ ID NO: 196502 - protein, 151 aa, Glycine max
  Coding DNA Sequence Number=SeqID_79724
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=6e-22, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=34; ConfidenceScore=5.29e-01
MKARTCDPLKARACSPLKARSCSPMKARSCSPMKASPFEGEDVQPSKARMCSPLKARACSPLKARTCSPLNARACSPLKARTSSPLKARVCSPLKARTCSPLKARTFSPLKERKCSPLKGRAYNPLKARTCSPLKVRACNPLKARACSPLR

SEQ ID NO: 196503 - protein, 93 aa, Glycine max
  Coding DNA Sequence Number=SeqID_79725
  Homolog annotation: Hit_ID=Q47522; Match level="QueryCoverage=48%, HitCoverage=56%, E-value=3e-21, Identity=100%"; Hit description=LacZ protein
RVPFAIQAAQLLGRAIGAGLFAITPAGERGMCCKAIKLGNARVFPVTTLILSDVVVGQEDLSMVFALASTWAMFLAFGSLACVGPVSYTVGMA

SEQ ID NO: 196504 - protein, 471 aa, Glycine max
  Coding DNA Sequence Number=SeqID_79726
  Gene Ontology: Mol. function=4 iron, 4 sulfur cluster binding; Cellular component=periplasmic space; Biological process=nitrate assimilation
  Homolog annotation: Hit_ID=Q06457; Match level="QueryCoverage=93%, HitCoverage=50%, E-value=0.0, Identity=85%"; Hit description=Nitrate reductase
  Pfam annotation: Domain name=Molybdop_Fe4S4; Domain location=33-87; Score=87.2; E_value=5.1e-23; Accession=PF04879.6; Description =Molybdopterin oxidoreductase Fe4S4 domain
  Pfam annotation: Domain name=Molybdopterin; Domain location=90-471; Score=336.9; E_value=3.5e-98; Accession=PF00384.12; Description =Molybdopterin oxidoreductase
  Pfam module annotation: Pfam domain module=Molybdop_Fe4S4::Molybdopter in; Domain location=33-87::90-471
RRAVGARVAGEDRTGQSVGRQPGIAAARGGELMSETRTTCPYCGVGCGVIARVEPSGTVTVRGDENHPANFGRLCVKGAALGETTSLSGRLLHPEVDGRAVGWPQALAEAGSRLRDIIERYGPQAVAFYASGQLLTEDYYAANKLMKGFIGAANIDTNSRLCMSSAVTGYKRALGADVVPCSYEDVEQSDLVVLVGSNAAWAHPVLYQRLAQAKRDNPRLRIVVVDPRRTATCDIADDHLALAPGSDGGLFVGLLNAIAASGGMAAGFRDQRQALTIAAQWSVEKAAAFCGLAPEQVARFYRDFIAAPRAITLYTMGINQSASGSDKCNAIINVHLASGKFARRGCGPFSLTGQPNAMGGREVGGLATMLAAHMNFEPQDLQRLARFWGSERLAQTPGLTAVELFAAIGRGEVKAVWIMGTNPVVSLPDSHAVSQALSRCPLVMVSDVAANTDTGRFAHIRFPALAWGEKN

SEQ ID NO: 196505 - protein, 450 aa, Glycine max
  Coding DNA Sequence Number=SeqID_79727
  Gene Ontology: Mol. function=hydrolase activity; Cellular component =integral to membrane
  Homolog annotation: Hit_ID=Q5P378; Match level="QueryCoverage=59%, HitCoverage=95%, E-value=6e-69, Identity=52%"; Hit description =Predicted putative neutral zinc metallopeptidase
  Pfam annotation: Domain name=NUDIX; Domain location=315-446; Score =68.8; E_value=1.7e-17; Accession=PF00293.18; Description=NUDIX domain
  Pfam annotation: Domain name=Zn_peptidase; Domain location=5-276; Score=482.3; E_value=5.8e-142; Accession=PF04228.4; Description =Putative neutral zinc metallopeptidase
  Pfam module annotation: Pfam domain module=NUDIX::Zn_peptidase; Domain location=315-446::5-276
EILVRLDDLEESQHVEDSRGRSMVGGRSIGIGTIAIALIAMYFGVDPNLVLNIAQQAQPAAESQAVPADSRDPKVKFVSRVLWSTEQVWQKAFADAGQQYTAPNLEIFGGATQTACGQGQAAMGPFYCPADQKVYIDLSFYQELQERFKAPGDFAQAYVIAHEVGHHVQNLLGTSAKVQQARQQARSEAESNAYSVRLELQADCYAGVWAHHADQQFRILEEGDIEEALRAATAIGDDALQKQAQGYVVPDSFTHGSSAQRVRWFKQGLQSGREQHLIETTVSSEILAKGKMLTVRYDEARLPNGVISGREYVIHPGAVVVIALTQEGGVVLERQFRYPLKQVFIELPAGKIDPDEPVLTTGQRELLEETGYTAQEWVKLGVQHPCIGYSNEVIHIYLATGLSLGAHARDIDEAMDVFVWPFEQVMQAIEAGEITDSKTMSAMLLAERYL

SEQ ID NO: 196506 - protein, 212 aa, Glycine max
  Coding DNA Sequence Number=SeqID_79728
  Gene Ontology: Mol. function=DNA binding
  Homolog annotation: Hit_ID=Q1SP03; Match level="QueryCoverage=88%, HitCoverage=38%, E-value=2e-17, Identity=34%"; Hit description=IMP dehydrogenase/GMP reductase
MGTNQTGKRFYQVKVKSLDTTSIKELGRLMEPLQMQAFRKTYGKILELTIVEVSIEAVASLTQYYDQPLRCFTFGDFQLVPTIEEFEEILGCPLGGRKPYLSSGCLPSLSRIATVVKDSARGLDRIKQTRNGIAGLPQKYLEDKPRGMANQGDWVPFMDVLALLIFGVVLLSKRGWFGAKRVAHGSSVAYPPSVFGWFRTCSDKTQDIHVRS

SEQ ID NO: 196507 - protein, 159 aa, Glycine max
  Coding DNA Sequence Number=SeqID_79729
  Gene Ontology: Mol. function=metal ion binding; Biological process =metal ion transport
  Homolog annotation: Hit_ID=Q7N6G7; Match level="QueryCoverage=92%, HitCoverage=87%, E-value=6e-58, Identity=71%"; Hit description =Similar to putative sensory transduction regulator YbjN of Escherichia coli
MDSLIVPDLALLRRWLDQSGISFFECDSCQALHLPHMQNFDGVFDAKIDLVDNVILFSALAEVKPTALIPLVADLSQINASSLTIKAFVDIQDDNLPKLIVCQSLSVAVGITYEQFTHFMQQGEEQVSMVILEARANDLLFMGDEEEIPAGAVRQPMLH

SEQ ID NO: 196508 - protein, 98 aa, Glycine max
  Coding DNA Sequence Number=SeqID_79730
MREISMGSVATYPSVGGRRETHGCVFQERKTRGVATNVYSRKTSAKPERCGLRTLSVNCSGVVFTHGEVDKGVSLAPTYSSIVIYCDQTKSRLRSWTI

SEQ ID NO: 196509 - protein, 91 aa, Glycine max
  Coding DNA Sequence Number=SeqID_79731
MIVIVKKGENVNHAAFDDVEKNSLDNDCHHQKGGECEYQANKIKKKIRPQTISLVDQALSSKHIVSNIQGSSNRLPGSVIDYQKTILKISF

SEQ ID NO: 196510 - protein, 268 aa, Glycine max
  Coding DNA Sequence Number=SeqID_79732
  Gene Ontology: Mol. function=N-acetyltransferase activity; Biological process=metabolic process
  Homolog annotation: Hit_ID=Q5H5C1; Match level="QueryCoverage=49%, HitCoverage=66%, E-value=9e-41, Identity=64%"; Hit description =Phosphinothricin acetyltransferase
  Pfam annotation: Domain name=AHSA1; Domain location=8-79; Score=84.4; E_value=3.5e-22; Accession=PF08327.1; Description=Activator of Hsp90 ATPase homolog 1-l
  Pfam annotation: Domain name=Acetyltransf_1; Domain location=191-262; Score=27.6; E_value=4.3e-05; Accession=PF00583.14; Description =Acetyltransferase (GNAT) family
  Pfam module annotation: Pfam domain module=AHSA1::Acetyltransf_1; Domain location=8-79::191-262
MCTARVLPFSPAAIYDAFASPELLAQWWGPEGFSNTFEVFEFKAGGQWKFVMHGPDGNDYPNESVFAVLELNSKVVIEHVCAPLFTLTVTLNPVENGTQLSWEQVFADEATAQAVKHIVEPANEQNLDSECKGALLKFVVCQHAVHAQQILDIFNEAIVNSTALYDYQPRAFDSMLPWFQTKESNGFPVIGAVDSTGVLLGFATYGTFRAWPAYKYTVEHSVYVHKDHRGKGLGLALMQQLIAEARSTSGACDGGWYRCSECGQYYLA

SEQ ID NO: 196511 - protein, 153 aa, Glycine max
  Coding DNA Sequence Number=SeqID_79733
MASRKRKATTSVSHAGYDKSRLVSQEAWDRYSDNVLARNILPERNVKLYITEFDDFRRELIRRNWHRQQTNLAEGSIDVAIVKEFYANLFVHDDTSPKQVRVRGHLIKFDVDSLNTFFETSMVVEQGESLPSYSRFARLRPDPQELAARLCIL

SEQ ID NO: 196512 - protein, 145 aa, Glycine max
  Coding DNA Sequence Number=SeqID_79734
IPASPPQLDLAPYASEPYNAQWNAPWLLRDKHTLRSSRILGEMEVDEPWLGLWLPLNYQVDMGASLAYDTRIWDESYRLFAAKFLFGFVVDLGMAFMDNWVVGNEKGATWAARSLHLWAYSLKDLCPFLHMFCSRILSGTISKLY

SEQ ID NO: 196513 - protein, 91 aa, Glycine max
  Coding DNA Sequence Number=SeqID_79735
NSGGYIHLVVQREQGRVHPLWIFAFKGFYKVEKKSQGPQVAWGVDVGTGCCRTSHLIQQARVSEDPLSELSTLSTKRDKRLAKRVDDALSA

SEQ ID NO: 196514 - protein, 62 aa, Glycine max
  Coding DNA Sequence Number=SeqID_79736
VEKIAVSDSALVEEAGVDDDSTFSRVSIRSGDSSCFSWAIESTENGITAVRVSAASLSKSGT

SEQ ID NO: 196515 - protein, 174 aa, Glycine max
  Coding DNA Sequence Number=SeqID_79737
  Pfam annotation: Domain name=zf-CCHC; Domain location=23-40; Score =22.8; E_value=0.00017; Accession=PF00098.13; Description=Zinc knuckle
MALPLIIEKKAPKASMQEKTSSIKCFKCLGRGHITSQCPTTKTMIMRGQDIYISQDDATTSPSSNENEEAIGEESREEIYPQEEGQPLMVKEECKEVSVSFKRLAKKESHFEINTNIKETSPLKQPPHLLLCKKTLVSTATPLGLEVIPQVKELLDEGLVRKSLNPCALLVPKI

SEQ ID NO: 196516 - protein, 75 aa, Glycine max
  Coding DNA Sequence Number=SeqID_79738
MNSAHNITHFGGGYELVKCLKCPYSITSAEQLLERKEKEKVEEETRGVRCPSLTIREVKEQVGVFKHGAVTGPLK

SEQ ID NO: 196517 - protein, 207 aa, Glycine max
  Coding DNA Sequence Number=SeqID_79739
  Gene Ontology: Mol. function=nucleoside-triphosphatase activity; Cellular component=nucleus; Biological process=DNA replication initiation
  Homolog annotation: Hit_ID=Q1S047; Match level="QueryCoverage=76%, HitCoverage=18%, E-value=1e-44, Identity=60%"; Hit description=MCM; Nucleic acid-binding, OB-fold
  Subcellular localization annotation: CTP_CleavageSite=44; ConfidenceScore=5.80e-01
MASDSSPLNFNNGPSSPDDSLSSPIGNTFSSPASRRRRRSSTPSAFATPSERRSRFASSDATPTAPRSRQRGGSGGGGGHVPATPTSTTDDVPVSSDGGDGFDMDDARPTFVWGTNISVEDVNDAIKRFVRNFREASSSQGGDDDDGLHLHTEGKYEKLIRQVIDVEGDSLDVDARDVFDHDPDLYTKMVRYPLEVLAIFDLVLMNM

SEQ ID NO: 196518 - protein, 53 aa, Glycine max
  Coding DNA Sequence Number=SeqID_79740
MGEQWRQFKSDLMSKWALAANKDNIDDTVCEKYGISKEKWAQFCQTRREPLGE

SEQ ID NO: 196519 - protein, 174 aa, Glycine max
  Coding DNA Sequence Number=SeqID_79741
  Gene Ontology: Mol. function=nucleic acid binding; Cellular component= nucleus; Biological process=DNA integration
  Homolog annotation: Hit_ID=Q1S3Z1; Match level="QueryCoverage=85%, HitCoverage=11%, E-value=7e-58, Identity=75%"; Hit description =Integrase, catalytic region; Zinc finger, CCHC-type
MGTKYNIEKFSGNNDFGFVEDHTKLLYVDDILIDSSSKDEISTLKERLSSEFEIKDLDIARRILGMDIVRNQMKGELFLSQQGYLKKVVERFRMHQSKPVSTPLGHHTKLSITQAPNTEEERRKMDTIPYASGVGSIMYGMVCSRPNLAHAVSIVSRFMADPCQAHWEALKWVL

SEQ ID NO: 196520 - protein, 725 aa, Glycine max
  Coding DNA Sequence Number=SeqID_79742
  Gene Ontology: Mol. function=protein dimerization activity; Cellular component=nucleus; Biological process=regulation of transcription, DNA-dependent
  Homolog annotation: Hit_ID=O22208; Match level="QueryCoverage=79%, HitCoverage=78%, E-value=1e-113, Identity=44%"; Hit description=BZIP family transcription factor
  Pfam annotation: Domain name=bZIP_1; Domain location=210-274; Score =46.7; E_value=7.6e-11; Accession=PF00170.11; Description=bZIP transcription factor
  Pfam annotation: Domain name=bZIP_2; Domain location=210-264; Score =19.3; E_value=0.0082; Accession=PF07716.5; Description=Basic region leucine zipper
  Pfam module annotation: Pfam domain module=bZIP_1::bZIP_2; Domain location=210-274::210-264
MDSLFNTTDALPFASDLEFGMDFDNNGEFEITFDDLDELDDIFIPSDAEDFLLPDVCNSNYDSASPPIDAKNSDSPDSDVSAVSGEGDSADNVRVSSVPSPEAEFCDREESSNGPVSSQGSGNGGSGVYEAMHSPSPDSGPYERDITSSHAHAVTNNGVKMEETPAFDLKRKKESCDGSATKHRRFSSSVENNNNNTEKQSQSGLNGIDDEDEKRKARLMRNRESAQLSRQRKKHYVEELEEKVRSLNSIIADMSSKMSYVVAENATLRQQVGAAGVMCPPPPAPAPGMYPHHPPMAPMPYPWMPCAPYVVKPQGSQVPLVPIPRLKPQQPASAPKGKKSENKKSEGKTTKVASISLLGLFFFIMLFGGLVPLVDFRFGGLVENVPGTGRSNYVSDRVYGQGGGKVWSLNGRRNGSERDEDVGFSNGGRFSVSDRVNYERGRNFREERHDRRKGSDDFGRQGNASEPLVASLYVPRNDKMVKIDGNLIIHSIMASEKAMASQTAEAKKDKRETGLAIPKDLDSALAIPGVGRSRGQHPHVYSVSPEQRKALGSGSTKVLKDHMKSSVTDGKMQQWFREGLVGPMLSSGMCTEVFQFDVSPSPGAIVPATSVANVSTENRQNATSVKKTRNRRTLHELPEPLNGSSLNITEERVKNLQKDHLHGNKSSMVVSVLVDPKEAGDGDVDVDGMMRPKSLSRIFVVVLIDSVKYVTYSCGLPRASPHLVT

SEQ ID NO: 196521 - protein, 132 aa, Glycine max
  Coding DNA Sequence Number=SeqID_79743
MVPNGDADKGPIEACQAANLTNDDGSVEIDKSTIMAPDLQRILHFHPTLTVGARYKISVAVNLSDTCKGEKMERKRKTPSYTVPSKPSSPFLAFACVGEVDDDIDFAVGTGSEGGGGSAISTARRRNSKKDD

SEQ ID NO: 196522 - protein, 312 aa, Glycine max
  Coding DNA Sequence Number=SeqID_79744
  Gene Ontology: Mol. function=DNA binding; Biological process =regulation of transcription
  Homolog annotation: Hit_ID=Q6PT61; Match level="QueryCoverage=37%, HitCoverage=45%, E-value=3e-29, Identity=59%"; Hit description =Induced protein MgI1
  Pfam annotation: Domain name=Myb_DNA-binding; Domain location=119 -169; Score=43.6; E_value=6.5e-10; Accession=PF00249.21; Description =Myb-like DNA-binding domain
MREDDSNWFSRWEEELPSPEELMPLSQTLITPDLAMAFDIRNPHTSNTAQNQHHHHHQNQQPPQLQQPSNPSSLPNPQQQQQQQQQQQQQPTSAEFADSGELGSGTAGEEPARTLKRPRLVWTPQLHKRFVDAVAHLGIKNAVPKTIMQLMSVDGLTRENVASHLQKYRLYLKRMQGISAAGPGGASGAVADPATDHLFASSPVPAHFLHPAARPNSDHFLPFVPALHHHQQQQQMAAAAQYHRQVGHFGSPPNGHFENPFMSRPNLQRMGGGGGPVHNNHHPVSGYVEDMESANAASGGRKVLTLFPTGDD

SEQ ID NO: 196523 - protein, 153 aa, Glycine max
  Coding DNA Sequence Number=SeqID_79745
  Gene Ontology: Mol. function=protein-methionine-S-oxide reductase activity; Biological process=protein metabolic process
  Homolog annotation: Hit_ID=Q9ZQB9; Match level="QueryCoverage=69%, HitCoverage=21%, E-value=8e-11, Identity=32%"; Hit description =Putative glucosyltransferase
MSSPSPTTITTTVPRMPSNPTPQPLIKIDVDTDSGRENENPVVKTCFYSCIKLFLYLSVVLLVFEIVMYFEGWYFGMARFQLKHLLWASSFGIRFKKIKHVPIGGGVVDLESGEGKSFSFSPMVLVQIPMCNEKELDDGSGTMVVVISVGEGK

SEQ ID NO: 196524 - protein, 195 aa, Glycine max
  Coding DNA Sequence Number=SeqID_79746
  Gene Ontology: Cellular component=nucleus; Biological process =regulation of progression through cell cycle
  Homolog annotation: Hit_ID=O82717; Match level="QueryCoverage=70%, HitCoverage=35%, E-value=2e-41, Identity=56%"; Hit description=Cyclin
  Pfam annotation: Domain name=Cyclin_C; Domain location=55-188; Score =106.8; E_value=6.2e-29; Accession=PF02984.9; Description=Cyclin, C -terminal domain
MDFDYANTFGFPTSFYQGISPRSGAYIFILNNVDHELATVEYIDDIYKFYKLVEVNELVRLTDYTHEQVLVMEKTIMGKLENMAHFLSELGMMHYATIKYFPSMVAASAVFAARCALNKAPLWNETLKLHSGYSQEQLMHVNMNWDCARLLVSFHSTVANREEKVVYLKYSDPEKGVVAMLPPAKNLLPEGSNSQ

SEQ ID NO: 196525 - protein, 171 aa, Glycine max
  Coding DNA Sequence Number=SeqID_79747
  Gene Ontology: Cellular component=nucleus; Biological process =regulation of progression through cell cycle
  Homolog annotation: Hit_ID=P25011; Match level="QueryCoverage=82%, HitCoverage=31%, E-value=2e-20, Identity=44%"; Hit description =G2/mitotic-specific cyclin S13-6
MASRPIVQQEARGVARESVCLVIYFYDPLRIFGAKLLGNAPAPATAENNKKQACANVAGSPTVANGGVVVAKRMAPKPDQKKVVLKPKPKKVIDIKASPNKKEVLKDKKKEGDSNFKKKSHHTLTLVFTTRSKATWGITNKLKERIIDIDSDDVDDELVVVECIDDIYKFY

SEQ ID NO: 196526 - protein, 850 aa, Glycine max
  Coding DNA Sequence Number=SeqID_79748
  Gene Ontology: Mol. function=nucleoside-triphosphatase activity; Cellular component=membrane; Biological process=cell division
  Homolog annotation: Hit_ID=Q9LET7; Match level="QueryCoverage=90%, HitCoverage=94%, E-value=1e-110, Identity=46%"; Hit description =Calmodulin-binding protein
  Pfam annotation: Domain name=AAA; Domain location=413-598; Score =262.2; E_value=1.1e-75; Accession=PF00004.19; Description=ATPase family associated with various cellular activities (AAA)
  Pfam annotation: Domain name=AAA; Domain location=619-771; Score =102.7; E_value=1.1e-27; Accession=PF00004.19; Description=ATPase family associated with various cellular activities (AAA)
  Pfam annotation: Domain name=AAA_2; Domain location=409-539; Score= -39.6; E_value=0.0094; Accession=PF07724.4; Description=ATPase family associated with various
  Pfam annotation: Domain name=AAA_5; Domain location=413-545; Score= -4.2; E_value=0.0037; Accession=PF07728.4; Description=ATPase family associated with various
  Pfam module annotation: Pfam domain module=AAA::AAA::AAA_2::AAA_5; Domain location=413-598::619-771::409-539::413-545
  Subcellular localization annotation: CTP_CleavageSite=50; ConfidenceScore=5.61e-01
MDWNIISNEVRAKSNPQSPNVPNATQAQTMPSNSKQKKKQSKLLQQSSLSSNAATTPSKTLQPSELASLCEEASRKFPSLIAKSAFIAELAQVDDTVPVSNRIWLSAPSMLSLSLPPGSTVSVSIPSSGEKISQLHSFPLASLANECEKLYGLESSKALDDYAGNYLVLATVFPSSKVLKNGVRLSSNLYHAMGCPALGTSVFVHPISSAANGINEQHSTGNSCLSIYNCKELYLQLVPSKNGLPLKFNNFPSLGVSKVKFHVQSENDIVASPATPSNGSKFSNACGMSSPLFDNSASSLPNQNSQSLNSFDVSLALGNESSKELLLTGAMKQPVTKSDHYPSNGNGDLYPEDSDIADSGNQAFTVNDETKVFLSLPSNAASEEPIQRDIPCVKLESKVANASLHDKISKLGGVLLHGPPGTGKTSLAQLCAHEVGVKIFPINGPEIVTHYYGESEQQLHEVFDSAIQAAPAVVFIDELDAIAPARKDGGEELSQRLVATLLNLMDGISRSEGLLVIAATNRPDHIEPALRRPGRFDKEIEIGVPSPDQRSDILLTLLSEMDHTLSEFQIEHLGTATHGFVGADLAALCNEAALICLRHYANFKKTYGSCSDYITEQPALMNSATNSRDHSGDAISSVSDMSVASSRVLPSSSLAVTRGKESDGVSVSDRVMSQLLVELDGLHQRVNVTVIAATNRPDKIDPALLRPGRFDRLLYVGPPNEVDREEIFRIHLCKIPCDSDVSLKELARLTDGCTGADISLICREAAVAAIEERLDASVITMEHLKMAIKQIQPSEVHSYPKLSTKFQRAVHCCDIKDEFNDMQCDSRSTQFNICDWAHVHYMGSSALQTG

SEQ ID NO: 196527 - protein, 99 aa, Glycine max
  Coding DNA Sequence Number=SeqID_79749
  Gene Ontology: Mol. function=RNA-directed DNA polymerase activity; Biological process=RNA-dependent DNA replication
MEELKRIEWMWGSFSMSILVNGSPTNDFIVQKELHQRDPLAPFIFLVVAKGLSDLIREAESKNFLSGVEVGNNNLRIALQFADDTIFFLEKCFDIEGYP

SEQ ID NO: 196528 - protein, 94 aa, Glycine max
  Coding DNA Sequence Number=SeqID_79750
MRANGEREKESKELHATKTEMRERERESGGHPASLTRRPHLLRARATLLCGFYCRAGTDVWRGVVLLTPLSAECPSVSLVFTQMPTPETMDNTV

SEQ ID NO: 196529 - protein, 81 aa, Glycine max
  Coding DNA Sequence Number=SeqID_79751
MARNAEQRLRKGYKNCKIINEREQVTVVEVARGVHGLPELWEEENDSSDKARGVGFWKSNEGDKSSLRICSKPHEIRYSYM

SEQ ID NO: 196530 - protein, 69 aa, Glycine max
  Coding DNA Sequence Number=SeqID_79752
LERENRRRNERGSTCVGAELDEECRELVLEEQELVSEIFIVRLHGSMEGECLDLVTACAVKSLSASTNH

SEQ ID NO: 196531 - protein, 447 aa, Glycine max
  Coding DNA Sequence Number=SeqID_79753
  Gene Ontology: Mol. function=RNA-directed DNA polymerase activity; Cellular component=chromatin; Biological process=chromatin assembly or disassembly
  Pfam annotation: Domain name=zf-CCHC; Domain location=335-352; Score =15.9; E_value=0.0023; Accession=PF00098.13; Description=Zinc knuckle
  Pfam module annotation: Pfam domain module=Retrotrans_gag::zf-CCHC; Domain location=125-215::335-352
MEAKVEALEGEMSEVRSTLADVQNAVKENHASLIAMLEKCLGKSLSGEEGSASFAGKTTSEIPVSSEKAKGTSSSDLRGDVLAEFRQSVKKVELPPFDGEDPAGWISRAEVYFRVQDTSPEVKVSLAQICMEGSTIHFFNSLIGEEEGLTWEALKEALLERYGGHGEGDVYEQLTELKQTGTVEEYITEFKYLTAQIPKLPEKQFRGYFLHGLKTEIKGKVRSLAAMGELSRAKLLQVTRAVEKEIKGGSGSGYSRGPRPGNGSFRTGSHGMGKSGSDWVMVKGREVGSNGGVKSGVNGPRGDKPAHGDRKRVGPRDRGFTHLAYNELMERKQKGLCFKCGGPFHPMHQCPDKQLRVLVVEDDEDNEEEAKILAVEVEEANDEEKGEMSVLDLHHIAHENHHTIKFQGSIRGVEVLILVDSGATHNFISQKLVHQMDWPVEITPQMN

SEQ ID NO: 196532 - protein, 592 aa, Glycine max
  Coding DNA Sequence Number=SeqID_79754
  Gene Ontology: Mol. function=RNA-directed DNA polymerase activity; Cellular component=chromatin; Biological process=chromatin assembly or disassembly
  Pfam annotation: Domain name=Chromo; Domain location=480-534; Score =51.4; E_value=2.9e-12; Accession=PF00385.14; Description='chromo' (CHRromatin Organisation MOdifier
  Pfam annotation: Domain name=rve; Domain location=178-334; Score =119.9; E_value=7.4e-33; Accession=PF00665.16; Description=Integrase core domain
  Pfam annotation: Domain name=zf-H2C2; Domain location=119-160; Score =17.5; E_value=0.0017; Accession=PF09337.1; Description=His(2)-Cys(2) zinc finger
  Pfam module annotation: Pfam domain module=Chromo::rve::zf-H2C2; Domain location=480-534::178-334::119-160
MQQRIITAEQQNWAAKLLGFDFEIIYKQGRLNKGADALSRIYEGGDLNVMNSCVKWIQEEQIKTEIQQDEKLQRIIEEMQQNSVSWPGYEYRQGVLLYEGRLVISSKSGLIPTLLEEFHSTPQGGHSGFYKTYRRLAANVYWIGMKGTVQEFVRNCDICQRQKYMASSPGGLLQPLPIPEQIWEDLSIDFIIGLPKSKGYEAILVVVDRLSKYSHFIPLKHPYTARSIAEIFCKEIVRLHGIPVSIVSDRDPIFMSSFWRELFKLQGTKLKMSTAYHPESDGQTEVVNRCLETYLRCFIADQPKTWVSWVHWAEYWFNTTFHAATEKTPFEIVYGRQPPILTRWVQGQTRVEAVQRELLDRDEALRQLKSQLLRAQEKMKNQADKKRIDRSFVCGEWVFVKLRAHRQQSVVTRINAKLAARYYGPYPIIEKIGAVAYRLKLPEGSRVHPVFHVSLLKKVVGRYHEEEELPDLLEEQIDMYVPEAALATRKVKQQGEEVRQVLIHWKGRTVEEATWEDEIMIRSQFPKFSLEDKAIAEGEGIDRTQLIEELPHEQLIHQRSSGPKTWKESTIALPGYKEWEGEYSRGGIIVIF

SEQ ID NO: 196533 - protein, 426 aa, Glycine max
  Coding DNA Sequence Number=SeqID_79755
  Gene Ontology: Mol. function=cysteine-type peptidase activity; Cellular component=lysosome; Biological process=ubiquitin-dependent protein catabolic process
  Homolog annotation: Hit_ID=O22207; Match level="QueryCoverage=79%, HitCoverage=36%, E-value=1e-130, Identity=69%"; Hit description =Ubiquitin carboxyl-terminal hydrolase 5
  Pfam annotation: Domain name=DUF1055; Domain location=1-113; Score =139.4; E_value=1e-38; Accession=PF06337.3; Description=Domain of Unknown Function (DUF1055)
  Pfam annotation: Domain name=UCH; Domain location=186-403; Score =115.2; E_value=1.8e-31; Accession=PF00443.19; Description=Ubiquitin carboxyl-terminal hydrolase
  Pfam module annotation: Pfam domain module=DUF1055::UCH; Domain location=1-113::186-403
YGGGPTLARKVISSGLSQTELAVEVYPLRLQLLMLPKNDRFPIRISKKETIGQLHRKACEIFDLQPDQVCIWDYYARRKHALMNDMDKTLDDANLQMDQDILVEVINNTNNTSFAQENGSAQREMNSALVEPSKSSLSIAGGLSASRGASRGHNMDLSSSQNLNSPVRDVENPYGTSGVTTRGSFGGLTGLLNLGNTCYMNSAIQCLVHTPEFARYFREDYHREINWQNPLGMVGELALAFGELLRKLWAPGRTPIAPRPFKAKLVRFAPQFSGHNQHDSQELLAFLLDGLHEDLNRVKHKPYIKSRDADGRPDEEVADEYWANHIARNDSIIVDVCQRVLGKTQSRRGRVVDSTKIAIAGALPVAESHCIVVVALSVSDKVESGVKLHRCAFRVHRSERGMWSGADCGFGSGTSELFWACSPQGF

SEQ ID NO: 196534 - protein, 443 aa, Glycine max
  Coding DNA Sequence Number=SeqID_79756
  Gene Ontology: Mol. function=cysteine-type peptidase activity; Cellular component=transcription factor TFIID complex; Biological process=ubiquitin-dependent protein catabolic process
  Homolog annotation: Hit_ID=O22207; Match level="QueryCoverage=74%, HitCoverage=34%, E-value=2e-88, Identity=53%"; Hit description =Ubiquitin carboxyl-terminal hydrolase 5
MNLGWVRFTGKRCGIMMNALGIKMQDMYPGSIRIGYISDTGTLPKIEYPCFRLRDQWCFLTSGQYKSTLVCPVCNKVSVTFDPFMYLSLPLQPTTNRTMTVTVFACDGAALPSACTVTVPKQGRCRDLIQALSNACSLKHNERLVLVEIRNHLIHRYFEDPLQLLSNIKDDDRLAAYKVPKIDKNTKYLQLIHRRREQSSDSHIISGWKPYGTPIVSLISCDDTVTRGDIQVIVNRMLSPLLRKGINVEQATTSETSIPKATSDQCSFNSSDDACAANMVSNSVNKDTTNSKAPPVPLPTLPLLLVDDNNACIDLSMGEEKVVKLSPLSPKILVYIDWSQKLLEKYDTHPLETLPEVLKYGPVTKKARTEPLSLYTCLEAFLREEPLVPEDMWLVHPAAHSNSILSSYLSFSCLASSPNGVYINNCELNLSMTYFINVPYSAI

SEQ ID NO: 196535 - protein, 120 aa, Glycine max
  Coding DNA Sequence Number=SeqID_79757
MLPHDWLRWPRSCIRPIGGILHIELFNEGVEAIYGPRWESTVPEVRLGQEGIQMLVWICCPIVLLEVEWFSPQGQCLSGVLVAPGTFDTSLQLIMESVDERLWGMFYLALRWAPNALAKI

SEQ ID NO: 196536 - protein, 66 aa, Glycine max
  Coding DNA Sequence Number=SeqID_79758
  Homolog annotation: Hit_ID=O22207; Match level="QueryCoverage=68%, HitCoverage=5%, E-value=5e-09, Identity=68%"; Hit description =Ubiquitin carboxyl-terminal hydrolase 5
MTEVPMCIASVSELSPDEERILIRDIALTAQANSKEGDTFFLITQRRYRVKAFFAADFAVQASSNP

SEQ ID NO: 196537 - protein, 610 aa, Glycine max
  Coding DNA Sequence Number=SeqID_79759
  Gene Ontology: Mol. function=transporter activity; Cellular component= membrane; Biological process=oligopeptide transport
  Homolog annotation: Hit_ID=Q96400; Match level="QueryCoverage=93%, HitCoverage=93%, E-value=0.0, Identity=66%"; Hit description=Nitrite transporter
  Pfam annotation: Domain name=MFS_1; Domain location=34-520; Score =16.9; E_value=5.4e-05; Accession=PF07690.6; Description=Major Facilitator Superfamily
  Pfam annotation: Domain name=PTR2; Domain location=96-504; Score =463.0; E_value=3.7e-136; Accession=PF00854.12; Description=POT family
  Pfam module annotation: Pfam domain module=MFS_1::PTR2; Domain location=34-520::96-504
MEIEKSTKSNAEMGEKEEKKKKHRRGGIRTLPFILANEVCDRFASAGFHGNLISYLTQELNMPLVSASNTLTNFGGTSSFTPLIGAIVADSFAGRFWTITVASLIYELGLISITVSAILPQFRPPPCPTQVNCQEATSSQLWILYISLLLTSVGSGGIRPCVVPFSADQFDMTKSGVASRKWNLFNWYFFSMGLASLSALTIVVYIQDNMGWGWGLGIPCIAMLISIIAFVLGSPLYKTVKPEGSPLVRLAQVTVAAIKKRKEALPEDPQLLYHNWELDTPISLEGRLLHSNQYKWLDKAAIVTEEEARDQTTTPNLWKLATVHRVEELKSIIRMLPIWASGILLITSSSHLHSFVIQQARTMDRHLSPSFQISPASMSIFSVLTMMSGVVLYERLFVPFARRFTGNPSGITCLQRMGIGFIINIIATVVAGLMEMKRKSFAAKYHLLDDPKATIPISVFWLVPQYCLHGVAEIFMSVGHLEFLFEQAPESMRSSATALYCITTAIGNYMGTLLVSLVHKYTGKENNWLPDRNLNRGGLDYYYFLLSGIQVVNLVYYLICAWFYTYKPVDEISERTKEEDLEQANEHISPDDKLLKDGRDEEKRELTKDE

SEQ ID NO: 196538 - protein, 286 aa, Glycine max
  Coding DNA Sequence Number=SeqID_79760
  Gene Ontology: Mol. function=calcium ion binding; Cellular component =oxygen evolving complex; Biological process=photosynthesis
  Homolog annotation: Hit_ID=Q5VQX1; Match level="QueryCoverage=59%, HitCoverage=63%, E-value=6e-75, Identity=78%"; Hit description =Thylakoid lumenal 20 kDa protein-like
  Pfam annotation: Domain name=PsbP; Domain location=98-286; Score= -20.5; E_value=0.00037; Accession=PF01789.7; Description=PsbP
MDAGLIPPDDEKIPLGEQPPQEGLLAPKFGPCSNHLGRPILAAVVCHCPLVPYLVVLGCLPILPHHQHKKRKSSGLYKWVLRSINLITSLPFISQRTNLYGQNLSGSKQYKLPFTFTDSYIIVNSSYEPYKFILPPTWKQARVANILSGNYCQPKCAEPWVEVKFEDEKQGKVQVVASPLIRLTNKPNATIEDIGSPEKLIASLGPFVTGNTFDPEELLETSVEKLGDQTYYKYVLETPYALTGTHNLAKATAKGNTVVLFVVSANDKQWQTSEETLKAVLNSFEV

SEQ ID NO: 196539 - protein, 167 aa, Glycine max
  Coding DNA Sequence Number=SeqID_79761
  Pfam annotation: Domain name=zf-CCHC; Domain location=115-132; Score =8.0; E_value=0.047; Accession=PF00098.13; Description=Zinc knuckle
MSLHSSSSVNGRHRAHLRPHSHWREKERKPQEANINLPYFHRKDNVEANLDWEIKVEQQLERKSTSKSYGSYSYPNKDQGQGILGVTPPKPKYDKGKTIEKQPLKASMQEKTSSIKCFKCLGRGNITSQCPTKKTMIMRGQDIYSSQDEATTSPSSGETEDANWEES

SEQ ID NO: 196540 - protein, 230 aa, Glycine max
  Coding DNA Sequence Number=SeqID_79762
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=3e-26, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTDPLDESISCFLIRVDPWVLVSIAFRGLHVLAFRGQHVLNFRGLRVLAFRGLHVLAFRGLHTLAFRGLQVLAFRVLHVIAFRGLHVLAFRGLHVLTFRGPHVLTFRGPHVLAFRGLHVLAFRGLHVLAFRGLHVLTFRGLHALAFRGLYVLTFRGLHVLTFRGLHVLTFRGLHVLAFRGLHALAIKELHVLAFRGLHALTFRGLYVLLFRGLHTPTFKGLHVLTFRGLH

SEQ ID NO: 196541 - protein, 164 aa, Glycine max
  Coding DNA Sequence Number=SeqID_79763
  Gene Ontology: Mol. function=RNA binding; Cellular component=nucleus; Biological process=nicotianamine biosynthetic process
  Homolog annotation: Hit_ID=Q9ZVI3; Match level="QueryCoverage=89%, HitCoverage=51%, E-value=7e-72, Identity=90%"; Hit description =Putative RNA-binding protein
  Pfam annotation: Domain name=KH_1; Domain location=18-105; Score =10.8; E_value=0.06; Accession=PF00013.19; Description=KH domain
MDWQSAPASPSSFTVKRILRLEIPVDTYPNFNFVGRLLGPRGNSLKRVEATTGCRVYIRGKGSIKDPDKEEKLRGRPGYEHLNEPLHILIEADLPANVVDIRLRQAQEIIEELLKPVDESQDYIKRQQLRELALLNSNFREESPGPSDDEYCGPPAIDCWEYLP

SEQ ID NO: 196542 - protein, 171 aa, Glycine max
  Coding DNA Sequence Number=SeqID_79764
  Gene Ontology: Mol. function=protein kinase activity; Biological process=protein amino acid phosphorylation
  Homolog annotation: Hit_ID=Q6YTQ6; Match level="QueryCoverage=96%, HitCoverage=9%, E-value=2e-33, Identity=48%"; Hit description =Helicase-like protein
  Subcellular localization annotation: CTP_CleavageSite=40; ConfidenceScore=5.23e-01
MSNIQGKTFIWKTLTSALRSQRQIVLTVTSSGIASLLLPRGQTAHSKFKILVPTFDDSICNIHQVASSGIVSLLLPREQTAHSKFKIPVPTFDDSICNIHQGSKLVELLKVTKLIIWDEAPMGHKFCFEALDKSLRDIMGLGNESSTIFGGKIIVFGGDFRQMLPFIPRGS

SEQ ID NO: 196543 - protein, 176 aa, Glycine max
  Coding DNA Sequence Number=SeqID_79765
  Gene Ontology: Mol. function=RNA binding
  Homolog annotation: Hit_ID=Q9ZVI3; Match level="QueryCoverage=53%, HitCoverage=25%, E-value=2e-14, Identity=72%"; Hit description =Putative RNA-binding protein
  Subcellular localization annotation: CTP_CleavageSite=20; ConfidenceScore=5.20e-01
MSGLYNPNFSPARAASPQIRSNPEVDRSKLKKRKRTQSWTLGETPFGFGHPVPIRVAGRTSEAWTLHASASHMQPPPKSRSSSSCLWISITSCFCSLVVYGSMLDEMYLHSVNLMLPAMNLMIVILRTYEKSYPFKACTLEGVLNNAGAINIGTVDFSRPSSTQKFRACLFAPFYQ

SEQ ID NO: 196544 - protein, 351 aa, Glycine max
  Coding DNA Sequence Number=SeqID_79766
MKNSRGRSMKHAHLFHCEDQRSQEHNKIIRDRLESNTNNSFRTREIPIKRLFNVGHFTNASGDLSRYSKGKNFSAGINVMDYDIPELVVFIQEEHQQFVKDTCIGKGVSPEGKCMSEDCAVNHDPMSCHFENDLNTRRDSNLRTMEAMSINSNGPEYESKPLTLKDAMEFYDSRGLVMDGEEDSGYNISIDHLTKKTIPETIREALTKEAEFSRSFKNWQINSFLGTIGSRVEFPSCSDCVQVADTIMCRSEIANSHSPSGSGKRQENDPQETTCSCDVGPSPYAAPATTSSSASHHSNDSISSTHSFAFPILPAEWNGSPERMLEANKSQFRKDRWQKIRVLFSCCKVDC

SEQ ID NO: 196545 - protein, 80 aa, Glycine max
  Coding DNA Sequence Number=SeqID_79767
MRPNNKKKAKSEEKRERERVGRRRREDELEMDGSGAAAGNHSGNALRHGKRSPKHIGNDMWDVAMERRDKKLVEQASPSN

SEQ ID NO: 196546 - protein, 313 aa, Glycine max
  Coding DNA Sequence Number=SeqID_79768
  Homolog annotation: Hit_ID=Q84YF3; Match level="QueryCoverage=97%, HitCoverage=92%, E-value=9e-43, Identity=37%"; Hit description =Hypothetical protein 4B
  Pfam annotation: Domain name=DUF1191; Domain location=34-313; Score =307.3; E_value=2.8e-89; Accession=PF06697.3; Description=Protein of unknown function (DUF1191)
MEPVLLPSLVIMLVLVLCFESLPSVRAQSTTTSPGSSSTREEAKALDALLQQFAYKDLVNPKTGIIYNATQLPSNLTGIEVAALRLRSGSLRRKGFQAYNEFEIPKGLIVSPYVERLVLVYQNLDNRSSSYYYPLPNYTYLAPVLGLLAYEGSNLSATNLSELDIDASESPILVKFRDVKPAPHGAVAKCIWFDLQGSSNFSNVTGGNTCSTTQQGHFSIVVKSIAPLAPSPAPAGAAPKGEGEKGNNNNEKVWIIVGSVVGGLVLLVLLSLLVLWMSKYKQKMKMQQMERAAEVGEPLQMSSIGDTKAPAAT

SEQ ID NO: 196547 - protein, 72 aa, Glycine max
  Coding DNA Sequence Number=SeqID_79769
MHNDSLTSLGLHHCPAYGLATCSAHKSPPIQGTNQNQGILDKVESPIHSRSKRQITKPHFLSDFVTNPDKGS

SEQ ID NO: 196548 - protein, 159 aa, Glycine max
  Coding DNA Sequence Number=SeqID_79770
  Homolog annotation: Hit_ID=O04342; Match level="QueryCoverage=55%, HitCoverage=21%, E-value=7e-19, Identity=59%"; Hit description =Expressed protein
MADLLEALVLSFIGRCMHVSMTHHVHRLPCIEFCMKEYLSIRHQLETLLAEKARLASENEKYSRENRFLREIVEYHQLTMQDVVYIDEGMEEVNEVYPVDDSRITRLLSVSPHSSDEDVLVSPSPPMLSKEIFTVPEEDSKSISKDGAPSTVSVSPHTK

SEQ ID NO: 196549 - protein, 67 aa, Glycine max
  Coding DNA Sequence Number=SeqID_79771
MQPVIFVLFVRRRCIPQYYYAVNIFSVKTVYQSALLFQSSNHDLYTSTHVKCSGGNRGDPSEKDECS

SEQ ID NO: 196550 - protein, 179 aa, Glycine max
  Coding DNA Sequence Number=SeqID_79772
  Gene Ontology: Mol. function=calcium-dependent phospholipid binding
  Homolog annotation: Hit_ID=O22341; Match level="QueryCoverage=96%, HitCoverage=80%, E-value=2e-27, Identity=62%"; Hit description =Annexin
  Pfam annotation: Domain name=Annexin; Domain location=122-174; Score =24.3; E_value=0.00024; Accession=PF00191.10; Description=Annexin
  Pfam annotation: Domain name=Annexin; Domain location=41-100; Score =26.6; E_value=8.5e-05; Accession=PF00191.10; Description=Annexin
  Pfam module annotation: Pfam domain module=Annexin::Annexin; Domain location=122-174::41-100
MEKISSRPWTKNSRAILRKGGLIIIMNKIDMRCMCTWYAGHFLSIYEGVPCMVLVEIACTRSSDQVFDVRKAYHTLYKKSLEEDVAHHTAGDFCKDLKADPKDEFLSLLRATVKCLIRLEKYLEKVVQFAINKRGTDEGALTRVVCHQRRNSVPLERAIVKDTIADYEKMLVALLSCIF

SEQ ID NO: 196551 - protein, 298 aa, Glycine max
  Coding DNA Sequence Number=SeqID_79773
  Homolog annotation: Hit_ID=O04342; Match level="QueryCoverage=71%, HitCoverage=50%, E-value=6e-25, Identity=38%"; Hit description =Expressed protein
MAYRRRQGISKSSTFKEEFHDPSLEDDNASPSIFSSSSTPPPSSLAAQAIKAAASRREPSLSFAFAPAEFDHQRSKSFGAYGNGNSKSGGFWGVIAQKAKSILDDDKPTPQHDTMPQTQTLKSHSFNTFSDPSAVQNSPSQFKPGYESLDSSRKMDNPKFRKGLDKITSSLNQLGDTFEKAFEEGRTIVGSKTADLRTQIRRKGSNFGDTNQTSDLRNPFQEADQTQTQSSHETKLKASRDVAMATAAKAKLLLRELKSVKADLAFAKARCAQLEEENKVLRDREGSDKGQNREDDDL

SEQ ID NO: 196552 - protein, 84 aa, Glycine max
  Coding DNA Sequence Number=SeqID_79774
  Subcellular localization annotation: CTP_CleavageSite=50; ConfidenceScore=5.39e-01
MGGLDCFWRKQPSSPRRAGRQPPPPFSYKKATRVVLRVPDPPENPARGASATLPRGFHKQIREDFPLFFTVLHSFFIRSSFFNG

SEQ ID NO: 196553 - protein, 47 aa, Glycine max
  Coding DNA Sequence Number=SeqID_79775
MFDVITGALGGPAFGGPEVVIGALGGPAFGGPEVVIGALGGPDLRWS

SEQ ID NO: 196554 - protein, 166 aa, Glycine max
  Coding DNA Sequence Number=SeqID_79776
MRDPLLFHNTPLLPGQVKVSVEEVRDADAPVPVPTDEVSLVGQALHTFLAWPTHLKKVFITAELFLRPYQVRWDATVFGVINPDFPLYIKHEDLSEIAHGGQCLSISVLQLWILHLTETCMRARNSDIYGFLEPQSIQRYGQSQFEPESSTAADTGRWWSSCPRNT

SEQ ID NO: 196555 - protein, 551 aa, Glycine max
  Coding DNA Sequence Number=SeqID_79777
  Gene Ontology: Mol. function=metal ion binding
  Homolog annotation: Hit_ID=Q2QYH9; Match level="QueryCoverage=94%, HitCoverage=95%, E-value=3e-61, Identity=30%"; Hit description=Zinc finger, C3HC4 type family protein, expressed
  Pfam annotation: Domain name=LRV_FeS; Domain location=44-92; Score= -2.9; E_value=0.098; Accession=PF05484.2; Description=LRV protein FeS4 cluster
  Pfam annotation: Domain name=zf-C3HC4; Domain location=369-409; Score= 39.2; E_value=1.4e-08; Accession=PF00097.15; Description=Zinc finger, C3HC4 type (RING finger)
  Pfam module annotation: Pfam domain module=LRV_FeS::zf-C3HC4; Domain location=44-92::369-409
  Subcellular localization annotation: CTP_CleavageSite=34; ConfidenceScore=5.26e-01
MAANSGNISFASSQSSSQIHGSTDTVQVAVCSLCQKALSPDNEMASDLASSGVCGDCKFLLLEDFGNHTVTQSSRRRLRGRFRHNSSESVENNFSQQIPHVVNTVRQHQSAVSGEDDQLVDGDTPAWSLQYASTHTTPSGSRRWRQVLSDTDSDGFDNWNSLYGENESSASFRQYRVPHGETDSFSHSAYGGDSDISMDTHSFEGTGVFNLPDEGDEFDSDTDIDPMHAGLSQWISTDEDDEEEEEEEEEGDREWELAEAEEAEATSHLQIFFTSSPSESRDRINSTESGGMFSQIIRETWHGFEDVDLPHGANFGDYLDARHFEDLLEHLAENDSSRRGAPPAAVSFVNNLPRVVIGKEHEKHGELVCAICKDVLAPRTEVNQLPCSHLYHINCILPWLSARNSCPLCRYELPTDDKDYEEGKQNIDSRNVIHERQRIDVTDDSYSDVSDGDEVNGSGQGGIRQRLLSSGSTVDSSATRSGRGRWFFLAAAPIVSLVGIVLVLWLGNNSQNEGSRHLGSHYLSGQNQHAVHAYSSPNQRESRSRRWWCPF

SEQ ID NO: 196556 - protein, 116 aa, Glycine max
  Coding DNA Sequence Number=SeqID_79778
MTGDTKDSVRKLDVLYITREDTHGRIYRAGSCLKINRIPEDEKMLKSKLLMVLVVFFPYYELESETETCRTKIAQEKQKLPDLDVLNILSEIEYSKVWSLIKIKDLVNTEHWAKVC

SEQ ID NO: 196557 - protein, 211 aa, Glycine max
  Coding DNA Sequence Number=SeqID_79779
  Homolog annotation: Hit_ID=Q2QQD3; Match level="QueryCoverage=68%, HitCoverage=36%, E-value=4e-43, Identity=52%"; Hit description =Expressed protein
MLLIFNRISGHIPLKITSIENGTVLKTFKHLLHQNKQVDFIELFHEKLLVKQENENQLFLTFINGTVSVWSFCGELVTQFEDHQLWHPDCYTNNTYITKDQDLIISYCKADSDDQWMEGNAGSINVSDILTGKCVAKLNATSSSIKADECNNSACNCNKQNMILIMYGLTNDKSFWFLLAPWPQESHVWFCNFADIVSAPDFSKIQAASAL

SEQ ID NO: 196558 - protein, 217 aa, Glycine max
  Coding DNA Sequence Number=SeqID_79780
  Homolog annotation: Hit_ID=Q1STP6; Match level="QueryCoverage=61%, HitCoverage=81%, E-value=2e-27, Identity=54%"; Hit description =Harpin-induced 1
MIPTRHNEEGICWLQRKHCVPDGSIMCSDCTCIVRGDLSIDSVQTKAPHYQCGFSKASEHELGHGHSTTLINLDSITTIALPNLTLEAPIPNGDILAEEIKGLNLTLTVMADRLVSNSKVTKDVALGSLPLNTLVRIFSQVNVLGFIKFYVASTSSCDFTLNLSYRTIVNKKCQEKTDFLVDLFGLEKGEKIQRKEIDVRKERAYWISIYFPSTSTY

SEQ ID NO: 196559 - protein, 736 aa, Glycine max
  Coding DNA Sequence Number=SeqID_79781
  Gene Ontology: Mol. function=nucleic acid binding; Biological process= DNA integration
  Homolog annotation: Hit_ID=Q2QYH7; Match level="QueryCoverage=41%, HitCoverage=57%, E-value=7e-52, Identity=38%"; Hit description =Cytochrome P450 family protein, expressed
  Pfam annotation: Domain name=p450; Domain location=271-713; Score =44.5; E_value=5.3e-13; Accession=PF00067.12; Description=Cytochrome P450
  Pfam module annotation: Pfam domain module=RVT_2::p450; Domain location=127-260::271-713
MTGSNGNLMGNLPILDGTNWGEWQIQMQVVFGFQDVLEVVECGIAELEKQSSDPQKATCKDAKKRDCKALFFIHQSVDKANFQKIDHAKTVKEAWYILEKAYSRDAKMLSIANLMKGCGEKLDDQMVVEKILRSLSPRFDYIVCAIEESKNLEGLKIEELQGPLEAHEQRMNDRDIIILCLDVDDLLITGNNEVVIQTVKKQLQREFDMTDPGVMSYFLGIEFIHKNRGLVMHQKNYALEVLKRYKMEECNLAKSPVEFGLKLGVGLDEKPMDATLFKQMVGSLRSGDVEDNKSTTGYVFKLLGSTICWSSKKQEDVGHSTCKSEYMVAVLAACQLAWLESLFAELKIQLDSVVQLNMDNKSAICLANNSIAHGRTKHIGTKYHYLRDQVRKGRISLAYCKPEEQEADILTKALHGEKFYKFREKTWRSELLKLELGRIVEENKELWKLQKEVEMMILKVIKDREADNQKSGTHENQKDLLQIILEGAASATTDTSRKGIFRPRYNINQLILDICKNVYFAGSESTALATIWTLLLLALHPEWQQRVRSEIMETYENMVPHSFHDKDKLRNLKALTMVIQESLRLYGPSTMATREVLANEVKLGEHVLPKGINMWLFTLALHRDPDNWGPDAREFKPERFAGGVSAACKYPQVYIPFGLGSRICLGQNFAMLQMKEVLCLLLSNFSFAVSPNYCHCPVDGLLLMPKYGVRLLASKVHETCCIVKVLFCVTPTCDQD

SEQ ID NO: 196560 - protein, 543 aa, Glycine max
  Coding DNA Sequence Number=SeqID_79782
  Homolog annotation: Hit_ID=Q2QQD3; Match level="QueryCoverage=79%, HitCoverage=87%, E-value=1e-162, Identity=68%"; Hit description =Expressed protein
MEGRMRGGYSGRRIVASRRGSGKGNVNIIINNNNNNNNKNNTNVIKKLQSREICSKPHRAFASVTASHRFRSMRLTHQYDTHDPSKTRSSLWPFLMKRTKVVEIVAAKNVVFALYHSGLCAAFSRETDERICFLNVCPDEVIRSLFYNKNNDSLITVSVYASENFCSLKCRSTKIEYIRRGKPDAGFPLFQSESLKWPGFVEFDDVNGKVLTYSAQDCIYKVFDLKNYTLLYSISDRNVQEIKISPGIMLLIYNRTSGHIPLKIISIEDGTILKVFNHLLHRNKKVDFIEQFNEKLLVKQENENLQILDVRSSELMEVSRLEFMTPSAFIFLYENQLFLSFRNRTVSVWNFRGELVTSFEDHQLWHPDCNTNNIYITSDQDLIISYCKADSDDQWIEGTAGSINVSNILTGKCVAKITAISSSAKADECRSSGCSCKKSHSCLMRSPVAEALEDITALFYDEDRNEIYTGNRHGLVHNGKKEVTSKRGSDNGNGINNDNNINVVKMLQNREICSSQILQYYTYDPSKSGLAAALILACKILAL

SEQ ID NO: 196561 - protein, 479 aa, Glycine max
  Coding DNA Sequence Number=SeqID_79783
  Subcellular localization annotation: CTP_CleavageSite=32; ConfidenceScore=5.13e-01
MWFTMWSSFLLRVPPSHSGSRSPLVDNVPMLSAVLRGTSSIDTIHILSLYGVKFFVKVPAIAASLLPLCETFGSIKPTSHSTGDECSSTSTYMAFSLAFLFLIRLWKFCRPPLDPLCITELGVAAGLLEVWTLSGISTGNSIHQTANMIYQKITKAGNSSSNSSSPTTNSSNACLRNLVDFLPASLAAIIDYFSSEVTRGVWKLVPMNGTDWPSPAAFIQSIESEMKAILTHVGVEVPNRSSGGAPVMLPLPMAALVSLSITFKLDKSQEYMHAITGAALENCASGCPWPSMPVIGSLWAQKGRHWHNFIVVSGSRSVFKHSNECVAQLLRSCFTSFLGTLCVSTECNVNGLLGSTISAPEYSNELASSRHVKSNKASLSLAVQSAKEVATLGASLLMCGRSRDVKQNNDSVGSHILEGYAMGENSKSTSEIEIARVFSPNPGSMYYGAVVVVCSSTMGDATRLHHSPPQNTTFSFLIQ

SEQ ID NO: 196562 - protein, 591 aa, Glycine max
  Coding DNA Sequence Number=SeqID_79784
  Gene Ontology: Mol. function=phosphoglycerate mutase activity; Cellular component=cytoplasm; Biological process=glucose catabolic process
  Homolog annotation: Hit_ID=P35493; Match level="QueryCoverage=92%, HitCoverage=99%, E-value=0.0, Identity=78%"; Hit description=2,3 -bisphosphoglycerate-independent phosphoglycerate mutase
  Pfam annotation: Domain name=Metalloenzyme; Domain location=432-559; Score=193.1; E_value=6.8e-55; Accession=PF01676.8; Description =Metalloenzyme superfamily
  Pfam annotation: Domain name=iPGM_N; Domain location=54-422; Score =516.6; E_value=2.8e-152; Accession=PF06415.4; Description=BPG -independent PGAM N-terminus (iPGM
  Pfam module annotation: Pfam domain module=Metalloenzyme::iPGM_N; Domain location=432-559::54-422
MATRNLLSGFTCPTFSPIIAADTQKERKQEKNKKAQMGSTGFSWKLADHPKLPKGKTVAVVVLDGWGEATPNEYNCIHKAETPCMDSLKKGAPERWRLVRAHGTAVGLPTEDDMGNSEVGHNALGAGRIFAQGAKLVDLALASGKFFEGGGFKYIKESFENGTLHLIGLLSDGGVHSRLDQLQELASEVLKESVSIFLQMAVMFWMVQVWGFVETLENDLANLREKGVDARIASGGGRMNVTMDRYENDWNVVKRGWDAQVLGEAPYKFTNALEAVKKLRAEPKANDQYLPPFVIVDESGKPVGPIVDGDAVVTFNFRADRMTMIAKALEYENFDKFDRVRFPKIRYAGMLEYDGELKLPSHYLVSPPEIDRTSGEYLVYNGIRTFACSETVKFGHVTFFWNGNRSGYFNSELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNDVPTGGLANVAATVMNLHGFEAPSDYETTLVEVVDN

SEQ ID NO: 196563 - protein, 53 aa, Glycine max
  Coding DNA Sequence Number=SeqID_79785
MEARQIGGNGPGRKGVEGSDHVEIKENEEVLKKIIATHPLYEVLIQSHISCLK

SEQ ID NO: 196564 - protein, 81 aa, Glycine max
  Coding DNA Sequence Number=SeqID_79786
MFDREAKGKSWFGGPVPPEKKNRGRILEHQSWLNLSPPRRPARYPDPAHFLYLVLEKAKENKQRGRKHFRTRGRRQSNKNH

SEQ ID NO: 196565 - protein, 455 aa, Glycine max
  Coding DNA Sequence Number=SeqID_79787
  Gene Ontology: Cellular component=nucleus; Biological process =regulation of progression through cell cycle
  Homolog annotation: Hit_ID=Q8RYC7; Match level="QueryCoverage=53%, HitCoverage=38%, E-value=5e-18, Identity=31%"; Hit description =Cyclin-like protein
  Subcellular localization annotation: CTP_CleavageSite=3; ConfidenceScore=5.04e-01
MASRSRKSKRKLEPEPHPLVITKKLRQKLPRRRRQNISPVLLVGISAQNPRFSVDSSSVSDFAVGEASCNSSRASVAGKGNINSRNEFSTDSTRNRRFEKRNENEVEVSESSCVDSASFASERNRSLILKFKREDKNLNENDDVSEACTKSEITTVLKFKSGSETKNAKEDDDVWCAKSEITCSEEQFNSNSKSSGNGNGNIKVSSDSNANDFVSFSSGVRASSFHEEANRNKENTKNRASESEYSEVSRSLHVEENCADLIAQSMTKEDSDVYDVVADLACSEDLRFSYCNDDDDDNESEYCSSQGTVLSEFHSELFGECSQNELSDYCPSSLFVDSGSQFSEGSVGETPSPTHLLFLQYSKEFAELVSAPPLKNASNVEDVVNFVRFEDLDDEDSYQMLRKRERRQGYVLNYGDGYFSTTEFGDTVIEQRAQMVHWIIEVDSRSLLSQVLDGE

SEQ ID NO: 196566 - protein, 350 aa, Glycine max
  Coding DNA Sequence Number=SeqID_79788
  Gene Ontology: Mol. function=transition metal ion binding
  Homolog annotation: Hit_ID=Q8W319; Match level="QueryCoverage=80%, HitCoverage=100%, E-value=2e-79, Identity=53%"; Hit description =Putative splicing regulatory protein
  Pfam annotation: Domain name=RRM_1; Domain location=74-141; Score =26.3; E_value=0.00011; Accession=PF00076.12; Description=RNA recognition motif. (a.k.a. RRM, R
MPKESVPGENSILAMVEHTDQRAEAIPQSTAAPNWTIHVSDVRKKFLHSNIVTNPIMEKFPHSLRCDFLQIKTVKVSNISLVTFKKDIEEFFSFSGDIRYIEMQRESGHTQVAYVTFKDTQGADTAVLLTGSKIGDLYVTITPVEKYQLPPEALPSSPTNQSPDAVKKAEDVMSTMLAKGFILGKDAINKAKAFDEHHQLTSNASSTVASIDRKIGLSDKLSFGTAVFNGKVREMDERYQLSEMTKSAMAAAEQKASSAGSAIMSNPYVKSGASWFSSAFTAIAKAAEDVSTMTKEKVEQAVVERNEIIYGERKGTVDEFAKTHLEEASDIGPAVVPVNSDDDRKLATIL

SEQ ID NO: 196567 - protein, 202 aa, Glycine max
  Coding DNA Sequence Number=SeqID_79789
  Gene Ontology: Mol. function=protein binding; Cellular component =nucleus; Biological process=regulation of progression through cell cycle
  Homolog annotation: Hit_ID=Q1PFW3; Match level="QueryCoverage=83%, HitCoverage=41%, E-value=1e-57, Identity=64%"; Hit description=Cyclin
  Pfam annotation: Domain name=Cyclin_C; Domain location=92-198; Score =24.1; E_value=0.0005; Accession=PF02984.9; Description=Cyclin, C -terminal domain
  Pfam annotation: Domain name=Cyclin_N; Domain location=1-90; Score= -25.2; E_value=0.024; Accession=PF00134.13; Description=Cyclin, N -terminal domain
  Pfam module annotation: Pfam domain module=Cyclin_C::Cyclin_N; Domain location=92-198::1-90
QSCRRQLRQETLFLGVNLLDRFLSKGYFKAKRNLLIVGIACLTLATRIEENQQYNRVGQKNFYIGSNVYSRSEVVAMEWVVQEVLKFQCFLPTIYNFLWYYLKAANADAVVEKRVKYLAVLALSGHEQLCYWPSTVAAALVILACLEFNQISSHKVIGIHVRSKDENLYECIEYIDIEEKHIHIFSEAVRTLQQTGNSAVNC

SEQ ID NO: 196568 - protein, 94 aa, Glycine max
  Coding DNA Sequence Number=SeqID_79790
MGFGCCKYGFVHGVGQEARESGFVAADVEFECAGEERGVGVASEPCTRRNRLRLVRGSEDGNEGGLEVCLVSGVGGGVLAKWGHDDGRVLCFGA

SEQ ID NO: 196569 - protein, 316 aa, Glycine max
  Coding DNA Sequence Number=SeqID_79791
  Gene Ontology: Mol. function=protein serine/threonine kinase activity; Cellular component=membrane; Biological process=protein amino acid phosphorylation
  Homolog annotation: Hit_ID=Q9LFD4; Match level="QueryCoverage=99%, HitCoverage=60%, E-value=2e-83, Identity=55%"; Hit description =Protein kinase-like protein
  Pfam annotation: Domain name=Pkinase; Domain location=87-316; Score= -71.0; E_value=0.00025; Accession=PF00069.15; Description=Protein kinase domain
  Pfam annotation: Domain name=Pkinase_Tyr; Domain location=87-314; Score=-33.1; E_value=1.9e-10; Accession=PF07714.7; Description =Protein tyrosine kinase
  Pfam module annotation: Pfam domain module=Pkinase::Pkinase_Tyr; Domain location=87-316::87-314
MGNCGSREESAVVSKAQVVQQLHHATSLGASARTDKKHAHRHNLSECASDLSESCSTPRGNNSSNTLLYTHVIAFTLYELETITKSFRADYILGEGGFGTVYKGYIDENVRVGLKSLPVAVKVLNKEGLQGHREWLTEVNFLGQLRHPNLVKLIGYCCEDDHRLLVYEFMFRGSLENHLFRTTELVHYSLNAFEFLPRKWMFGCTGSGVEMITVVSSFQDNSITSNDRHMQYLISVDLESGWKYEATVPLSWATRMMIALGAAKGLAFLHNAERPDYTAKLSDFGLAKAGPQGDETHVSTRVMGTYGYAAPEYVMT

SEQ ID NO: 196570 - protein, 231 aa, Glycine max
  Coding DNA Sequence Number=SeqID_79792
  Gene Ontology: Mol. function=protein serine/threonine kinase activity; Cellular component=cell surface; Biological process =protein amino acid phosphorylation
  Homolog annotation: Hit_ID=Q7G6W1; Match level="QueryCoverage=64%, HitCoverage=21%, E-value=6e-42, Identity=57%"; Hit description =Putative receptor-like protein kinase
  Pfam annotation: Domain name=Pkinase; Domain location=43-214; Score= -50.0; E_value=1.4e-05; Accession=PF00069.15; Description=Protein kinase domain
  Pfam annotation: Domain name=Pkinase_Tyr; Domain location=19-214; Score=-142.6; E_value=0.001; Accession=PF07714.7; Description =Protein tyrosine kinase
  Pfam module annotation: Pfam domain module=Pkinase::Pkinase_Tyr; Domain location=43-214::19-214
SQQRAIVVHPCNSEDGNALKISVAAAGSGASTGVDSDGGGAGGTGVFSSTNSVQHVEAGNMVISIQVLREVTNNFNKGNILGRDIKPENILLGDDFCPKISDLGLDKLRKKEDIVTMSRRRGTPRYMALEWITIDPITSKADVYSFGMVLLELVNGIRNFEIQGSVEILDGQIRDAYDSRAHFETVNRMVKTAMWCLQDRPELRPTIGKVAKMLEGTVEITNLNKPTIFFL

SEQ ID NO: 196571 - protein, 294 aa, Glycine max
  Coding DNA Sequence Number=SeqID_79793
  Gene Ontology: Mol. function=sequence-specific DNA binding; Cellular component=intracellular; Biological process=regulation of transcription, DNA-dependent
  Homolog annotation: Hit_ID=Q8LJQ5; Match level="QueryCoverage=29%, HitCoverage=40%, E-value=3e-22, Identity=56%"; Hit description=LEC1 -like protein
  Pfam annotation: Domain name=CBFD_NFYB_HMF; Domain location=67-132; Score=64.4; E_value=3.6e-16; Accession=PF00808.13; Description =Histone-like transcription factor (CBFNF-Y) and archaeal histone
MTKEKVKEGEYDGKDQHKGEKDRASDKGKCSIIPFQQTDTYANTTIQPPINSNNGGPIPSLVLRDKSKMPITNVTKITGQILPNNAKISYDAMDMIQQGATKYINFVTRKAKEQCQSEYRKIMNAEDLLWAMKKLGFNDYVEPLTAFVQRYRNIEGSDLFTSHKEPIPHIENNEPRPNPMPTLEILHSPVPPPVHSSKPYFSIDTSHRELIPHTENNGPSLGLEPNHMPTFEMTPLSPSVHPFESYFSIDPDTNLEILDPNDINEIYLDEFGVGCSNDAFNNVDVSALFKHDQP

SEQ ID NO: 196572 - protein, 52 aa, Glycine max
  Coding DNA Sequence Number=SeqID_79794
MKVPQDTGKKRKQKVEKECTCKLQRVVKAVSMPLSEKAMGPGSKLTSFETNV

SEQ ID NO: 196573 - protein, 1017 aa, Glycine max
  Coding DNA Sequence Number=SeqID_79795
  Gene Ontology: Mol. function=transferase activity, transferring phosphorus-containing groups; Cellular component=membrane; Biological process=two-component signal transduction system (phosphorelay)
  Homolog annotation: Hit_ID=Q1SE10; Match level="QueryCoverage=99%, HitCoverage=99%, E-value=0.0, Identity=74%"; Hit description=CHASE; Lantibiotic regulatory protein
  Pfam annotation: Domain name=CHASE; Domain location=108-349; Score =261.4; E_value=1.8e-75; Accession=PF03924.4; Description=CHASE domain
  Pfam annotation: Domain name=HATPase_c; Domain location=491-675; Score=126.7; E_value=6.3e-35; Accession=PF02518.16; Description =Histidine kinase-, DNA gyrase B-, and HSP90-like ATPase
  Pfam annotation: Domain name=HisKA; Domain location=379-444; Score =94.1; E_value=4.3e-25; Accession=PF00512.15; Description=His Kinase A (phosphoacceptor) domain
  Pfam annotation: Domain name=Response_reg; Domain location=850-1006; Score=63.5; E_value=6.9e-16; Accession=PF00072.14; Description =Response regulator receiver domain
  Pfam module annotation: Pfam domain module=CHASE::HATPase _c::HisKA::Response_reg; Domain location=108-349::491-675::379 -444::850-1006
MGLSLKMQNHHPVALRLHDQMGSKRKYTFIQAHRAWLPKFLLLWILLMALISWCIYSKMDDDTKVRRKEVLGSLCDQRARMLQDQFSVSVNHVHALAILVSTFHYYSYPSAIDQETFAEYTARTAFERPLLSGVAYAQRVVNSERERFEKEHGWVIKTMERKSSLVRDEYAPVIFAQQTVSYLESIDMMSGEEDRENILRARATGKAVLTSPFRLLGSHHLGVVLTFPVYKSKLPQKPTVEERIEATAGFVVAYIDKPLNLGSILWLYVYCKLLSVLIYVGGSFDVESLVKNLLGQLDGNQAILVNVYDVTNYTNPLIMYGNQYQEGDMSLAHESKLDFGDPYRKHQMICSAGNHIVKVEDDFHEMQELKVRAEAADVAKSQFLATVSHEIRTPMNGILGMLALLLDTELSSTQRDYAQTAQACGKALITLINEVLDRAKIEAGKLELEAVPFDLRSIIDDVLSLFSEKSRHKGLELAVFVSDKVPDIVMGDPGRFRQIITNLVGNSVKFTEQGHIFVKVHLADNRKSMMNGKHETFLNGESDEVFYISGDYHFKTLSGCEAADERNSWDNFKHLIADKEYGLDSSRETMAACESSEQVTLRVCVEDTGIGIPFSAQDRIFMPFVQADSSTSRNYGGTGIGLSISKCLVELMGGQINFISRPQVGSTFSFTAVCGAFKKSSVTDKKENLEDLPSNFRGMKVIVVDGKPVRASVTRYHLKRLGILVKVANSISKAVALCGKTGSLTSGMFQPDIIMVEKDTWISGEDGIFNIWKQNGRMFKMPKMILLATNIISAEFDKAKATGFTDTVIMKPLRASMVAACLQQVLGMGKRRQLGKDMPNGFLHSLLYGKKILVVDDNGVNRRVAAGALKKFGADVKCAESGKAALEMLQLPHNFDACFMDIQMPEMDGRRKGASSCEENWDMLAWTWGNHLNRGYTFCRFEATSRIRMMESKANEEMNNGNEWHVPILAMTADVIHATYDKCMKCGMDGYVSKPFEEENLYQEVAKFFKSKTMSDS

SEQ ID NO: 196574 - protein, 589 aa, Glycine max
  Coding DNA Sequence Number=SeqID_79796
  Gene Ontology: Mol. function=protein serine/threonine kinase activity; Cellular component=mitochondrion; Biological process =protein amino acid phosphorylation
  Homolog annotation: Hit_ID=Q1SB26; Match level="QueryCoverage=93%, HitCoverage=93%, E-value=0.0, Identity=58%"; Hit description =Tetratricopeptide-like helical
  Pfam annotation: Domain name=PPR; Domain location=107-141; Score =19.8; E_value=0.0097; Accession=PF01535.11; Description=PPR repeat
  Pfam annotation: Domain name=PPR; Domain location=142-176; Score =18.1; E_value=0.031; Accession=PF01535.11; Description=PPR repeat
  Pfam annotation: Domain name=PPR; Domain location=177-211; Score =21.1; E_value=0.004; Accession=PF01535.11; Description=PPR repeat
  Pfam annotation: Domain name=PPR; Domain location=213-247; Score =32.0; E_value=2.1e-06; Accession=PF01535.11; Description=PPR repeat
  Pfam annotation: Domain name=PPR; Domain location=248-282; Score =46.9; E_value=6.6e-11; Accession=PF01535.11; Description=PPR repeat
  Pfam annotation: Domain name=PPR; Domain location=283-317; Score =29.6; E_value=1.1e-05; Accession=PF01535.11; Description=PPR repeat
  Pfam annotation: Domain name=PPR; Domain location=318-352; Score =44.1; E_value=4.9e-10; Accession=PF01535.11; Description=PPR repeat
  Pfam annotation: Domain name=PPR; Domain location=353-387; Score =41.3; E_value=3.4e-09; Accession=PF01535.11; Description=PPR repeat
  Pfam annotation: Domain name=PPR; Domain location=388-422; Score =43.7; E_value=6.1e-10; Accession=PF01535.11; Description=PPR repeat
  Pfam annotation: Domain name=PPR; Domain location=423-457; Score =23.6; E_value=0.00069; Accession=PF01535.11; Description=PPR repeat
  Pfam annotation: Domain name=PPR; Domain location=458-492; Score =36.4; E_value=9.7e-08; Accession=PF01535.11; Description=PPR repeat
  Pfam annotation: Domain name=PPR; Domain location=493-527; Score =54.2; E_value=4.3e-13; Accession=PF01535.11; Description=PPR repeat
  Pfam annotation: Domain name=PPR; Domain location=528-562; Score =19.7; E_value=0.011; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=107-141::142 -176::177-211::213-247::248-282::283-317::318-352::353-387::388 -422::423-457::458-492::493-527::528-562
  Subcellular localization annotation: CTP_CleavageSite=63; ConfidenceScore=5.51e-01
MLRARGRRASLHWFHLLVRHLGSFSNPTDFRSSSTFTNRAQFLDSMRSLKSEESALSFFHKMVAMNPLPPDKDFATLFGVIVKMKHYATAISLIKHTYSLGVKPDVHTLTIVINCLCHLKHTVFGFSVLGAMFKIGVEPTVVTFATLINGLCAEGNVGAAARFADSLEDMGYESNSYTHGTIINGLCKVGDTAGAISYLEKIEGRNRGFDLLIAYSTIMDSLCKDGMLCLALNFFSGMTCKGIQPDLVAYNSLIHGLCSFGRWNEAAALFGNMMTKGIVPNVQTFNVLVDNFCKEGKISRAKTIMCFMVHVGVEPDVVTYNSVISGHCLLSQMNDAVKVFELMIHKGLLPNVVTYSSLIHGWCKTRNINKAIFVLDEMVNNGLNLDVVTWSTLIGGFCKAGRPEAAIELFCTMHEHHQLPNLQTCAIILDGLFKCQFHSEAISLFRKMEKMNLELNIVTYNIVLDGMCSFGKFNDARELFSCLPSKGIQIDVVAYTTMIKGLCKEGLLDDAEDLLMKMEENGCPPNEFTYNVLVRGLLQRYDISRSTKYLMLMKGKGLSADATTTELLISYFSANKENSALQVFLQKFV

SEQ ID NO: 196575 - protein, 336 aa, Glycine max
  Coding DNA Sequence Number=SeqID_79797
  Gene Ontology: Mol. function=pectinesterase activity; Cellular component=cell wall; Biological process=cell wall modification
  Homolog annotation: Hit_ID=Q4PSN0; Match level="QueryCoverage=87%, HitCoverage=88%, E-value=1e-106, Identity=58%"; Hit description =Pectinesterase family protein
  Pfam annotation: Domain name=Pectinesterase; Domain location=39-328; Score=214.0; E_value=3.4e-61; Accession=PF01095.10; Description =Pectinesterase
MSLHWCCFVCLFLLVGLRAEVANAQFYRNVGNKHLPYWSIVVDQSGHGNFSTIQSAIDSVPSNNRYWVSIKVKAGTYREKVKIPYDKPFIILKGEGKRRTLVEWDDHNDISQSPTFAAMADNLVVKCMSFRNSYNNPINNKHENVPAVAAMVSGDKAYFFRVGFFGVQDTLWDVAGRHYYMLCTMQGAVDFIFGAAQSLFERCSISVIGGALAPGLSGFITAQGRENSQDANGFVFKDCHVFGSGSSYLGRPWRSYARVLFYNTTMTNVVQPSGWTSSDFAGYEGRITFAEYGNFGPGSDPSKRVSWTKKLDLKTIENMASLKFIDTEGWLQNQQF

SEQ ID NO: 196576 - protein, 281 aa, Glycine max
  Coding DNA Sequence Number=SeqID_79798
  Gene Ontology: Mol. function=pectinesterase activity; Cellular component=cell wall; Biological process=cell wall modification
  Homolog annotation: Hit_ID=Q4PSN0; Match level="QueryCoverage=79%, HitCoverage=88%, E-value=4e-36, Identity=52%"; Hit description =Pectinesterase family protein
  Pfam annotation: Domain name=Pectinesterase; Domain location=53-272; Score=125.4; E_value=1.6e-34; Accession=PF01095.10; Description =Pectinesterase
MYLGWYLLTFFFFLTSVKIVLVHANHNHHHHHHHEQRNNKQIANKTSHSSSGTIIVDLSGNGDFSTIQSAIDSISSDNKNWVYIYVKAGTYREKVKISFDKPFIVLEGEGQKNTFVEWDDHDSSAESPTFTTMADNVVVKSISFRDCTISAIDANLGPGIIGFITAQGRTDPNDSNGFVFKQCNIIGNGTTYLGRPWRGYARVIFYNTKMSNIIQPLGWQPWGFAGQEDHITFAEYGNSGPGSDTSKRVSWLKNLDSSTVSKMASTSFIGTDGWLKTLTQL

SEQ ID NO: 196577 - protein, 591 aa, Glycine max
  Coding DNA Sequence Number=SeqID_79799
  Gene Ontology: Mol. function=methyltransferase activity; Cellular component=nucleus; Biological process=mRNA editing
  Homolog annotation: Hit_ID=Q9C866; Match level="QueryCoverage=90%, HitCoverage=91%, E-value=0.0, Identity=46%"; Hit description=PPR -repeat protein
  Pfam annotation: Domain name=PPR; Domain location=175-209; Score =37.1; E_value=6e-08; Accession=PF01535.11; Description=PPR repeat
  Pfam annotation: Domain name=PPR; Domain location=245-279; Score =16.3; E_value=0.087; Accession=PF01535.11; Description=PPR repeat
  Pfam annotation: Domain name=PPR; Domain location=307-341; Score =45.4; E_value=2e-10; Accession=PF01535.11; Description=PPR repeat
  Pfam annotation: Domain name=PPR; Domain location=342-376; Score=7.5; E_value=0.97; Accession=PF01535.11; Description=PPR repeat
  Pfam annotation: Domain name=PPR; Domain location=408-442; Score =45.4; E_value=1.9e-10; Accession=PF01535.11; Description=PPR repeat
  Pfam annotation: Domain name=PPR; Domain location=443-477; Score =17.2; E_value=0.061; Accession=PF01535.11; Description=PPR repeat
  Pfam annotation: Domain name=PPR; Domain location=479-513; Score =16.0; E_value=0.096; Accession=PF01535.11; Description=PPR repeat
  Pfam annotation: Domain name=PPR; Domain location=548-582; Score =10.3; E_value=0.45; Accession=PF01535.11; Description=PPR repeat
  Pfam annotation: Domain name=PPR; Domain location=74-108; Score=38.1; E_value=3.1e-08; Accession=PF01535.11; Description=PPR repeat
  Pfam module annotation: Pfam domain module=PPR::PPR::PPR::PPR::PPR::PP R::PPR::PPR::PPR; Domain location=175-209::245-279::307-341::342 -376::408-442::443-477::479-513::548-582::74-108
MQCSKLLKGTYISLLKSCKSMSQLKQIQAHIFCFGLQQDRDILNKLMAFSMDSSLGDFNYANRIFNHIHHPSLFIYNLMIKAFVKRGSLRSAISLFQQLRERGVWPDNYTYPYVLKGIGCIGEVREGEKIHAFVVKTGLEFDPYVCNSLMDMYAELGLVEGFTQVFEEMPERDAVSWNIMISGYVRCKRFEEAVDVYRRMQMESNEKPNEATVVSTLSACAVLRNLELGKEIHDYIANELDLTPIMGNALLDMYCKCGCVSVAREIFDAMIVKNVNCWTSMVTGYVICGQLDQARYLFERSPSRDVVLWTAMINGYVQFNHFEDAIALFGEMQIRGVEPDKFIVVTLLTGCAQLGALEQGKWIHNYIDENRIKMDAVVSTALIEMYAKCGCIEKSLEIFNGLKDMDTTSWTSIICGLAMNGKTSEALELFEAMQTCGLKPDDITFVAVLSACGHAGLVEEGRKLFHSMSSIYHIEPNLEHYGCFIDLLGRAGLLQEAEELVKKLPDQNNEIIVPLYGALLSACRTYGNIDMGERLATALAKVKSSDSSLHTLLASIYASADRWEDVRKVRSKMKDLGIKKVPGYSAIEVDG

SEQ ID NO: 196578 - protein, 107 aa, Glycine max
  Coding DNA Sequence Number=SeqID_79800
MEPIASLAQYYDQPLRCFIFGDFQLSPMVEEFEEILGCPLRGRKPYLFSGFYPSLARISKKVQISAQELDRQRQVENGVVGIPRKYLERSTFFSPIITTRKVRLSLC

SEQ ID NO: 196579 - protein, 413 aa, Glycine max
  Coding DNA Sequence Number=SeqID_79801
  Gene Ontology: Mol. function=nucleotidyltransferase activity; Cellular component=cellular_component; Biological process =biosynthetic process
  Homolog annotation: Hit_ID=Q9ZVI9; Match level="QueryCoverage=85%, HitCoverage=82%, E-value=1e-168, Identity=82%"; Hit description =Putative phospholipid cytidylyltransferase
  Pfam annotation: Domain name=CTP_transf_2; Domain location=252-383; Score=66.1; E_value=1.2e-16; Accession=PF01467.16; Description =Cytidylyltransferase
  Pfam annotation: Domain name=CTP_transf_2; Domain location=49-179; Score=96.0; E_value=1.2e-25; Accession=PF01467.16; Description =Cytidylyltransferase
  Pfam module annotation: Pfam domain module=CTP_transf_2::CTP_transf _2; Domain location=252-383::49-179
MSSYEAVTETKWVVTCMVGGVIVGVSLLGAYSSQLWKSRRRNKKPVRVYMDGCFDMMHYGHCNALRQARALGDQLIVGVVSDAEIIANKGPPVTPLHERLVMVNAVKWVDEVIPEAPYAITEEFMKKLFDEYKIDFIIHGDDPCVLPDGTDAYAHAKKAGRYKQIKRTEGVSSTDIVGRMLLCVRERSIAEKNHNHSSLQRQFSNGHSPKFEAGVSAATASGTRISHFLPTSRRIVQFSNGRGPGPDSHIVYIDGAFDLFHAGHVEILRLARDLGDFLLVGIHTDQTVSATRGSHRPIMNLHERSLSVLACRYVDEVIIGAPWEISKDMLTTFNISLVVHGTIAESNDFKKEECNPYAVPISMGIFKVLESTLDITTTTIIRRIVSNHEAYQFLIALDLLSKYAMILLFKDMS

SEQ ID NO: 196580 - protein, 41 aa, Glycine max
  Coding DNA Sequence Number=SeqID_79802
MDNTWNNSKVEFNLQQLTPDQAYKLIKFQGATPKEGLPKKR

SEQ ID NO: 196581 - protein, 107 aa, Glycine max
  Coding DNA Sequence Number=SeqID_79803
MVLLCDRGGFVGDGDGAIRLMGLIGEEWSEKTKMQQRRFDDNLVSEPMPLNINNLTSVRELLFLNNMPDVHYYKKAFYIDYSSHSTSIFNRSHSGRCKKGKPFLQRS

SEQ ID NO: 196582 - protein, 37 aa, Glycine max
  Coding DNA Sequence Number=SeqID_79804
MTGPGLVLVLRRQRPKHRKLDSWLCDTLALAMPRQHC

SEQ ID NO: 196583 - protein, 84 aa, Glycine max
  Coding DNA Sequence Number=SeqID_79805
  Homolog annotation: Hit_ID=Q9FEA1; Match level="QueryCoverage=69%, HitCoverage=11%, E-value=4e-08, Identity=45%"; Hit description =Anthocyanin 1
MRSMERVVVRVKAVEVEAATSVQVSIIESSMLLEIEWPHREGFLIDVMHMVRELRAKVKEHVNGKVSIVEVKRAFNQNIPHAVD

SEQ ID NO: 196584 - protein, 57 aa, Glycine max
  Coding DNA Sequence Number=SeqID_79806
  Pfam annotation: Domain name=DSS1_SEM1; Domain location=6-55; Score =34.9; E_value=2.7e-07; Accession=PF05160.4; Description=DSS1SEM1 family
MSYLLSTRKSGRWWALKWDDKEEGKEVTQQWEDDWDDDDVSDDFSLQLKRELESNTN

SEQ ID NO: 196585 - protein, 326 aa, Glycine max
  Coding DNA Sequence Number=SeqID_79807
  Gene Ontology: Mol. function=peroxidase activity; Cellular component =vacuole; Biological process=response to oxidative stress
  Homolog annotation: Hit_ID=Q52QY2; Match level="QueryCoverage=92%, HitCoverage=84%, E-value=1e-121, Identity=71%"; Hit description =Secretory peroxidase PX3
  Pfam annotation: Domain name=peroxidase; Domain location=41-290; Score=438.5; E_value=9.2e-129; Accession=PF00141.13; Description =Peroxidase
MCSHSLIFHANLFLLLLIVGCHAQLRVDYYKNTCPNVESIVRSAVEKKLQQTFVTAPATLRLFFHDCFVRGCDASVMLATRNNTSEKDNPINLSLAGDGFDTVIKAKAAVDSVPGCQNKVSCADILALATRDVIALAGGPSYAVELGRLDGRVSTKASVRHHLPHPEFKLEQLNQMFASHGLTLTDLVALSGAHTIGFSHCSQFSKRIYNFRRRKSIDHTLNPTYAKQLQQVCPKNVDPRLAIDMDPVTPRTFDNQYYKNLQQGRGLLASDQALFTHKRTRDLVNLFASNNTAFEASFVSAMMKLGRIGVKTGNQGEIRHDCTMIN

SEQ ID NO: 196586 - protein, 171 aa, Glycine max
  Coding DNA Sequence Number=SeqID_79808
  Gene Ontology: Mol. function=nucleic acid binding; Biological process= apoptosis
MLCSSIIIYNLIENDPSTPVSTLIAHIKSTEGYTTKYHKAWLAKKKDIEDIYGNWERSYHDLLRLFRAMQQFLPSIVVEKKKLPMSPQGGQPIEGFIMVHHHFWSFRLCIDGFQYCKPIVQVDGTWLCAFAVVEGESMGTWQLFLQNLKRHVTPEHGKTTQILYQQLHRKP

SEQ ID NO: 196587 - protein, 111 aa, Glycine max
  Coding DNA Sequence Number=SeqID_79809
MPTTTVTTTLKPPDARGVTMGLGGAAMYSDSAAASASDSDENACNDAIEDVAIRIIGADEQESSSSPSSSRGRGGELGGKEAVERVLLASLDDGIVGARDSSSSSSSSTYQ

SEQ ID NO: 196588 - protein, 57 aa, Glycine max
  Coding DNA Sequence Number=SeqID_79810
  Homolog annotation: Hit_ID=Q9FJD4; Match level="QueryCoverage=53%, HitCoverage=3%, E-value=2e-07, Identity=83%"; Hit description =Importin beta
MAVRALEEKVQPYCDGILTQLLKDLSSNQLRRSVNSIMPMLQSDNHPLLIHLVLMTI

SEQ ID NO: 196589 - protein, 85 aa, Glycine max
  Coding DNA Sequence Number=SeqID_79811
MMITQMQRLLNCNIEEIYGRIEGLENQLNQNAGRHYGGNRWGNDGSWQNRMEGQNRIEGVKLNVPPFKGKSDPDTYLDLEMKIEH

SEQ ID NO: 196590 - protein, 161 aa, Glycine max
  Coding DNA Sequence Number=SeqID_79812
  Homolog annotation: Hit_ID=Q1SYX5; Match level="QueryCoverage=40%, HitCoverage=18%, E-value=2e-14, Identity=63%"; Hit description =Protein kinase
MHHLQKFRVEISRMSQEAYSRILQGFKGSPKTHLLMSYTSNVLQLLDSLYMEKDMDDVVTKIAIIVLGHSADTLGNDNQNKKEESCKTFEQKNAFMRRFLDLGEEKNGKGAVDQHLRIATNNYSYLLGSGGFGKVYKGIFSNGTIVAVKVLQGLSDKKMEE

SEQ ID NO: 196591 - protein, 438 aa, Glycine max
  Coding DNA Sequence Number=SeqID_79813
  Gene Ontology: Mol. function=transferase activity, transferring hexosyl groups; Cellular component=integral to membrane; Biological process=carbohydrate biosynthetic process
  Homolog annotation: Hit_ID=Q9ZVI7; Match level="QueryCoverage=86%, HitCoverage=60%, E-value=1e-120, Identity=57%"; Hit description =Expressed protein
  Pfam annotation: Domain name=Glyco_transf_8; Domain location=57-355; Score=137.2; E_value=4.3e-38; Accession=PF01501.10; Description =Glycosyl transferase family 8
MENTITKVKSIPVVCDNVDKKLRQIFDLTEDEANFHMKQSAFLYKLNVQTMPKSHHCLSLKLTVEYFKSSHYDEKADEEKFIDSSLHHYVIFSNNVLAASVVINSTVFHAKESSNQVFHVLTDGENYYAMKLWFLRNHYKEAAVQVLNVELDIQKENPLLLSLPEEFRVSILSYDNPSTNQIRTEFLSIFSDSHYLLPDLFSNLNKVVVLDDDVVIQQDLSALWNTDLGDKVNGAVQFCSVKLGQLKSYLGEKGLSQNSCAWMSGLNIIDLVRWRELGLTQTYRKLIKEFTMQEGSVEGIAWRASLLTFENEIYPLNESWVVSGLGHDYKIDTQPIKTASVLHYNGKMKPWLDLGIPQYKSYWKKFLNKEDQLLSDCNQLFRSNYSLQFTIVYRINETRLSWGVGAKVGVWYFALWMYAEAMGLGLSTGFCKICRQPP

SEQ ID NO: 196592 - protein, 791 aa, Glycine max
  Coding DNA Sequence Number=SeqID_79814
  Homolog annotation: Hit_ID=Q9AVK4; Match level="QueryCoverage=99%, HitCoverage=100%, E-value=0.0, Identity=61%"; Hit description =SCARECROW
  Pfam annotation: Domain name=GRAS; Domain location=399-690; Score =451.2; E_value=1.3e-132; Accession=PF03514.5; Description=GRAS family transcription factor
  Subcellular localization annotation: CTP_CleavageSite=32; ConfidenceScore=5.09e-01
MAACALFSGGGNITEDGNVNGSGSANSTPLTSASNSSNMSNEEQQQLHAGGIMPQPYCERKMMRKRMASEMEVNVHATPPHNSSSTTSDYPRFPRRSNTNTNMLEKGSPTTTSSTTTLAADNVAIPNYPTVTVTTNYSTMLLPSSLNSSGVAPNYNSTHQHHHFQGLVESQDQQNSVPAVCGFSGLPLFPSQSQRNRDNIRNSGGNIVDVVASSSPSPSMDDTSGAATTSGWIDGILKDLIHSSNSVSIPQLISNVREIIYPCNPNLAMVLEYRLRLLLTESTTPQHKRGTEGVPLLPSVSSVKLMNNRVVDGIAPNLHFTDASGGAVVVNQHMLSNWGVPQITPHHDNTNTNTNTNNNNNPSVSLVTLPSPAPPPHYSPPEEKNPQEEDLAAATTTAHEVALSRKKKEELREQKKKDEEGLHLLTLLLQCAEAVSAENLEDANKMLLEISQLSTPFGTSAQRVAAYFSEAISARLVSSCLGIYATLPHTHQSHKVASAFQVFNGISPFVKFSHFTANQAIQEAFEREERVHIIDLDIMQGLQWPGLFHILASRPGGAPYVRLTGLGTSMEALEATGKRLSDFANKLCLPFEFFPVAEKVGNLDPERLNVSKTEAVAVHWLQHSLYDVTGSDTNTLWLLQRLAPKVVTVVEQDLSNTGSFLGRFVEAIHYYSALFDSLGSSYGEESEERHVVEQQLLSREIRNVLAVGGPSRTGEPKFHNWREKLQQCGFRGISLAGNAATQASLLLGMFPSEGYTLVEDNGILKLGWKDLCLLTASAWRPPFHGAITHHN

SEQ ID NO: 196593 - protein, 282 aa, Glycine max
  Coding DNA Sequence Number=SeqID_79815
MLRSLKNLDNMSLEELFGTLKIIILVIVQSTKCKKLVQGTLILKDLKDVEEQEWVKTELLQKEKSKDKYKHYKSKSLMSSWEDMDNTPFNEKVEGEANLCLMDDTTSEESESEQEKTHLLLEVASPISLPSPFCCHSSSKKQRNPLMKKILGLQAPHGAYIISDHWSFYNKDDADKALFVKGTLLSDIWWDNVDYTLSFTAPIYHKGRNALKGNLLMWMDVRRHVNVEFANFSNGREGFYDVYSLRDRGILDAKYWWLVHDAHAPILQKIALKLLGQTCSSS

SEQ ID NO: 196594 - protein, 68 aa, Glycine max
  Coding DNA Sequence Number=SeqID_79816
MEKVKGLRILKMRVRELFTHGEEITCGANDRLWYERSVKTRFKQRKRSPMLEEGDEDAQRIKGTPKGP

SEQ ID NO: 196595 - protein, 152 aa, Glycine max
  Coding DNA Sequence Number=SeqID_79817
  Gene Ontology: Mol. function=zinc ion binding
  Homolog annotation: Hit_ID=Q10BU5; Match level="QueryCoverage=71%, HitCoverage=71%, E-value=7e-25, Identity=76%"; Hit description=DHHC zinc finger domain containing protein, expressed
MQLVMLLWCYFAVVFMDPGTVPPNWKPAADEERGEVDPLNGVYTFLETTLVTISLLPHFKTYFSDGEIPGTPGTLATTFLTFVLNLAFSLSVLGFLVLHVSLVASNTTTIEVFGMDKRYWFIPAYSEEDIRRMPVLQGLEYPSTPDFNAQEF

SEQ ID NO: 196596 - protein, 87 aa, Glycine max
  Coding DNA Sequence Number=SeqID_79818
MLSSSTRRPYEVLVVKVILSSHTIAKDQGVYHVFNKMDEESKHTLIVKGSVVTKQQNFSKTNLKAMKVALEKTLKETLEVDVEAIDK

SEQ ID NO: 196597 - protein, 216 aa, Glycine max
  Coding DNA Sequence Number=SeqID_79819
MKSGGGGGGGMGALPSYGVPAKRRWKGLVVAVLGLVILSMLVPLVFLLGLHNGFHSSGTISPRSLSINSLPFSHILPPQQIHVNFTSDFYLLTLRRALDLSFSRAARETASLNPRLFRIDESSFLFVCACVTSSSMKDPCARFLFYSEKRYIYEQKSTPSNEKSLERYDRHDVGHNESEEGQSNHVEDLITKFEPTLPKKTEQWLAGGEWKGGKGK

SEQ ID NO: 196598 - protein, 359 aa, Glycine max
  Coding DNA Sequence Number=SeqID_79820
  Gene Ontology: Mol. function=transcription factor activity; Cellular component=nucleus; Biological process=regulation of transcription, DNA-dependent
  Homolog annotation: Hit_ID=Q9XHD3; Match level="QueryCoverage=84%, HitCoverage=71%, E-value=5e-41, Identity=34%"; Hit description =PHAP2B protein
  Pfam annotation: Domain name=AP2; Domain location=164-211; Score =39.9; E_value=8.5e-09; Accession=PF00847.10; Description=AP2 domain
PFQDMAMFDLNVDINHCDADADSSCDQKGLVLQSFPPEISDSRTSSSSVWNPVEEDSSNNSSPLIFDILKKERDESEFDAATERVNKEQNMAPQEAEIVARTLFPVTAAVDKGVRVPDFKLGLWGKTECLNLSLPEPDGQNGLRTLQQKVPPVRKNRRGPRSRSSQYRGVTFYRRTGGFDTAQAAARAYDRAAIKFRGVDADINFSLSDYEEDLKQMRNLSKEEFVLLLRRQINGISRRSSTYRGALALRKDAQGEPRMGPFVGMTCYPKPSINCDDGKAEASFKPCSYKGEIIVNSNMTGTCHNLDLSLGISPSSKRLKNNDYSGGYSFGCMTCKIPEERGPMVLLFTFLVVAIFFYG

SEQ ID NO: 196599 - protein, 148 aa, Glycine max
  Coding DNA Sequence Number=SeqID_79821
  Gene Ontology: Mol. function=transferase activity
MACNKYVHAKTVTANGRPDPREAEAWAFLQALKWIPQLDLANAVIEFESDCKAVVDVLHSSFNGVSEFYSILANCKNHLSLYPKSRMSLIRGQANQDAHIVARVSSSCILLHISQGFCERIAREECGISEGIVRVSVRCYFAARLRDG

SEQ ID NO: 196600 - protein, 85 aa, Glycine max
  Coding DNA Sequence Number=SeqID_79822
MGCFCSRAPSVGSCHHHHHGDGGGGGGCGGGSGGGGGFKLSTAISGRVFPRSGTLMILLVPPLAAVVVFRFWDHRPVPKGTIFWR

SEQ ID NO: 196601 - protein, 238 aa, Glycine max
  Coding DNA Sequence Number=SeqID_79823
  Gene Ontology: Mol. function=catalytic activity; Biological process =cellular metabolic process
  Homolog annotation: Hit_ID=O48602; Match level="QueryCoverage=90%, HitCoverage=66%, E-value=5e-96, Identity=84%"; Hit description=2' -hydroxydihydrodaidzein reductase
  Pfam annotation: Domain name=3Beta_HSD; Domain location=9-231; Score=- 73.8; E_value=1.4e-07; Accession=PF01073.9; Description=3-beta hydroxysteroid dehydrogenaseisomerase family
  Pfam annotation: Domain name=Epimerase; Domain location=8-230; Score =17.7; E_value=2.2e-07; Accession=PF01370.11; Description=NAD dependent epimerasedehydratase family
  Pfam annotation: Domain name=KR; Domain location=6-152; Score=-94.8; E_value=0.073; Accession=PF08659.1; Description=KR domain
  Pfam annotation: Domain name=NAD_binding_4; Domain location=10-221; Score=-25.0; E_value=5.1e-07; Accession=PF07993.2; Description=Male sterility protein
  Pfam module annotation: Pfam domain module=3Beta_HSD::Epimerase::KR::N AD_binding_4; Domain location=9-231::8-230::6-152::10-221
MVEGKGRICVTGGTGFLGSWIIKSLLEHGYAVNTTIRSDPGRKRDVSFLTNLPGASEKLKIFNADLSDPESFGPAVEGCVGIFHTATPIDFAVNEPEEVVTKRAIDGALGILKAGLKAKTVKRVVYTSSASTVSFSSLEEKDVVDESVWSDVDLLRSVKPFSWSYAVSKVLSEKAVLEFGEQNGLEVTTLVLPFVLGGFVCPKLPDSVERALLLPLGMNAAPYFTLFLLPLLCFVFSN

SEQ ID NO: 196602 - protein, 326 aa, Glycine max
  Coding DNA Sequence Number=SeqID_79824
  Gene Ontology: Mol. function=catalytic activity; Cellular component =cytosol; Biological process=cellular metabolic process
  Homolog annotation: Hit_ID=Q40316; Match level="QueryCoverage=99%, HitCoverage=100%, E-value=1e-136, Identity=69%"; Hit description =Vestitone reductase
  Pfam annotation: Domain name=3Beta_HSD; Domain location=9-278; Score=- 26.9; E_value=4.7e-11; Accession=PF01073.9; Description=3-beta hydroxysteroid dehydrogenaseisomerase family
  Pfam annotation: Domain name=Epimerase; Domain location=8-254; Score =100.8; E_value=4e-27; Accession=PF01370.11; Description=NAD dependent epimerasedehydratase family
  Pfam annotation: Domain name=KR; Domain location=6-151; Score=-91.7; E_value=0.049; Accession=PF08659.1; Description=KR domain
  Pfam annotation: Domain name=NAD_binding_4; Domain location=10-238; Score=8.9; E_value=3.1e-09; Accession=PF07993.2; Description=Male sterility protein
  Pfam annotation: Domain name=NmrA; Domain location=8-275; Score= -105.1; E_value=0.041; Accession=PF05368.3; Description=NmrA-like family
  Pfam annotation: Domain name=adh_short; Domain location=6-153; Score=- 58.2; E_value=0.038; Accession=PF00106.15; Description=short chain dehydrogenase
  Pfam module annotation: Pfam domain module=3Beta_HSD::Epimerase::KR::N AD_binding_4::NmrA::adh_short; Domain location=9-278::8-254::6 -151::10-238::8-275::6-153
MEEEKGRVCVTGGTGFIGSWIIKRLLEGGYTVNTTIRSDPGRKRDVSFLTNLPFASKKLRIFNADLSNPESFSEAIEGCIGVLHTATPIDLEVNEPEEIVTKRTIDGALGILKACLNSKTVKRVVYTSSASAVYWQGKEEEVMDESYWSDENLLRDLKPFAWSYSISKTLAEKAVLEFGEQHGLDVVTLIPTFVLGPFICPKLPGSVYTSLAFLFGEKNPLGASRIHMVHVDDVARAHIFLLEHPNPRGRYNCSPFIATVEEIVELLSAKYPKFQIPTPDEVKKINGPKLPHLNSKKLIDAGFEFKYSLEEMYEDAIECCKEKGHL

SEQ ID NO: 196603 - protein, 320 aa, Glycine max
  Coding DNA Sequence Number=SeqID_79825
  Gene Ontology: Cellular component=membrane
  Homolog annotation: Hit_ID=Q10S28; Match level="QueryCoverage=99%, HitCoverage=40%, E-value=1e-112, Identity=65%"; Hit description =Expressed protein
MSLKLRRVFVNTCLLLMLLFFSSPLAVISAAKSAGRIINAEAMDNAQLWLAWVQSSSWLASLIFQFLPNVIIFVSMYIVIPSALSYLSKFERHLTVSGEQRAVLMKMVCFFLVNLILLRGLVESSLESTILKMGRCYLDGEDCKRIEQYMSASLLSKSCLSSLAFLITSTFLGISYDLLAPIPWIKRNIQKFRKNDMLQLVPEQSDEYPLEHQAIDNHNSLQRPLMHDNAYDIANGDNVEGQDLFVYPITGSSPAPKQTFDFAQYYAFNLTIFALTLVYCSFNPLVVPVGAIYFGYRYVVDKYNFLFVYRVRGFPAGNDG

SEQ ID NO: 196604 - protein, 108 aa, Glycine max
  Coding DNA Sequence Number=SeqID_79826
  Gene Ontology: Mol. function=catalytic activity; Cellular component =endoplasmic reticulum; Biological process=metabolic process
  Homolog annotation: Hit_ID=Q5J909; Match level="QueryCoverage=89%, HitCoverage=35%, E-value=3e-37, Identity=65%"; Hit description =Sterol-4-alpha methyl oxidase
  Pfam annotation: Domain name=Sterol_desat; Domain location=1-108; Score=-4.8; E_value=3.3e-05; Accession=PF01598.8; Description=Sterol desaturase
MVVYIKKSFEPTIKIDVSTLCPRAFIEDFSNYWIHRMLHCKWAFEKIHKVHHEYVAPIGLSAPYAHWAEIIILGIPSFLGPALVPGHITTYWLWFILRQLEAIETHSG

SEQ ID NO: 196605 - protein, 109 aa, Glycine max
  Coding DNA Sequence Number=SeqID_79827
  Gene Ontology: Cellular component=chloroplast
MGDKLHRREGNSPDHQLRPLNDRSVIKEMNGAKRSAEAVGCKKESVGERSALEGRTRASSAGRSGSENVGLSNANVGEIQCLETQGFLRKVRPRREASYRKMVIGSRRK

SEQ ID NO: 196606 - protein, 105 aa, Glycine max
  Coding DNA Sequence Number=SeqID_79828
  Homolog annotation: Hit_ID=Q00VP3; Match level="QueryCoverage=59%, HitCoverage=30%, E-value=8e-08, Identity=39%"; Hit description =Homology to unknown gene
MTLCSTFSNFNIHILKNNKGSFSRRFQLSQKLDDDNFIDKIKRRELILESGELATIGAIFNFRGKKPDYLGVQKNQPALALCPATKNCISTSENVTNLTHYTPPW

SEQ ID NO: 196607 - protein, 34 aa, Glycine max
  Coding DNA Sequence Number=SeqID_79829
MAEVLYWISTFVLILTLLCILGYQGLRLTLGLCV

SEQ ID NO: 196608 - protein, 155 aa, Glycine max
  Coding DNA Sequence Number=SeqID_79830
  Gene Ontology: Mol. function=NAD+ ADP-ribosyltransferase activity; Cellular component=nucleus; Biological process=protein amino acid ADP-ribosylation
  Homolog annotation: Hit_ID=O82289; Match level="QueryCoverage=54%, HitCoverage=14%, E-value=3e-13, Identity=47%"; Hit description =Expressed protein
MGSGVLVSHQLGFYVRKKKKEPATQKLHSIDTPHNLVFLIILTILSTQGCFHAVNYAESVEGMSSFGSTDSDIVEIYQCSGASMQARWELFQKQAEITKKNNGEANIRYAWLASSKGELSTMMNYGLSHYGLSGPKCTYGIGVHYARLKNTLNSL

SEQ ID NO: 196609 - protein, 125 aa, Glycine max
  Coding DNA Sequence Number=SeqID_79831
MHHQAMKNNLADLGMERKKVGSQPLCPKPRKLSPSIHEFLKPIKCTKHSQPNINDESGVLNMITEKNAEAREFQCNGCLPCCYSGSPPRRTENPLVHDVEFLHQVEVASPLARTKLSDKFGFTSA

SEQ ID NO: 196610 - protein, 377 aa, Glycine max
  Coding DNA Sequence Number=SeqID_79832
  Gene Ontology: Mol. function=methylmalonate-semialdehyde dehydrogenase (acylating) activity; Cellular component=integral to membrane; Biological process=valine metabolic process
  Homolog annotation: Hit_ID=UPI00005F80AA; Match level="QueryCoverage =80%, HitCoverage=60%, E-value=1e-153, Identity=88%"; Hit description= COG1012: NAD-dependent aldehyde dehydrogenases
  Pfam annotation: Domain name=Aldedh; Domain location=87-376; Score =87.9; E_value=3e-23; Accession=PF00171.12; Description=Aldehyde dehydrogenase family
  Subcellular localization annotation: CTP_CleavageSite=65; ConfidenceScore=5.29e-01
SKKTVTRDPGALGVLGRAVTATGQARCGFSVAKSVCIAPGFSCAVALSLARGTINAAPPASGQATADLKRGRDMKTVGNFIDGQVCLSSSNQTVDVHNPASGQVERRVTQSTAAEVKQAIDVAHRAFADWSRTTPLRRARIMFNFKALLEQHRDELAELIVSEHGKVYSDALGELTRGMEVVEFACGIPHLIKGEYSPDVGSGVDSFSLMQPLGVVAGITPFNFPAMVPMWMFPIALACGNTFILKPPALVPSASVRLAELLKEAGLPDGVFNVVHCANEDAAQLCTDPRIQAVSFVGSSTVAEHIYTTASAHGKRVQAFGAAKNQAIVMPDADLDATVNALMGGAFGSAGERCMALPIAVVVGDDTGDKLIAKLKP

SEQ ID NO: 196611 - protein, 115 aa, Glycine max
  Coding DNA Sequence Number=SeqID_79833
  Gene Ontology: Mol. function=pepsin A activity; Cellular component =anchored to membrane; Biological process=proteolysis
  Homolog annotation: Hit_ID=UPI000034F181; Match level="QueryCoverage =85%, HitCoverage=23%, E-value=2e-22, Identity=57%"; Hit description =aspartic-type endopeptidase/ pepsin A
  Subcellular localization annotation: CTP_CleavageSite=58; ConfidenceScore=5.12e-01
HTEAKAEAKAELSVAAHLVQSQGTQNRSLPVSSATMNFTPGGVSVGEGEAVVDLGELAAAEEAVAVGEFGVVLDGALLRRGGDSGGGGVGPLPDRLRVAVVHREGVDVAVAEGEE

SEQ ID NO: 196612 - protein, 56 aa, Glycine max
  Coding DNA Sequence Number=SeqID_79834
  Homolog annotation: Hit_ID=UPI000034F181; Match level="QueryCoverage =69%, HitCoverage=7%, E-value=2e-13, Identity=79%"; Hit description =aspartic-type endopeptidase/ pepsin A
MAQDSCSLHYTTVQIGTPGVKFMVALDTGSDLFWVPCDCTRCAATDSSAFASAFAS

SEQ ID NO: 196613 - protein, 298 aa, Glycine max
  Coding DNA Sequence Number=SeqID_79835
  Gene Ontology: Mol. function=pepsin A activity; Cellular component =anchored to membrane; Biological process=proteolysis
  Homolog annotation: Hit_ID=UPI000034F181; Match level="QueryCoverage =92%, HitCoverage=52%, E-value=1e-127, Identity=78%"; Hit description= aspartic-type endopeptidase/ pepsin A
  Pfam annotation: Domain name=Asp; Domain location=3-288; Score= -177.6; E_value=0.0041; Accession=PF00026.14; Description=Eukaryotic aspartyl protease
  Subcellular localization annotation: CTP_CleavageSite=46; ConfidenceScore=5.36e-01
DFDLNVYNPNGSSTSKKVTCNNSLCMHRSQCLGTLSNCPYMVSYVSAETSTSGILVEDVLHLTQEDNHHDLVEANVIFGCGQIQSGSFLDVAAPNGLFGLGMEKISVPSMLSREGFTADSFSMCFGRDGIGRISFGDKGSFDQDETPFNLNPSHPTYNITVTQVRVGTTLIDVEFTALFDSGTSFTYLVDPTYTRLTESFHSQVQDRRHRSDSRIPFEYCYDMSPDANTSLIPSVSLTMGGGSHFAVYDPIIIISTQSELVYCLAVVKTAELNIIGLQHCFLFSSAVLYAHSHARYPK

SEQ ID NO: 196614 - protein, 812 aa, Glycine max
  Coding DNA Sequence Number=SeqID_79836
  Gene Ontology: Mol. function=microtubule binding; Cellular component =phragmoplast; Biological process=positive regulation of microtubule polymerization
  Homolog annotation: Hit_ID=Q6L4A9; Match level="QueryCoverage=87%, HitCoverage=99%, E-value=1e-142, Identity=41%"; Hit description =Putative microtubule-associated protein, identical
  Pfam annotation: Domain name=MAP65_ASE1; Domain location=121-757; Score=213.9; E_value=3.6e-61; Accession=PF03999.3; Description =Microtubule associated protein (MAP65ASE1 family)
MHKNSDCTRIDYPVSLPKPILIVTLLPLLTLKNPSLLHSSNCIPISKTLKKSQFFVSVLNLKSFKLRFNRNFPCLMIVFNILVPMYSNRTSSQFGQQETTCHLLLKELQIIWDEVGESDSRRDAMLREIEHKCLDLYRKEVDEAKLCRAQIQQEIADNVAEIAGICAAMGEQPLHGDFTVDKLLLVCPQFDPKSCGSLKKARETVVSQLEEMRKLKTKRKKQFSEVLYHLKNISSELYGSMVANAYLEENNLSLKRLEELQKQLLQLQNEKASRLKQVSDQLNALNSLCLVLGLDVKDKICEICPTMVNSTVTKDVSDNTIKNLTSEIQSLREVKIHRMQKFYFMYHFSLYMLPQLQSFAAALLEMWDLMDTPMEEQQKFHHVTSKITALESEFTESKILSIDSVIYLEKEVERLQVLKSTKMKELLRKKKLELEEICRKTHLTTQTVFQSQHSLELLDYDQIEHLITKTKEEALNRKEILEKVEKWLVACQEESWLEEYNRDDNRYNAGRGAHLTLKRAEKARALLSKIPGIVETIILKVKAWEKERGQEFMYDGSRLLSILEDYSTLRQEKENERQLQRDQKKLQGQLMAEHETLFGSKPSPAFKSGYKVSRCSTGIPSITMLQDPRHASLIHQSNKKGNVTNQKGSILRNKNIYHSTQSSGKDNSKAIGHSVKLKKTASSAEKGTEIQSSLTRKPLSPVSPAVLSKANISNFQEDHRKSQNVATQQKSQMLTATPPSRPYIAGDEENMTPKNMALPVPTTPLTSVPMLTAITPDSVYSGPTAASKTSQSFEYSFEEVRAGFMLPKTYAQ

SEQ ID NO: 196615 - protein, 110 aa, Glycine max
  Coding DNA Sequence Number=SeqID_79837
MERGLAGTLPREITNLVNRSFLLKVDVKSGCCSPFEKTLNLMPNFPDVVENDLHCGEREAINLSKDSEELIPTKHNFYCESTMGELTLNEMKGKTDGVSMNVEPIQSQSS

SEQ ID NO: 196616 - protein, 413 aa, Glycine max
  Coding DNA Sequence Number=SeqID_79838
  Gene Ontology: Mol. function=ARF guanyl-nucleotide exchange factor activity; Cellular component=intracellular; Biological process =regulation of ARF protein signal transduction
  Homolog annotation: Hit_ID=Q9LZX8; Match level="QueryCoverage=97%, HitCoverage=22%, E-value=1e-154, Identity=70%"; Hit description =Guanine nucleotide exchange factor-like protein
MASSEADSRLKQVLVPALEKIIKNASWRKHAKLSHECKSVVEILTSPPKPQSPASDEAAEPEASVPGPIHDGGPVEYSLAESESILRPLIAAASSGVVKIADPALDAVQRLIAHGFLRGEADSSGGAPEAKLLASLIEAVCKCHDFGDDAVELLVLKTLLSAVTSISLRIHGDCLLLIVRTCYDIYLGSKNVVNQTTAKASLIQMLVIVFRRMEADSSTVPIQPIVVAELMDPVEKTDVDNSMTQSVQGFITRIVQDIDGVLNPVTPSAAAAAHDGAFETTITATVEAANPADLLDSTDKDMLDAKYWEISMYKTALEGRKEELVDGEVVERDDDLEIQIGNKLRRDAFLVFRALCKLSMKTPPKEATVDPQLMKGKIVALELLKILLENAGAVFRTSESLNFKVASMFGQSG

SEQ ID NO: 196617 - protein, 372 aa, Glycine max
  Coding DNA Sequence Number=SeqID_79839
  Gene Ontology: Mol. function=nucleic acid binding; Cellular component= mitochondrion; Biological process=multicellular organismal development
  Homolog annotation: Hit_ID=Q8H2U4; Match level="QueryCoverage=95%, HitCoverage=78%, E-value=2e-85, Identity=47%"; Hit description =Pentatricopeptide (PPR)repeat-containing protein-like
  Pfam annotation: Domain name=PPR; Domain location=129-163; Score =18.9; E_value=0.018; Accession=PF01535.11; Description=PPR repeat
  Pfam annotation: Domain name=PPR; Domain location=164-198; Score =20.8; E_value=0.0048; Accession=PF01535.11; Description=PPR repeat
  Pfam annotation: Domain name=PPR; Domain location=199-233; Score =29.2; E_value=1.5e-05; Accession=PF01535.11; Description=PPR repeat
  Pfam annotation: Domain name=PPR; Domain location=234-268; Score =24.2; E_value=0.00046; Accession=PF01535.11; Description=PPR repeat
  Pfam annotation: Domain name=PPR; Domain location=269-303; Score =27.7; E_value=4e-05; Accession=PF01535.11; Description=PPR repeat
  Pfam annotation: Domain name=PPR; Domain location=304-338; Score=2.3; E_value=4; Accession=PF01535.11; Description=PPR repeat
  Pfam module annotation: Pfam domain module=PPR::PPR::PPR::PPR::PPR::PP R; Domain location=129-163::164-198::199-233::234-268::269-303::304 -338
MEQIVKEEVKEGNERRYRWIEVGKNVTKEQQQAISKLPFRMADRSKALMRQIICFSAEKGTISDLLRSWVKLMKPTRADWLSVLKELRTTEHPFYLELKAVFSSSCLNLLVCLVAKHTLLEESFEVNIRDYTKIIHYYGEHNLLEDAEKFLTLMKQRGFIYDQVILTTMVHMSSKAGNHDRAKEYFEEIKLLGEPLDKRSYGSMIMAYIRAGMPEEGENLLQQMEAQEILAGSEIYKALLRAYSMIGNAEGAQRVFDAIQLAGITPDDKICSLLVNAYAMAGQSQKALIAFENMRRAGIKPSDKCIASVLVAYEKESKINTALEFLIDLERDGIMVGEEASAVLAKWFRKLGVVEEVELVLRDFAIIEVAAL

SEQ ID NO: 196618 - protein, 49 aa, Glycine max
  Coding DNA Sequence Number=SeqID_79840
MKKIFRKSKECVVRAMDWSIWEYGIEGDYKDVRLQLTSHTPCILSAGCY

SEQ ID NO: 196619 - protein, 954 aa, Glycine max
  Coding DNA Sequence Number=SeqID_79841
  Gene Ontology: Mol. function=microtubule motor activity; Cellular component=microtubule associated complex; Biological process =microtubule-based movement
  Homolog annotation: Hit_ID=Q9FZ06; Match level="QueryCoverage=86%, HitCoverage=92%, E-value=0.0, Identity=68%"; Hit description=Kinesin- like protein
  Pfam annotation: Domain name=Arm; Domain location=726-767; Score =33.7; E_value=6.5e-07; Accession=PF00514.13; Description =Armadillobeta-catenin-like repeat
  Pfam annotation: Domain name=Arm; Domain location=768-809; Score =22.0; E_value=0.0022; Accession=PF00514.13; Description =Armadillobeta-catenin-like repeat
  Pfam annotation: Domain name=Arm; Domain location=810-850; Score =19.8; E_value=0.0097; Accession=PF00514.13; Description =Armadillobeta-catenin-like repeat
  Pfam annotation: Domain name=Arm; Domain location=860-900; Score=6.4; E_value=1.9; Accession=PF00514.13; Description=Armadillobeta-catenin -like repeat
  Pfam annotation: Domain name=Kinesin; Domain location=140-470; Score =434.1; E_value=1.9e-127; Accession=PF00225.13; Description=Kinesin motor domain
  Pfam module annotation: Pfam domain module=Arm::Arm::Arm::Arm::Kinesin ; Domain location=726-767::768-809::810-850::860-900::140-470
  Subcellular localization annotation: CTP_CleavageSite=38; ConfidenceScore=5.67e-01
MASNRNGVQRGSAKFDRPLKPRPRPSSPSPGSALRRPNAAARNGDAASTSQGFPVPYVDDMELIEAPVLILERALHSCLGVDQLGFGTTWCRRETDMEEEQNREHYAATELKDAEVAAKTEQVKGPNKEELPGRVRVAVRLRPQNAEEMIADADFADCVELQPELKRLKLRRNNWDSDTYEFDEVLTEFASQKRVYEVVAKPVVESVLDGYNGTVMAYGQTGTGKTFTLGRLGEVDASDRGIMVRSMEDIFADLSPDTDSVTVSYLQDLLNPANDNIPIVEDPRSGDVSMPGATLVEITDQHSFLELLRIGEANRVAANTKLNTESSRSHAILTVHIKRSVLENEDIVSSQNGDASHLTKPSKPLVRKSKLVVVDLAGSERVHKSGSEGHMLEEAKSINLSLSSLGKCINALAENNAHVPFRDSKLTRMLRDSFGGTARTSLIVTVGPSPRHRGETSSTILFGQRAMKVENMLKIKEEFDYKSLSRKLEIQLDKLIAENERQHKAFEDEVEKVNLEAQCRIAEVERNFADALEKERLKCQMEYMELVKELEQKLVLNQERNDCNSFVADNGEGPASSSTDEVAEVKMLLETERNRRKAAEEEVGHLKSQLGKHMPSEAGGDVEIIKLRNILEDEANQKKRLEEEIIILRSQLLQLNFEADQMRRCLENGSSGSTFSALDSSTTQVRHSQFKDVANGQKSSVATLFEQDDANVRIHAVKVVANLAAEEANQKRIVEAGGLTSLLMLLRRYEDETVRRVAAGAIANLAMNEANQELIMAEGGITLLSMTASDAEDPQTLRMVAGAIANLCGNDRILMTLRSQGGIKALLGIVRCGHPDVLSQVARGIANFAKCESRASNQGIKSGRSFLIEDGALPWIVQNANNEAAPIRRHIELALCHLAQHEVNSKDLIGGGALWELVRISQDCSREDIRNLARRTLSSVSTFKSELRRLRIDY

SEQ ID NO: 196620 - protein, 91 aa, Glycine max
  Coding DNA Sequence Number=SeqID_79842
MRRRPGIGGLQTHAAARDQFRLLGQNVAKIITDLMKEQLATFRSQLEDFARKHSSKKVRARKRERGCIVRDVVCGEKGKRGIRGSLFLRGE

SEQ ID NO: 196621 - protein, 93 aa, Glycine max
  Coding DNA Sequence Number=SeqID_79843
  Gene Ontology: Mol. function=DNA binding; Biological process =regulation of transcription
  Homolog annotation: Hit_ID=Q1T6I7; Match level="QueryCoverage=49%, HitCoverage=17%, E-value=4e-11, Identity=73%"; Hit description=No apical meristem (NAM) protein
  Pfam annotation: Domain name=NAM; Domain location=21-87; Score=-47.3; E_value=0.0044; Accession=PF02365.6; Description=No apical meristem (NAM) protein
MGAFVEVYPQSHTKVLSLNTLLLGLCFCPTNEELIDYYLCSKINENGDDVWIIHEIDVYKCVCFLLEKQENSIVVRKRFLEEHERLDGTVDDG

SEQ ID NO: 196622 - protein, 155 aa, Glycine max
  Coding DNA Sequence Number=SeqID_79844
MDSVFVLVYCNSDIISSYEGIKFECHSGPKVITISEDMSLDALRKIIFYANGGCRILLNLFYHQQIHVGDGCVEYDYVELKHNDDVGKMFFIYSKFSTKGPIELNATFGRSPVIVVCDSKSQLAQKKKRRVFERLQTKELQENSEALKGGSELGD

SEQ ID NO: 196623 - protein, 87 aa, Glycine max
  Coding DNA Sequence Number=SeqID_79845
  Subcellular localization annotation: CTP_CleavageSite=33; ConfidenceScore=5.12e-01
MAHNFTPKKRVSFRLRRTQLHRTEQQSPKNKIKVAVKVLFFFGLRNRERKRVSESERKKRSILERERERKKCKTCVNDPMLRQTTFL

SEQ ID NO: 196624 - protein, 140 aa, Glycine max
  Coding DNA Sequence Number=SeqID_79846
MDLSNVSKGSFRLRAGMEPATAPLEEQPFPVITIVPFSLQEVVEKGDNDEVMVRDDILKYQSSIMSPMSAGALWNQLELAKLGDTHKMTLVAFEEDEHLFTRLAPDGPPTSMFISVCLNNFQCALLRRLNMDPSQLHPNS

SEQ ID NO: 196625 - protein, 767 aa, Glycine max
  Coding DNA Sequence Number=SeqID_79847
  Gene Ontology: Mol. function=RNA-directed DNA polymerase activity; Biological process=RNA-dependent DNA replication
  Pfam annotation: Domain name=RnaseH; Domain location=515-633; Score= -11.9; E_value=0.00074; Accession=PF00075.14; Description=RNase H
  Pfam module annotation: Pfam domain module=RVT_1::RnaseH; Domain location=384-729::515-633
MDRFGRLVVQIMNLNPEDKRQPLPKGRRYKHYTPLTTNRATIIDEAFNAKVPRQLPPYLLPDLVWIEPSTANTTTTMATTLKTIELSRTRSRNLYMQGGRGITHKGVNTNPNKSRKTNKHHIHTIKDLNVNCVNIQLPRSLPPITFTKRDFKGINPINQNDSMVVSIVIAIFIVSKVLIDQGSSTNILYWKTFQRLGISPATIQPYYKPLLGFAGERVETRGYVDLMTTFGQGKLSHSFTIRKKLNEFKAIVSTPHLKIKFPTLMGEIVTIKADQKQAQQYYAKSLKVGPYPPTKEPGKPHSPSSGSNSQVISIVKEFLIRALAVYEITRGNLGDTSNVDPRDDTIDKGPKQIEELIKLQLGPKSGEEIDKLLKAQYIGEVRYSTWLANVVMVRKDNGKWRMCTDYTNLNKACPKDVYPFPSIDKLLDNMSDFHLLSFLDAYSGYNHIRMHPEMKKKPPSSLKMPIYVTRSCLLDSRMLEPHTKGSWTRKYSKRKYDMRLNPKKCILGVPPKTESFSWDVACKQAFLAFKKTIATPPALKFGFMASNNQAEYEALIAGLKLAKKVGARKLRCYSNSQLVHGQVANRYQDKEAAILRYYHAIKTLVDDFDCFKMYHIPREDNTTTDLLSKIASTKKTGHLKTIIHETLQAPMIDINEVMAGEEEEPDWMTPYKNFLTQGVLPSNKNEARRLKRKASYYVILDGELFKRGMDILGQFPKAPGQVEFLLVTVDYFTKWIKARPLQAISANTMILVEVGEPSMRRLFFQAQ

SEQ ID NO: 196626 - protein, 176 aa, Glycine max
  Coding DNA Sequence Number=SeqID_79848
MFEFNSDVFRRFKDHFFKVKATSVISEGLSLMHEENEEPCFPFYWQSDHARNNGRIRIMTLVKQVGPTEGDVTPPPTSVNEPSIEEGYLTEVGVNLPHASGSIEANFVEVMPDVPPPATRKRKHSGRRDQTTTTSCRGPPSTPFATQAAANTTNISNPLAPPSPSTQAVSVPSSSM

SEQ ID NO: 196627 - protein, 144 aa, Glycine max
  Coding DNA Sequence Number=SeqID_79849
  Subcellular localization annotation: CTP_CleavageSite=48; ConfidenceScore=5.40e-01
MPPPSSVLPPSAPTVLPPTMPFSSSCQIVSLDQRSLTILEENGNRHKEAMSVASEVPQGEVERSAEEKEALNATVAESAKLISDLQAQLRDSEFASCNLQTKLKESKLEVVREKELNKELEDELLMFKKEVVEQHMKGFFKAVR

SEQ ID NO: 196628 - protein, 144 aa, Glycine max
  Coding DNA Sequence Number=SeqID_79850
  Gene Ontology: Mol. function=helicase activity
  Homolog annotation: Hit_ID=Q1SN45; Match level="QueryCoverage=98%, HitCoverage=8%, E-value=1e-28, Identity=50%"; Hit description=AAA ATPase
MELVLRNLYLAVKIITLLGVYCLKRVVNPNLHNYIYIHDTQKELQNKVSHFGGEKGYEVFDKTLVEDLTKTDDQFNCLAKHFRKVRDFVEGNARKRFCLRLYRDRRKDPSVYNIPDTDEVVALIVRDLDSMNFGRDIVLKSIFG

SEQ ID NO: 196629 - protein, 92 aa, Glycine max
  Coding DNA Sequence Number=SeqID_79851
  Homolog annotation: Hit_ID=Q1SN45; Match level="QueryCoverage=77%, HitCoverage=4%, E-value=7e-15, Identity=52%"; Hit description=AAA ATPase
MMNRYCFEALDCTLWDLMHYDKGEGDIEIPTNLLVLDNDKPLLSLVDVVYSNILENLNVSNFFEDRAILAPTLKTSEEVNEFMLSLIPGDEE

SEQ ID NO: 196630 - protein, 676 aa, Glycine max
  Coding DNA Sequence Number=SeqID_79852
  Gene Ontology: Mol. function=nucleic acid binding; Cellular component= intracellular
  Homolog annotation: Hit_ID=Q4RQM6; Match level="QueryCoverage=71%, HitCoverage=81%, E-value=3e-44, Identity=27%"; Hit description =Chromosome 2 SCAF15004, whole genome shotgun sequence
  Pfam annotation: Domain name=Ank; Domain location=431-463; Score =17.3; E_value=0.054; Accession=PF00023.20; Description=Ankyrin repeat
  Subcellular localization annotation: CTP_CleavageSite=16; ConfidenceScore=5.06e-01
MVTNLPATKSTNTTTSLQEKRHRSIFEVPPNFFDCCRLLPSPHSSVSDHYSVSRTQTLEPSSNDDVVLDAPQNAVVSAPRWTCNTCKTQFDSLQDQRSHFKSDIHRFNVKLTIAGKNIVKEEDFEVLTSEFVKDYDVSSISGSEIDDDSETESQSQSVLCDKSSKSFKTKLFFRLQTGQRVSVWKCLIMNVTENVLYDNEKAENQVVEKLKSLTAEPRDNTYLRIVLLASGGHFAGCVFDGDAVVAHKTFHRYVVRAKAGKKQSSKDASGRAAHSAGASLRRYNEIALKKEVHELFTDWKPYFDASNCIFIHAPSSSRQLLYDGERSYFTNQQCAIRNIALTVRRPTFREAKRVYSQLIQVTYEADEKEVLQSNQEDSVSIHISKINVSPTSSKGDMAELDDKDKAEAFSSKQNDELPISSNGESEDDLSCKSTPLHQAAQSDDSLKVLEFLEQGLDPCIKDERGRTPYMLAHDKEVRNTFRRFMASNLDKWDWQAAKVPSALTKEMEESQAAKQAEKDAKRKARAKELKKLRKAKEKKAQVEATLPKNDSKTIEKQVTASTSVKGQSQLKSGVQLSKEDQIRMAQAAEREKRAAAAEKRIAALKIQANSATTAPTMSEPKSGLAGDIYCSCCNSSLAGKVPFHRHRASKYRESSGLRQHVLPVLNQIREVDSLRT

SEQ ID NO: 196631 - protein, 139 aa, Glycine max
  Coding DNA Sequence Number=SeqID_79853
  Gene Ontology: Mol. function=oxidoreductase activity; Cellular component=integral to membrane; Biological process=electron transport
  Homolog annotation: Hit_ID=Q2MIY9; Match level="QueryCoverage=99%, HitCoverage=70%, E-value=3e-49, Identity=74%"; Hit description =Cytochrome P450 monooxygenase CYP706E1
MAELLRNPGKIDKRKELSQAIGKDVTIEESHILKLPFLRAVVKETLRLHPPGPFLVPHKCDEMVTIYGFKVPKNAQVLVNVWAMGRDPRENPEVFKPERFLEREIDFKGHDFEFIPCGTGNRIAISSQNNAFNGGIPCS

SEQ ID NO: 196632 - protein, 191 aa, Glycine max
  Coding DNA Sequence Number=SeqID_79854
  Gene Ontology: Mol. function=oxidoreductase activity; Cellular component=membrane; Biological process=electron transport
  Homolog annotation: Hit_ID=Q2MIY9; Match level="QueryCoverage=96%, HitCoverage=96%, E-value=3e-81, Identity=71%"; Hit description =Cytochrome P450 monooxygenase CYP706E1
  Pfam annotation: Domain name=p450; Domain location=1-182; Score= -201.1; E_value=0.081; Accession=PF00067.12; Description=Cytochrome P450
MDLLVAGIDTTSSTVEWIMAEVLRNPDKLVKSRKELSQTVGKYVTVVKETLRLHPPGPLLVPHKCDEMVSISSFNVPKNAQILVNVWAMGRDPTIWENPTIFMPERFLKCEVDFKGHDFELIPYGAGKRICPGLPLAHRTMHLIVASLVHNFEWKLADGLMPEHISMKDQFGLTLKKVQPLRVQPIPIKHD

SEQ ID NO: 196633 - protein, 694 aa, Glycine max
  Coding DNA Sequence Number=SeqID_79855
  Gene Ontology: Mol. function=nucleoside-triphosphatase activity; Cellular component=membrane
  Homolog annotation: Hit_ID=Q944N4; Match level="QueryCoverage=52%, HitCoverage=85%, E-value=1e-134, Identity=58%"; Hit description =Tobacco mosaic virus helicase domain-binding protein
  Pfam annotation: Domain name=AAA; Domain location=536-648; Score =79.1; E_value=1.4e-20; Accession=PF00004.19; Description=ATPase family associated with various cellular activities (AAA)
  Pfam annotation: Domain name=Vps4_C; Domain location=640-692; Score= -11.6; E_value=0.016; Accession=PF09336.1; Description=Vps4 C terminal oligomerisation domain
  Pfam module annotation: Pfam domain module=AAA::Vps4_C; Domain location=536-648::640-692
MEILYSKLYDKYTKLKSKKLSDLDHINKEQEGKFVNYLTAAEELIEHLKSEKEGLVEQVNELRTEFSSLRHEWAAKEKEVADYQKLLMEEKEKNEALSEEVEKLLKLHQERTSHVLYNNSKIKTVDDQFKANSNSSSIRMTRKHTKQIALEKEARSISLENEGNSVERESTPNACKETVSDNANDRSGIDLHESGHGNWLIQTLFEYALSMKLSLDYQAGRICLSALHGSSGYSFSLSWIGKSPGEEEAEAELLYHVISLGTFERVAPEWMREDIMFSPSMCPIFFERISRGIIDSFNSIFTHDNNNNYHNTNSPSSSSSTNRMEASPPPSVSNERVAYKLKGYFDLATQEIAKGVRAEEWGLIDDALLHYRNAHSILLEANSTPVPSYITTSEQQKVQSYREKISKWQSQVSERLQTLARRAGSSSANQSTSKLGQTAAAPIKTLSTRKNVLQKPPQRGGQVNKVGSPKSSQASGVNYDDKLVEMINTAIVDRSPSVRWEDVAGLEKAKQALMEMVILPTKRRDLFTGLRRPARGLLLFGPPGNGKTMLAKAVASESQATFFNVTAASLTSKWVGEAEKLVRTLFMVAISRQPSVIFIDEFDGVTSNPDDIVIVIGRDLERLVKETERYSGSDLQALCEEAAMMPIRELGVDILTVRGLRYEDFKKAMTIIRPSLNKSKWEELERWNEEFGSN

SEQ ID NO: 196634 - protein, 323 aa, Glycine max
  Coding DNA Sequence Number=SeqID_79856
  Gene Ontology: Mol. function=GPI anchor binding; Cellular component =anchored to membrane; Biological process=cell adhesion
  Homolog annotation: Hit_ID=Q9LZX4; Match level="QueryCoverage=93%, HitCoverage=72%, E-value=1e-111, Identity=66%"; Hit description =Fasciclin-like arabinogalactan protein 10 precursor
  Pfam annotation: Domain name=Fasciclin; Domain location=191-321; Score=93.5; E_value=6.5e-25; Accession=PF02469.12; Description =Fasciclin domain
MAHLLPFLVLTLLAATASAHNITDILAANPDYSDFNDFLSQTGLAGDINTRQTITVLVLNNAAFSAVAAKHPLSVVKNLLSLHILLDYFDNTKLHQITNGTTLSTTLYQTTGNANGNVGSVNITDLKGGKVGFGSAAPGSKLDSSYIKSVKSIPYNISVIEISAPIMAPGILAAPPPSADVNITALIEKAGCKTFASLISSNGLIKTFQATADKGLTIFAPNDEAFKAKGVPDLSKLTNAEVVSLLQYHAAAKYLPVGSLKTTKDSINTLASNGAGKFDLTVSVAGDSLTLHTGVDSSRIADTILDSSPLSIYSVDSVLLPQE

SEQ ID NO: 196635 - protein, 154 aa, Glycine max
  Coding DNA Sequence Number=SeqID_79857
  Gene Ontology: Mol. function=GPI anchor binding; Cellular component =anchored to membrane; Biological process=cell adhesion
  Homolog annotation: Hit_ID=O22126; Match level="QueryCoverage=75%, HitCoverage=27%, E-value=4e-33, Identity=64%"; Hit description =Fasciclin-like arabinogalactan protein 8 precursor
MTEMFRGAEADLAAFEVGDVDGADVAVGITCGLVESGGKSGPVGDLVELCVVEVVEEDMEAEEVLDDGEGVFRGDGGEGGVVEDEDGDGLAGVDVAGEAGLGEEVVEVAVVGVGGENVGDVVGGGGGGEESEDEEGEQVSHDGESREWEVGVKS

SEQ ID NO: 196636 - protein, 469 aa, Glycine max
  Coding DNA Sequence Number=SeqID_79858
  Gene Ontology: Mol. function=molecular_function; Cellular component =nucleus; Biological process=biological_process
  Homolog annotation: Hit_ID=Q6EUI5; Match level="QueryCoverage=96%, HitCoverage=15%, E-value=1e-169, Identity=62%"; Hit description =Putative lysosomal trafficking regulator 2
  Pfam annotation: Domain name=Beach; Domain location=58-335; Score =724.1; E_value=9.4e-215; Accession=PF02138.8; Description=BeigeBEACH domain
MDGSDSIVEAGKRIRSFENGEGRRNAYRTIVQARPPHLNNIYLATQRPEQLLKRIQLMERWARWEISNFEYLMQLNTLAGRSYNDITQYPVFPWILSDYSAESLDLSNPSSYRDLSKPIGALNPDRLNRFQERYASFDDPVIPKFHYGSHYSSAGTVLYYLVRVEPFTTLAIQLQGGKFDHADRMFSDIFATWNGVLEDMSDVKELVPELFYLPEVLTNENSIDFGTTQMGGKLDTVKLPAWAENPIDFIHKHRKALESEYVSAHLHEWIDLIFGYKQRGKEAVTANNVFFYTTYEGTVDLDKISDPVQQRAIQDQIAYFGQTPSQLLTVPHLKKMPLAEVLHLQTIFRNPKEVKPYAVPFPERCNLPAAAIHASSDTVVVVDMNAPAAHVAQHKWQPNTPDGQGTPFLFQHRKATLASAGGTIMRMFKAPAASGGEWQFPQAVAFAVSGIRSQAIVSITSNKEVITGK

SEQ ID NO: 196637 - protein, 353 aa, Glycine max
  Coding DNA Sequence Number=SeqID_79859
  Gene Ontology: Mol. function=cysteine-type peptidase activity; Biological process=proteolysis
  Pfam annotation: Domain name=Transposase_21; Domain location=1-92; Score=-100.0; E_value=4.5e-06; Accession=PF02992.5; Description =Transposase family tnp2
MLFCTINDFPAYGNLSGYNVKSYRACPICEEDTRYIQLKHGRKTVYARHQHFLKPHHPLLMIRKTFYGSQKHENAPILLASDQVFQQKIKLIWVERPLVYVYLVIGKVDGPHRKKLRTYLGIVAFNKVDVTYENWKQVPATQKDLIWKDIQVEFDIAEACDLRTKKKILQTVGERWRQFKFDLTLRWTLASDKDSVDCLQKDVRMKAQAIQKQNTTPHVLSREGYELLEKKLIYEKKKKQLEEVAKFGSTNTLIDPPSSIRRHVKWKMARTKKTYQMTCEATKEIGDKINSLEEQVSQGSFVSYGCQDLQGPATFLLPRLPRPRAMTQKIKDQLEESITEKVTQQLMLSFSQM

SEQ ID NO: 196638 - protein, 88 aa, Glycine max
  Coding DNA Sequence Number=SeqID_79860
MDKQVPKKPMNSADRLELDDDLIYQMTLITSQLFLKPMQVSWDANMFRVYNDNIPLYIKHEDLGEITHNGQCLNIAIIQIAYYGLMKH

SEQ ID NO: 196639 - protein, 105 aa, Glycine max
  Coding DNA Sequence Number=SeqID_79861
MVGAGLKKDLRVSRVVPGGSLNAFLFLLIGVISQRLAMGFLIWDPGEEDQAGHCEQLDALSPFNPLSEMWQKEKESMDRPHRLHPVGTTRSPQGRLRHPGVADRP

SEQ ID NO: 196640 - protein, 1509 aa, Glycine max
  Coding DNA Sequence Number=SeqID_79862
  Gene Ontology: Mol. function=DNA binding; Cellular component =intracellular; Biological process=DNA integration
  Homolog annotation: Hit_ID=Q1T010; Match level="QueryCoverage=74%, HitCoverage=99%, E-value=0.0, Identity=45%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=LRR_1; Domain location=1256-1278; Score =4.1; E_value=50; Accession=PF00560.23; Description=Leucine Rich Repeat
  Pfam annotation: Domain name=LRR_1; Domain location=1305-1329; Score =4.3; E_value=45; Accession=PF00560.23; Description=Leucine Rich Repeat
  Pfam annotation: Domain name=LRR_1; Domain location=1331-1351; Score =5.5; E_value=26; Accession=PF00560.23; Description=Leucine Rich Repeat
  Pfam annotation: Domain name=LRR_1; Domain location=1365-1387; Score =2.8; E_value=87; Accession=PF00560.23; Description=Leucine Rich Repeat
  Pfam annotation: Domain name=rve; Domain location=402-570; Score =74.3; E_value=3.8e-19; Accession=PF00665.16; Description=Integrase core domain
  Pfam module annotation: Pfam domain module=LRR_1::LRR_1::LRR_1::LRR _1::RVT_2::rve; Domain location=1256-1278::1305-1329::1331-1351::1365- 1387::724-938::402-570
MGSTNGNFPANLPILDGKNWSKWSVQMKVIFAYQEVQEVVDEGYPALVEGATEAQRAVHRENKKKDNKALFFIHQCIDNAHFEKIASAKTSHEAWKILEKCNEGADQLKKVQLQTLRRQYELMQMNVTEKVAEFFNRVIALTNSMKVSGETVTDQMIVEKILRTLIPKFDHVVVAIEESKNLATLKVEELQGSLEAYEQRMLERQSDRSQDQALQAQTWKRGGLSGKKGNRGRGRSREYRSNYGSSGKQSQNNEENDQSESSSRRGGSQNWQGGKFSNEANLVSEKLDQDEEPITLMMMTKERSSNSGIWYIDSGCTNHMTGHKEWLVNLDLSKKSRVRFADDRHITAEGIGDVYVKKEDGKDVVITEVLYVPGLKSNLINMGQLLEKGFSLYMISGHLGVYDTHQRRILKVPLTRNRTFQIKVNALESHCLSAEVDKDGSWLWHLRFGHLNFKSLSLLNSKGMVSGMTPIKLPSKVLRTDGGGEFCSHEMENFCTENGILHEIVAPYTPQHNGIAERRNRTILNMVRSMLKGKNMSHTFWGEAVMTAAYVLNLCPTKKLGSKVPEEIWTRKKPNVKHLKVFGYLCHKHIPDQKRKKLDDKSESMVFIGYSSTGAYKLYNPRTKKDQTVAEIDLDLDQTAPDLDNGEELGEELNLPLAPPVESNAPQNERLRRHAEVPARLHDYELFQDSEIGNVGELIHMALLADVSPVSFDEAIVDETWRKAMKEELVFKVKLNPNGSISRHKARLVVRGFKQKEGLDYSEVFAPVARMKTIRLLVALASWRGWKLWQLDVKSAFLNGPLEEEVYITQPPGFELKGSEDKVLKLKKALYGLKQAPRAWNKRIDAFLSKTGFRKCSVEHGLYVKKSDSGGILLICLYVDDLLITGSSSTEIAEIKRCLSIEFEMTDLGKLSYFLVEANLKLGSCEQETKVDSTMFRQLVGCLRFLCHSRPEISFGVGLVSRYMKSPRQSHLVAAKRILRYLKGTLNHGVLFPTHLPNQKEDGNLHLVAYSDSDWCGDQVDRCSTMGYVFFLGEAPFSWSSKKQDVVALSTCEAEYIAACSAACAIKIMVDNKSAINLAKNPVSHGRSKHIETKYHFLRDQVSKEKIKLQHCGTDLQVADILTKPLKIERFKSLRDKMNGNITTPSLTKVEYGRSGYNWHMSEDNWHMLNGDDWHMMSEDHWYDDLNTTVRTVFTKKDQYPDWEKLDIRNMFNNSLKSIWPNQVTPNSFPNLTKIVIDSCRSQYVFPIYVAKVLRQLQVLKISFCTIENIVEESDSTCDMMVVYLEVRKCHHMMTIVPSSVQFHSLDELHVYKCHGLVNIIMPSTITNLPNLRILRISECDELEEIYGSNNESDDAPLGEIAFMKLEELTLKYLPRLTSFCQGSYNFKFSSLQKVHLKECLVMETFCHGNITTTSHIEVRCLYGWSNEESEDHWVGDLNTTIRTIFTKEPLSNSSVTVKYEVLVNSIATLIFMNVIVSIIVFYFGETKLANATPYVLLSNLSAVVKKIV

SEQ ID NO: 196641 - protein, 821 aa, Glycine max
  Coding DNA Sequence Number=SeqID_79863
  Gene Ontology: Mol. function=nucleoside-triphosphatase activity; Cellular component=membrane; Biological process=defense response
  Homolog annotation: Hit_ID=Q1STU9; Match level="QueryCoverage=96%, HitCoverage=75%, E-value=1e-111, Identity=33%"; Hit description=H+ -transporting two-sector ATPase, alpha/beta subunit, central region; Disease resistance protein
  Pfam annotation: Domain name=LRR_1; Domain location=468-490; Score =1.5; E_value=1.5e+02; Accession=PF00560.23; Description=Leucine Rich Repeat
  Pfam annotation: Domain name=LRR_1; Domain location=492-512; Score =8.6; E_value=7; Accession=PF00560.23; Description=Leucine Rich Repeat
  Pfam annotation: Domain name=LRR_1; Domain location=514-535; Score =12.3; E_value=1.4; Accession=PF00560.23; Description=Leucine Rich Repeat
  Pfam annotation: Domain name=LRR_1; Domain location=665-689; Score =2.7; E_value=88; Accession=PF00560.23; Description=Leucine Rich Repeat
  Pfam annotation: Domain name=LRR_1; Domain location=695-718; Score =4.5; E_value=40; Accession=PF00560.23; Description=Leucine Rich Repeat
  Pfam annotation: Domain name=NB-ARC; Domain location=116-381; Score =74.7; E_value=2.9e-19; Accession=PF00931.13; Description=NB-ARC domain
  Pfam module annotation: Pfam domain module=LRR_1::LRR_1::LRR_1::LRR _1::LRR_1::NB-ARC; Domain location=468-490::492-512::514-535::665 -689::695-718::116-381
MDGQIGYISSYEENIEKLITEVQTLKDTQESVQHRVVEAERNGDKIENIVQNWLKKANEIVAAANKVIDVEGTRWCLGQYCPYLWTRCQLSKSFEKMTKEISDVIEKGKFDTISYRDAPDVTITPFSRGYEALESRTSMLNEIKEILKDPKMYMIGVHGMGGVGKTTLVNELAWQVKKDGLFVAVAIANITNSPNVKRIQGQIADALLDRKLEKETEEVGIPFGDEHNGCKLVITSREREVLIKMDTQKDFNLTALLEEESWKLFQKIAGNVVNEVGIKPIAEEVAKCCAGLPLLITALGKGLRKKEVHAWRVALKQLKEFKHKEFENNVYPALKLSYDFLDTEELKLLFLFIGSFGLNEIHTEDLLICCWGLGFYGGVHTLMEARDTHYTFINELRASSLLLEGKPEWVGMHDVVRDVAKSIASKSLPTDPTYPTYADQFRKCHYIRFQSSLTQVQADNFFSGMMKEVMTLILYEMSFTPFLPPSLNLLINVRSLNLRRCKLGDIRMVAKLSNLEILSLAGSSIAELPGEIKHLTQLYMGGCYNIEWEVEGRKSESNNAKVRELQNLHNLTTLEISFKDTSVLPRDFQFPAKLERYKIWIGNISKWYWSQNWYGEALGPSRMLKLTDYRWTSRLLFTTVEDLSFAKLKGVKDLLYDLDVEGFPQLKHLYIQDNDELLHLINPRRLMNPHSAFLNLETLVLNNLCKIEEICHGPMQTQSFAKLKVIKVTCCHWLKNLFLYSITGNLSQLHEMKISGCKGMTKIIDVEKQEDQKELLQIVLPELHSVTLLGLLELQSFYCSVAVDQGNPSSQSIPLALFNQQ

SEQ ID NO: 196642 - protein, 166 aa, Glycine max
  Coding DNA Sequence Number=SeqID_79864
MAVFGDHNGYCSLVKKAKRYIKDAWRLTSTLIPNSGLSWLCMWMAWWSSLMGDSGPAKDTILEWPETDWALCASVQGGGRVRERQSSDEMERSSKLWQRLPTKEKIAGKGDSEQKKERSPLECGNRTPEGKPVLEMEEAQIWAKKVELPVFMGTDPIGWIARAEKF

SEQ ID NO: 196643 - protein, 176 aa, Glycine max
  Coding DNA Sequence Number=SeqID_79865
MTHQSRHSPCHMWTPNSTPAPQALSRICWRKRLFSVEGSNLDEFNNWRLDKPASLDKHCPGYVFPFPFSISTSLQVCPCFPTMSIVSDSALGMGESDSRGFVWQPMVEWEVVPIEDSSSEEVPCEVSDNGSSSYKRLIDFDNVGEGNSELPTGIESLMTPRKDQPSPITTVVPPPP

SEQ ID NO: 196644 - protein, 229 aa, Glycine max
  Coding DNA Sequence Number=SeqID_79866
  Gene Ontology: Mol. function=RNA-directed DNA polymerase activity; Biological process=RNA-dependent DNA replication
MAFSATERYRNRDAPGLGQLRTGGVAIVFFKARKACLQASFHKNDSLHHFESKRHDPITEVGVFSDEVRAHAPFFIGFPHHDNVGQPSRVSDLSDKLGFEQLVDLFPDCFTYMSMLVVSEVVVEMRALPRLRSLFGIFDNAHELIVAATRGGMGFAWLSNKWIRGHLQDLCIALSGLLLVCLDNDNFSCQGRQLHFEDFGHHEVVNDDRDKHRVVLVDGVDAFNIFVNE

SEQ ID NO: 196645 - protein, 72 aa, Glycine max
  Coding DNA Sequence Number=SeqID_79867
MERSAKEREALDATHEKGFFKAMRQAELFIEGLDLNLLDPFKDEKDGQLFDEDEIAAMEESDGGEKDDGADV

SEQ ID NO: 196646 - protein, 133 aa, Glycine max
  Coding DNA Sequence Number=SeqID_79868
MGIDVGLCGLGVLGRREEGWLEPNINPVACFRARRLKGAINFLCSLVPPTSSLCFLLAATEGGTLGVTLTTSTSIVSTMLSWSTLASIGSPPPPEGKDKMARTSSNAGNCSNIVVSTLSDGSLLVELLWRLDL

SEQ ID NO: 196647 - protein, 144 aa, Glycine max
  Coding DNA Sequence Number=SeqID_79869
  Gene Ontology: Mol. function=RNA-directed DNA polymerase activity; Cellular component=mitochondrion; Biological process=RNA-dependent DNA replication
MESPWLLFGANSGFKDDLVRCFSLVICQRMLDKGFSLELSVAVGDNGIGESIAAYESTVTIKNLTCLGAFGNGPSMSIPHMAKGQGELKLWRLSSGTWGTYANFGQFLNFLVKLRHLLDGVILLDDDLGALEVGLEALSRGYEC

SEQ ID NO: 196648 - protein, 98 aa, Glycine max
  Coding DNA Sequence Number=SeqID_79870
MATSQMKLTGKIGWVSLNSIYKRIFEFDSNAFRSFKDCFFKVKETSVVFYGLPLMYEESGEPRFPFLWQSDPIKFKSFEEQLMSSKESDAILPPKGIG

SEQ ID NO: 196649 - protein, 243 aa, Glycine max
  Coding DNA Sequence Number=SeqID_79871
MQEEEERPLIRKRKLPSTSTKSAEQTETGNSQAQMPKKKKKVKQVEPEPSVAVEGGEPIKKKKKKIKPSKEQGDNQTVDVQPPSTDIDGTEVEATPSVAEMDNPVDQPDSSPAQPAVEVQQNVSVEEIPSRARTSPAPETDAVHVEEQGEGQGIGSISPYGSSQKSSSEENFSDEEAIQEAEAGGSDIYPASSTSKLSASIGIAEDTFIKMQDEDPAAALRLLLNTSQANTSSEKIPGASSLI

SEQ ID NO: 196650 - protein, 65 aa, Glycine max
  Coding DNA Sequence Number=SeqID_79872
MATQVTCTSKCELMRLNQHEENDTKKKGIALKASSSTHEASDKEDSIEIDEDDDLSLFVKDSTNF

SEQ ID NO: 196651 - protein, 183 aa, Glycine max
  Coding DNA Sequence Number=SeqID_79873
MSTSRFHSIANVVEVPFSFNRQWMYHYPKYVLFDCDGTKHFIRVQRYGSKCFFADGLKDFRRVHNVNESVMVRFIASDKNTTLRVAVMGPIHRQILLAAASRFVYGFKKYITLQQGLGKCTQWHVMIHDDVPSIANPWFRYLGEKKLMVGDEVVFYFRFEKHAWELLIRKEIEWEEEDLQLED

SEQ ID NO: 196652 - protein, 340 aa, Glycine max
  Coding DNA Sequence Number=SeqID_79874
  Homolog annotation: Hit_ID=Q6EUI5; Match level="QueryCoverage=90%, HitCoverage=10%, E-value=7e-36, Identity=35%"; Hit description =Putative lysosomal trafficking regulator 2
MSNGILFNCCNAVMGWCCHGTVAANGEHCDMVMLVVGSIHGISLFIDDSMVVYIYFSLNPTLVARVLHLFYRLVVQPNTSRAHTFAEEFLACGGIETLLVLLQREAKAGDSGVLESLSMNPESQKTEIAGGNEMIKESQKDEGLKEKSEAIIQDNDQGSISVDSGSSPDPSSDVNSDRIFEITSAKNLGGISLSISADSARKNVYNADKSDGIVVGIIGLLGALVASGHLTFGSRAGPDTTSNLLGVGLHDKGGTMFEDKVSLLLYALQKAFQAAPNRLMTNNVYTALLAASINASSSEDGLNFYDSGHRFEHSQLLLVLLHSLPFAPRSLQSRALQVLA

SEQ ID NO: 196653 - protein, 42 aa, Glycine max
  Coding DNA Sequence Number=SeqID_79875
MVSASSFSFLQPLHASRYHRTTSHTTKLQIVTPEHHHDMNTG

SEQ ID NO: 196654 - protein, 80 aa, Glycine max
  Coding DNA Sequence Number=SeqID_79876
MSQDANKELSLLDCHAHYLCAKRPNKRCSQSKAYELFSVLVERNLVSYAAMITGFLKAGKFHMAEELYCDAPHEFRDLAC

SEQ ID NO: 196655 - protein, 317 aa, Glycine max
  Coding DNA Sequence Number=SeqID_79877
  Gene Ontology: Mol. function=phosphopantothenoylcysteine decarboxylase activity; Biological process=coenzyme A biosynthetic process
  Homolog annotation: Hit_ID=Q9SWE5; Match level="QueryCoverage=54%, HitCoverage=85%, E-value=6e-53, Identity=56%"; Hit description =Phosphopantothenoylcysteine decarboxylase
  Pfam annotation: Domain name=Flavoprotein; Domain location=79-199; Score=133.0; E_value=8.1e-37; Accession=PF02441.9; Description =Flavoprotein
MDSSGPAREKGKAKAVARRTRARAKAKAKAKAKAKDNTKANTKAKAEANTEAKAKTNTEAKEKTNTEAKAECAPPPEKPRVLLACCGSICAAKFERVCRHFLEWAEVKVVLTRSALPYIGDQTFPDDLLACIDEHEWLTWKQIGDPVVHIELREWADIMIIAPLSLNTLGKIAGGLCDNLLTCIVRAWDYEKPFFVAPSMESSEWIDSLTEDHAMAIDELGIHLIPPVPQRASEYHAMAQPFTIYSSVRASYELKMKGKPSHTKCLDLDEKGRWAEKRKDELRRRMEEKLRRSEEEEENFPFYSFLESFGDRKDAPL

SEQ ID NO: 196656 - protein, 206 aa, Glycine max
  Coding DNA Sequence Number=SeqID_79878
  Gene Ontology: Mol. function=phosphopantothenoylcysteine decarboxylase activity; Cellular component=cytosol; Biological process=coenzyme A biosynthetic process
  Homolog annotation: Hit_ID=Q9SWE5; Match level="QueryCoverage=87%, HitCoverage=88%, E-value=1e-45, Identity=52%"; Hit description =Phosphopantothenoylcysteine decarboxylase
  Pfam annotation: Domain name=Flavoprotein; Domain location=14-132; Score=110.4; E_value=5.1e-30; Accession=PF02441.9; Description =Flavoprotein
MDCSEAGCAIPTKPRILLAACGTYDACKFKVVHWKFAEWAAEIKVVITKSALRYHGTPRNELASVDENDWLTYRRPGVAMLHVELRNWADIMVIAPLSTNTLGKIALGLCDNLLTSIVRAWDYRKPLFVAPSMSTCIWEDFFTERHLNAIDELGIILIRPVSITTASGEREHAMAEPSTICSDVKASYYKQMQKMMQKEASTTSTS

SEQ ID NO: 196657 - protein, 142 aa, Glycine max
  Coding DNA Sequence Number=SeqID_79879
MGYLRKHFDAQIRIIECLWSGGLTPTTNNFQVQEMSRKLHPLRAWHSRKTKIMWLCRDIRAHANLYVSHSGPYDMEVSHDAQEFIVTLVRFDARGNVLSWRFELVRPVHVTKDQGDHTDMTPEEGEEYYELPQDLEPSFEED

SEQ ID NO: 196658 - protein, 97 aa, Glycine max
  Coding DNA Sequence Number=SeqID_79880
MGEWFLAMVFECLRLGGYQQNTHPGRQIKTLVTPWRLRGSMTKSVFSFESQVWQKVPVIGIRGKREIKKRWRGCANNVRHNLAMEHACNTAEGKNLK

SEQ ID NO: 196659 - protein, 97 aa, Glycine max
  Coding DNA Sequence Number=SeqID_79881
MQREKRNCCKRKRRVKNLARMKDRERTYQNPNTITFFFFFLSDAVTRNHRCSHQKPPPAAEQVWRFPTEAVARERTKDFERSCCKRMKEPENEGATE

SEQ ID NO: 196660 - protein, 516 aa, Glycine max
  Coding DNA Sequence Number=SeqID_79882
  Gene Ontology: Mol. function=transferase activity, transferring hexosyl groups; Cellular component=integral to membrane; Biological process=carbohydrate biosynthetic process
  Homolog annotation: Hit_ID=Q9M3Y6; Match level="QueryCoverage=99%, HitCoverage=87%, E-value=0.0, Identity=90%"; Hit description=68 kDa protein
  Pfam annotation: Domain name=Glyco_transf_8; Domain location=176-490; Score=389.7; E_value=4.3e-114; Accession=PF01501.10; Description =Glycosyl transferase family 8
QLVEKRKEKRAAELVKQDDEVIVKLEDSAIEHSKSVDSAVLGKYNIWRKENENENADSTVRLMRDQIIMAKVYLSIAKMKNKLQLYQELESQLKESQRALGEATSDADMRHSDHEKIKTMGQVLSKAKEQLYDCKLVTGKLRAMLQTADEQVRGLRKQSTFLSQLAAKTIPDGIHCLSMRLTIDYYLLPLEKRKFPRSENLENPSLYHYALFSDNVLAASVVVNSTIVNAKDPSKHVFHLVTDKLNFGAMNMWFLLNPPGKATINVENVDEFKWLNSSYCPVLRQLESATMKEYYFKAGHPTTTGASNLKYRNPKYLSMLNHLRFYLPQVYPKLDKILFLDDDIVVQKDLTGLWAVNLNGKVNGAVLTCGESFHRFDKYLNFSNPHIAKNFDPNACGWAYGMNMFDLKVWKKKDITGIYHKWQNLNEDRVLWKLGTLPPGLMTFYGLTHPLNKSWHVLGLGYNPSVDRSEIDNAAVVHYNGNMKPWLEIAMTKYRSYWTKYVKFNHPYLQNCKLRE

SEQ ID NO: 196661 - protein, 82 aa, Glycine max
  Coding DNA Sequence Number=SeqID_79883
  Homolog annotation: Hit_ID=Q7X9G4; Match level="QueryCoverage=60%, HitCoverage=7%, E-value=2e-07, Identity=54%"; Hit description =Acetolactate synthase
MTLPNLTHLKGHFWLVPQLSNMAKIIKIVPRDNDSDIGVFERLMDIYGATARVGKDIGNPTTMALESLNEHVSTIFGLAGVN

SEQ ID NO: 196662 - protein, 578 aa, Glycine max
  Coding DNA Sequence Number=SeqID_79884
  Gene Ontology: Mol. function=binding; Cellular component=kinesin complex; Biological process=lipid metabolic process
  Homolog annotation: Hit_ID=Q6Z901; Match level="QueryCoverage=90%, HitCoverage=90%, E-value=0.0, Identity=69%"; Hit description=Kinesin light chain-like protein
  Pfam annotation: Domain name=TPR_1; Domain location=109-141; Score =11.1; E_value=0.25; Accession=PF00515.18; Description=Tetratricopepti de repeat
  Pfam annotation: Domain name=TPR_1; Domain location=152-185; Score =11.2; E_value=0.25; Accession=PF00515.18; Description=Tetratricopepti de repeat
  Pfam annotation: Domain name=TPR_1; Domain location=194-227; Score =11.6; E_value=0.22; Accession=PF00515.18; Description=Tetratricopepti de repeat
  Pfam annotation: Domain name=TPR_1; Domain location=276-309; Score =18.3; E_value=0.028; Accession=PF00515.18; Description =Tetratricopeptide repeat
  Pfam annotation: Domain name=TPR_1; Domain location=318-351; Score =19.0; E_value=0.017; Accession=PF00515.18; Description =Tetratricopeptide repeat
  Pfam annotation: Domain name=TPR_1; Domain location=361-394; Score =4.0; E_value=1.8; Accession=PF00515.18; Description=Tetratricopeptide repeat
  Pfam annotation: Domain name=TPR_1; Domain location=402-435; Score =7.8; E_value=0.63; Accession=PF00515.18; Description=Tetratricopeptid e repeat
  Pfam annotation: Domain name=TPR_1; Domain location=444-477; Score =11.9; E_value=0.2; Accession=PF00515.18; Description=Tetratricopeptid e repeat
  Pfam annotation: Domain name=TPR_1; Domain location=486-519; Score =13.9; E_value=0.12; Accession=PF00515.18; Description=Tetratricopepti de repeat
  Pfam annotation: Domain name=TPR_2; Domain location=109-141; Score =10.7; E_value=1.9; Accession=PF07719.7; Description=Tetratricopeptide repeat
  Pfam annotation: Domain name=TPR_2; Domain location=152-185; Score =15.6; E_value=0.18; Accession=PF07719.7; Description=Tetratricopeptid e repeat
  Pfam annotation: Domain name=TPR_2; Domain location=194-227; Score =10.1; E_value=2.2; Accession=PF07719.7; Description=Tetratricopeptide repeat
  Pfam annotation: Domain name=TPR_2; Domain location=236-269; Score =8.0; E_value=3.9; Accession=PF07719.7; Description=Tetratricopeptide repeat
  Pfam annotation: Domain name=TPR_2; Domain location=276-309; Score =15.2; E_value=0.24; Accession=PF07719.7; Description=Tetratricopeptid e repeat
  Pfam annotation: Domain name=TPR_2; Domain location=318-351; Score =19.9; E_value=0.009; Accession=PF07719.7; Description=Tetratricopepti de repeat
  Pfam annotation: Domain name=TPR_2; Domain location=361-394; Score =9.7; E_value=2.5; Accession=PF07719.7; Description=Tetratricopeptide repeat
  Pfam annotation: Domain name=TPR_2; Domain location=402-435; Score =11.1; E_value=1.7; Accession=PF07719.7; Description=Tetratricopeptide repeat
  Pfam annotation: Domain name=TPR_2; Domain location=444-477; Score =12.8; E_value=1.1; Accession=PF07719.7; Description=Tetratricopeptide repeat
  Pfam annotation: Domain name=TPR_2; Domain location=486-519; Score =14.6; E_value=0.37; Accession=PF07719.7; Description=Tetratricopeptid e repeat
  Pfam annotation: Domain name=TPR_4; Domain location=109-134; Score =16.5; E_value=0.098; Accession=PF07721.5; Description=Tetratricopepti de repeat
  Pfam annotation: Domain name=TPR_4; Domain location=444-469; Score =1.3; E_value=26; Accession=PF07721.5; Description=Tetratricopeptide repeat
  Pfam annotation: Domain name=TPR_4; Domain location=486-511; Score =5.3; E_value=8.8; Accession=PF07721.5; Description=Tetratricopeptide repeat
  Pfam module annotation: Pfam domain module=TPR_1::TPR_1::TPR_1::TPR _1::TPR_1::TPR_1::TPR_1::TPR_1::TPR_1::TPR_2::TPR_2::TPR_2::TPR _2::TPR_2::TPR_2::TPR_2::TPR_2::TPR_2::TPR_2::TPR_4::TPR_4::TPR_4; Domain location=...
  Pfam module annotation: Domain location=109-141::152-185::194 -227::276-309::318-351::361-394::402-435::444-477::486-519::109 -141::152-185::194-227::236-269::276-309::318-351::361-394::402 -435::444-477::486-519::109-134::444-469::486-511
  Subcellular localization annotation: CTP_CleavageSite=40; ConfidenceScore=5.49e-01
MPGLVSDAQPLGISVPDTPRQSQRTPSPLPKKPPSPSPSRSSKKKTPETPPLLSDASLDNPDLGPFLLKLARDTIASGDGPSKALDFAIRASKSFERCAVEGEPSLDLAMSLHVLAAIYCSLGRFDEAVPVLERAIQVPDVERGADHALAAFSGYMQLGDTFSMLGQVDRSISCYDQGLQIQIQALGDSDPRVGETCRYLAEANVQAMQFDKAEDLCKKTLEIHRAHSEPASLEEAADRRLMALICEAKGDYESALEHLVLASMAMIANGQDNEVASIDVSIGNIYMSLCRFDEAIFSYQKALTVFKSAKGENHPSVASVFVRLADLYHRTGKLRESKSYCENALRIYSKPVPGTTAEEIAGGLTEISAVFESVDEPEEALKLLNRAMKLLEDKPGQQSTIAGIEARMGVMYYMIGRYEDSRNSFESAVAKLRASGERKSAFFGVVLNQMGLACVQLFKIDEAAELFEEARGILEQECGPCHQDTLGVYSNLAATYDAMGRVGDAIEILEYVLKLREEKLGIANPDFEDEKRRLAELLKEAGKTRDRKAKSLENLIDPGSKRTKKEGAKRWPGLGFRI

SEQ ID NO: 196663 - protein, 870 aa, Glycine max
  Coding DNA Sequence Number=SeqID_79885
  Gene Ontology: Mol. function=protein transporter activity; Cellular component=nuclear pore; Biological process=protein import into nucleus, docking
  Homolog annotation: Hit_ID=Q9FJD4; Match level="QueryCoverage=99%, HitCoverage=99%, E-value=0.0, Identity=83%"; Hit description =Importin beta
  Pfam annotation: Domain name=HEAT; Domain location=169-207; Score =14.6; E_value=0.35; Accession=PF02985.12; Description=HEAT repeat
  Pfam annotation: Domain name=HEAT; Domain location=214-250; Score =20.8; E_value=0.0049; Accession=PF02985.12; Description=HEAT repeat
  Pfam annotation: Domain name=HEAT; Domain location=362-398; Score =16.8; E_value=0.079; Accession=PF02985.12; Description=HEAT repeat
  Pfam annotation: Domain name=HEAT; Domain location=404-441; Score =16.6; E_value=0.088; Accession=PF02985.12; Description=HEAT repeat
  Pfam annotation: Domain name=HEAT; Domain location=454-488; Score =3.3; E_value=17; Accession=PF02985.12; Description=HEAT repeat
  Pfam annotation: Domain name=HEAT; Domain location=499-538; Score =8.1; E_value=4.4; Accession=PF02985.12; Description=HEAT repeat
  Pfam annotation: Domain name=HEAT; Domain location=601-637; Score =3.5; E_value=16; Accession=PF02985.12; Description=HEAT repeat
  Pfam annotation: Domain name=HEAT; Domain location=87-123; Score=6.0; E_value=8; Accession=PF02985.12; Description=HEAT repeat
  Pfam annotation: Domain name=IBN_N; Domain location=23-103; Score =87.3; E_value=4.7e-23; Accession=PF03810.9; Description=Importin -beta N-terminal domain
  Pfam module annotation: Pfam domain module=HEAT::HEAT::HEAT::HEAT::HEA T::HEAT::HEAT::HEAT::IBN_N; Domain location=169-207::214-250::362 -398::404-441::454-488::499-538::601-637::87-123::23-103
MAMEVTQILLNAQAVDGTLRKQAEESLKQFQEQNLPSFLFSLAGELANDEKPAESRKLAGLILKNALDAKEQHRKIEFVQRWLSLDPTLKAQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKLAPYIQDIFNITAKAVREDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAGSASSPLTPFFQEIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASRSATAHEEAMLAIGALAYATGADFAKYMTEFYKYLEMGLQNFEDYQVCAITVGVVGDVCRALEEKILPYCDGIMTQLLKDLSSNQLHRSVKPPIFSCFGDIALAIGENFEKYLLYAMPMLQSAAELSAHTSGADDDMTEYTNSLRNGILEAYSGIFQGFKGSPKTQLLMPYAPHVLQFLDSLYNEKDMDDVVTKTAIGVLGDLADTLGSNAGPLIQQSVSSKDFLKECLSSDDHLIKESAEWAKLAISRAISF

SEQ ID NO: 196664 - protein, 553 aa, Glycine max
  Coding DNA Sequence Number=SeqID_79886
  Gene Ontology: Mol. function=beta-amylase activity; Biological process=polysaccharide catabolic process
  Homolog annotation: Hit_ID=Q5NB81; Match level="QueryCoverage=87%, HitCoverage=84%, E-value=1e-161, Identity=57%"; Hit description =Putative beta-amylase PCT-BMYI
  Pfam annotation: Domain name=Glyco_hydro_14; Domain location=89-512; Score=328.4; E_value=1.2e-95; Accession=PF01373.8; Description =Glycosyl hydrolase family 14
  Subcellular localization annotation: CTP_CleavageSite=40; ConfidenceScore=5.76e-01
MAILSQSTASFSFVSTRTDSTHLTRFPCRVTFRARSPPLRPALVSSRLNSSRSPDAGGSLSPDNGGGDVAYQLHHDFSPQRRRRGSPVFVTLPVNSIGRDGRVARPKAMMFSLKALATAGVEGVVIEIWWGLVEKKKPRVYDWRGYEELVAMACKCGLKVRAVLAFHQHGTGPDDPNWMPLPLWVLDEIQKDTELAYCDRFGQRNIEYISLGCDILPVLCGRSPIQAYADFMRNFRDTFESLLGVVITGVQIGMGPGGELRYPSFSSQEPNLAWSHELGEFQCYDKYMLASLNASARNIGKREWGNGGPFGSESLMQNPEHTDFFRNDGGSWDTPYGKFFLEWYSDMLLLHGERICREAETIFRGTEVHISAKLAAIHWHYAMQSHPSELTAGYYNTSNRDGYLPIARMFSKYGFSMCCSCFEMQDAVTQKINPDGSPEGFLRQLLLVARLCDISLEGQNFSTNLDDGAFTQVLKMSKFYSDGIEKRPFSFNFVRMDKRLFESRNWDRFTRFVRQLSNGNIFRARLNSVREVRLKTTPVVAAVGLLYHLYQHS

SEQ ID NO: 196665 - protein, 244 aa, Glycine max
  Coding DNA Sequence Number=SeqID_79887
  Homolog annotation: Hit_ID=Q9M3Y6; Match level="QueryCoverage=32%, HitCoverage=12%, E-value=6e-19, Identity=62%"; Hit description=68 kDa protein
  Subcellular localization annotation: CTP_CleavageSite=63; ConfidenceScore=5.33e-01
MAPNNNRTKGSHFPLLAFLFLCLLAPLLFFFFASPLHGLILSFSNLTCFQLLVLFLVLAHPRRVSNNKSDLQEFYITCLDSPFLFLRDFLIVGNEIEVIIQLFRLKRILFGYNSSLALIEGDNKKVLDVIVSNTNDVGPLSLESFRKNNLSASWRVAGLRTSNAMNQLNQPADNFRQEKQNGKEGRFSGGIVLSVGRAQWTDSPVQLSRRFATPCIMGGTEFVAVMETTSLVTADIYNPSQTPT

SEQ ID NO: 196666 - protein, 58 aa, Glycine max
  Coding DNA Sequence Number=SeqID_79888
  Pfam annotation: Domain name=K-box; Domain location=1-57; Score=-3.8; E_value=0.00091; Accession=PF01486.8; Description=K-box region
MSKLNEKYEAVQKTQRRLHGEDLGPLSIKELQILEEQLEKALSQARQRKLIDTNMDIG

SEQ ID NO: 196667 - protein, 124 aa, Glycine max
  Coding DNA Sequence Number=SeqID_79889
MKSSTVSYKQTLQNQGGVVVIIKKGENVNHEDFDDVKKIKPWIMVVIIKKGENGENVNVCIHDFDDAKEESNKVASKDKCGFKINTRLLQQTKPCFKINSRSSLVLKQSAFKTFKALVIDYQAV

SEQ ID NO: 196668 - protein, 79 aa, Glycine max
  Coding DNA Sequence Number=SeqID_79890
  Subcellular localization annotation: CTP_CleavageSite=21; ConfidenceScore=5.06e-01
MSTQTSTASNVFHHSSSWFSCCQGPPNFLGCTIIYQFQATFHVDRNFIEVPSLYHRQWAPDYPPHVLLDYNGLLICCVC

SEQ ID NO: 196669 - protein, 266 aa, Glycine max
  Coding DNA Sequence Number=SeqID_79891
  Gene Ontology: Mol. function=sequence-specific DNA binding; Cellular component=exocyst; Biological process=exocytosis
  Homolog annotation: Hit_ID=Q1SEU4; Match level="QueryCoverage=91%, HitCoverage=39%, E-value=3e-48, Identity=42%"; Hit description=Exo70 exocyst complex subunit
MAIHDELGEASRDIFMKVINMIFHNPEAKIMVRAMDGKIKVMTINVMSYLIGLADQTSEHNGAGTSSLSVQIDRIMKRLERKLVAESKHLGERRYFFMMNSWRLVELCAEKSGLDVDCFKKYTAKIQQNLKLYQRSSWNVVLDLLKLENDDRFVEPNANAESMKDKLKLFNNHFKDLCSIQSRWAAFDMQLREQIIMSLENILLPAYGNFIGRFQNILGKHSYEYIKYGMFDIQDQINHLFLETKPMSQRLLKFVSQVCSSKNTYV

SEQ ID NO: 196670 - protein, 102 aa, Glycine max
  Coding DNA Sequence Number=SeqID_79892
MAAEWRRKRERRCHFKEKMSLEEAHHHRRPWIRAWRKMEMNEGRGREEHEILCFKGALKSEDCIKTIPVFPLDTSPPITPVWHITDEKNVQIQDNQDQSQEF

SEQ ID NO: 196671 - protein, 83 aa, Glycine max
  Coding DNA Sequence Number=SeqID_79893
  Gene Ontology: Mol. function=ribokinase activity; Biological process =D-ribose metabolic process
  Homolog annotation: Hit_ID=Q9C524; Match level="QueryCoverage=83%, HitCoverage=18%, E-value=4e-16, Identity=60%"; Hit description =Fructokinase, putative; 80047-82040
MYSENFVRRGSSKHRGRESHKGPLVVCFGEMMINLVPTVARVSLADATAYKKFPSGATANVAVGICRLGGSAAFIGKVKFSRI

SEQ ID NO: 196672 - protein, 457 aa, Glycine max
  Coding DNA Sequence Number=SeqID_79894
  Gene Ontology: Mol. function=hydrolase activity, acting on carbon -nitrogen (but not peptide) bonds; Cellular component=cytoplasm; Biological process=nitrogen compound metabolic process
  Homolog annotation: Hit_ID=Q8LI89; Match level="QueryCoverage=92%, HitCoverage=51%, E-value=0.0, Identity=76%"; Hit description =Putative NAD synthetase
  Pfam annotation: Domain name=NAD_synthase; Domain location=118-378; Score=-83.0; E_value=1.4e-06; Accession=PF02540.7; Description=NAD synthase
IKYHTPEEEIAFGPGCWLWDYLRRSGASGFLLPLSGGADSSSVAAIVGCMCQLVVKAELAGEVDLNIHSSFLENPAKLLEYRAWWPLITSECSTCKEAKLSTDEIANGDEQVKADAIRIGNYKDGLYPTDSREFAKRIFYTVFMGSENSSEMTRSRAKVLADEIGSWHLDVSIDVVVSAFLSLFQTLTGKRPRYKVDGGSNVENLSLQNIQARIRMVLAFMLASLLPWVHSKPGFYLVLGSSNVDEGLRGYLTKYDCSSADINPIGSISKQDLRAFLQWAAIHLGYSSLADIEAAPPTAELEPIRSNYSQLDEVDMGMTYEELSVYGRLRKIFRCGPVSMFQNLCYRWGARLTPSQVAEKVKHFFKYYSINRHKMTVLTPSYHAESYSPEDNRFDLRQFLYNARWPYQFRKIDELVSELDVKDVKDSGDHEAMAATSDGVGGMGVAAAGSGNPNVGL

SEQ ID NO: 196673 - protein, 49 aa, Glycine max
  Coding DNA Sequence Number=SeqID_79895
MGFILSGVIYKYLIMLDNGQLQPKVTSARVHKLVMLILENSRHFRFALR

SEQ ID NO: 196674 - protein, 87 aa, Glycine max
  Coding DNA Sequence Number=SeqID_79896
MENNDSIISREKIDQAAVWLGSAVSSAFFSSLERFSCVNVATSDPDNDDDDDDYYSTTTATPTSASTTTTTALATTPPSVQGKMSKG

SEQ ID NO: 196675 - protein, 64 aa, Glycine max
  Coding DNA Sequence Number=SeqID_79897
  Gene Ontology: Mol. function=sequence-specific DNA binding; Cellular component=nucleus; Biological process=regulation of transcription, DNA-dependent
  Homolog annotation: Hit_ID=A0EIX6; Match level="QueryCoverage=93%, HitCoverage=27%, E-value=6e-26, Identity=98%"; Hit description =Transcription factor AGL20
  Pfam annotation: Domain name=SRF-TF; Domain location=9-59; Score =114.3; E_value=3.5e-31; Accession=PF00319.9; Description=SRF-type transcription factor (DNA-binding and dimerisation domain)
MVRGKTQLRRIENATSRQVTFSKRRNGLLKKAFELSVLCDAEVALIIFSPRGKLYEFASSSGWE

SEQ ID NO: 196676 - protein, 197 aa, Glycine max
  Coding DNA Sequence Number=SeqID_79898
MHALLGSFNSGNWYDSKVLDSAGLSCHAFTRNRGAIIVVEFSLTRGICGQGLIRIRLNYHEESGLPNNASSPSVRYSVLTVYTACAIRSPTGNLVPLDIEIEAMLRRNRAERRRKLLQDRKVASILEEETHFSDLLSPDSPSSREFATQLPEAITMAEENDQRITLEDYSSSSVPQFFTGIARPEVQASNIIISWIT

SEQ ID NO: 196677 - protein, 567 aa, Glycine max
  Coding DNA Sequence Number=SeqID_79899
  Gene Ontology: Mol. function=serine-type endopeptidase activity; Cellular component=cytoplasm; Biological process=negative regulation of enzyme activity
  Homolog annotation: Hit_ID=Q9LLL8; Match level="QueryCoverage=99%, HitCoverage=75%, E-value=0.0, Identity=64%"; Hit description=Xylem serine proteinase 1 precursor
  Pfam annotation: Domain name=PA; Domain location=182-279; Score=47.1; E_value=5.8e-11; Accession=PF02225.12; Description=PA domain
  Pfam annotation: Domain name=Peptidase_S8; Domain location=4-407; Score=27.5; E_value=3e-08; Accession=PF00082.12; Description =Subtilase family
  Pfam module annotation: Pfam domain module=PA::Peptidase_S8; Domain location=182-279::4-407
  Subcellular localization annotation: CTP_CleavageSite=56; ConfidenceScore=5.01e-01
MDIIGAKYFKADGNPDPSDILSPVDADGHGTHTASTVAGNLVPNANLFGLANGTARGAVPSARLAIYKVCWSSSGCADMDILAAFDAAIHDGVDVISISIGGGNPSYVEGSISIGAFHAMRKGIITVASAGNSGPSLGTVTNTAPWIVTVAASGIDRTFRSTVQLGNGKNVSEVQGVGVNCFDPKGKQYPLINGVDAAKDSKDKEDAGFCYEGTLQPNKVKGKLVYCKLGTWGTESVVKGIGGIGTLIESDQYPDVAQIFMAPATIVTSGTGDTITKYIQSTRSPSAVIYKSREMQMQAPFTASFSSRGPNPGSQNVLKPDVAAPGLDILASYTLRKSLTGLKGDTQFSEFILMSGTSMACPHVAGVASYVKSFHPHWTPAAIRSAIITTAKPMSKRVNNEAEFAYGAGQLNPRSAVSPGLVYDMDALGYIQFLCHEGYKGSSLSALVGSPVNCSSLLPGLGHDAINYPTMQLSLESNKGTRVGVFRRTVTNVGPAPTIYNATVRSPKGVEITVKPTSLTFSKTMQKRSFKVVVKATSIGSEKIVSGSLIWRSPRYIVRSPIVINNP

SEQ ID NO: 196678 - protein, 148 aa, Glycine max
  Coding DNA Sequence Number=SeqID_79900
  Gene Ontology: Mol. function=serine-type endopeptidase activity; Cellular component=cytoplasm; Biological process=negative regulation of enzyme activity
  Homolog annotation: Hit_ID=Q9LLL8; Match level="QueryCoverage=97%, HitCoverage=19%, E-value=8e-48, Identity=59%"; Hit description=Xylem serine proteinase 1 precursor
  Pfam annotation: Domain name=Subtilisin_N; Domain location=2-81; Score=70.5; E_value=5.2e-18; Accession=PF05922.7; Description =Subtilisin N-terminal Region
MNFYIVFLGAHTESRGNALDTYLNVLSAVKESFLEAKESMVYSYTKTLNAFAAKLSEDEAKKLSAMDEVLLVFQNQYRQLHTTRSWNFIGLPTTAKRRLKSESDIIVALLDTGFTPESKSFKDDGFGPPPARWKGSCGHYANFSGCNK

SEQ ID NO: 196679 - protein, 73 aa, Glycine max
  Coding DNA Sequence Number=SeqID_79901
MNRWMTMKNLMLEDTGTQRSDRIMYVRGRGCHMKHRFLGHSPGRQALCTMCWSLSAEAELRGQISALSFILGS

SEQ ID NO: 196680 - protein, 147 aa, Glycine max
  Coding DNA Sequence Number=SeqID_79902
  Homolog annotation: Hit_ID=Q337F4; Match level="QueryCoverage=83%, HitCoverage=38%, E-value=5e-08, Identity=30%"; Hit description=F-box domain containing protein, expressed
MIRDVYDLAEGIPHGSSLLQNSYIDPLSEQLSLEDRFVLPKKGDFTKVAVDMAMKLWVSLESITLTSVVSRHDIFPTILEYCKKITEMKFSCGYIFDVKHSEAMAKCTPNLKVLSIRVIVATMTALCCVLTSLEHLEGECLSLFPSE

SEQ ID NO: 196681 - protein, 57 aa, Glycine max
  Coding DNA Sequence Number=SeqID_79903
MSKAVYDTGSFDRSVSLLWIRLRREPLAVLMSERFLFGDDHDVKFCERAAKETKEEG

SEQ ID NO: 196682 - protein, 426 aa, Glycine max
  Coding DNA Sequence Number=SeqID_79904
  Homolog annotation: Hit_ID=Q1S9Q0; Match level="QueryCoverage=53%, HitCoverage=71%, E-value=1e-38, Identity=43%"; Hit description =Ankyrin
  Pfam annotation: Domain name=Ank; Domain location=234-268; Score =26.1; E_value=0.00013; Accession=PF00023.20; Description=Ankyrin repeat
  Pfam annotation: Domain name=Ank; Domain location=269-302; Score=7.7; E_value=2.4; Accession=PF00023.20; Description=Ankyrin repeat
  Pfam module annotation: Pfam domain module=Ank::Ank; Domain location =234-268::269-302
MIMSMQIIMSEAPASIPSNAIVVEVLNRENYSNWSALVRNYLIGNGLWYDIIQDKDDEKEVPYIEDNDEDPKNHIEGNDKGSKPRFQGNFIEALKPPFPMPSPQDEEDPEQSYIEGNDENQTSKKKNENDSTKSTSAKESRSRKWEYKNRRALHAIQLSCGKAVGQIKECKTAKEAWKHLKTSFSEDVYAHYDSKQSRFFSELILQTNVRKGFLDDAKESISISPEDIFTKSPEGKTVLHVAVEAGHVEIVKILVEMGKKTLVKMQDKKGYTALALAAKLTDNKEMVECMVEIGGDELLSIAAKEGPVYEIPVLLASARGHKKMTRFLFNNTPWPLLRRNRWQCALVLLSRCIYNEIFDVAAAIIQHPDAQRMPLNDEAKNLRPIYALAHMPSAFRSAETRLHWCQLLIYNGTSNLSHTWLINYYT

SEQ ID NO: 196683 - protein, 335 aa, Glycine max
  Coding DNA Sequence Number=SeqID_79905
  Gene Ontology: Mol. function=transferase activity
  Homolog annotation: Hit_ID=Q1S9Q3; Match level="QueryCoverage=97%, HitCoverage=68%, E-value=3e-88, Identity=54%"; Hit description =Ankyrin
MEILNCLCERIPTMVEEELREASAYDAMLQAAKNGITEFIESMKGANPDLLLAMDESKRGIFAHAIVNRQEGVFNLIHDIETKEIFTSCEDALKNNLLHIAAELAPSRYLDRISNAALQMQRELQWFQEVKKVVPRWCHEAKDGNDKTASEVFTDEHKELLKRGQQWAKETAGAFTLVGTLIITIMFAAAFTAPGGNDDKHGTPVFLGESTFTFFIVSDAISLITSSSSVLMFIGILTSRYAEQDFIKWLPMKLLFGLVTLFLSVASMMCTFCAALALMLKGYYRIVIAAMWLALLPILVFVPSLLRLTSEISRSTVRFDKLAAKKKKNRDSGSM

SEQ ID NO: 196684 - protein, 1009 aa, Glycine max
  Coding DNA Sequence Number=SeqID_79906
  Gene Ontology: Mol. function=protein binding; Cellular component =membrane; Biological process=defense response
  Homolog annotation: Hit_ID=Q84XG0; Match level="QueryCoverage=91%, HitCoverage=92%, E-value=4e-77, Identity=28%"; Hit description=NBS -LRR resistance protein RGH1
  Pfam annotation: Domain name=LRR_1; Domain location=534-555; Score =4.0; E_value=50; Accession=PF00560.23; Description=Leucine Rich Repeat
  Pfam annotation: Domain name=LRR_1; Domain location=557-578; Score =11.0; E_value=2.5; Accession=PF00560.23; Description=Leucine Rich Repeat
  Pfam annotation: Domain name=LRR_1; Domain location=580-602; Score =8.9; E_value=6.2; Accession=PF00560.23; Description=Leucine Rich Repeat
  Pfam annotation: Domain name=LRR_1; Domain location=604-626; Score =9.2; E_value=5.4; Accession=PF00560.23; Description=Leucine Rich Repeat
  Pfam annotation: Domain name=LRR_1; Domain location=768-790; Score =0.6; E_value=2.2e+02; Accession=PF00560.23; Description=Leucine Rich Repeat
  Pfam annotation: Domain name=LRR_1; Domain location=820-841; Score =5.4; E_value=28; Accession=PF00560.23; Description=Leucine Rich Repeat
  Pfam annotation: Domain name=LRR_1; Domain location=871-893; Score =1.9; E_value=1.2e+02; Accession=PF00560.23; Description=Leucine Rich Repeat
  Pfam annotation: Domain name=LRR_1; Domain location=895-917; Score =8.7; E_value=6.6; Accession=PF00560.23; Description=Leucine Rich Repeat
  Pfam annotation: Domain name=LRR_1; Domain location=919-941; Score =2.1; E_value=1.2e+02; Accession=PF00560.23; Description=Leucine Rich Repeat
  Pfam annotation: Domain name=LRR_1; Domain location=946-967; Score =2.3; E_value=1.1e+02; Accession=PF00560.23; Description=Leucine Rich Repeat
  Pfam annotation: Domain name=LRR_1; Domain location=970-992; Score =4.2; E_value=47; Accession=PF00560.23; Description=Leucine Rich Repeat
  Pfam annotation: Domain name=NB-ARC; Domain location=118-417; Score= -86.6; E_value=9.2e-05; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NB-ARC; Domain location=534-555::557-578::580-602::604-626::768-790::820-841::871 -893::895-917::...
  Pfam module annotation: Domain location=919-941::946-967::970 -992::118-417
MSAIPVTNTISEIMERMSSFHGFGQNITENIKHHLTAIQNKCLGSAKLDLSDPKTKKWLGQVTELFYLVDDLCAKAALLSKQRKMMPLFPTCNLKPLLQLRKIEKQLAREVAPMKNVKMLPIRDVEEEKEAETVVRGYVKEKIMKSILDRKKGVVRAVVIFGITGLEKGKVTEYVCEDENVKSGFDVVVPIDGLHLEQHFADSVVDRVKHELEAKKKKDSGEGKGFFVVLDDFHNENHGEWLQLMTKLKEAAQAHTSTGGGVLLVTTRNEAVLKSVIHIFFSVHGYRFDSLDLSESQPLFEKIVGTRGTTIGSKTKGDLLEHMCGGILGAVKSMARLVRSQNPTTESDINALKDEFVQEMLLKYYSEFDLPSWRLRQCFAYSLFRFYPSTDFVKEFVKEEELIRLWMAEGFLGHSSSQHEPEDLGHECIQEFLRRSIFSSQEDGCISINKSKALTTILAGNDRVYLEDNGTTDDNIRRLVKGSNMDVSTGNFRSLFKNNKSVRTFLLEEKQQRVPDQVMLSWLACDAILSAFTRLRVLTLKDLGMKVLPASIGDLKSLRYVDLSRNNFNKLPICIGELQHLQTLLLFHCLKLRELPDEVHHFPSLRHLDVDKCMNLMHMPSALKKLTWLLSLPHFVTSKRNGLEELLHLNQLRGDLEISHLERFKCKGSSSNNGKDHDYPIYLKEKQHLEGLTLRWNHDDEKKKHSLEDYQLQNLEPHPNLKRLFIIGYPGNQFPTCLLSLKNLVEISVYNCPKWKHLPIMGQPLIKKLTLVSLADLEFITDMDNSLEELPLERVRILDCPNLTSWGNPETCNTTAFSGALSELVMEYCPKLDSMPLFPKIKNKLVLDHSSMKPLLYTLGYKSDTSPPLSELKQLTVNGCEDLKSNIKGWKHLSKLETLHISNCTQINLPSEEWKGLKGLTDLVIEDIPDLKSLPEEIKHLASEGSLNSLEIKSCHELTTMLDFGEYLHSFAYILIEDCPNLDSLPDSYKHNFFTPLKIQNCPLLKDSY

SEQ ID NO: 196685 - protein, 55 aa, Glycine max
  Coding DNA Sequence Number=SeqID_79907
MVHISDIKLIRTDTTLDLSQKAEKGWSQKYDKCGVGGLVQVSTLLLEMWMLRLSF

SEQ ID NO: 196686 - protein, 135 aa, Glycine max
  Coding DNA Sequence Number=SeqID_79908
MEPPTSPLPTYWTNNSSSDDALQIIADNSSGFSGRIPFGKIVKCPSCRIAVGVAQPQQGSPPAERSMDITAWERGLRYVKLMKQSIPAAVHSIVVQTPSGLTRTHRFATETVDLPAQEGERVTVAVAALSNVYRK

SEQ ID NO: 196687 - protein, 103 aa, Glycine max
  Coding DNA Sequence Number=SeqID_79909
MEMPHRSFSYYSTNTVLFKFLNPNIEMDSQEPPIYPRLIRTTIIIPSQNWPLEQNRGYRGSGAGGNHSLLGKRINYMFDDYVTSSNFVGSHSRYLVVEIEWGQ

SEQ ID NO: 196688 - protein, 176 aa, Glycine max
  Coding DNA Sequence Number=SeqID_79910
MYAWSPDVKDIIIIVWGWGKGWVNVMDDGPAKLNIIPDHFQVPTASIESPESRTSSIAEPGTDQSSSGCHGVPVLEVRKRSDLSSFYAVHLLSLVKVELTAAELESLRSELADIAEREAHSKAQLEHIDEVLRSARLSGYLYIRTVLTAHPTPVYGNAVVFLPTSCSSHFFALILM

SEQ ID NO: 196689 - protein, 130 aa, Glycine max
  Coding DNA Sequence Number=SeqID_79911
MIRTIFACLNGKASHKKSKLEPLEVTKPVYRDELTKKQRLRKAVKKTVRFAESEPTILGEDSEKTRCVSGNEVGGKEGIRVRIKLTKEEAARLLSKCNNGGILEFEDVARELVLIPVNRVSIVSDGTINL

SEQ ID NO: 196690 - protein, 316 aa, Glycine max
  Coding DNA Sequence Number=SeqID_79912
  Gene Ontology: Mol. function=metal ion binding; Cellular component =integral to membrane; Biological process=ubiquitin cycle
  Homolog annotation: Hit_ID=Q6EPF2; Match level="QueryCoverage=86%, HitCoverage=73%, E-value=1e-67, Identity=47%"; Hit description=Ring zinc finger protein-like
  Subcellular localization annotation: CTP_CleavageSite=59; ConfidenceScore=5.86e-01
MQNSNPSSSSPPSPPLLDTAPFLPRSRRRAPPSLRTAATFFRRASGRRMMLREPSVRVREAAAAEVEGRQSEWAYSRPVVALDVAWNAAFLAIGASVLALSADEDPCVPLRAWIVGYLLQGALHSLCVVAEFTRRRRTATISGTHSGSNVEWSFSSESDEEFYPSEQFLEGDGNSITKHIESANTMLSFIWWIVGFYWVTAGGQSLTRDSPQLYWLCITFLSFDVMIVLICVAVACLIGIAVCCCLPCILAILYVVADQEGATKEEIEQLPKYKFIIIKEFKKEGDIEESSRGIMTESESETATEHVIALEDAMRT

SEQ ID NO: 196691 - protein, 142 aa, Glycine max
  Coding DNA Sequence Number=SeqID_79913
  Subcellular localization annotation: CTP_CleavageSite=80; ConfidenceScore=5.27e-01
MSAENLCMNGKPVKNEAYVVVHTQSRTKFFTTRTQTKEEGGSKSNNNNPSWNGKFMPTTASRWRKGRRNGVINFSVRVLKESAESESLVEIQNNLRGFGMQLSMGGDDDSSGIVTGIPVFWNYPLNIPRCMSICNLEKENLD

SEQ ID NO: 196692 - protein, 57 aa, Glycine max
  Coding DNA Sequence Number=SeqID_79914
MEKVQGEMQQKGYGHQDRKKCKPHEKSKQPSLPRPRHRDVKSGPSVFSRLEKISRGR

SEQ ID NO: 196693 - protein, 84 aa, Glycine max
  Coding DNA Sequence Number=SeqID_79915
  Gene Ontology: Mol. function=catalytic activity; Biological process =metabolic process
  Homolog annotation: Hit_ID=Q1SI48; Match level="QueryCoverage=71%, HitCoverage=16%, E-value=5e-17, Identity=83%"; Hit description=AMP -dependent synthetase and ligase
FDPKDFFRELYETDNVQFRILIVKQGLGGNVRIILSGAAPLSRHVEGFLRVVTCAHILQGYEFEGLEILLMNKGKIKQQKVNGE

SEQ ID NO: 196694 - protein, 212 aa, Glycine max
  Coding DNA Sequence Number=SeqID_79916
  Gene Ontology: Mol. function=protein serine/threonine kinase activity; Cellular component=beta-catenin destruction complex; Biological process=protein amino acid phosphorylation
  Homolog annotation: Hit_ID=Q1S1R7; Match level="QueryCoverage=97%, HitCoverage=44%, E-value=1e-106, Identity=87%"; Hit description =Protein kinase
  Pfam annotation: Domain name=Pkinase; Domain location=1-167; Score =10.8; E_value=3.3e-09; Accession=PF00069.15; Description=Protein kinase domain
MHAKAHLNLAWQQMLVNPQTHQLKVCDFGSAKMLVPGEPNISYICSRYYRAPELIFGATEYTTAIDIWSAGCVLAELLVGHPMFPGESGVDQLVEIIKILGTPTREEIKCMNPNYTEFKFPQIKAHPWHKVFHKKMPSEAVDLVSRMLQYSPNLRCTALEACAHPFFDDLREPNACLPNGRPLPPLFNFTAQELADAPDELRRRLIPEHARS

SEQ ID NO: 196695 - protein, 82 aa, Glycine max
  Coding DNA Sequence Number=SeqID_79917
  Gene Ontology: Mol. function=binding
  Homolog annotation: Hit_ID=Q1S1R8; Match level="QueryCoverage=90%, HitCoverage=17%, E-value=2e-28, Identity=80%"; Hit description =Tetratricopeptide-like helical
MYSAVHTFIYEDRGHPREAEIYSKIDEIIRRIKEAGYVPYMNFSLHEMDRDGKEAGLAYHSEKLAVAFGLLASPPDSRRIDT

SEQ ID NO: 196696 - protein, 322 aa, Glycine max
  Coding DNA Sequence Number=SeqID_79918
  Gene Ontology: Mol. function=protein serine/threonine kinase activity; Cellular component=cytosol; Biological process=protein amino acid phosphorylation
  Homolog annotation: Hit_ID=Q1S1R7; Match level="QueryCoverage=91%, HitCoverage=62%, E-value=1e-126, Identity=75%"; Hit description =Protein kinase
  Pfam annotation: Domain name=Pkinase; Domain location=171-322; Score =20.3; E_value=9e-10; Accession=PF00069.15; Description=Protein kinase domain
  Pfam annotation: Domain name=Pkinase_Tyr; Domain location=171-322; Score=-113.3; E_value=1.6e-05; Accession=PF07714.7; Description =Protein tyrosine kinase
  Pfam module annotation: Pfam domain module=Pkinase::Pkinase_Tyr; Domain location=171-322::171-322
  Subcellular localization annotation: CTP_CleavageSite=51; ConfidenceScore=5.03e-01
MGFIRSVLSGSILLVGFVFAGSCESIAMNVMRRLKSIASGRTSISSDPVMRAQALCEIDMIGGDCTTKRAKFDQDTEGKVNEETYPNERCGKDQEHHVDSNVPSVPRTEKSGYDQLPKELNEMKIGDDKGKNNNEKDMEATIVSGNGTETGEIITTAIGGRDGQPKRTISYIAERVVGTGSFGVVYQAKCLETGEAVAIKKVLQDKRYKNRELQVMRMLDHTNVLRLKHCFYSTAEKDDLYLNLVLEYVPETVYRVSKHYVRMHQHMPIINVQLYTYQICRGLNYLHHVIGVCHRDIKPQNLLVNPQTHQLKVCDFGSAKML

SEQ ID NO: 196697 - protein, 105 aa, Glycine max
  Coding DNA Sequence Number=SeqID_79919
MGAKYLEVVKRGSHPNNGWSPDEIRTQNEHNLSLCFVGNDRAWAARYRMTIICLYMPLDTIASGWRKVREMTIICLCPPLDLLFLNDKGRRICIYAFITHLAASK

SEQ ID NO: 196698 - protein, 169 aa, Glycine max
  Coding DNA Sequence Number=SeqID_79920
  Homolog annotation: Hit_ID=Q1SL15; Match level="QueryCoverage=82%, HitCoverage=13%, E-value=2e-17, Identity=37%"; Hit description =Ovarian tumour, otubain
MDEYQWSYDNTMSQEVDMDYENEQECGVNEPHVDCSDAFNTSQVFSTRDDVLLWARSIAQEKGFVAIIMRSDTHTGSRGRTSFVLIGCERSGQYKCRKKEFVRRDTESRKCGCPFRLRGKPMHGGEGWMVKLIYGIHNHELAKSLVGHPYVGKLTKDEKKIIVDMTKSM

SEQ ID NO: 196699 - protein, 66 aa, Glycine max
  Coding DNA Sequence Number=SeqID_79921
MREYLMVIRTFCQPEASFTVVIQDIQARRHPRFFSARQGRSSSIACGNVVVIPFYCFQGIEVLLTP

SEQ ID NO: 196700 - protein, 50 aa, Glycine max
  Coding DNA Sequence Number=SeqID_79922
MGGEEAFLAYERTFFRKRKCLKMLRTEEGSSISCYGRTFFRKNLWKKVLP

SEQ ID NO: 196701 - protein, 100 aa, Glycine max
  Coding DNA Sequence Number=SeqID_79923
MVESSERQSWGLSPHERIPLPKFRGPYKEKEGILMVRMNTRGGSTSSRPDTYIHEVSKDMRLPPSHLLPTYTRYKIITGTSVTYNNARVTFWEVSQKTCE

SEQ ID NO: 196702 - protein, 92 aa, Glycine max
  Coding DNA Sequence Number=SeqID_79924
  Subcellular localization annotation: CTP_CleavageSite=52; ConfidenceScore=5.74e-01
MASSPASPPPPPPPSPPPPPSDASASPSAVKRTRKATRLRSLKKLRTYLGIVARDKVDVTYENWKEVPTAQKGFIWEDIQVEFEIPEASDSR

SEQ ID NO: 196703 - protein, 108 aa, Glycine max
  Coding DNA Sequence Number=SeqID_79925
MLITINQYKKNVNLAASHGQRLEDEHAMVSTLQIEMEARERVIESLHVDAMKWMDRFALTLNRSQELPRLLARAKAMADMYSALDEVHDLFDYCQHMVEIMTHIIRNC

SEQ ID NO: 196704 - protein, 100 aa, Glycine max
  Coding DNA Sequence Number=SeqID_79926
ANMVCLVISIGARVAYMEKWGWNRVGMTRHNSQARKWLKNPRCSSTQNGTGKGECTSMKEVWALMPPGTGLGGARSPQGELVQRQQWRHDDGTGEASTKN

SEQ ID NO: 196705 - protein, 170 aa, Glycine max
  Coding DNA Sequence Number=SeqID_79927
MRLPGKESLLMKSPITINEILDVSISFLNDHLEETLGSTKIEEIHSKCINLAQVKVYGESRFWLKAGRMARHDTCQGLVWLKDKRGAPHYFHDTNAKNDDLETLCKTGHACTYADTQVSNFYGHVMLGLKIHFLYFSQPNISKICSFINLCIHPSPFWASGKIFTAFTLQ

SEQ ID NO: 196706 - protein, 102 aa, Glycine max
  Coding DNA Sequence Number=SeqID_79928
MYKDNWTQPWPMGSEIYPKVHENPRAFFSSSSPIFLEPLAHGSSDWSLPREDCIRILSCGAIPGVGGQHCPSPKKGRQGSNVCRLPGLEPGQSKRQFSPATH

SEQ ID NO: 196707 - protein, 92 aa, Glycine max
  Coding DNA Sequence Number=SeqID_79929
  Homolog annotation: Hit_ID=Q0ZCC2; Match level="QueryCoverage=70%, HitCoverage=25%, E-value=5e-08, Identity=40%"; Hit description=CCHC -type integrase
MPLGGRIASEVVWLAGLVKESSIEQGGFQLHCDNQSAIDLAKNKVLLKNIHTLDNVADMLTKAVTTDKFKHYVGLIECCLVLDVMGLKPRTL

SEQ ID NO: 196708 - protein, 239 aa, Glycine max
  Coding DNA Sequence Number=SeqID_79930
  Homolog annotation: Hit_ID=Q9FI63; Match level="QueryCoverage=49%, HitCoverage=22%, E-value=1e-12, Identity=39%"; Hit description =Arabidopsis thaliana genomic DNA, chromosome 5, TAC clone:K21I16
  Subcellular localization annotation: CTP_CleavageSite=34; ConfidenceScore=5.29e-01
MVNSLYDELLQEILQKLPSSSSSSVSLVCKRWLRLHRSSTTSLSLRLTTPHFSLIPSLSSFLSHHPFLSSLSLSLSPPLSLSPHLLSLITPFSNLLALSLSPAPVSLSSLLSLSASCPRLNSLLITLPRPLFLNWVTSFPCLKELSITFSSDEEERVNSDDDEESDDFDSDSGFELGLESLCLVGIRGDDWGVGWLWRRCKNLRKLRLQSCQGIGGSYSSFVKCLQGLEEIELRTCRSV

SEQ ID NO: 196709 - protein, 302 aa, Glycine max
  Coding DNA Sequence Number=SeqID_79931
  Gene Ontology: Mol. function=nucleic acid binding; Cellular component= nucleus; Biological process=DNA integration
  Homolog annotation: Hit_ID=Q1S1X7; Match level="QueryCoverage=72%, HitCoverage=27%, E-value=1e-39, Identity=40%"; Hit description =Integrase, catalytic region; Zinc finger, CCHC-type; Peptidase aspartic, catalytic
MKVHTTKLVTFALIASVGDPSTFQEAMNSLEKDRWIGLWKPPISEKEGEEFKARLVAKGTMLVLVASHDMHLEQMDVKTTFLHGDLEEQIYVEHNLQGNGTSGLFLICFKLATGDVSMNVEFTKEFDMKDLGPTKKILGMEIHKDRKSRQLWLSQQGYVERVLDKFNMSNAKLIGAKVEYKSKVPYANVVGCLMYVMVCTRPDLAHAISQGCNQHGDPSVVGYVDSNYVGDLDDTRSKTSKEVNVAPCGACRSWIFFINEVICFLKIMAAEWRRKKDDWRFHFKEKMSQEEAHHHRKPWIRA

SEQ ID NO: 196710 - protein, 236 aa, Glycine max
  Coding DNA Sequence Number=SeqID_79932
MVYDRNQEKAQEIKNIITAPTYCLVGKRKKRQQKAILTENTPLIDDPPSPIERHVKWKLARIKRYQQMTSQATQEISNKIELKEAIKIELSQRQSQYSPSIKANIQVLGARKSTKGSNAETAVNPSGEEHVAHVMLTMGFDAQVSLPMSEIQYVRPALDTFISWPTHVVNLVSHEISPKKLVEPIQRSDDVATDDPLDDLIKSLFMNEWSSSVGHGLVYGFLEPQSIHNATDRRVE

SEQ ID NO: 196711 - protein, 76 aa, Glycine max
  Coding DNA Sequence Number=SeqID_79933
MSMLVVERKVLMWTLVLRDASVGEQRDAGEQKDAGVGEQKDAGAALYGVKACPAEQLLVTTMLWKCQMIFASSSLD

SEQ ID NO: 196712 - protein, 33 aa, Glycine max
  Coding DNA Sequence Number=SeqID_79934
MKQNLENEVKRQIVVILEELSTSESPTNSSAQD

SEQ ID NO: 196713 - protein, 91 aa, Glycine max
  Coding DNA Sequence Number=SeqID_79935
MKSVHFQVKKRLREFGKASTSKPHAKREISALSAAGAFSQAKLKIGAKPNFTYSVQTYTMPRAQNHTAATVPIQGKEPWKQQRGTTCALKP

SEQ ID NO: 196714 - protein, 134 aa, Glycine max
  Coding DNA Sequence Number=SeqID_79936
MVMGDFISRLSFPENTETFSSLTSYPELRRSEFLIGGYVGARASLLSTTPPFVAMTQELVARGDTIRLSAPRHSVTPSVIDEQRPMWSSAPFPEMSAFSDGDFSSLTSYQELRRSEFLIGGYVGARALLLSAAP

SEQ ID NO: 196715 - protein, 125 aa, Glycine max
  Coding DNA Sequence Number=SeqID_79937
  Homolog annotation: Hit_ID=Q8H767; Match level="QueryCoverage=38%, HitCoverage=13%, E-value=6e-11, Identity=64%"; Hit description =Lysine ketoglutarate reductase trans-splicing related 1
MEELVLNKRSELEEICKLTHIEPYTSIAASAIIDSENELTWAPVFFFRYIEIMKGEGLKISQPAPDPNSTKIHHRIIVRARTKKVHRRVYELRGNTQAPLKLLSILNSLFDGWDPMRLVSTRNAW

SEQ ID NO: 196716 - protein, 39 aa, Glycine max
  Coding DNA Sequence Number=SeqID_79938
MDLILDVGKLVVRQQAKDVVLAAELEGAVLAISIAHSKG

SEQ ID NO: 196717 - protein, 415 aa, Glycine max
  Coding DNA Sequence Number=SeqID_79939
  Gene Ontology: Mol. function=peptidyl-prolyl cis-trans isomerase activity; Cellular component=periplasmic space; Biological process =protein folding
  Homolog annotation: Hit_ID=Q2KXA6; Match level="QueryCoverage=99%, HitCoverage=79%, E-value=1e-136, Identity=60%"; Hit description =Survival protein (Peptidyl-prolyl cis-trans isomerase) precursor
  Pfam annotation: Domain name=Rotamase; Domain location=129-222; Score= 52.7; E_value=1.3e-12; Accession=PF00639.11; Description=PPIC-type PPIASE domain
  Pfam annotation: Domain name=Rotamase; Domain location=267-359; Score= 133.6; E_value=5.4e-37; Accession=PF00639.11; Description=PPIC-type PPIASE domain
  Pfam annotation: Domain name=SurA_N; Domain location=1-86; Score =29.7; E_value=3.6e-14; Accession=PF09312.1; Description=SurA N -terminal domain
  Pfam module annotation: Pfam domain module=Rotamase::Rotamase::SurA _N; Domain location=129-222::267-359::1-86
MERVQRHEADRLGIRVTDAQVDQAITTIAGRNKISVAQLRAEIEKSGVSWDSYRKSLMDEIRSDRLRQRAVDSTIVISDAEVDAFLKDQRRNPAFAAAPQQAQPQPQPEAAPEQAAAPAGPMLYAVAQILVRVPEGSSPEQLAALRKKAEDLLARVKRGDDFASLAAASSDGPEALQGGVMGVRPLDGWPDLFAKAIANLQKGQVSGLLQSGNGFHILKVMDRGTAQPAPSRTGRAPVPTPAPQPRPQPQAQAPQGPVEVMQTHARHILIKTSTVMSDEQARQRLEQVRQRLVAGDAKFDDMARQYSQDATAPQGGDLGWLNPGETVPPFEAAMNALKPGEISQPIQTPFGWHLIQVEERRQHDATDDLARMKARQTLFERRAQPAFEDWLDQLRAQAYIDNRLEKQDRINQNNR

SEQ ID NO: 196718 - protein, 447 aa, Glycine max
  Coding DNA Sequence Number=SeqID_79940
  Gene Ontology: Mol. function=carbohydrate binding; Cellular component= outer membrane; Biological process=outer membrane biogenesis (sensu ProteoBacteria)
  Homolog annotation: Hit_ID=Q7WG18; Match level="QueryCoverage=99%, HitCoverage=55%, E-value=0.0, Identity=73%"; Hit description =Putative outer membrane (Permeability) protein
  Pfam annotation: Domain name=OstA_C; Domain location=1-376; Score =380.8; E_value=2.2e-111; Accession=PF04453.5; Description=Organic solvent tolerance protein
WDVAKVSDNDYFRDISQLGLNQASTTYLPQRARVGWSSTYWSAYAQVYKYQTLQDPDALLTPPYDKQPELYLRGARYDWGGFDVDWTSTAVRFSKPLFLGNRNGPNGDRLQTYPTVSYPIVRPGWFVIPKAGVNYTQYQTDWYHGDWLGLNSGTANAGTSFGYPRSQSRTVPIMSLDAGLIFERDTTLFGKDSIQTLEPRLYYLRVPYRDQSKIPVYDTSLSDFSFSQAFDENIYSGGWDRISNANQLTAALTTRWLDASTGFERASVAVAQRLYFADQKVTLPGETPRENVRSDFLVGASAALTDTLTTDVAAQYNPYDNQWSRGLLSARWSPQRLTTVALAYRYQHDPQPGVLYQPQGQNQIRLAVQWPFTMRWYGVGRVDYSLRDGPSNTANGTTDSPRVTQAIAGLEYNGDCCWVGRMVFQRYAVSATDANTALFFQLDLTGL

SEQ ID NO: 196719 - protein, 84 aa, Glycine max
  Coding DNA Sequence Number=SeqID_79941
MATYDDLDDEKSNSSNEEQPNICLMTDTNKKFELKTWFKSDVSSSSSLDGEEVMVQKHRVKEIKGNLSRSYPNQINIKNAVSRK

SEQ ID NO: 196720 - protein, 98 aa, Glycine max
  Coding DNA Sequence Number=SeqID_79942
  Gene Ontology: Mol. function=electron carrier activity; Cellular component=cytoskeleton; Biological process=electron transport
  Homolog annotation: Hit_ID=Q86AI8; Match level="QueryCoverage=93%, HitCoverage=30%, E-value=6e-11, Identity=39%"; Hit description =Similar to Homo sapiens (Human). Mucin 2
  Pfam annotation: Domain name=PT; Domain location=48-83; Score=7.8; E _value=0.098; Accession=PF04886.3; Description=PT repeat
MTGPLDESISCFLIRVDPWVLVPSPSEGYTPSPLEDFTSSPSEGCTPSPSEDYTSLPSEGCTPSPSEDYTSSPSEDYTSLPSEDFTSSPSEGYLPSPW

SEQ ID NO: 196721 - protein, 117 aa, Glycine max
  Coding DNA Sequence Number=SeqID_79943
MKPCFYSCYLASFCPTTTMSISPCGRVAPARHPVDLEKSKRVLELPALIMGLCRFYGVPVASSKVIRIPTNRAFIKKYCAPRQAQGETPQQPGDGLQWATDPPSPPLEFTSAHPQKG

SEQ ID NO: 196722 - protein, 193 aa, Glycine max
  Coding DNA Sequence Number=SeqID_79944
MTDRLLAWSLTFDCCIMHYNIVRILMPRSSNLAQASEEDLILMWAFLTGRPIDWAHLICYCMHKALWSGAPLPYPQLVTLFLRHFEIPLDLEPFLLVKRSFAIGAGAVTSFGYRKDMDGQWLKKDAQPPQDECTPSPPPQRDDSSALMNEVLSELRGLHTYVGERFDSLDGRIDLLMLALKEWIPASLSLKRM

SEQ ID NO: 196723 - protein, 127 aa, Glycine max
  Coding DNA Sequence Number=SeqID_79945
  Gene Ontology: Mol. function=ribonuclease H activity; Biological process=RNA-dependent DNA replication
  Homolog annotation: Hit_ID=Q1T293; Match level="QueryCoverage=78%, HitCoverage=20%, E-value=7e-14, Identity=34%"; Hit description =Ribonuclease H
MGQMQQDGSARGDPGATDCGGLFQNKFAAYLACFTANLGVRNSLYEEIMGAILAIELVEHKGWRYLWPECDSLLTIQASQNYHLVTHTYVEDNSCANKLASCARDSSEFCWWDSPLILLEQNSIGMG

SEQ ID NO: 196724 - protein, 526 aa, Glycine max
  Coding DNA Sequence Number=SeqID_79946
  Homolog annotation: Hit_ID=Q9ATW1; Match level="QueryCoverage=38%, HitCoverage=68%, E-value=1e-51, Identity=52%"; Hit description =Cinnamyl alcohol dehydrogenase
  Pfam annotation: Domain name=ADH_zinc_N; Domain location=97-231; Score=27.8; E_value=3.7e-05; Accession=PF00107.16; Description=Zinc -binding dehydrogenase
  Pfam annotation: Domain name=GFO_IDH_MocA; Domain location=99-216; Score=-15.2; E_value=0.028; Accession=PF01408.12; Description =Oxidoreductase family, NAD-binding Rossmann fold
  Pfam module annotation: Pfam domain module=ADH_zinc_N::GFO_IDH_MocA; Domain location=97-231::99-216
PCNACFILLVLDLVVGPPIPCKGWADCTSIRLGLASRAKTVSTMLRIIANKRFSHMVPNEHFVVSILSGLPLDVAAPFLGAGITVYGPLRYFGLDKPNMHLGVVGLGGLGHLAVKFAKALDLKVSVIISTSPNKKKKAIQHLGADSFVAAVCTLDGIIDTISAMHPLTPLIDLLKSHGKLVMVGAPEKPLELLLPQETQEIIDFATEHNVRPQIEVIPMDYVNIAMERLLNADDKCINSGYEFVPEHRRSARVRRLTVTFPSQLPKPCIKGCAVSIRISDDEYQKGLLSCQNNLHGRLILPKGTTPAKEHFGAWHLRLHQWSPDFNPNRMRQTHAQIPVAIGTSIVLNESTRQRAFAHYARLLIDFDLAGTFPSEDKAPVDDNTVPIPSKDPNTSSAPIADLASPIVMTEVAMEPPSDVAHVAQFQPPYPCICKETVSGFEPMTNKSPRHNFTAAPGLALFFEHKSLKINVEKLKPQALCGQFYTTSSPKFVGKDTKVLGSSLGTSIAFLAIMRNTVGACHNALLA

SEQ ID NO: 196725 - protein, 130 aa, Glycine max
  Coding DNA Sequence Number=SeqID_79947
MAIGELKFPNSNSKSGEKGRGAHSLEEIVKSHGSFERDNDYDLGQRNRESLEKGVILAEDGEALFKNERYGKNVLLMRLSSLVDGSSVGLLVKPRPSRNCSLEDAEFELGVNEGCQELRKLEAVGEKANE

SEQ ID NO: 196726 - protein, 130 aa, Glycine max
  Coding DNA Sequence Number=SeqID_79948
MAEKTKKQLEEAAQSGSTEGVINPSSHQTTRETAAIGRPEHPGHVRAAGAGGLALPPKPKVGPSGARVSTKESCVDPSGNDPQTGDSDKCGLYIEENPSRLVALGRLYEGSTTVHNIPLLHGQVKVGVKE

SEQ ID NO: 196727 - protein, 78 aa, Glycine max
  Coding DNA Sequence Number=SeqID_79949
MELEEELILYKKEAVGKHEKGFQKVVRQVGFFAKDLDLSLSDPFKDVKDGILLDENELAAKEEAADEEQEAEEYGDDA

SEQ ID NO: 196728 - protein, 190 aa, Glycine max
  Coding DNA Sequence Number=SeqID_79950
MTTLTQIWMTLLLSNILPNDHNSDLPLPKCQLVYAILTQMSVHVAQLISDAIYQFAGVAPMRHPVDPEKSNRALGFPALIMGLCQFYGMPFTPRKVIRPPITRAFIKNQQAANHRGQVWLNESFYQYTLHQQGQDSSPYTWPTLEQFEATVAWPEDWPNFQTKARPAGTFGGGDDAQEEEDMADLIDFLL

SEQ ID NO: 196729 - protein, 71 aa, Glycine max
  Coding DNA Sequence Number=SeqID_79951
MAKFDPEIVMEFYANVWPTEEGVHDMHSWVRGQWIPFDTNALSQFLGHPLILAEGQQSLQDTFTRSDRWDL

SEQ ID NO: 196730 - protein, 68 aa, Glycine max
  Coding DNA Sequence Number=SeqID_79952
MESSLAMECSSRFDVCVCGICEGGVKGDEGWLLYEDTGLLRSMLLYGNCCGGGSCSCGHEGCGDDGCG

SEQ ID NO: 196731 - protein, 112 aa, Glycine max
  Coding DNA Sequence Number=SeqID_79953
MVWPYPIVLNLKWKTKVHLQCDKVYPESIFKEDSYVQSAVTVNGSPERLWKSKLSVSDFDKSESSTKLPKGVKENTLMAKLLEARLEAQKSCSRTCKSTFGSTREAYNENIK

SEQ ID NO: 196732 - protein, 173 aa, Glycine max
  Coding DNA Sequence Number=SeqID_79954
  Gene Ontology: Mol. function=RNA-directed DNA polymerase activity; Cellular component=mitochondrion; Biological process=RNA-dependent DNA replication
  Homolog annotation: Hit_ID=Q1S0N5; Match level="QueryCoverage=78%, HitCoverage=15%, E-value=1e-58, Identity=69%"; Hit description =Peptidase S16, lon protease
  Pfam annotation: Domain name=AAA; Domain location=18-170; Score=46.1; E_value=1.2e-10; Accession=PF00004.19; Description=ATPase family associated with various cellular activities (AAA)
  Subcellular localization annotation: CTP_CleavageSite=20; ConfidenceScore=5.19e-01
MAQLSCHPSPFHIKRGKIICLSSPPGVGKTSIGRSITRALNRKFFRFSVGGLADVAEIKGHHRTYIGVMPRKMVQCLKNVGTTNPLVLIDEIDKVLFVCTTNFVEMIPNPLLDRMEDVAIARYITDEKMHIARDYLEKTTREACGIEPKQVFIFATCFAITSPAKNGMFKVLT

SEQ ID NO: 196733 - protein, 628 aa, Glycine max
  Coding DNA Sequence Number=SeqID_79955
  Pfam annotation: Domain name=Transposase_21; Domain location=15-185; Score=-87.9; E_value=4.1e-07; Accession=PF02992.5; Description =Transposase family tnp2
MRNCPTCRVSRYKVKDDESSDDATTCNGRPTKDPINPRLGLALDGMNPFGNLSTNHSHGLFVDDLQPSSLVVHEAKIHYDVYDDSKYKTKEMIFDVYLTPLIKDIRKLWVDGVDVYDANLQETFRYVIEEAIEFCSKYMETTKPVGLPQSHHESRHGGRGTQGYNLVTMGWQEADLEHFTSASDKNSIRASMAYFGVIKELWELDYNEFRVCMFKCQWVNGITSMHQDELGFTLVNLRKVANKDNPFIMAKQARHVFYIQDSCDSTWSVVLQGKSNSISHQNDTLTLHIGESPSFSPQMPSVNEEHEVDDVHAIHDDHDEGLWENILTVMATPPRSPSHLDDPLETTSRRSKQSTQLRSLTRKFDISEASNAKKKVILTVATRWRQFKSSLTTKYIYCDNKGEDKQHPFAKYGLDPKTWEEFAKSRLTPNLQDSTMILDPPSPIARHFKWKMACTKRYGQMTSKGSFVPHGRHDILNTVIGRLEHPGRVCVAGTGVTINQYFGHASRASNNPCTSISQQQFLEMIGNMKDELRKEVDGEHKKSLEKIKQEVKEAITLELSQKSSQYSRSIEAYIQLLAARAIDTFIGWLIHIVKTVSYEDSDIHEPKPIGVVKGSNKVAGVDPMGELM

SEQ ID NO: 196734 - protein, 69 aa, Glycine max
  Coding DNA Sequence Number=SeqID_79956
MYQSHIRGANVVISLLVDIRGLNRRKKYSKGMANIDIEGILKQQPDDGLMKSTVLASLLELVFVETCDR

SEQ ID NO: 196735 - protein, 33 aa, Glycine max
  Coding DNA Sequence Number=SeqID_79957
MVDFTDPRRRGYPGEGFPSSDRDEARVREMRCE

SEQ ID NO: 196736 - protein, 106 aa, Glycine max
  Coding DNA Sequence Number=SeqID_79958
  Gene Ontology: Mol. function=transferase activity; Biological process= DNA integration
  Homolog annotation: Hit_ID=Q1SPQ1; Match level="QueryCoverage=58%, HitCoverage=17%, E-value=7e-11, Identity=52%"; Hit description =Polynucleotidyl transferase, Ribonuclease H fold
MITYMTVCPNDEGRWVMKSKALSNKLFGVFVQPRPKEKSNKVSHISLDAKVSNCRSGMELMDEIMAHQGRDYEQKGNQFRDVRKSIINLVMFIRAIAYGGTGKGGY

SEQ ID NO: 196737 - protein, 88 aa, Glycine max
  Coding DNA Sequence Number=SeqID_79959
  Subcellular localization annotation: CTP_CleavageSite=5; ConfidenceScore=5.04e-01
DTAVNAVNRPSIMPSELNSSRIGERLQVSPRELRKFFSKAGIFSFKFKSVPRSKELEVSRRGRLELAEYLTSLLDSHLYFSFRACANE

SEQ ID NO: 196738 - protein, 141 aa, Glycine max
  Coding DNA Sequence Number=SeqID_79960
MTTLTHIWMTLLLSNILPNDRNADLPLRKYQLGSRPQDTQWTRRSPTEPWGFLHGLRASVSPTGCSSPPARSYHRDIGKDRSRKTPSGPGEVQQGLGVSSSDHGPLQAQGKTPQQPGDGRQRATNAPPPPLEFTSAHPQKG

SEQ ID NO: 196739 - protein, 137 aa, Glycine max
  Coding DNA Sequence Number=SeqID_79961
  Gene Ontology: Mol. function=unspecific monooxygenase activity
  Homolog annotation: Hit_ID=O04892; Match level="QueryCoverage=68%, HitCoverage=17%, E-value=4e-27, Identity=78%"; Hit description =Cytochrome P450 like_TBP
LPTLETAQPEVGSSGWKSTARRVVSGAPPAALENPEDRVPPTPGKGSRQNGSVTSGKGLALRAGHGGPSPEPVGCRWTARAASAARAGRRVPVGGRMGNGPFGASSPGVEQSTQNWYGQGESDCLIKTKHCDGPCGC

SEQ ID NO: 196740 - protein, 118 aa, Glycine max
  Coding DNA Sequence Number=SeqID_79962
  Gene Ontology: Mol. function=ribonuclease H activity; Biological process=DNA integration
NAFDKKVRPRKFNEGDLVLKKTSHAIKDSRGKWASNYEGPFVVKRALSGGALILTNMDGEELPSPQGAESSQATVRSQDKSMAEINQGTDASGDGVTTDRSLPLPDAKQAENVAARQP

SEQ ID NO: 196741 - protein, 90 aa, Glycine max
  Coding DNA Sequence Number=SeqID_79963
MEDQKISFDLFEAMKHSDMGDACFEEEEVEQEIALLASTMVLQSLLEKEPGYRRDFLARDEELDDSKDSCVEQVVFVELEKLRPAEKPKA

SEQ ID NO: 196742 - protein, 339 aa, Glycine max
  Coding DNA Sequence Number=SeqID_79964
  Gene Ontology: Mol. function=hydrolase activity; Cellular component =integral to membrane; Biological process=proteolysis
  Homolog annotation: Hit_ID=Q2UJ87; Match level="QueryCoverage=95%, HitCoverage=29%, E-value=1e-161, Identity=87%"; Hit description=N -arginine dibasic convertase NRD1 and related Zn2+-dependent endopeptidases
  Pfam annotation: Domain name=Peptidase_M16; Domain location=12-131; Score=-8.1; E_value=0.0013; Accession=PF00675.10; Description =Insulinase (Peptidase family M16)
  Pfam annotation: Domain name=Peptidase_M16_C; Domain location=155 -338; Score=97.0; E_value=5.8e-26; Accession=PF05193.11; Description =Peptidase M16 inactive domain
  Pfam module annotation: Pfam domain module=Peptidase_M16::Peptidase _M16_C; Domain location=12-131::155-338
  Subcellular localization annotation: CTP_CleavageSite=103; ConfidenceScore=5.20e-01
MRACSPCPLLERMTASHSGSSNAYTAATETNYFFEVSATSESSDGSSSGNSTPTNGTTSTGQTESSKSPNSSKPSPLYGALDRFAQFFVAPLFLESTLDRELRAVDSENKKNLQSDLWRLMQLNKSLSNPAHPYHHFSTGNLQTLKEEPQKRGLNVRDEFIKFYEKHYSSNRMKLVVLGRETLDEMEQWVGDLFAGVKNKNLPQNRWDDVQPWLADDMCKQVFAKPVMDTRSLDIYFPFLDEEHMYESQPSRYISHLIGHEGPGSILAYVKAKGWANGLSAGVMPICPGSAFFTVSIRLTKEGLRQYREVAKAVFEYIALIKEREPEQWIFDEMKNLAE

SEQ ID NO: 196743 - protein, 372 aa, Glycine max
  Coding DNA Sequence Number=SeqID_79965
  Gene Ontology: Mol. function=RNA binding; Cellular component=outer membrane; Biological process=electron transport
  Homolog annotation: Hit_ID=Q8UFL6; Match level="QueryCoverage=100%, HitCoverage=48%, E-value=0.0, Identity=93%"; Hit description=Group 1 outer membrane protein
  Pfam annotation: Domain name=Bac_surface_Ag; Domain location=143-372; Score=61.7; E_value=2.3e-15; Accession=PF01103.13; Description =Surface antigen
  Pfam annotation: Domain name=Surf_Ag_VNR; Domain location=43-116; Score=72.9; E_value=1e-18; Accession=PF07244.5; Description=Surface antigen variable number repea
  Pfam module annotation: Pfam domain module=Bac_surface_Ag::Surf_Ag _VNR; Domain location=143-372::43-116
MEAISKRVAGEGYPFARVTPRGDRDMSGNTIGVTYIVDQGERAYVERIEIRGNTRTRDYVIRREFDISEGDAFNQTVITAAKRRLEALGYFSKVNISTAGGSAPDRVVIVVDVEDQSTGSFGIGAGYSQNDGVLLEASIEEKNFLGRGQYIRLAAGAGEDDARSYTLSFTEPYFLGYRLAAGFDLFKSQSRSEDYYDYDEQGFSLRVTAPITEDLSTTFKYTYKQLNYDGEGDWETGSNLAAPYKDLIRGGDWTQSIISNTLNYNTLDDRNMPREGWQAALTNEFAGLGGDSEYYKIYAKARFYYTLSDEYDVIGSLTGQAGHVMPTGDNLLVFDQFKFGGRQVRGFKNDGIGPRIGSDSIGGTTYFAASAE

SEQ ID NO: 196744 - protein, 77 aa, Glycine max
  Coding DNA Sequence Number=SeqID_79966
MKQRQMMHKLFIKEIATWRREGDIFGSDTLGMTLGEIEDLMESDSTSHYKHSAIFNGDDATRTYQNSDGVKPGTCSN

SEQ ID NO: 196745 - protein, 83 aa, Glycine max
  Coding DNA Sequence Number=SeqID_79967
MVDDMHGAKLEACAAMALRLVPHTVVGPKLEARAAKLAFFPSSLMSCKVVKQEATTLLLMESFPHCKNLDHVEVLQFLNRCST

SEQ ID NO: 196746 - protein, 89 aa, Glycine max
  Coding DNA Sequence Number=SeqID_79968
  Subcellular localization annotation: CTP_CleavageSite=63; ConfidenceScore=5.00e-01
MAKGCGMTKFCLRMSSGPPPLDDKGCRMTKFCLCAPSDTTVSEWQRGADNRKVSPRVTSSWVMTAKGGVVDQSKALAPTYPQMRNSDLR

SEQ ID NO: 196747 - protein, 278 aa, Glycine max
  Coding DNA Sequence Number=SeqID_79969
  Gene Ontology: Mol. function=RNA-directed DNA polymerase activity; Cellular component=intracellular; Biological process=RNA-dependent DNA replication
MFQRLRKYQLRLNPNKCTFGVRFGKLLGFIVSQKGIEVDPDKVRAIREMPVPQTEKHVRGFLGRLNYISRFISHMTTTCRPVFKLLRKDQGVVWTEDCQKAFDRIKNYLLEPPILIPPVEGKPLIMYLIVLEDSMGYVLGQQDETGRKEHAIYYLSKKFTDCESRYSLLEKTCCALAWAAKRLRHYMINHTTWLISKMDPIKYIFEKPALTGRIARWQMLLSEYDIEYRTQKAIKGSILADHLAHQPIEDYQPIKFDFPDEEVMYLKMKDCDEPLPGE

SEQ ID NO: 196748 - protein, 177 aa, Glycine max
  Coding DNA Sequence Number=SeqID_79970
  Gene Ontology: Cellular component=integral to membrane
  Homolog annotation: Hit_ID=Q92S85; Match level="QueryCoverage=79%, HitCoverage=46%, E-value=2e-48, Identity=67%"; Hit description =HYPOTHETICAL TRANSMEMBRANE PROTEIN
MTDEGWACPVFSDRKCKSRQGPLTGQAMPPGTICPSRGRGDGRQPGGGLLRFRLDHPFPAWNPRRQARQRSARRRPPGGDGRRVDILLPAQHRPARSHHFAALRHPARHRRRVDAEGKHFGTSPRRPQRNGDAAPAGTPQLGTPPAAENAVQEIEDLSQHHSSRHARFRHRHTHLHH

SEQ ID NO: 196749 - protein, 104 aa, Glycine max
  Coding DNA Sequence Number=SeqID_79971
MLSEEQERITEPVAHGPASERRFPPQQFHMLSSSVETRGCDRRREIVQAEDFFQQMEQRGHGMYYTLPTFSQYPSQMYQYPFVWWCCGNTSSFFMADHDPFAAT

SEQ ID NO: 196750 - protein, 51 aa, Glycine max
  Coding DNA Sequence Number=SeqID_79972
  Subcellular localization annotation: CTP_CleavageSite=18; ConfidenceScore=5.33e-01
MATPPVSPPPPSASPLPPAVAAVSPSTQKRTRKVEFKIHEASDSRTKMKVL

SEQ ID NO: 196751 - protein, 207 aa, Glycine max
  Coding DNA Sequence Number=SeqID_79973
  Homolog annotation: Hit_ID=UPI0000503967; Match level="QueryCoverage =98%, HitCoverage=93%, E-value=5e-08, Identity=27%"; Hit description =UPI0000503967 related cluster
MHERQSIHGAPNKSGEWRITLGNHYAWFQTHGWRMHERQSIHGAPNKRREWRIALGNHNAWLQTHGWRMHERQSINGAPKKSGEWRIALGNHYAWLQTHGWRMHERQSIHGAPNKSGEWRIALGNHNTWLQTRWWRTHERQSIQGTPNKRGEWGIALGNHYAWFQTRGWRMHERQSIHGAPNKRREWRIALGNHYAWFQTRGWRMHE

SEQ ID NO: 196752 - protein, 66 aa, Glycine max
  Coding DNA Sequence Number=SeqID_79974
MTSNDNSWQPLVVIGGGEGGVKVWVAFGEDERVKIMFFMLKNIFIICRSRLASSSHLAEVHFSYLA

SEQ ID NO: 196753 - protein, 116 aa, Glycine max
  Coding DNA Sequence Number=SeqID_79975
  Gene Ontology: Mol. function=iron-sulfur cluster binding; Biological process=electron transport
  Homolog annotation: Hit_ID=Q8ZQE9; Match level="QueryCoverage=99%, HitCoverage=35%, E-value=6e-42, Identity=74%"; Hit description=NADH oxidoreductase for hcp gene product
  Pfam annotation: Domain name=Fer2; Domain location=36-111; Score =67.9; E_value=3.2e-17; Accession=PF00111.17; Description=2Fe-2S iron- sulfur cluster binding domain
MAIVEEDVKALGVTRFFKEQFFTPVAEAATSGIQFTRLQPAQTFFGRVGTTLLEALESNKVPVAAACRAGVCGCCKTKVVSGDYTVTSTMTLTDAEIAEGYVLACSCHPQGDLVLA

SEQ ID NO: 196754 - protein, 138 aa, Glycine max
  Coding DNA Sequence Number=SeqID_79976
  Homolog annotation: Hit_ID=Q6D2E3; Match level="QueryCoverage=80%, HitCoverage=80%, E-value=1e-31, Identity=52%"; Hit description =Putative membrane protein
  Pfam annotation: Domain name=DoxX; Domain location=13-94; Score=93.9; E_value=4.8e-25; Accession=PF07681.2; Description=DoxX
MAVNEKLACDDLGKLLLRLAVGGLMLFHGLHKLFGGVGFISGMLVEKGLPGFIAYGVLIGEVVAPILIIVGLFTRPAALVLAFTMIVAWLMVGTGKTFALDAVGAWAIESLMYFFIGSLAVAFLGAGRYALGKAPPWR

SEQ ID NO: 196755 - protein, 145 aa, Glycine max
  Coding DNA Sequence Number=SeqID_79977
MFPKELLLPENFWKRCSGSFPEDLFFRNTFYYFRNIPSSGNLPEDLLPEVPEEPLTGLPEGATVTKLSPFFFGVLYPKCITKPKLRGRPPTLNANGSKGWRRSLAKKKTTKEASAEERRGRKLSRKRENEEDRMLPKEGKSFLCF

SEQ ID NO: 196756 - protein, 65 aa, Glycine max
  Coding DNA Sequence Number=SeqID_79978
MVSSGGIVAVLREVSLERRRYLFYPFKFQFKTQSIQAMVELRRQYSKTDNNQNFNLEIKSSVYVA

SEQ ID NO: 196757 - protein, 225 aa, Glycine max
  Coding DNA Sequence Number=SeqID_79979
  Homolog annotation: Hit_ID=Q6YUB8; Match level="QueryCoverage=94%, HitCoverage=69%, E-value=2e-59, Identity=52%"; Hit description=Major intrinsic protein-like
  Pfam annotation: Domain name=DZC; Domain location=189-224; Score =78.0; E_value=2.9e-20; Accession=PF08381.1; Description=Disease resistancezinc fingerchromo
  Pfam annotation: Domain name=DZC; Domain location=2-37; Score=31.3; E_ value=3.5e-06; Accession=PF08381.1; Description=Disease resistancezinc fingerchromo
  Pfam module annotation: Pfam domain module=DZC::DZC; Domain location =189-224::2-37
MTTELTKRQKMKNREIFNKWQAQRWWAENYDKVMELYNVQRLNRQAFPLPTPPRSEDESSKRESIEDFPVTPPLSRERPPCNLFRAGGGGMGMGYSSSDSFDHHSMQSSRHYYDPNDVNSTPKASSTISAAAKTDISSSMDVDASIRSSSSREADRSGDLSISNASDLDTEWVEQDEPGVYITIRALPGGKKELRRVRFSREKFGEMHARLWWEENRARIHEQYL

SEQ ID NO: 196758 - protein, 171 aa, Glycine max
  Coding DNA Sequence Number=SeqID_79980
  Gene Ontology: Mol. function=protein binding; Cellular component =ESCRT III complex; Biological process=protein transport
  Homolog annotation: Hit_ID=Q9SKI2; Match level="QueryCoverage=90%, HitCoverage=69%, E-value=7e-52, Identity=71%"; Hit description =Expressed protein
  Pfam annotation: Domain name=Snf7; Domain location=1-126; Score =101.1; E_value=3.3e-27; Accession=PF03357.11; Description=Snf7
MAKDLVRTRHQVEKFYKLKSQLQGVSLRIQTLKSTQAMGEAMKGVTKAMGQMNRQMNLPSLQKIMQEFERQNEKMELTSEMMGDAIDDALEGEEDEEETEDLVNQVLDEIGIDINQELVNAPSSAVAAPAAKTKVPQVETTGNDDGGIDSDLQARDSSFTGKIDAHLYHIA

SEQ ID NO: 196759 - protein, 188 aa, Glycine max
  Coding DNA Sequence Number=SeqID_79981
  Gene Ontology: Mol. function=metal ion binding; Cellular component =integral to membrane; Biological process=ubiquitin cycle
  Homolog annotation: Hit_ID=Q5ICP0; Match level="QueryCoverage=84%, HitCoverage=52%, E-value=7e-15, Identity=30%"; Hit description=RING -H2 subgroup RHE protein
  Pfam annotation: Domain name=zf-C3HC4; Domain location=119-160; Score= 22.6; E_value=0.00073; Accession=PF00097.15; Description=Zinc finger, C3HC4 type (RING finger)
  Subcellular localization annotation: CTP_CleavageSite=80; ConfidenceScore=5.69e-01
MGDVLSPFTISSPPPPSSPSTKNNSMPMLYYGLVVVGTAAIVLAIYNLVLLRRSQTRHARPAQSITHNRDIVQVVSERTRSFEDSQQRNLLSSFKYKKEVVAKEEEEEEEEEQDDEFECSVCLSVYEEGEEVRKLPQCKHYFHVLCIDMWLYSHLDCPICRTPVDVLCPGENSPDGMMESGAGMAASL

SEQ ID NO: 196760 - protein, 196 aa, Glycine max
  Coding DNA Sequence Number=SeqID_79982
MFVHRNNANTATLAEVAETLQYIVSPHGRNTWTVDNLVPYVEKITILSKEQVRIIEPVSHGPASERQFPAQEFHILQSNVETQGIGRRREAVEAEEYSQQMVDRGHGMYYTPPTFSQYPSQMYQYPFEGHHIDTFASEHSFGGVAETHPHFSWPTMTPSQQHDVPIVTPNARRNPDRQVRRLWDQPCVPSTCMIGL

SEQ ID NO: 196761 - protein, 89 aa, Glycine max
  Coding DNA Sequence Number=SeqID_79983
MAKEGEEMAFFQSYLDYKAQNAQVTNALGNIMDKCSMKLQTKFREDPMVKEGWAAFLPRQLHVASLRSFIKRLPHGFFEKFSRETSLTS

SEQ ID NO: 196762 - protein, 268 aa, Glycine max
  Coding DNA Sequence Number=SeqID_79984
MDKLLYGKACPDEGDTKALNTFLRTTNLTYMCRMIHNMLFNIVMRRVGFRDRFYIYKIMVGEKVNLPEIIFLDWMQVFKDRFNPKVKKNHIPFGIFFTRILRLAGVEVSFMEPSVSATQLKGATFVKIAIAEKFPKYMQRHIKKKVKKETLTREKELRQTTTSDQLPNEVVLEAVKPRFEEKLWKAEFDVKVQSALETSAKIFSIASTARDTELQPTMSVIEVSFQGFDIGVISNSIETNPRVAPLHSHPVIIDDEAILDALLAKPMS

SEQ ID NO: 196763 - protein, 146 aa, Glycine max
  Coding DNA Sequence Number=SeqID_79985
  Homolog annotation: Hit_ID=Q1SJY5; Match level="QueryCoverage=36%, HitCoverage=5%, E-value=1e-07, Identity=48%"; Hit description =Integrase, catalytic region
MSKGTDYVGPKKIWVPKSQIVHVIDILGRKSPGFKMVPGQWMLTTHDRGKYMFLNLNPHEGGSVAFGGIGKGKISSIDKVLIPSLASIDKVLDQAEGVKTRSSFKDLALCALVFEIKPNTIEEALTDNDWITAMEEELHQFTRNNI

SEQ ID NO: 196764 - protein, 102 aa, Glycine max
  Coding DNA Sequence Number=SeqID_79986
  Gene Ontology: Mol. function=calcium ion binding; Cellular component =flagellin-based flagellum; Biological process=ciliary or flagellar motility
  Homolog annotation: Hit_ID=Q45W79; Match level="QueryCoverage=92%, HitCoverage=57%, E-value=1e-29, Identity=64%"; Hit description =Calcium-binding pollen allergen
  Pfam annotation: Domain name=efhand; Domain location=13-41; Score =27.9; E_value=3.5e-05; Accession=PF00036.22; Description=EF hand
  Pfam annotation: Domain name=efhand; Domain location=50-78; Score =14.7; E_value=0.31; Accession=PF00036.22; Description=EF hand
  Pfam module annotation: Pfam domain module=efhand::efhand; Domain location=13-41::50-78
MMKSLGQPTTEEEIKRMIQEVDVEGDGHINLGEFLELNTKGADPDEILENLKDVFSIFNIDGNGSIIAEELNMVMASLGDACSIDECQKMIVGVDCNKFYNS

SEQ ID NO: 196765 - protein, 361 aa, Glycine max
  Coding DNA Sequence Number=SeqID_79987
  Gene Ontology: Mol. function=nucleic acid binding; Cellular component= nucleus; Biological process=DNA replication
  Homolog annotation: Hit_ID=Q6WG36; Match level="QueryCoverage=99%, HitCoverage=75%, E-value=4e-92, Identity=64%"; Hit description=RPA 70kDa subunit
  Pfam annotation: Domain name=Rep_fac-A_C; Domain location=295-351; Score=-29.0; E_value=8.7e-05; Accession=PF08646.1; Description =Replication factor-A C terminal domain
MIVVILNKETILAEFEIIGNPKPYMDSDKPTVRASADCTWRICPGLVIVLLPKMQSHNNTQNFRPTIQPPYQPPPLYKGCGPVVKNEVPARIVPKAALNPYQCRWAIKARVTAKVDLRRYNNARGDGNIFLFDLLDSDGGEIRVLMEVKYDDICESFSSYLEEEWNGNPKKNFESEGQFWQEVELTLWGEFCNREGQQLQEMVDTGSFLILAVKAGKVNDFSGKSIGSISTTQLFINPDFPEAHSLREWFDRVGKDSASLSISKDIIPGAVKNKVRKTVSQMKDEGLGRSDKPDWIIVRAAILFIKTDTFCCTACPLMIGDRRCNKKVTRSGNTRWQCDRCNQEFEEGKRLWSTQQRICTF

SEQ ID NO: 196766 - protein, 305 aa, Glycine max
  Coding DNA Sequence Number=SeqID_79988
  Gene Ontology: Mol. function=nucleotide binding; Cellular component =clathrin coat of trans-Golgi network vesicle; Biological process =intracellular protein transport
  Homolog annotation: Hit_ID=Q1SCR3; Match level="QueryCoverage=71%, HitCoverage=46%, E-value=8e-70, Identity=63%"; Hit description=Pre -mRNA cleavage complex II Clp1
  Pfam annotation: Domain name=Clp1; Domain location=152-299; Score= -95.0; E_value=1.5e-06; Accession=PF06807.4; Description=Pre-mRNA cleavage complex II protein Clp1
MVYGGAGPVGGSGSASTIKQVFTWYGATIEMDGATETDYTADVTPMVSYVNLHVVLDGRRSRAKASPPDDSGSSQEIADNSSSCVAAEIAVSDIFLKPCDILWYVNFVNLVGQGPRVIVVGPTDSGKSTLSRMLLSRAVKQGWKPTFVDLDIGQGSITIPKCIAATPIEMSIDLVEGIPLEMPLVYYYGHTTPRQFTGNAESRALGMVINTMGWIEGVVALACNSYIQGQCCLGFGSESGKSSNGPEKDYSLIGDTTNRLFGIFNAIPIIANTYGSGIVPEIQATLAPSVEGEMLKFKDYAFVML

SEQ ID NO: 196767 - protein, 89 aa, Glycine max
  Coding DNA Sequence Number=SeqID_79989
  Homolog annotation: Hit_ID=Q6WG36; Match level="QueryCoverage=51%, HitCoverage=7%, E-value=1e-08, Identity=60%"; Hit description=RPA 70kDa subunit
MSLNLTANTIPVIIGGNVNAKLLVQVLDMALISNSKNSQQQRYRLLGYKRGLIPTNVKKGLIPNKKVFSLTHSHHEWRKAERKVEGSEI

SEQ ID NO: 196768 - protein, 76 aa, Glycine max
  Coding DNA Sequence Number=SeqID_79990
MAPKKLSAKRSRRDAATKGTSVTPEFDSHHFRSAKHQQHFEAIKGWSFHTERRVQLRDDEYTYFQEEIARRHWTSL

SEQ ID NO: 196769 - protein, 87 aa, Glycine max
  Coding DNA Sequence Number=SeqID_79991
MGKGKRRQHNQKSDKPNEESSQKLWTPLTRFKRFTSITHNEAQVKVQRRLLEALVRRVDCMVFSCMRSRERPKLMIHAGLKLMSGIL

SEQ ID NO: 196770 - protein, 125 aa, Glycine max
  Coding DNA Sequence Number=SeqID_79992
  Gene Ontology: Mol. function=hydrolase activity, hydrolyzing O -glycosyl compounds; Biological process=carbohydrate metabolic process
  Homolog annotation: Hit_ID=Q47522; Match level="QueryCoverage=50%, HitCoverage=83%, E-value=2e-22, Identity=75%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPVTTLNSIDECGYINLVIDFCYAETSALAKASYKAWTEIG

SEQ ID NO: 196771 - protein, 196 aa, Glycine max
  Coding DNA Sequence Number=SeqID_79993
  Gene Ontology: Biological process=protein modification process
MSFESGMVMEEHDSEKVEIVLKTIGPARPSRLLVSSSIKVRDLRRLIAGNDNLQIDNLSLILRGSALYDMKNGDDVYIQLNDGDCLIVAVKPKPPVKDGYDNDDEDEDLKFRLPQSSSWWKKRLYTFLHDNLKLPDILLMVIFTLSLKAWLLIILWFILAPVAHRWDLGPLYDKVVYNNPPPYLRIARNLRGTVLC

SEQ ID NO: 196772 - protein, 231 aa, Glycine max
  Coding DNA Sequence Number=SeqID_79994
  Gene Ontology: Mol. function=structural constituent of ribosome; Cellular component=intracellular; Biological process=translation
  Homolog annotation: Hit_ID=Q6KF70; Match level="QueryCoverage=50%, HitCoverage=21%, E-value=7e-14, Identity=38%"; Hit description =Transglutaminase
MVVTFFPRMTTPDSPWMTIYLVPPRYNPIGARDPGLLKSSMMAVISSEQESEQHQHGPSEAPKSSAALWKQVHPSTQQGSVPPHAPTATLSSRSPSPAPHFPFSRSSPAAHESAAPAPSSAPPCAREASASHVAPPPAPAAAHCASRPGAGSLSPDIASPHAVAPASPSSPEAEGANQTAPRSGAALRRGPAGAAAADPVLELATNLREIVSDTLLMRHNRSSQRRGCHVA

SEQ ID NO: 196773 - protein, 62 aa, Glycine max
  Coding DNA Sequence Number=SeqID_79995
MVRDEGQHRWACRFGFNWEMQSKAILRKFEPMNPLTFPPPSIIVLLSCDVEGKNPLPLYRRR

SEQ ID NO: 196774 - protein, 82 aa, Glycine max
  Coding DNA Sequence Number=SeqID_79996
MAVHLFECVAHIVTHLEEDEVIAFELVEDLVADDLAVLNVMLPECANPRWPPCRHYYKYAILRRAFNDGGTKNNIVLDAVAF

SEQ ID NO: 196775 - protein, 88 aa, Glycine max
  Coding DNA Sequence Number=SeqID_79997
MEWGPLGFLYLRFMRPTKIFEINEHVGRHGGRKVAPLVLFFLTISVVAVQAKVILQCTHLYPHEPVGLRTKSRVIIRPSSIPNFGSGK

SEQ ID NO: 196776 - protein, 45 aa, Glycine max
  Coding DNA Sequence Number=SeqID_79998
MTKIQRKTNEVPEDVLSVWVLAMDVVLEIDELKSVESNDSLDRQY

SEQ ID NO: 196777 - protein, 67 aa, Glycine max
  Coding DNA Sequence Number=SeqID_79999
MESGGMRGHCMVFRTFVQPGANDPVDGQRLTSFSAPLVILTQGVRGHAGVPYGFYFIRPETCKPDDA

SEQ ID NO: 196778 - protein, 141 aa, Glycine max
  Coding DNA Sequence Number=SeqID_80000
MLKALRANAPLPYPQLITLFLRHFQIPLDDEPFVQVKHSFAIGAGAVTSFGYRKDQNSQWLKKDALPPQDERTPSPPPQRADSALMNEVLSELRGLRSYFDERFDSLDTRFAGMDIRLTQLEEDVGYIRQSFDLPPPPPPS

SEQ ID NO: 196779 - protein, 366 aa, Glycine max
  Coding DNA Sequence Number=SeqID_80001
  Gene Ontology: Mol. function=ribose phosphate diphosphokinase activity; Cellular component=chloroplast; Biological process =ribonucleoside monophosphate biosynthetic process
  Homolog annotation: Hit_ID=Q1S8E7; Match level="QueryCoverage=99%, HitCoverage=89%, E-value=1e-164, Identity=82%"; Hit description =Ribose-phosphate pyrophosphokinase
  Pfam annotation: Domain name=Pribosyltran; Domain location=191-322; Score=130.5; E_value=4.7e-36; Accession=PF00156.17; Description =Phosphoribosyl transferase domain
MSESSNFVNGKPIIPVLNERTLPKFMESAREAKTVSRNSNRLKLFSGRANPTLSQEIARYMGLELGKISIKRFADGEIYVQLQESVRGCNVYLIQPTCPPANENLMELKIMIDACRRASAKNITAVIPYFGYARADRKASILDATTRSRYSLTQGRESIAAKLVANLITKAGADRVLACDLHSGQSMGYFDIPVDHVHCQPVILDYLASKMISSSDLVVVSPDVGGVARARAFAKKLSDAPLAIVDKRRHGHNVAEVMNLIGDVKGKVAVMVDDMIDTAGTIAEGAALLHEEGAREVYACCTHAVFSPPAIERLSSGLFHEVIITNTIPVAEKNYFPQLTIITVANLLGETIWRVHDDSSVSSIFQ

SEQ ID NO: 196780 - protein, 320 aa, Glycine max
  Coding DNA Sequence Number=SeqID_80002
  Gene Ontology: Mol. function=transporter activity; Cellular component= membrane; Biological process=oligopeptide transport
  Homolog annotation: Hit_ID=Q1S8E6; Match level="QueryCoverage=99%, HitCoverage=47%, E-value=1e-152, Identity=84%"; Hit description =Transporter, major facilitator family, putative
  Pfam annotation: Domain name=PTR2; Domain location=1-239; Score= -37.3; E_value=0.00015; Accession=PF00854.12; Description=POT family
MASNGEDLYVMDENESPTNGNRKILHTEGFKFLDRAAIISSRDLEDQKSGVYNPWRLCPITQVEEVKCILRLLPIWLCTIIYSVVFTQMASLFVEQGAAMKTTISHFRIPPASMSSFDILSVAVFIFFYRRVIDPLVGRLKKKSSKGLTELQRMGIGLVIAVMAMVSAGIVECYRLKYADPVCPHCSGTSSLTIFWQIPQYTLIGASEVFMYVGQLEFFNAQTPDGLKSFGSALCMTSISLGNYVSSLLVSIVMKISTEDHMPGWIPGNLNRGHLDRFYFLLAILTSIDLVLYIACAKWFKSIQLEGKYEENDMPGSFKV

SEQ ID NO: 196781 - protein, 77 aa, Glycine max
  Coding DNA Sequence Number=SeqID_80003
RVGRHHPPCGCLVSPGPCPVASGAWLLRGGVSPLLHYQDRVAHHRPPCGCLASPDPAPNGVRGVPPMWRCLPFVALS

SEQ ID NO: 196782 - protein, 69 aa, Glycine max
  Coding DNA Sequence Number=SeqID_80004
MNMLLTRHRLFCSTRTYCFGDGKAVDDPQELTFYLYDSFIERKNGMLLPFLKRLKIPEVMPKPNDSKKS

SEQ ID NO: 196783 - protein, 116 aa, Glycine max
  Coding DNA Sequence Number=SeqID_80005
MHGSSNGVEEANHMLIGVCMLNVVVKPGHWTWSGGRKKEKAYSYMDNKSPSKESKEVTRESLIAISNSLPDKTLESTSALESKKSDGVMIPNRDQDDKFRSELISISYAESPDDKI

SEQ ID NO: 196784 - protein, 737 aa, Glycine max
  Coding DNA Sequence Number=SeqID_80006
  Gene Ontology: Mol. function=protein kinase activity; Biological process=protein amino acid phosphorylation
  Homolog annotation: Hit_ID=Q1S8D8; Match level="QueryCoverage=67%, HitCoverage=99%, E-value=0.0, Identity=93%"; Hit description=Protein kinase domain, putative
  Pfam annotation: Domain name=Pkinase; Domain location=64-314; Score =21.6; E_value=7.5e-10; Accession=PF00069.15; Description=Protein kinase domain
  Pfam annotation: Domain name=Pkinase_Tyr; Domain location=76-314; Score=-28.2; E_value=9.7e-11; Accession=PF07714.7; Description =Protein tyrosine kinase
  Pfam module annotation: Pfam domain module=Pkinase::Pkinase_Tyr; Domain location=64-314::76-314
MGCLHSKTAHLHSPEDPPTALPDSKKPDPGNGGDDVDQECQVQAFKEYGLIELRRATNEFSTDYIVSESGEKAPNVVYRGKLENNRLVAVKRFSKLSWPDAQQFMAEAAGVGKVRHKRMVNLIGCCAEGDERLLVAEYMPNDTLSKHLFHWDKQPLPWEMRVRVAYHVAQALDHCSLENHKIYHDLNAYRILFDEDGDPRLSSFGLMKNSRDGKSYSTNLAYTPPEFLRTGRIIPESVIYSYGTVLLDLLSGKHIPPSHALDLIRGKNVLLLMDSSLEGQYANDDATKLVELASKCLQFEARERPEIKFLLTAVAPLQRQKEVASLVLMGLTKNTAVAVLPTMLSPLGKACARMDLTAVHDILLKTGYKDEEGAENELSFQEWTQQVQDILNTKKFGDIAFRDKDFKNAIEYYSKLVVMMSVPSATVFARRAFSYLMNDQAELALRDAMQAQVCIPDWPTAFYLQALALSKLGMETDAHDMLNDGAAFEAKRQDGWRWIVGLRILSIEIPGSGSSLSCGRDSHLRRRLMEYKYEVKVWKCGVKFTYVVIHGSLVWRLTLGAKFEVGKFDGAWNFGMWQRRVKDLLAQQDEVLYHVMELKSLGEGSYLQQHMNVFNQIISDLTRFDVKVEDKDKTCILLCSLPSSYEHLVTTLMYGKNSISLEAIQVALMSHSQWRQNAMGSLQDDGMYVKGKQERGRTQDKGSSGRKKSKSREHKKTMEATMWMRLTLKGEIVRVQV

SEQ ID NO: 196785 - protein, 148 aa, Glycine max
  Coding DNA Sequence Number=SeqID_80007
MTHPPHAEVPGLWDLHLPCEEKATISVNYSTEGIDPRGATTWAAEVDAGVGVAEVEGSSAGLALALLAPQIETVRSSGFQQFFLIAGNLSLEVLEWAIEIIWPEIIAPMFISKRETRPKISLALSTVKPEVCDVGAKLEYERTLRGIL

SEQ ID NO: 196786 - protein, 88 aa, Glycine max
  Coding DNA Sequence Number=SeqID_80008
MDKVDIFVPHPLTNACLLIQLSPECGCKPLVYLLKQPALLSVDFQDRSIRDYSSCTLESSTTRDPRSLNPFSEIRRREEEVSHKRGRL

SEQ ID NO: 196787 - protein, 57 aa, Glycine max
  Coding DNA Sequence Number=SeqID_80009
MGFPFAGDFSIRYSLSLVEILLSFFFEERMRILFTGQGSKWLKVVSQHGLFIVRARL

SEQ ID NO: 196788 - protein, 65 aa, Glycine max
  Coding DNA Sequence Number=SeqID_80010
MSHAVKDSRGKWAPNYEGPFVVKKAFSGGALGRAQMEARVTIDRLSPLPNSGQAKNAAARQPNIL

SEQ ID NO: 196789 - protein, 242 aa, Glycine max
  Coding DNA Sequence Number=SeqID_80011
  Gene Ontology: Mol. function=monooxygenase activity; Cellular component=intrinsic to endoplasmic reticulum membrane; Biological process=electron transport
  Homolog annotation: Hit_ID=Q1RWX2; Match level="QueryCoverage=96%, HitCoverage=58%, E-value=8e-69, Identity=55%"; Hit description =Flavin-containing monooxygenase FMO
MATTLDNPPISVSKIAIIGAGVSGIAASKQLSHHNPLVFEASDSIGGVWRHCSYNSTKLQSHRRDYEFSDFPWPQRESSEFPTHLEILDYLHSYAEHFDVLKNIRFNSKVVEIRYVGDQEDLSSSFGGLPSDHRTPLPGHPVWEIGVQKNNQSDSIQWYAFEFVVVCIGKYGDIPKIPEFACNKGPDVFKGRVMHTLDYCKLDQEAATKLLEGKKVVVVGFKKSGIDLAMECAKANQGNYSI

SEQ ID NO: 196790 - protein, 240 aa, Glycine max
  Coding DNA Sequence Number=SeqID_80012
  Gene Ontology: Mol. function=dimethylaniline monooxygenase (N-oxide -forming) activity; Cellular component=intrinsic to endoplasmic reticulum membrane; Biological process=electron transport
  Homolog annotation: Hit_ID=Q9LMA1; Match level="QueryCoverage=94%, HitCoverage=42%, E-value=4e-90, Identity=69%"; Hit description =Probable flavin-containing monooxygenase 1
MAFNCYVLQQRSGISKFIESYLLRKLPLEKYELKPEHPFEEDYASCQMAIVPENFFSEADKGKIVFKRASNWSFWSGGIEFEDNSKLEADVVVFATGFDGKKKLKSILPRPFCSLLDYPSGLMPLYRGTIHPLIPNMAFVGYIESVSNLATSEIRSMWLSGLLDKKFELPSVEKMLSQTLHEMDVMKRSTRFYKRHCNSTHSINHNDEMCEDMGWSSWRKKNWITEGFSPYSSEDYRKKD

SEQ ID NO: 196791 - protein, 312 aa, Glycine max
  Coding DNA Sequence Number=SeqID_80013
MCNPREEGVASDDASVSVFIHNDDDKANNQHSDAHFRPVDKAGGGEKAVGGGKKVAGRGKKAEHNYVNVNGSLFVTPTLLEDDIEDGYVSEQLSSDYSDEEGLALPSEPLIGPSGNDPKTGDSDRYSLYIEANPACLVTLGRVYEGSTVVHNTPLFPGQVKVGVEEVKDPDAPVPVPTDEPVVSPTKPPQKSDPELTWDATVFGVFNPDFPLYIKHEDLSEIAHGGQCLSILVLQLWIFMRAGNSDIYGFLEPQSTQRSGQSQFETESYVKSWMQSSKRDVYLRAYLNGALKGLDDAPQSKSKAPARWIVVK

SEQ ID NO: 196792 - protein, 98 aa, Glycine max
  Coding DNA Sequence Number=SeqID_80014
MRDHGSIGLSLGMGSFGGQGLTFSPWVKVYGKLGFWLKACRTAGHDICQGLASGSGMKGMSHIYSHDTHATMMIRKFYAKLVMHAPMWTLKRQVFMVM

SEQ ID NO: 196793 - protein, 64 aa, Glycine max
  Coding DNA Sequence Number=SeqID_80015
MDHFKVNALNDHLPSKKESLDSPLLKELRRSDFLFDGGRTREPHLARPQKGRLRQLATPLGIVL

SEQ ID NO: 196794 - protein, 380 aa, Glycine max
  Coding DNA Sequence Number=SeqID_80016
  Gene Ontology: Mol. function=transferase activity; Biological process= biosynthetic process
  Homolog annotation: Hit_ID=P75829; Match level="QueryCoverage=79%, HitCoverage=90%, E-value=1e-70, Identity=47%"; Hit description =Hypothetical protein ybjX
  Pfam annotation: Domain name=DUF535; Domain location=27-307; Score =220.7; E_value=3.3e-63; Accession=PF04393.3; Description=Protein of unknown function (DUF535)
  Subcellular localization annotation: CTP_CleavageSite=70; ConfidenceScore=5.57e-01
MSSIVDTPFSNLPQPKSGWQLFKNLAFGTLTPGLAWQNPAYRRKFMLRSLATPISTARLLTSLAKQPRLMQMLQVQPGLPCRLHRPWLTVKMDRQHALESLNWHYQTLSRQLPATLLAGYLSKPGYTLLTLTGKEEQQFTVRLCADAFLDKEGEATLAFCDRHNTVLAEMTFTLCQFAGKTTLFIGGLQGAKAHVPHELIQGATKACHGLFPKRLLLEAAMTLGTAFPVEQIVAVSNATHIYRSWRYRKKKEGKLLADYDSFWISIGGEKQDNGHFLLPLAMPRKPMEEIASKKRAESNRQPNANPLSRAPATARGKTSYAAESVPPPRPAFPLLSPLQWLNPVLTNDEWLWRSRAACSSGHRQAPWQFGGIRRRTPDDT

SEQ ID NO: 196795 - protein, 66 aa, Glycine max
  Coding DNA Sequence Number=SeqID_80017
MLGSALSAPVALSLNYSLPLWFYLEIAMNALSAPAALSLFITTVKILDFQMNALSGPGRAKRIHPC

SEQ ID NO: 196796 - protein, 141 aa, Glycine max
  Coding DNA Sequence Number=SeqID_80018
MKVDPSVPYKVITCVPRKGKQIGKNSWQDRTQGITWLPKLKISSGEEAEVLEESEEVQALKAKLERTRVVKEKFKMTTIRVRKECDELRDVNMTMIEALEREMKRVRKEEWAKTSSEGLYGAATTNSSFEGPKETSRGWKV

SEQ ID NO: 196797 - protein, 141 aa, Glycine max
  Coding DNA Sequence Number=SeqID_80019
MSRDCLVQFYILNLFRSPMNCVFVHVSSTHEFGAMRSDCLVQFSILNLFWSPRNCVFVHVSSTFKFGAMRSDCLVKFFIVNLFRNPMNCVFVHVSSTFEFGAMRSYFLVQFSIVNHFRSPMNCIFVHVFSTHAFAAMRIDC

SEQ ID NO: 196798 - protein, 132 aa, Glycine max
  Coding DNA Sequence Number=SeqID_80020
MCKKEHESFKEYAQRWRDLAAQVAPPITEKEIITMIVDTLPVFYHEKMVGYTPSSFADLVFTGKRIEMGLKRGKFNNPALMNEKTGANEECENEGETHAATVVPTWPSFPPIQQCHYSANNNHSPYPPPIYP

SEQ ID NO: 196799 - protein, 126 aa, Glycine max
  Coding DNA Sequence Number=SeqID_80021
  Gene Ontology: Mol. function=nucleic acid binding; Biological process= DNA integration
  Homolog annotation: Hit_ID=Q1SZQ0; Match level="QueryCoverage=98%, HitCoverage=19%, E-value=1e-16, Identity=55%"; Hit description =Integrase, catalytic region; Zinc finger, CCHC-type; Peptidase aspartic, catalytic
MAEEDALSLDNIEGGVCAEYTNVGVYGRRNSGSNKEALEMGERRLHLSWTHSERNYGTLLNPSIWQKMPQFTQHDLKMDESIAVSSIINKLSSSWKDFKHTLKHKKEELTLVQLGSHFMIEESLRA

SEQ ID NO: 196800 - protein, 71 aa, Glycine max
  Coding DNA Sequence Number=SeqID_80022
  Homolog annotation: Hit_ID=Q1T2W9; Match level="QueryCoverage=92%, HitCoverage=8%, E-value=6e-12, Identity=56%"; Hit description =Leucine-rich repeat; Leucine-rich repeat, cysteine-containing type
MLIQSFIGNDGLYGPPLTKNPDHKEQEVLPQQECGRPRSYFWSTLNLEAMEAMVLATCAQNSLSDLPSGVS

SEQ ID NO: 196801 - protein, 100 aa, Glycine max
  Coding DNA Sequence Number=SeqID_80023
HEPEIYLKAHENPRAFSCISGPIFLESSIQCPWGEGGRIALVWNPLGVPMDPKRIKVIPDWPTPPTPLIELVRNHVPSWEDAPERGVEGRSPKYQEPRDL

SEQ ID NO: 196802 - protein, 113 aa, Glycine max
  Coding DNA Sequence Number=SeqID_80024
  Gene Ontology: Mol. function=nucleoside-triphosphatase activity; Cellular component=membrane; Biological process=defense response
  Homolog annotation: Hit_ID=Q1SI25; Match level="QueryCoverage=85%, HitCoverage=10%, E-value=2e-25, Identity=60%"; Hit description=NB -ARC domain, putative
MDEPNGEQTNESEAIQTIVKNVKRLLDKTEMSVAEYPVGVEPRVQEMIELLDQKQSNDVLLLGMWGMGGIGKTTIAKAIYNKIGRNFEGKSFLEQIRKVWGEDAGQGVEYVGK

SEQ ID NO: 196803 - protein, 75 aa, Glycine max
  Coding DNA Sequence Number=SeqID_80025
MRGIVHEPQGEPLGTSTLTSRGLHVLALRGLPALALGTSYPHLQRTTCPHFQRATRPRHQRTACPHLRRASRPHL

SEQ ID NO: 196804 - protein, 332 aa, Glycine max
  Coding DNA Sequence Number=SeqID_80026
  Gene Ontology: Mol. function=oxidoreductase activity; Cellular component=integral to membrane; Biological process=electron transport
  Homolog annotation: Hit_ID=Q43071; Match level="QueryCoverage=96%, HitCoverage=76%, E-value=2e-45, Identity=36%"; Hit description =Cytochrome P-450
  Pfam annotation: Domain name=p450; Domain location=1-328; Score= -178.9; E_value=0.0079; Accession=PF00067.12; Description=Cytochrome P450
MGFALDAQVVKEILGMVGKDIVVEVRKVLHFGSLNNMMKNMFVKSYVFGEGVRKRCMSLVDKVNVFVGKIILDNGVKRVVEGEDKVRVTEGSNDFVDVLLDLEKENKLQHSDMGTSFVVQVEGTSTGVVVTENKRGHISCGSILVEGTSTWLFKENKGGYIPCGSLLVMTFTRLKRNLKDRRSLGDWIPLDPTVGIECSASDDDLPNLPYVHTIVKETLRMHIRTSLFHGPIGTTTMVNIWAISHDQDVWVELEQFKPEHFLKYEDLPIMGSDLRLTPFSSGIKVCPRKATGLATVELWLAMFLQNFKWMPYDSGVDLSECLKLFVEINTLS

SEQ ID NO: 196805 - protein, 106 aa, Glycine max
  Coding DNA Sequence Number=SeqID_80027
MEDSEHTLTTSLFLEPSPLVERIFPLGTKPHVLTLMGVSAQVVTLLIVDQGGREEDPEIDEEDLPKEKKAIFCDKTTTSEEVPQEGARWLIEESSEKDPDMQDVSS

SEQ ID NO: 196806 - protein, 49 aa, Glycine max
  Coding DNA Sequence Number=SeqID_80028
MSNRWVTVQSVVIFSTPSNYFPYMPIEFLFSYGIRCKKGFGPDVLAFKM

SEQ ID NO: 196807 - protein, 160 aa, Glycine max
  Coding DNA Sequence Number=SeqID_80029
  Gene Ontology: Mol. function=RNA-directed DNA polymerase activity; Cellular component=mitochondrion; Biological process=RNA-dependent DNA replication
MDEARHLKRKASYYVIHDGKLFKRGLTTTLLKCLNNQQIDYIMRELHEGICGLYTRGRSLDTKAVRVGYYWPTLKAEALDFIRRYRRCQEFAYVPHTPPNNLHSLSSHWPLAMWGMDILGPLPKVLGAVKYLLVAIDYFTKWIEARPLREIMANEVEKFT

SEQ ID NO: 196808 - protein, 278 aa, Glycine max
  Coding DNA Sequence Number=SeqID_80030
  Gene Ontology: Mol. function=RNA-directed DNA polymerase activity; Cellular component=chromatin; Biological process=RNA-dependent DNA replication
MGEERRKAIKEEVDNLLRANFIREVLSFLDAYSGYNQIKMHPLDVEKMAFITEDDNFCYKVMSFGLENIGLTYQRLMERVFKQHIERNVEVYKDDMVVKSQTIPQHVADLEEVFGELRKYSMRLNPEKCILGVGGGKFLGFMITYQGIEANLDKCTAILEMLGAPLLMYLLVANEVVSSTLVQEKGKHQLHIYFTSRHDAKKFHIQYEPHSPMKRQFMADSLVEFAGNDTTTLDWWTLYVDGVSNVKGSEAGIILEGPDTITLEQALELNFRASNNEA

SEQ ID NO: 196809 - protein, 91 aa, Glycine max
  Coding DNA Sequence Number=SeqID_80031
MERTLQHTLGVPLYTPENNQRNFLTTHNGTNAMIPVEVGEPSTKRLLYQQQQNEDNIRVELETTDEVREITRIKEVVKLRATRRYNTKVQP

SEQ ID NO: 196810 - protein, 396 aa, Glycine max
  Coding DNA Sequence Number=SeqID_80032
  Gene Ontology: Mol. function=RNA-directed DNA polymerase activity; Biological process=RNA-dependent DNA replication
MAPSLLSVFLLIKAKELALTESGHQVHVVSGLDFLACKAEEWTDVRLDSVGRIVLVDEDLGHYEIRYDDGDNHGVVLVDGVDALEVPIRKGCIDKINVDVLDGMQVPVLVEVVARATMTVVFVCLGLSLFFCLLPSSYVAPLDVLQVLVLLGDCLYLVASDPGPRGFIWGSRMGTSRLNASSRIVLALVFASRFCLAWWTLSTNLLGRKAKSMECNTTSKIEILDLDGYAPKFVHELSEGLVACLSQTGQGDRGHAMRPAGSALWTESFDKGVEAVYEPRFACVRKASMCSSRFVVPSYHSRLSGFHPKGHQKYCLCVGGVIPLECVQARCRRIAYCLGDVWHVPLAGCESAWGTIASKARPSANHGWMVPNFTHWLGEVPLTGGGTCKTKDSDAQ

SEQ ID NO: 196811 - protein, 94 aa, Glycine max
  Coding DNA Sequence Number=SeqID_80033
MASDTHARVYHHSDSSTCHPRILLCLQYVPPTTCAHERPVKPLGVPPTYMSPMTSDIYAKAYYQASSKTCAHEHTTMTQYMPPMMSGIYARADY

SEQ ID NO: 196812 - protein, 148 aa, Glycine max
  Coding DNA Sequence Number=SeqID_80034
  Gene Ontology: Mol. function=binding; Cellular component=spindle microtubule; Biological process=regulation of mitosis
  Homolog annotation: Hit_ID=Q8L5J4; Match level="QueryCoverage=55%, HitCoverage=15%, E-value=6e-37, Identity=92%"; Hit description =Anaphase promoting complex/cyclosome subunit
MEEYEALGGEVAESEVGEDDFGGVEEVEGAAVVAAEEEGLGLHVDVGGVGGEGGHLVGEEDGGGVEVLAHAVPHHSSKLLHLFLPHFRNFTLSLTACKGFAGSFSSLCVVQRPSCDGGLVVFLQQQCYLTGSTATTAEADAFRVSVVH

SEQ ID NO: 196813 - protein, 228 aa, Glycine max
  Coding DNA Sequence Number=SeqID_80035
  Subcellular localization annotation: CTP_CleavageSite=26; ConfidenceScore=5.59e-01
MAPPLTSSPLSSVATPWSPLQLPPITEESVSSLNGMDVLNSGHCSLSSCFLTFSCAFWLLVSFSSSSIFQRGSIEQPIMDREVISIGGSSFKDTRQGAFDSESSSLERVKVSHQTGGGASRLRERARPSATGVRRGDDDGDVRASPRVQCSISVGSMSSTPTVASYEWVKLVNTKDSCKLGVQACGSDDFLFLRAVSFYPCFSVCFVGALECDPFPASPEQLDDGASL

SEQ ID NO: 196814 - protein, 117 aa, Glycine max
  Coding DNA Sequence Number=SeqID_80036
MMHAPDLNSQMQCGTYRIQYQGNSPKRVYTTPHLGNHEVFVEATQSSTVTPPLGDQPGPTRSSLPGDTPPSTKYILPQCILFPMSYEGRSTRSMHPLMDIHNIRHMNVGTIKYNDHG

SEQ ID NO: 196815 - protein, 353 aa, Glycine max
  Coding DNA Sequence Number=SeqID_80037
MGLPLNSVSKKLFEFDSNIFHHFKDHFFKVLATGVVADDMSLMFNRDGEPCFLFYWQSDPTRFKLYNEDLLTRVERVGKAMEQLPASLGMRAILSLLSVNDPFVVVDGKVPDLTLVWCRRMTNMCLCYCLACFASIMGDFACRPLMMQVGPVRETVSPSAATPSAGEGGQPAGEVGPVVAVVEVTLVLLPLSWQRRRGMIVLGHLATRSRRPLESLCPEVGCRVDAHCGSPFNCVRCPFGSIGYRGSYCCCCDSCYSCFFTFTCCYCCSRATQVDSIVVSLFTVAAPLLSDGVIATNAPTVLPPSSTTLMVSPSTVLVAVVSPSSSSHPRILLDHLYTFSDVDSLWGATYKPE

SEQ ID NO: 196816 - protein, 164 aa, Glycine max
  Coding DNA Sequence Number=SeqID_80038
MEQHEKGFQKVVRQAKFFMKDLDLGLFDPFKDVNDGVLLDQEEIATEEEEAADEGQGVVEQDHGGLVKSRMAQSYLKFDFNLIKGLVTHLAGLLSILWSFSPYVSPLMVVRNEFELHLNKGLSCYRVVGHLDLQKYSSDVELRPLMVVVIVAAYERPKGIPWVL

SEQ ID NO: 196817 - protein, 160 aa, Glycine max
  Coding DNA Sequence Number=SeqID_80039
  Gene Ontology: Mol. function=binding; Cellular component=thylakoid; Biological process=photosynthesis
  Homolog annotation: Hit_ID=Q1T5W2; Match level="QueryCoverage=79%, HitCoverage=27%, E-value=2e-59, Identity=84%"; Hit description=TPR repeat
MQYDKENVVEAKFRDLENESCKSDQSDSSFLRTLKSNTDLLACKAEYYYQCGEYQKCFELTNDLLEKDLFHLKTTLVHLAAAVELGHSNELYLMSCNLVKDYPQMALSWFAVGCYYYSIKKYDQSRRYFRASPGAAVKLCLGDLLVMGSNPETASLHMQG

SEQ ID NO: 196818 - protein, 162 aa, Glycine max
  Coding DNA Sequence Number=SeqID_80040
MPGPYMGRGRCDNLRRWATVVEGKHQQKSTKKSAKQVQSRRVVLFIAKRDCAKKENEGEPSNQHGMTPSFRDRLWALLMVGSSAREVAIALVVADNIDRKCCQKIQKQIVKGEKVPKALECGDNSQENGRSRKVHQGQQVHPGNPRPTVPSGARFSLFLCQE

SEQ ID NO: 196819 - protein, 96 aa, Glycine max
  Coding DNA Sequence Number=SeqID_80041
  Gene Ontology: Mol. function=hydrolase activity, hydrolyzing O -glycosyl compounds; Cellular component=extracellular region; Biological process=carbohydrate metabolic process
  Homolog annotation: Hit_ID=Q1R5Y4; Match level="QueryCoverage=98%, HitCoverage=45%, E-value=6e-30, Identity=57%"; Hit description =Probable bifunctional chitinase/lysozyme
MKLNLATKALFCMGLTCAALPAFALEAWSGQEGGSTYEVIFDGGVYKNAWWVGASDCPGNAANDQANNPWRFERNATAAEMDKYGNPVTCETSGGT

SEQ ID NO: 196820 - protein, 82 aa, Glycine max
  Coding DNA Sequence Number=SeqID_80042
MVHDDTFIVPDPPQEPIHPAAMPKPPAPIATDVDMPRHAVDTCQKTAESLECMIGMRMATARTEAYTLTEHYLRLARGVTEQ

SEQ ID NO: 196821 - protein, 151 aa, Glycine max
  Coding DNA Sequence Number=SeqID_80043
MKHHMLSTNLRTPPKQRNFKGSTFSEIAMKETEQNEEEEISKNMNEGATNKHSKEREREREREREREKRVNEESLPYIRRSRPSWTWLQRRREKVRGERESVSTKRIGTVRSSVQLNPGRWFQPDMTACMCHHPSVVVVRVRSIEKENILP

SEQ ID NO: 196822 - protein, 73 aa, Glycine max
  Coding DNA Sequence Number=SeqID_80044
MTVVAAATDSNNHVGGNDDDHSNSGDDDNGDNNHIDRLVVMVTIDDHDGDCSSGYDNYGENNHDESLRYLRIS

SEQ ID NO: 196823 - protein, 979 aa, Glycine max
  Coding DNA Sequence Number=SeqID_80045
  Gene Ontology: Mol. function=endonuclease activity; Cellular component=nucleus; Biological process=regulation of transcription, DNA-dependent
  Homolog annotation: Hit_ID=Q9FHU7; Match level="QueryCoverage=92%, HitCoverage=94%, E-value=1e-162, Identity=40%"; Hit description =Similarity to nonsense-mediated mRNA decay trans-acting factors
MEGLSEDDILSLSDSDSCFEELIEERKTVLRQELAKITCNASEEDDESASFLDIVFSWSLKDALNEDLYKHKVQRIPETFMSTSDYLNSFIPPLIEETRSDLCSSLKGVSRAPICEIWTVIRDRFFKLPNSLFYLIKLKTRTDEVEDEVKEDIGSYEPEPGDIFAFTDIRPKNIGDLINRPKLSYVIAYVCGRKDANTNEIPIRASKCLEMDIEFEFSRLNKNETTQLRSYIEETNQPRNTKQKLYATYLLNLTTNIRIWKALKYKGEEANMNIIKDVLQPDLSVVMKRGVDCQNCKCRKSVIPVCKWYPLRSQNLNESQEVAISSCLTMCDHMVTKLIWGPPGTGKTKTLACLLRCLLRVRHRTLACAPTNTAVLEVAARLRNLVNGSLGFDTYGLGDIVLFGNKSRMKVDSYTGLRDVFLDHRVQNLSKCFDPLSGWKHYLESMIQLLEDPKEQYSSYEKEKGIVSFKDFVMQNYPSFGLQFHASKEGWELQSTDSIITEYVMQKRKDIVEQFLLDQQKKKKNMMTMEQFLLHQQEKKKNMMTMEQFIVERFGEFAAKLMFFMQILYTHLPKSFLSLEVVMKMFSVKDILTSLESKLKLILCGCKEEKNIIDCFQSSSGKCLSMLRSVSSAIPNTDFLAKGGIEKFCLQNASIILCTASGSIKLYAEDMTPIKYVIIDEAAQLKECESVIPLKLPGLKHIILVGDEKQLPALVKSKIAEKADFGRSLFERLVLLGDSKHMLNVQYRMHPSISLFPFSEFYDEKISDGPNVLERSYNERFLEGEMYGSYSFINVSKGKEQFGRGGYSSKNMVEAAVISEIIRSLKKEYLRSRKKVSIGIISPYNAQVYEIKEKVEKYNSVSFPDFSFSVRSVDGFQGGEEDIIIISTVRSNGSGKVGFLSNRQRANVALTRARYCLWIIGNATTLVNSDSVWRKVVLDAKIRDCFYNAEDDKKLALAIELELLEESESRFKKLSLWDK

SEQ ID NO: 196824 - protein, 63 aa, Glycine max
  Coding DNA Sequence Number=SeqID_80046
MLPMQENNRNELERLDKERQADFLNMLKGFVVNQRSNVLVLDDAMLAMRGKHDERERLESKSK

SEQ ID NO: 196825 - protein, 114 aa, Glycine max
  Coding DNA Sequence Number=SeqID_80047
  Subcellular localization annotation: CTP_CleavageSite=34; ConfidenceScore=5.50e-01
MKNTTLHYSTLHYATLVLQQTLSIQRTAKSPRVSQSLQQKQTKVLGLTTSSPNRPRYSIEQQSLEEMYLGKVAMEKKKRLVTIFNAMEKKKLRRRTREVRRRRREREQNRSRLI

SEQ ID NO: 196826 - protein, 99 aa, Glycine max
  Coding DNA Sequence Number=SeqID_80048
ITHTRGGDRTKPTTSVCRHERCVVVDEEQEIYEAPEHVATDDVAPQDVVFGGVLEDKLVLIEYADHVACKLWDDLDHEEFKLVAHGRKLRDLGPLIRRS

SEQ ID NO: 196827 - protein, 73 aa, Glycine max
  Coding DNA Sequence Number=SeqID_80049
MLTRNEQVKKTMFQAWRNEEIKLWTSEKDKVTMPILKNWEVQETNWESYNDSGLVASPIPKVLLYMHNYLPSY

SEQ ID NO: 196828 - protein, 556 aa, Glycine max
  Coding DNA Sequence Number=SeqID_80050
  Gene Ontology: Mol. function=RNA-directed DNA polymerase activity; Cellular component=nucleus; Biological process=RNA-dependent DNA replication
  Homolog annotation: Hit_ID=Q1RXD8; Match level="QueryCoverage=99%, HitCoverage=76%, E-value=9e-70, Identity=27%"; Hit description=RNA -directed DNA polymerase
MDEFYVTESFSKGCNASFLALIPKVADPQALDEYRPISLIGCMYKIVAKVVEEAKRSKKPCIVFKVDYEKVYDSVCWKFLLYMLSRLGFCSKWIQWIKGCLIFASVSVLINGSPLPKFIPQRGLRQGDLLAPLLFNIVVEALTGLASMENIKTIKAILRTFELASSLKINFAKSSFGAIGMPDRWKREAVGANPRRYQMWDPILRKCERKLARIPKKALDKLVSIQRKFLWGGLGIKDINFFNLALLDKWKWDLFQHEGKLWARVLESKYGGWRSLDIPSRDKVKFWEDTWIDGEVSLAAKYPRLYSISCQQNQIIQQLGGYNGLEWEWNLSWRRSLFDEIPMADSFLKDIDSKPIQMHKSDDLVWLADPSGLYSAQSAYILLRGEATLGIQDKAFEELWKLKVSSNILVFAWRLFRDILPTKSNLHKRQVEIIDRSCPLCNGVEEDVGHLFFQCSKTIPIWWESLSWLNIAAPLPQNPRHYFLQIGSISVDGMRATRWKCWWLAMTWTIWQHRNKLIFSNDRFNGNKLMDDATFLLWTWPRNFEKDFSIHFNHWS

SEQ ID NO: 196829 - protein, 282 aa, Glycine max
  Coding DNA Sequence Number=SeqID_80051
  Gene Ontology: Mol. function=nucleoside-triphosphatase activity; Cellular component=membrane; Biological process=defense response
  Homolog annotation: Hit_ID=Q1SI25; Match level="QueryCoverage=100%, HitCoverage=43%, E-value=8e-93, Identity=64%"; Hit description=NB -ARC domain, putative
  Pfam annotation: Domain name=NB-ARC; Domain location=1-186; Score= -37.5; E_value=6.8e-08; Accession=PF00931.13; Description=NB-ARC domain
MGGIGKTTIAKAIYNKIGRNFEGKSFLAHIREVWEQDAGSRIIITTRDMHILRGRRVDKVFRMKGMDEDESIELFSWHAFKQASPREDFIELSRNVVAYSAGLPLALEVLGSYLFDMEVTEWKNVLEKLKKIPNDEVQEKLKISYDGLTDDTEKGIFLDIAYMGREIIRSKTPMELEERSRLWFHEDALDGTKAIEGLALKLPINNTKCLSTKAFKEMKKLRLLQLAGVQLVGDFKYLSKDLRWLCWHGFPLACIPTNLYQGSLVSIELENNNVNLLWKEAQ

SEQ ID NO: 196830 - protein, 103 aa, Glycine max
  Coding DNA Sequence Number=SeqID_80052
MGGGDGGDGKRGRIMVERGGGGADVEADEGPSFAAPGASQGRRPGFCRNKSGVVRNRCGFGHGGGRHRSMAEETLVQVEVRRVHDIVKMSKGLVEVAEGHEDK

SEQ ID NO: 196831 - protein, 292 aa, Glycine max
  Coding DNA Sequence Number=SeqID_80053
MDNHKATIKLTGEGRMIYNHFISPASLRMRQRKHYGSISNNMVTYGKCSCPDTGTRLMYVNIPRYGRAKDAQILPEGTNDTQPQGAAQTSITHQGHRLEDDFLWDIGADISLKYMGDDMVLLLCLSDDRAKRIMEEETEGGLSLFHSLEKWNPKLCPGCQLTWVNCWGIPLVAWNTEHIRKIVSGIGDLVDVDDDVEVLQRLDRARILIKTPWKLIIQHTVNVHIREEVYGVHIVEEGGSCPETHHCRCRRVYGSSEEIATDVSDVGTPLMEASRTLVEDGGFNATSIRRHV

SEQ ID NO: 196832 - protein, 194 aa, Glycine max
  Coding DNA Sequence Number=SeqID_80054
MCFTCDERYPKGHYGVSKASLLVAEDEDSNCLNTDPVDPTSDPKPTPDPSPKLKPDPDPKPTPNPHPIHSAQISLTFFSGDLASRNLRPADLLSGNRVVLLTDGRSTHTFFQPPLSIFLSLPCRTAPTPLRVMFFPHGHFVELQVRQNKPWDPGSDREAYSSRQSAGGASRNNDRETYSSKKQSAGGANRNKQE

SEQ ID NO: 196833 - protein, 256 aa, Glycine max
  Coding DNA Sequence Number=SeqID_80055
  Gene Ontology: Mol. function=nucleoside-triphosphatase activity; Biological process=defense response
  Homolog annotation: Hit_ID=Q1SI25; Match level="QueryCoverage=62%, HitCoverage=17%, E-value=9e-46, Identity=60%"; Hit description=NB -ARC domain, putative
MATSDGGGCLLAGDSYPYWLTFNSEGSSMTFEIPQVKGRNLKKMMCHVHYSSPENITSDGLKNLLVINHTKAIIQLYKRNALVSFEDEEWQGVLSKIEPGNKVQIVVVFWSKLTVYKTTIYLIYEPMNEKIEHSRALNKNVMDSSGDENECVVGTISLQVESIYKPTNDIMEHCHASNKNAIVSSSDENACVVRPSSPQVESIDDLRWINCVFREVIKQVDNLGSLSMYLCGSLISCGMRCMTPIMVITLTALLVN

SEQ ID NO: 196834 - protein, 79 aa, Glycine max
  Coding DNA Sequence Number=SeqID_80056
MAVRVSREYGLHQMWGFKQPRLHSKGLRIDLGTVEEKNPLGFLIEGIAADKDNAGNNLASACLFILYCYDPLIEEVITF

SEQ ID NO: 196835 - protein, 235 aa, Glycine max
  Coding DNA Sequence Number=SeqID_80057
  Gene Ontology: Mol. function=RNA-directed DNA polymerase activity; Biological process=RNA-dependent DNA replication
MAREGETVVTSGSHPTEKRHIDDRLMKRGARRDQGSITNNQKRKWWALLTSPAKNLEDLKLELPLAWEPMCSESSSFEAFWLDDVEEGEELGANLDECGSQRFGNLSQKIKRLRKKLYKIQRSPWVSFLTNTKVEIEGELEELLRLEEVLWKQRLKVEWLMYVDRNTTFFHRKTSHRKQVNTIKKIQDGDGNVYRNVEDISEVLTKYFSDLFTSSPPHDMTEIASLVEGRNYGEM

SEQ ID NO: 196836 - protein, 166 aa, Glycine max
  Coding DNA Sequence Number=SeqID_80058
MKKNHSKTTKVEVTVLLIQLSKFYLQLYILFVVTETTVEVVVAVSMELQITSESQRNQNTNTGFSSKVPNGKSSTDEEGISLTCLALVYVPHCLVYSGEGGAHPILGIKSHEFCNMYRGPILKRGMPVSNLCGSHFQEANNAEKNPQINHPSFSLRFSCELHILLR

SEQ ID NO: 196837 - protein, 128 aa, Glycine max
  Coding DNA Sequence Number=SeqID_80059
  Pfam annotation: Domain name=DUF1475; Domain location=2-128; Score= -30.0; E_value=5.7e-05; Accession=PF07343.2; Description=Protein of unknown function (DUF1475)
MAAKISLAIGLRTLFTVLGLLMLAIVLYTVFTDGLPFRKELLTPWMAATLIDFYINVVALAVWIAYKESNLISSILWIVLLVCLGSITTSAYIVVQFLKLSSQESSQDPMYYVLLRNPNKYVYRSTTI

SEQ ID NO: 196838 - protein, 196 aa, Glycine max
  Coding DNA Sequence Number=SeqID_80060
MYDDGNEEDNEYDSLDIKVEERKLGQYDSPTFILSKRATTGNEGPQASNDKVKGQGTIFEGPLDVVKKAWRPRKGMKKKDKLASSATLKNKVDKVVVKGIENITMVSRKERVEFHTTVIPEQNRGIGFIDNREGFHYSSRPPDQPIVKSSSHKPPDSQNIHMDCVNEGNSKIEVVMETTLSQGVARKDSKFDVFDQ

SEQ ID NO: 196839 - protein, 75 aa, Glycine max
  Coding DNA Sequence Number=SeqID_80061
MVREGEACMWKKALAAFVWINRRSCGGEMASKSLVHMQISGEGIALCRNLPFGGRATRGLTGASSMGGRCAESPP

SEQ ID NO: 196840 - protein, 770 aa, Glycine max
  Coding DNA Sequence Number=SeqID_80062
  Gene Ontology: Mol. function=RNA-directed DNA polymerase activity; Cellular component=chromatin; Biological process=chromatin assembly or disassembly
  Pfam annotation: Domain name=Chromo; Domain location=661-714; Score =20.9; E_value=0.0033; Accession=PF00385.14; Description='chromo' (CHRromatin Organisation MOdifier
  Pfam annotation: Domain name=rve; Domain location=420-547; Score =46.6; E_value=8.5e-11; Accession=PF00665.16; Description=Integrase core domain
  Pfam annotation: Domain name=zf-H2C2; Domain location=364-402; Score =24.0; E_value=0.00024; Accession=PF09337.1; Description=His(2) -Cys(2) zinc finger
  Pfam module annotation: Pfam domain module=Chromo::rve::zf-H2C2; Domain location=661-714::420-547::364-402
MAHMLHSGIIKLSTSPFLALNALTIKDRFPIPTIDELLDELGGATWFSKLDLMQGYHQTLMAESDIAKTAFRMHHGHYEFLVMLFGLYNAPSTFQVEYLGHMVSCRGVEPVPAKITAVQNWPVPQSTRALRGFLGLSGFYRRFIKGYASLAAPLTTLLAKDSFHWNADADQEFCNLKQALCNSPNNHPIAFFSKPFCPKLLRASTYVRELAAITTAVKKWRQYLLGNSFIILTDHHTLKELMSQVIQTPEQQRYLARLLGYDYSIHYHTGRSNATADALSCQMEANSPQFFLLTVPNSLFLQELKQELLRNSAFIDFRNQIQANPSQYPEHSIRHDFILHKGRIWLPKDLQAIPTILVEFHNTHTGGHMGIAKTLGHISENFVWPSMKQDVKLFISSCLICQQTRNDHRKSPGLLCPLPIPKKPWEDLSLDFIVGLSPFQGHTTILVVVDHFSKGLHIGLLPAHYTMTTVARIFMEIVGKIHGMPRSLVSDRDPLFMSRFWLELFKLSGTKLKMSTAYHPQTDGQIEWSYNTSIHSATGKSPYEITFGKKPPNLPQYVAGDSNVTAVNDWLTERDNMISKLTKHLSKAQQKMKESADKHRRDLQFEEGAIGPMAHKLDLPESSRIHPVFHCSLLKPYTPSTTPPEVPLSLPASSEDHQPLIFPLAILDTKWTQSEEESELLVLVQWAGLLPEDTSWEPWTQLKTDYNLENKTKLPQGLRKQVVVQNVSCSGNIAPDGSGTPEDVLLLEFVRTVKTMFRFYHFATFLFLQG

SEQ ID NO: 196841 - protein, 236 aa, Glycine max
  Coding DNA Sequence Number=SeqID_80063
  Gene Ontology: Mol. function=ferredoxin hydrogenase activity; Cellular component=periplasmic space; Biological process=electron transport
  Homolog annotation: Hit_ID=Q8W4Z5; Match level="QueryCoverage=85%, HitCoverage=96%, E-value=2e-48, Identity=50%"; Hit description =Hypothetical protein f16
  Pfam annotation: Domain name=DUF588; Domain location=60-201; Score =166.9; E_value=5.2e-47; Accession=PF04535.3; Description=Domain of unknown function (DUF588)
FGNSLGNEWLPFNDMMYIQCCDCPAGLGHCFIGGVLETSRSCKQLIGPEGSDKEFEGYIDSNLRVVETFLRLFPIGLCVTALVIMLKNSQENKYGSVSYTDLGAFRYLVHANGICAGYSLFSAIFVALPRLSSMHIAWTFFVLDQVLTYIILSAGAASAEVLYLAEKGNMATAWSSACRSFGPFCHKVTASTTITFVVVVFYVLLSLISSYKLFSKYDAPTVSNPSMGADIVAFHG

SEQ ID NO: 196842 - protein, 251 aa, Glycine max
  Coding DNA Sequence Number=SeqID_80064
  Homolog annotation: Hit_ID=Q10L97; Match level="QueryCoverage=33%, HitCoverage=25%, E-value=2e-30, Identity=75%"; Hit description=NAD dependent epimerase/dehydratase family protein, expressed
MGEDFLRRSGIPFTIIRLTDGPYTSYDLNTLLKATAGQRRAVLIGQGDKLVGETSRIVVAEACVQALDLEVTENQVYEVNSVEVCCGGRRRQTRYAEGGAFVANVRITYGSACGANEPHVDCSDAFNTSQVFECQEDVLWWARSVAHENGFVVVILRSDRNTDTRTRKCGCPFKLRCKPVVGGEGWMVKLICGVHSHELAKSLVGHPYAVRLTKTEKTLIVVSQHALSRASECEAHGCAFQRRKDARSRHQ

SEQ ID NO: 196843 - protein, 110 aa, Glycine max
  Coding DNA Sequence Number=SeqID_80065
LIDVTDRAKKDEIVKVVMALKHAKIDEGYTIDVVATRQGEGLKIFQLALDPNAIEMHHRITVRGRLRKKFYELKGNTQSPPKLMSILNSLFDGWDPMRSVSAPARALVQW

SEQ ID NO: 196844 - protein, 47 aa, Glycine max
  Coding DNA Sequence Number=SeqID_80066
MELRVQKLRVQKKMGKAFPKILAAPAILSAVEDGLENYLDTFHMHSS

SEQ ID NO: 196845 - protein, 58 aa, Glycine max
  Coding DNA Sequence Number=SeqID_80067
MDGSGSHGGTLQLLIFVMSTILQVNVTDKRKMKNKRDRYSSKNNFLTKLKNISNVMKE

SEQ ID NO: 196846 - protein, 270 aa, Glycine max
  Coding DNA Sequence Number=SeqID_80068
  Gene Ontology: Cellular component=nucleus
  Pfam annotation: Domain name=Bromo_TP; Domain location=36-111; Score =65.6; E_value=1.5e-16; Accession=PF07524.3; Description=Bromodomain associated
MENNSSTNATSKLPRRAKRKKKGLGVNVAQVADNTSEFSFAIAKTAVAQICQSVGYKISKHHALEALTNVSTRYMEAIVRSASSFANASNRTDSNLFDLINGIHDLCSVLGFPGGSMIHKSNLLGSSALKEIMNFVNLSNKIPFAKPIPFRNVSEVTIDSGTSMCLSKQAKTHIPRWLPDFPKENCNRVLVKERKCDEKLWEHLLAAEENSGLLRSNDINGKEGKNARMELPKGRERMKFKIRGEKKKHGGLGVNMMNGDCKGKTSVLEL

SEQ ID NO: 196847 - protein, 91 aa, Glycine max
  Coding DNA Sequence Number=SeqID_80069
MVKRMKILLITYLKISTKTKTFMRKNVGVKMRLMWLEDPKPIIMSIKTYVSISHTKDPIIPIIESSPHLYLALSHLCPSLIIVLAQIPRSF

SEQ ID NO: 196848 - protein, 194 aa, Glycine max
  Coding DNA Sequence Number=SeqID_80070
  Gene Ontology: Mol. function=nucleotide binding; Cellular component =membrane; Biological process=small GTPase mediated signal transduction
  Homolog annotation: Hit_ID=Q43463; Match level="QueryCoverage=99%, HitCoverage=89%, E-value=7e-66, Identity=68%"; Hit description=Ras -related protein Rab7
  Pfam annotation: Domain name=Miro; Domain location=10-137; Score=3.8; E_value=0.0023; Accession=PF08477.3; Description=Miro-like protein
  Pfam annotation: Domain name=Ras; Domain location=10-187; Score =124.0; E_value=4.1e-34; Accession=PF00071.12; Description=Ras family
  Pfam module annotation: Pfam domain module=Miro::Ras; Domain location= 10-137::10-187
MSLRRRTLLKVIVLGDSGSVWTLANCVDTCTRSLVSNIRLPLELILSPKSFRLTTDLSLYKWVSFPVSTIWDTAGQERFQSLGVAFYRGADCCVLVYDVNVMKSFDTLENWHEEFLKQANPPDPRAFPFILLGNKIDIDGGNSRVVSEKKAKDWCAAKGNIPYFETSAKEDYNVDAAFLCIAKAALANEHEQDM

SEQ ID NO: 196849 - protein, 263 aa, Glycine max
  Coding DNA Sequence Number=SeqID_80071
  Gene Ontology: Mol. function=pseudouridylate synthase activity; Cellular component=nucleus; Biological process=tRNA processing
  Homolog annotation: Hit_ID=Q75M65; Match level="QueryCoverage=72%, HitCoverage=39%, E-value=2e-28, Identity=41%"; Hit description =Putative pseudouridine synthase
  Pfam annotation: Domain name=PseudoU_synth_1; Domain location=86-233; Score=26.8; E_value=2.8e-05; Accession=PF01416.10; Description=tRNA pseudouridine synthase
MTTQLSDTELIATLQARAKELEAENAKLLSQLADCRCHEMEKKLHIPDEKGRESKKGNRKSEEKIEKMPGYNTRFMSHHSKRYVALKVTYFGKRFYGFASEAQMEPTVESELFKAFEKTRLLVGDKKESQYSRCGRTDKGVSSVGQIPPITIIVLLKSKDLYGKCYGRKDEVIALFLRSNLKISATNNGNSGVVLDEQHGEIDYVGVLNRVLPNDIRIMGWCPAPVDFHARFRIMIAISNARQGNYFPVSCIMGWKQLWQHWT

SEQ ID NO: 196850 - protein, 127 aa, Glycine max
  Coding DNA Sequence Number=SeqID_80072
HLEEKANALADQGEWALFIDVLALLVFGAVVFPTVDGLVDLATIDTFHTYHHSKESLVMAVLANAYDTFNRRCEKSGARIVCCTPTLYVWMVSHLFHHESRPVYPLQGHHICPEKGKANWEHLLPIW

SEQ ID NO: 196851 - protein, 676 aa, Glycine max
  Coding DNA Sequence Number=SeqID_80073
  Gene Ontology: Mol. function=binding; Cellular component=thylakoid; Biological process=photosynthesis
  Homolog annotation: Hit_ID=Q5QNE5; Match level="QueryCoverage=87%, HitCoverage=88%, E-value=0.0, Identity=56%"; Hit description =Tetratricopeptide repeat protein-like
  Pfam annotation: Domain name=TPR_1; Domain location=204-237; Score =18.5; E_value=0.024; Accession=PF00515.18; Description =Tetratricopeptide repeat
  Pfam annotation: Domain name=TPR_1; Domain location=238-271; Score =31.1; E_value=3.8e-06; Accession=PF00515.18; Description =Tetratricopeptide repeat
  Pfam annotation: Domain name=TPR_1; Domain location=348-381; Score =4.5; E_value=1.6; Accession=PF00515.18; Description=Tetratricopeptide repeat
  Pfam annotation: Domain name=TPR_1; Domain location=396-429; Score =19.1; E_value=0.016; Accession=PF00515.18; Description =Tetratricopeptide repeat
  Pfam annotation: Domain name=TPR_1; Domain location=442-475; Score =9.9; E_value=0.36; Accession=PF00515.18; Description=Tetratricopeptid e repeat
  Pfam annotation: Domain name=TPR_1; Domain location=476-509; Score =35.0; E_value=2.7e-07; Accession=PF00515.18; Description =Tetratricopeptide repeat
  Pfam annotation: Domain name=TPR_1; Domain location=510-543; Score =9.3; E_value=0.41; Accession=PF00515.18; Description=Tetratricopeptid e repeat
  Pfam annotation: Domain name=TPR_2; Domain location=204-237; Score =22.2; E_value=0.0019; Accession=PF07719.7; Description =Tetratricopeptide repeat
  Pfam annotation: Domain name=TPR_2; Domain location=238-271; Score =27.4; E_value=5e-05; Accession=PF07719.7; Description=Tetratricopepti de repeat
  Pfam annotation: Domain name=TPR_2; Domain location=348-381; Score =5.2; E_value=8.2; Accession=PF07719.7; Description=Tetratricopeptide repeat
  Pfam annotation: Domain name=TPR_2; Domain location=396-429; Score =19.8; E_value=0.0097; Accession=PF07719.7; Description =Tetratricopeptide repeat
  Pfam annotation: Domain name=TPR_2; Domain location=442-475; Score =21.6; E_value=0.0028; Accession=PF07719.7; Description =Tetratricopeptide repeat
  Pfam annotation: Domain name=TPR_2; Domain location=476-509; Score =21.2; E_value=0.0037; Accession=PF07719.7; Description =Tetratricopeptide repeat
  Pfam annotation: Domain name=TPR_2; Domain location=510-543; Score =14.1; E_value=0.53; Accession=PF07719.7; Description=Tetratricopeptid e repeat
  Pfam annotation: Domain name=TPR_4; Domain location=238-263; Score =20.3; E_value=0.0071; Accession=PF07721.5; Description =Tetratricopeptide repeat
  Pfam annotation: Domain name=TPR_4; Domain location=396-421; Score =5.0; E_value=9.4; Accession=PF07721.5; Description=Tetratricopeptide repeat
  Pfam annotation: Domain name=Thioredoxin; Domain location=594-673; Score=15.1; E_value=9.7e-06; Accession=PF00085.10; Description =Thioredoxin
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_2::TPR_4::TPR_4::Thioredoxin; Domain location=204-237::238 -271::348-381::396-429::...
  Pfam module annotation: Domain location=442-475::476-509::510 -543::204-237::238-271::348-381::396-429::442-475::476-509::510 -543::238-263::396-421::594-673
MSHSRKPVSSELGFTERFRDSLSCSDDNTNKPDFRELDLGSPVSTLRPRHYHSAPTTTSSTSTSTSSGSTGSGSGRSGNNNAVSKRSHSGELSGSSETNSPTRVSKPGHRRSNSGQSQRSPSSSSSSAAVNSPPLSVLPAGNICPSGRVLKAATAAVAPSRSSRSDVLGSGTGNYGHGSIMRGGKGGGGGDVRIAGDSAKRVDPEEVKRMGNAEYKRGHFAEALCLYDRAIAMSPGNAAYRSNRAAALTGLGRLPEAVRACEEAVVLDPNYGRAHQRLAMLFLRLGQVEDSRKRLCYPGLQPDPAELQKLQIVEKHINKCGDVRRIRDWKSVLREVDAAVAAGADSCVQLFMCRAEALLKQHQMDDAESCLSQIPKSEPRPGSLSQARFFGMFSEAYCFFVRAQIEMAFGRFENAVTAAEKASQIDPRNVEVAVLLNNVRMVARARLRGNDLFKSERFTEACSAYGEGLRLDPSNSVLYCNRAACWFKLGQWERSIEDCNQALCILPNYTKAILRRAASNSKLERWEEAVTDYELLRRELPDDNEVAENLFHAQVALKKSRGEEVHNLKFGGEVEDISGLEQFRAAISLPGVSVVLFETASNMQCKQISPFMNTLCSRHPSINFLKVDIQTSPAVAAAENVRVVPTFKIYKNGSRVKEIICPSHDMLEHSIRHYSL

SEQ ID NO: 196852 - protein, 137 aa, Glycine max
  Coding DNA Sequence Number=SeqID_80074
  Gene Ontology: Mol. function=transferase activity
MKSLVWRLAHECLPTRANLRSRGVDCFLVCPLCENDVETTFNIFFDCQRELLMVLTLVMSSHEKVKLSHPSSTTEGSCVALEHVEKAERYALGAQRETGGSKNNVEEAMYESGRRSDVGFGSCAGIRIIHWPSSHCV

SEQ ID NO: 196853 - protein, 63 aa, Glycine max
  Coding DNA Sequence Number=SeqID_80075
  Gene Ontology: Mol. function=RNA-directed DNA polymerase activity; Cellular component=mitochondrion
MPKSGKALEANGTWTLTMLPKGKKPIGCKCVYKRKYNFDGIIERYKARLVAKGYNQVEGMDIT

SEQ ID NO: 196854 - protein, 148 aa, Glycine max
  Coding DNA Sequence Number=SeqID_80076
MPPSLGLEHWIVDTLIDQANHCWNSNLIKQVYNTQDVQHILSLVLMDINDILAESDKELLALIQEWEKPSSNFLKLNIDAALFIDQQCFGLGLCIRDHSSGFVRAKSFLLQDSKIVVDEFNKHLLYQDVNLFCSETSQPSCSFSCKRI

SEQ ID NO: 196855 - protein, 119 aa, Glycine max
  Coding DNA Sequence Number=SeqID_80077
MALVAIPWLFWFLIFLYRCCFKPNDGKFDNRGKVAATPNCALTAVVTNPCGEKSPDHSVEDRGHHVHFGAVVEMGNEIQEHHYEEGGDKLQRESKEETTIPSLVMIESRESEKIPLKSQ

SEQ ID NO: 196856 - protein, 223 aa, Glycine max
  Coding DNA Sequence Number=SeqID_80078
  Gene Ontology: Mol. function=pseudouridylate synthase activity; Biological process=tRNA processing
  Pfam annotation: Domain name=AT_hook; Domain location=66-78; Score =14.9; E_value=0.061; Accession=PF02178.9; Description=AT hook motif
MRMLRWMCGKTRQDKIRNEAIRERVGVAPIVEKMVENRLRWFGHVERRSVDSVVRRVDQMERRQTIRGRGRPKKTIREVIKKDLEINGLDRSMVIDMLLDTSRILRKPQYTMASEVPLVLQSCEFDNIKFMCSSDAGEALRVHLVNECQIYQLQAAIFHEALLNCVPLSNGPANAFANYFPITLLLFIVIYYADSPSFSRSKLAAFSRIQEESFPCPSYVTTN

SEQ ID NO: 196857 - protein, 96 aa, Glycine max
  Coding DNA Sequence Number=SeqID_80079
  Gene Ontology: Mol. function=actin binding; Cellular component=F -actin capping protein complex; Biological process=actin cytoskeleton organization and biogenesis
  Homolog annotation: Hit_ID=Q9M9G7; Match level="QueryCoverage=69%, HitCoverage=26%, E-value=6e-24, Identity=80%"; Hit description =Probable F-actin capping protein subunit beta
  Pfam annotation: Domain name=F_actin_cap_B; Domain location=1-96; Score=-157.6; E_value=0.071; Accession=PF01115.8; Description=F -actin capping protein, beta subunit
MEAAMGLMRRIPPKHTETALSALLSLMPDNSSDLLSQVDQPLQVLCDVECGKEFILCEYNRDADSYRGKDTASWLCLGEKSERERGKMEEMIFHDD

SEQ ID NO: 196858 - protein, 103 aa, Glycine max
  Coding DNA Sequence Number=SeqID_80080
MVMLAALMIIETPIVIAMAMVMVVIGEGDIGGSKNDDDVVVMSVVSVATVIGGNNTNGNGGGDNNVCCDGDVDGIDNDNGCAIVVTNSYDNHNNDSGVMMVKT

SEQ ID NO: 196859 - protein, 521 aa, Glycine max
  Coding DNA Sequence Number=SeqID_80081
  Gene Ontology: Mol. function=nucleic acid binding; Cellular component= nucleus; Biological process=mRNA processing
  Homolog annotation: Hit_ID=Q8LKG6; Match level="QueryCoverage=68%, HitCoverage=76%, E-value=6e-70, Identity=47%"; Hit description =Cleavage stimulation factor 64
  Pfam annotation: Domain name=RRM_1; Domain location=163-233; Score =100.3; E_value=5.7e-27; Accession=PF00076.12; Description=RNA recognition motif. (a.k.a. RRM, R
  Subcellular localization annotation: CTP_CleavageSite=43; ConfidenceScore=5.15e-01
VVYESVGFPTEGNNNQSSTVEDVATSSLSSALWAFVESIPTTPASAAESALVNRALNRMSSFSRLKIKHTNIAASGNIRCRVILMNLNSREGAVKEFAGVAAGEDRIETRISFFLSRWTNNGSEEEEDGAALHLLLLLISWPPPSPSIAAFSGYYDDCCVSDVVGNIPYDATEEQLIEICQEVGPVVSFRLVIDRETGKPKGYGFCEYKDEETALSARRNLQGYEINGRQLRVDFAENDKGNDRNREQGRGGPGMTTNVDHQKQVGVPAVHGEAVQHQPIGLHIAITAAAVMTAALGGAQFGIQSNQNSLQSQSALAHDPLTLHLAKMSRSQLTEIISELKGMATQNKELARQLLLSRPQLPKALFQLQMPNLRLVSDQTSQSSMNEGQLGQASLVQTLSGLPHGQDKLQPGLTPYAQEGQVNTIPHNPLVPSQLTAHPKPPVQPRIPLQQNPNNLVLPGTLSGQSNLMLPSARSPGLGSLSVRPPIQLATSTALNQQMHASLLQHSVHVGNSTVGHNVQK

SEQ ID NO: 196860 - protein, 70 aa, Glycine max
  Coding DNA Sequence Number=SeqID_80082
  Subcellular localization annotation: CTP_CleavageSite=57; ConfidenceScore=5.23e-01
MLPNHIGDRFLHRSSFILRSSSGRTLAPNERPFRAPVGGQGPVTRAMSKRLQEDWARAAEEGPRVLINLR

SEQ ID NO: 196861 - protein, 61 aa, Glycine max
  Coding DNA Sequence Number=SeqID_80083
  Subcellular localization annotation: CTP_CleavageSite=52; ConfidenceScore=5.30e-01
MATQSYLLNLNTFRVHAGISGRQCKPSIFKPSNFGFRVWVSVTICKFLVGVLLLAKFGIPI

SEQ ID NO: 196862 - protein, 99 aa, Glycine max
  Coding DNA Sequence Number=SeqID_80084
MPQLCRLFLIFLPLLHSHLSVPQIDDVDNKLPRKHEDTDDNDIRDFESDFEDTHDTNEEIDDLYNGRNVEMKRMVKAGYFNMDDKKGALKFPVSVINMD

SEQ ID NO: 196863 - protein, 160 aa, Glycine max
  Coding DNA Sequence Number=SeqID_80085
  Gene Ontology: Mol. function=oxidoreductase activity; Cellular component=membrane; Biological process=electron transport
  Homolog annotation: Hit_ID=Q9FIB0; Match level="QueryCoverage=89%, HitCoverage=26%, E-value=2e-30, Identity=46%"; Hit description =Cytochrome P450
MLPALAHEQSKNGFVRLRKHLQDASLNNVMTTVFGRRYNHDESNSSYEVEEVREMVMEGFEILGAFNWSDYVPWISFFYDPLRIRERCSVLAPRVKKFVKRVLEEHRIMPSFKELSDDSDFVDVLLSLEGDDKLQDDDIIAVLWIYVEIQILTLEATMLY

SEQ ID NO: 196864 - protein, 565 aa, Glycine max
  Coding DNA Sequence Number=SeqID_80086
  Gene Ontology: Mol. function=oxidoreductase activity; Cellular component=intracellular; Biological process=lignin catabolic process
  Homolog annotation: Hit_ID=Q84J37; Match level="QueryCoverage=95%, HitCoverage=95%, E-value=0.0, Identity=58%"; Hit description =Putative laccase (Diphenol oxidase) family protein
  Pfam annotation: Domain name=Cu-oxidase; Domain location=157-309; Score=170.5; E_value=4.1e-48; Accession=PF00394.12; Description =Multicopper oxidase
  Pfam annotation: Domain name=Cu-oxidase_2; Domain location=413-549; Score=158.6; E_value=1.7e-44; Accession=PF07731.4; Description =Multicopper oxidase
  Pfam annotation: Domain name=Cu-oxidase_3; Domain location=31-147; Score=189.3; E_value=9.5e-54; Accession=PF07732.5; Description =Multicopper oxidase
  Pfam module annotation: Pfam domain module=Cu-oxidase::Cu-oxidase _2::Cu-oxidase_3; Domain location=157-309::413-549::31-147
  Subcellular localization annotation: CTP_CleavageSite=33; ConfidenceScore=5.09e-01
MSFGKKLFLQILWWFSLIGLSSQRRSHYSFVVREANYTRLGSTKSILTVNGNFPGPTIKVHRGETIFVNVYNKGNYNITLHWHGVKQPRNPWTDGPAYITQCPIQPGRRFRQKLIFSTEEGTIWWHAHSDWSRATIHGAIFVYPTKNTPYPFPKPHAEIPIIFGEWWKSDINEVFTQFIESGGGPNISDALTINGQPGDLYPCSMAETFEFHVEQGRTYLLRVVNAAMNLILFFSVSKHNLTVVGADGMLTKPLAREYICISPGQTMDVLLHANQEPNHYYLAARAYSSGVGVAFDNTTTTARVKYSGNYTPRSSPSLPNLPNFNDTRAALDFITSLRGLSERYPRQVPTNITTQIVTTISVNTLPCPNNGRTCQGPNGTIFAASMNNISFDTPNVDILKAYYYHINGVYKPGFPRFPPFIFNFTGDFLPVTLNIPKQGTRVNVLNYGATVEIVFQGTNVVAGIDHPMHLHGFSFHVVGYGLGNFNQSKDPLNFNLVDPPYLNTVIVPVNGWAAIRFVATNPGVWFMHCHLERHQAWGMETVFIVKNGKASNETLPPPPPDMPSC

SEQ ID NO: 196865 - protein, 564 aa, Glycine max
  Coding DNA Sequence Number=SeqID_80087
  Gene Ontology: Mol. function=oxidoreductase activity; Cellular component=intracellular; Biological process=lignin catabolic process
  Homolog annotation: Hit_ID=Q84J37; Match level="QueryCoverage=97%, HitCoverage=96%, E-value=1e-167, Identity=51%"; Hit description =Putative laccase (Diphenol oxidase) family protein
  Pfam annotation: Domain name=Cu-oxidase; Domain location=156-308; Score=186.3; E_value=7.4e-53; Accession=PF00394.12; Description =Multicopper oxidase
  Pfam annotation: Domain name=Cu-oxidase_2; Domain location=412-548; Score=159.7; E_value=7.8e-45; Accession=PF07731.4; Description =Multicopper oxidase
  Pfam annotation: Domain name=Cu-oxidase_3; Domain location=30-146; Score=199.6; E_value=7.3e-57; Accession=PF07732.5; Description =Multicopper oxidase
  Pfam module annotation: Pfam domain module=Cu-oxidase::Cu-oxidase _2::Cu-oxidase_3; Domain location=156-308::412-548::30-146
MARGKNLFLQILWCFSLIGLSSQAQNYTFVVREAKYTRLCSTKSILTVNGEFPGPTIRANRGDTIFIDVYNKGNFNITLHWHGVKQPRNPWTDGPSYITQCPIQPGRKFTQRLIFTFEEGTIWWHAHSEWLRATVYGAIHIYPNKNNPYPFPQPDAEIPIIFGEWWTSDVNEVFRQSMETGGAPNVSDALTINGQPGDLFPCSSPETFKLNVEQGKTYHLRVINAALNLILFFSVSQHNLTVVGADAVYTRPLTREYICISPGQAMDVLLHANQDPGHYYLAAAAYSSGVGVAFDNTTTTARVEYSGNYTPPSSPSLPNLPNFNDTRAALNFITNLRGLPERAPSHVPTNITTQIVTTISVNTLPCPNGRNDCQGLNGTIFSASMNNISFRIPTIDILKAYYYHINGVYEPGFPTFPPFIFNFTGDFLPITLNTPKQGTRVNVLNYGATVEIVFQGTNLVGGIDHPIHLHGYSFHVVGYGLGNFNQSVDPMNFNLVDPPYLNTVIVPINGWAAIRFEAVNPGVWFMHCHLERHQSWGMETVFIVKDGESENLRLPPPPPDMPPC

SEQ ID NO: 196866 - protein, 81 aa, Glycine max
  Coding DNA Sequence Number=SeqID_80088
EWWKKDVVEVYNELRRSRRHAAIYVQLTSNLVIFIHAQRMVRVDYGTTYLLRMANAAVQDILFFAIAKHKLTVVGIMMVAM

SEQ ID NO: 196867 - protein, 97 aa, Glycine max
  Coding DNA Sequence Number=SeqID_80089
MAILKTSLEGVDKVEKGDNGCEPNEALWENMEDVRVVEKVLCPLTTTFDFVVCAIEESKDIKSVIVNNYWVHFNHMKKGSKEEMMSLWSKFLKPKLL

SEQ ID NO: 196868 - protein, 113 aa, Glycine max
  Coding DNA Sequence Number=SeqID_80090
MKAQVEKDEGPEAETLSRLLIVAEGPKFLSRFLVEPIIRLIKVILVAFYPDLSSLTGSGVYPDLSSFTGSGVYPDLSSLFGSGVIQISVTCIKRSAPSQVHITTFVKKLRNVG

SEQ ID NO: 196869 - protein, 264 aa, Glycine max
  Coding DNA Sequence Number=SeqID_80091
  Gene Ontology: Mol. function=oxidoreductase activity; Cellular component=membrane; Biological process=electron transport
  Homolog annotation: Hit_ID=Q2MIZ1; Match level="QueryCoverage=99%, HitCoverage=73%, E-value=1e-58, Identity=41%"; Hit description =Cytochrome P450 monooxygenase CYP76X2
  Pfam annotation: Domain name=p450; Domain location=21-264; Score= -142.2; E_value=0.00017; Accession=PF00067.12; Description=Cytochrome P450
MVHALLGSFLAMATKANHKLPSGPSRVPIISNLLELGEKPQNSLAKLAKIHGPIMSLKLGQITIVVMSLAQMAKEVLLTNDQFLSNQTIPQSVSVLNHEQYNLAFMPISPLWRELIKICNTQLFAHKSLDANQDVRQKLKDLVTNITKLVGTPNLANFFPVLKMVDPQSIKRRQSKNSKKVLDMFNHLVSQRLKQREDGKVHNDMLDAMLNISNDNKYMDKNKIEHLSHDIFVAGTDTIASTLEWAMTELVRNPDVMSKAKQEL

SEQ ID NO: 196870 - protein, 178 aa, Glycine max
  Coding DNA Sequence Number=SeqID_80092
  Gene Ontology: Mol. function=DNA binding; Biological process=DNA integration
  Homolog annotation: Hit_ID=Q1SKN1; Match level="QueryCoverage=95%, HitCoverage=20%, E-value=3e-27, Identity=43%"; Hit description =Integrase, catalytic region
MQMALLNAKITTVRLLLALAASNKWFIRQLDVNNALLHVDLNEEVYIILPPVARGTSGINICQRKYAFDLLIDTYMLNSKPVSTPFDYCTRLHQSSESLLSDSQISSYRRLIGSELQLKAFSDYDWAGCIDTRKFVTGFSVYLGSSLISWKSKNQATVSRSSFEAEYHALATVTCEIQ

SEQ ID NO: 196871 - protein, 315 aa, Glycine max
  Coding DNA Sequence Number=SeqID_80093
  Homolog annotation: Hit_ID=Q6R8G0; Match level="QueryCoverage=31%, HitCoverage=15%, E-value=7e-22, Identity=50%"; Hit description=PHO1 -like protein
  Pfam annotation: Domain name=SPX; Domain location=23-142; Score= -42.8; E_value=0.0046; Accession=PF03105.10; Description=SPX domain
MSNIHIIVSKKESVRVLRSCISSLESGLGAIYKVQKDKGQLRSLRIFIIRPGAFDQLSELAIKNGTSAKLHSIVTKRFGSSDNELSFSKEELRKVKEQLRLVFVEFYQKLLHLKDYSFMNLSAFSMIMKKYEKVNFLLEKVESTFIRNFTHSNHKKGRKLLRQKTKTERHSTTFFTGASGNENEQLTSDDDVGVILRRKAARELRLRFHGGSGGGNQVPQKIVICQSDPQNGRFGPRSLTKLYLFFLAFQGLLICSIWSSVASYRSCTRQIGQGKTKRKTKKDQTKVKPQIKRKVRVDMRMIFRLKLREKRGNGE

SEQ ID NO: 196872 - protein, 95 aa, Glycine max
  Coding DNA Sequence Number=SeqID_80094
PRVGSRAPGHYYHGYYRPEPKEGKERTKARSSLAIHSEGGWGSTSFMTHGPIETRFSDMDFFEMVNHFFNREREVIQNPLAPVQNRWKFPTPIPQ

SEQ ID NO: 196873 - protein, 181 aa, Glycine max
  Coding DNA Sequence Number=SeqID_80095
  Pfam annotation: Domain name=AP2; Domain location=90-141; Score=-8.5; E_value=0.0051; Accession=PF00847.10; Description=AP2 domain
LEKRDEAYDSALDVGVGILHGVANPSLHREVHLCVKEAERKHGVERKSSSSNKAVGGVGVKDAEEGEVEAGELKGEEFGGDDGAEEGGEGLEEVRAYKLQWSLHQLGTLEITEDAVRAYDQATILMSGINANTNFPITQTPEGDPKSTTNEDTPSTTTTVDPTCSCVHVGLTRPLCLYLSY

SEQ ID NO: 196874 - protein, 113 aa, Glycine max
  Coding DNA Sequence Number=SeqID_80096
  Gene Ontology: Mol. function=hydrolase activity; Cellular component =integral to membrane; Biological process=aromatic compound metabolic process
  Homolog annotation: Hit_ID=Q2XEK3; Match level="QueryCoverage=80%, HitCoverage=27%, E-value=3e-36, Identity=70%"; Hit description =Hydrolase, alpha/beta fold family precursor
MLRFTRRALLCATLAAFPAAAETPKFGPELQGFHYPYPLQQFSLTSQGQPLKMGYMDVPPEGAANGHTALLLHGKNFCAATWQDTIKALSKAGYRVIAPDQIGFCSSTKPAHY

SEQ ID NO: 196875 - protein, 613 aa, Glycine max
  Coding DNA Sequence Number=SeqID_80097
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=Q2HXK3; Match level="QueryCoverage=83%, HitCoverage=77%, E-value=0.0, Identity=81%"; Hit description =Carotenoid isomerase
  Pfam annotation: Domain name=Amino_oxidase; Domain location=101-598; Score=-27.0; E_value=0.00014; Accession=PF01593.14; Description =Flavin containing amine oxidoreductase
  Pfam annotation: Domain name=DAO; Domain location=93-596; Score= -21.7; E_value=0.00014; Accession=PF01266.14; Description=FAD dependent oxidoreductase
  Pfam module annotation: Pfam domain module=Amino_oxidase::DAO; Domain location=101-598::93-596
  Subcellular localization annotation: CTP_CleavageSite=78; ConfidenceScore=5.79e-01
MLNSSFLTVSEHTFSHTPHHFPTRASSQSPNLQPQFQSLAFANHVVSEFPSGSCSNAPRRKGVLAVRSKSTLGVEEVVAEGGGVKGKGEEEFDAIVIGSGIGGLVAGTQLAVKGARVLVLEKYVIPGGSSGFYQRDGYTFDVGSSVMFGFSDKGNLNLITQALEAVGCRMQVVPDPTTVYFHLPNNLSVRVHKEYDKFTEELTSYFPHEKEGILKFYGECWKIFDALNSLELKSLEEPLYLFGQFFQKPLECLTLAYYLPQNAGAIARKYIQDPQLLSFIDAEVDRCNYLFDSVRSFKKLLRKMCPDEESILVDLMYEVLCDRHFGGINYPLGGVGGIAKSLAKGLVDQGSEIAYKANVTSIIIEQGKAVGVRLSNGREFFAKTIISNATRWDTFGKLLKDIPLPKEEENFQKVYVKAPSFLSIHMGVKAEVLPPDTDCHHFVLESNWSKLEEPYGSIFLSIPTVLDSSLAPEGRHILHIFTTSSVEDWEGLSRADYEAKKQLVADEITSRLENKLFPGLRSSIDFMEVGTPKTHRRYLARDEGTYGPMPRRIPKGLLGMPFNTTGIDGLYCVGDSCFPGQGVIAVAFSGVMCAHRVAADIGKIEHSFKCATH

SEQ ID NO: 196876 - protein, 558 aa, Glycine max
  Coding DNA Sequence Number=SeqID_80098
  Gene Ontology: Mol. function=nucleoside-triphosphatase activity; Cellular component=integral to membrane; Biological process=transport
  Homolog annotation: Hit_ID=Q93YS4; Match level="QueryCoverage=98%, HitCoverage=77%, E-value=0.0, Identity=74%"; Hit description=White -brown complex homolog protein 23
  Pfam annotation: Domain name=ABC2_membrane; Domain location=327-539; Score=157.9; E_value=2.6e-44; Accession=PF01061.14; Description=ABC -2 type transporter
  Pfam annotation: Domain name=ABC_tran; Domain location=23-212; Score =166.5; E_value=7e-47; Accession=PF00005.17; Description=ABC transporter
  Pfam module annotation: Pfam domain module=ABC2_membrane::ABC_tran; Domain location=327-539::23-212
IKGMTTTEEKDILNGITGSVNPGEVLALMGPSGSGKTTLLNLLGGRLSHPISGGSITYNDQPYSKFLKSRIGFVTQDDVLFPHLTVKETLTYAARLRLPKAYTKEQKEKRALDVIYELGLERCQDTMIGGSFVRGVSGGERKRVCIGNEIIINPSLLFLDEPTSGLDSTTALRIVQMLQDIAEAGKTVVTTIHQPSSRLFHKFDKLILLGKGSLLYFGKASETMTYFQSIGCSPLISMNPAEFLLDLANGNINDVSLPSELEDKVQMGNAEAETQNGKPSPAVVHEAYETRVAETEKKRLMVPIPLDEALKTKVCSHKRQWGASWDEQFSILFWRGIKERRHDYFSWLRITQVLSTAVILGLLWWQSDTKNPKDLQDQAGLLFFIAVFWGFFPVFTAIFTFPQERAMLSKERAADMYRLSAYFLARTTSDLPLDLILPVLFLLVVYFMAGLRLSVAPFFLTVLTVFLCIVAAQGLGLAIGATLMDLKRATTLASVTVMTFMLAGGFFVQVQYEHISPVINGIRIDSGATEVAALIAMVFGYRFLAYLSLRRMKLQSGA

SEQ ID NO: 196877 - protein, 119 aa, Glycine max
  Coding DNA Sequence Number=SeqID_80099
MPNKLQSNFDPPIKILDETHFLKFKVQAPRKRKNFEGGKYEGNERKRMGFQHIRELKKVFEENRHNITIFKYSLAKIVFELGQFKLFGRAMISPRSFTQPPAVLSMFDYSVEVVVLCDH

SEQ ID NO: 196878 - protein, 78 aa, Glycine max
  Coding DNA Sequence Number=SeqID_80100
MTEYQAKHFQNSKFQNLEMECKTEMKEFIWSGVDLKTKGFICENAAAVQTLRQRHDFSISGFIQVRIQRPILKLRIKT

SEQ ID NO: 196879 - protein, 732 aa, Glycine max
  Coding DNA Sequence Number=SeqID_80101
  Homolog annotation: Hit_ID=Q8VYL1; Match level="QueryCoverage=23%, HitCoverage=31%, E-value=2e-71, Identity=74%"; Hit description =Putative adenylate kinase
MALRRVTKPMWGDNGLTTCDGLGKMQSQRCRVVDSVKIAIASALRIVKFHCIAAVASSVYRKLTSQILCLHSEIAERQSFSAVIEQSQDSFKFGVPMKEMTEMWSSLTGEDMNELKYDFVLERYLVWNLRVAHVDPMGPTQALSFLSFWMAHINSRPAASFTIVQSTSCDMMTKRANYRPLAALVLPVDVTISASDYTDSLRFRAAKQSASPITVMAQSSNLVAFVSQSSTLGSWILDSSASDHMTGNQSLFSQLSFSDSLPSVTLTNGSKTKVCGIGQTRSLPNLSLNSVLFVPDGSQSKVCGSHLVYRLQHSLYGLKQSPRAWFGRFSSELLQFCMTRYEADHSVFSLHSPSGLCIYLVVYLDDIVITGDDFDGCSILFWISISQRKYVLDILIETSMLDFRHSDTPMDPNIKLLPGQGEPLENPQFLNAPCDCHWNAVMRILRYIKDAIGHGLLNADKGNAKIVCYSNADWEGSPSNSRSTSVLKLYCAMTAAAIEITWPRQLLQQLRFGDTQATKLICHNQATLHIASTPVFHEQTTHREKPIPDTKKERTSLSQDNWRGIPTRLNNIPHSREIRKYFYDDVLQATQRAINDGKTRVKDVYRIGTLMELVRTLALSFADDGKRVKVCVQGSMGEGALAGMPLQLAGTRKILEFMDWGDYGAKGTFINIGSIGAAEVEEEDDMFILVAPQNAVGNCIIDDLRAMTNAAEHRPVILINARLKVQFLAPFV

SEQ ID NO: 196880 - protein, 217 aa, Glycine max
  Coding DNA Sequence Number=SeqID_80102
MKDGELLDEEEVVATEEDVDLGGIGSETLMGLYGIENESMTDLYEIENLMTINHLGFDFTLVEGLANQSGGVLWVPAKIKLGNRETQQGQTLGFYKDKTQQQKGSPNLGFDEPLEIRPGMDMSILDFGEAHQGHTLGLTSFWRIDQGYVGLGFWMDLGFDKPLEIPPGTCLSWVLERLTKGGPWTLGLIESCAQGFKDDLIGCLFLSGDVRQKSQSA

SEQ ID NO: 196881 - protein, 73 aa, Glycine max
  Coding DNA Sequence Number=SeqID_80103
MEPLGLMANGCGSGGCLGEEVVSGRRSGGGVDMNDDGCKKKKKEEEWREEEREVEFVEWFTNTHRNQVTNASI

SEQ ID NO: 196882 - protein, 107 aa, Glycine max
  Coding DNA Sequence Number=SeqID_80104
MVVEGGLKLSKGFLHLRPNRVLTIGVKRLRGKFYCDPTVGAKCTYQNLELIDVRVNIDKMGSTISHVGLHVPFIGRTKGGPAKQRTLTLNPIVRMLRELRLHLWCQG

SEQ ID NO: 196883 - protein, 141 aa, Glycine max
  Coding DNA Sequence Number=SeqID_80105
  Subcellular localization annotation: CTP_CleavageSite=31; ConfidenceScore=5.03e-01
MALAISFSFDRLPHFKVHPSSIMSFVFDSAMGMGGSDFGGSNQQPLMDHEVVLINDFSSKETRREVSDGKSSSSERLVDPRCVGGVNSRPHRRAWLRELDLIVSNLQSRLKEFELEVAKEKETNMELEKELLMFKKEEAME

SEQ ID NO: 196884 - protein, 660 aa, Glycine max
  Coding DNA Sequence Number=SeqID_80106
  Gene Ontology: Mol. function=transmembrane receptor activity; Cellular component=integral to membrane; Biological process=defense response to bacterium
  Homolog annotation: Hit_ID=Q9FYQ8; Match level="QueryCoverage=99%, HitCoverage=100%, E-value=0.0, Identity=78%"; Hit description =Endosomal protein-like
  Pfam annotation: Domain name=EMP70; Domain location=57-618; Score =837.0; E_value=9.7e-249; Accession=PF02990.7; Description =Endomembrane protein 70
MESCAQFGFWVVFILFLAFQIPPNYGFYLPGSYPHNYGVSDELWVKVNSLTSIDTEIPFSYYSLPFCKPEGGIKDSAENLGELLMGDRIENSPYRFRMYSNESEIYLCRIEALSGDQFKILKERIDEMYQVNLILDNLPAIRFTQKEGYFMRWTGYPVGIKIEDAYYVFNHLKFNVLVHKYEETNVARVMGTGEGAELIPVVKQGSSEKPGYMVVGFEVIPCSIMHNADSAKTLKMYEKYPSSIRCDPATVAMPIKEGQPVVFTYEVTFEESDIKWPSRWDAYLKMEGAKVHWFSILNSLMVITFLAGIVLVIFLRTVRRDLTRYEELDKEAQAQMNEELSGWKLVVGDVFRAPSNPALLCVMVGDGVQILGMSVVTILFAALGFMSPASRGTLITGILFFYMILGIAAGYVSVRMWRTIGFGEQKGWVSIAWKAACFFPGISFLILTTLNFLLWGSHSTGAIPFALFIILILLWFCISLPLTLVGGYFGAKAPHIEYPVRTNQIPREIPQQKYPSWLLVLGAGTLPFGTLFIELFFIMSSIWMGRVYYVFGFLFVVLILLVVVCAEVSLVLTYMHLCVEDWKWWWKSFFASGSVAIYIFLYSVNYLVFDLKSLSGPVSATLYLGYSLFMVLAIMLSTGTIGFLSSFWFVHYLFSSVKLD

SEQ ID NO: 196885 - protein, 111 aa, Glycine max
  Coding DNA Sequence Number=SeqID_80107
MASWLAERGWPGSESKACWLPNRPKNGHEYCSLELRQRTVAAAVKCIGKGEKYPERRAASIRAHRNAEIGRWKDDKQKDPLGQWVAEEVTVGGGWKSCWKGENGHQNKCND

SEQ ID NO: 196886 - protein, 216 aa, Glycine max
  Coding DNA Sequence Number=SeqID_80108
  Gene Ontology: Mol. function=phosphotransferase activity, phosphate group as acceptor; Cellular component=chloroplast thylakoid membrane; Biological process=nucleobase, nucleoside, nucleotide and nucleic acid metabolic process
  Homolog annotation: Hit_ID=Q8VYL1; Match level="QueryCoverage=94%, HitCoverage=34%, E-value=4e-86, Identity=74%"; Hit description =Putative adenylate kinase
  Pfam annotation: Domain name=ADK; Domain location=2-181; Score=239.7; E_value=6.3e-69; Accession=PF00406.12; Description=Adenylate kinase
  Pfam annotation: Domain name=ADK_lid; Domain location=121-152; Score =11.2; E_value=0.024; Accession=PF05191.4; Description=Adenylate kinase, active site lid
  Pfam module annotation: Pfam domain module=ADK::ADK_lid; Domain location=2-181::121-152
MISGAPASGKGTQCELIVQKFGLVHISTGDLLRAEVGAGTEIGNKAKEFMNAGQLVPDEIVTAMVAARLTREDAKQTGWLLDGYPRSYGQAQSLEKMQIRPNVYIVLDVPDEILIDRCVGRRLDPVTGKIYHLKFFPPDTEEIKARLITRPDDTEEKVKSRLNIYKQNAEAASSVYSSITHKIDGSQSKEAVFKEIESLLSQLQQDKVKIMKSEVA

SEQ ID NO: 196887 - protein, 64 aa, Glycine max
  Coding DNA Sequence Number=SeqID_80109
  Subcellular localization annotation: CTP_CleavageSite=39; ConfidenceScore=5.24e-01
MHSILSQVSSWTWSAISASAPTLRLWVTWYSNSTSSLTRKDHDRNHLSLESSGQIRKKGFIRLP

SEQ ID NO: 196888 - protein, 606 aa, Glycine max
  Coding DNA Sequence Number=SeqID_80110
  Gene Ontology: Mol. function=protein serine/threonine kinase activity; Cellular component=integral to membrane; Biological process=protein amino acid phosphorylation
  Homolog annotation: Hit_ID=Q8GRK2; Match level="QueryCoverage=99%, HitCoverage=99%, E-value=0.0, Identity=78%"; Hit description=Somatic embryogenesis receptor kinase 1
  Pfam annotation: Domain name=LRRNT_2; Domain location=32-72; Score =41.2; E_value=3.5e-09; Accession=PF08263.3; Description=Leucine rich repeat N-terminal domain
  Pfam annotation: Domain name=LRR_1; Domain location=100-122; Score =20.9; E_value=0.0047; Accession=PF00560.23; Description=Leucine Rich Repeat
  Pfam annotation: Domain name=LRR_1; Domain location=147-170; Score =14.5; E_value=0.39; Accession=PF00560.23; Description=Leucine Rich Repeat
  Pfam annotation: Domain name=LRR_1; Domain location=76-98; Score=1.7; E_value=1.4e+02; Accession=PF00560.23; Description=Leucine Rich Repeat
  Pfam annotation: Domain name=Pkinase; Domain location=283-557; Score =128.8; E_value=1.5e-35; Accession=PF00069.15; Description=Protein kinase domain
  Pfam annotation: Domain name=Pkinase_Tyr; Domain location=283-557; Score=124.7; E_value=2.7e-34; Accession=PF07714.7; Description =Protein tyrosine kinase
  Pfam module annotation: Pfam domain module=LRRNT_2::LRR_1::LRR_1::LRR_ 1::Pkinase::Pkinase_Tyr; Domain location=32-72::100-122::147-170::76 -98::283-557::283-557
MERKFMALGFIWWVVLVHPLCLISANMEVYCSNLYGDALHSLRTNLQDPNNVLQSWDPTLVNPCTWFHVTCNNDNSVIRVDLGNAALSGQLVPQLGQLKNLQYLELYSNNITGPIPSDLGNLTNLDSRLNNNSLSGPIPMSLTNITALQVLDLSNNHLSGVVPDNGSFSLFTPISFANNLDLCGPVTGHPCPGSPPFSPPPPFVPPPPISAPGGNGATGAIAGGVAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPHQEPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNNYIEAEVEQLIQVALLCTQGSPMDRPKMSEVVRMLEGDGLAERWDEWQKVEVLRQEVELAPHPNSDWIVDSTENLHAVELSGPR

SEQ ID NO: 196889 - protein, 124 aa, Glycine max
  Coding DNA Sequence Number=SeqID_80111
MNPLMKKILGLQAQMELTSRLEGRREIEGIAESILAGFLKNTQYMSSNTKQKTKNIDNLTFTNSCKWRHHSKGHDFGYVAVVGTTRGSEVGKCDNVGFLLWRSGKGHNVRVEQGTQSTGAEIFR

SEQ ID NO: 196890 - protein, 55 aa, Glycine max
  Coding DNA Sequence Number=SeqID_80112
MKRDISLALLTSVFQPHIIYIGFTLTIYTSALASTSGEKENGLQWLNYHVDLKNT

SEQ ID NO: 196891 - protein, 42 aa, Glycine max
  Coding DNA Sequence Number=SeqID_80113
MYVAAEDIEAGPRTKFQTEPTLPIYLKARMKLTLAIIATNRT

SEQ ID NO: 196892 - protein, 138 aa, Glycine max
  Coding DNA Sequence Number=SeqID_80114
MYTTNKHSDEAWFLWKWRKLFGIQHNNLSSSDQSAVSDFAKKVLRIDFLLTAFFSGGSDTKIETEEGKESTQQQTSIRGKNGGRMLIVSGNQKLLRPREMMISKSTVQQQSCVKCWKPMVKIHQDQKLIYVTAGNLIS

SEQ ID NO: 196893 - protein, 491 aa, Glycine max
  Coding DNA Sequence Number=SeqID_80115
  Gene Ontology: Mol. function=transcription regulator activity; Cellular component=nucleus; Biological process=regulation of transcription
  Homolog annotation: Hit_ID=Q8S3D6; Match level="QueryCoverage=57%, HitCoverage=68%, E-value=5e-42, Identity=45%"; Hit description =Putative bHLH transcription factor
  Pfam annotation: Domain name=HLH; Domain location=271-320; Score =45.9; E_value=1.4e-10; Accession=PF00010.16; Description=Helix-loop -helix DNA-binding domain
MQGLNSLLNSSSQISLQDLHNHTTNQIQNSHMNHQHHHQQQQQHQQQQHQLAHFDSTSHDDFLEQMLSSCSWTDLNHNKPLLWDPNTPNDIKPPDETTPSNNNDDATANVVFPSFDEHSTLASKFRNHQISPNNAPKNAAAAAFMLQHQLLRDSGLLNMPLSLPGNDVVDASSFKSPNPVPHSYTITGGEASVQALYNGFAGSLHGAGQSSNQTQHFQNPQGSSNPMQGQNFGAAPAGGGGATNQAPGSGAAAGGAPAQPRQRVRARRGQATDPHSIAERLRRERIAERMKALQELVPNANKTDKASMLDEIIDYVKFLQLQVKVLSMSRLGGAAAVAPLVADMYSEGGGDCIQANGNSNGGGAHAPNSNTNQTSATTPSNDSLTMTEHQVAKLMEEDMGSAMQYLQGKGLCLMPISLATAISTATCHTRNVTVNVNPLINAAAAAQIPTAANPAGDGPSSPSMSVLTVQSAVAVNDGSAAVKDAASVSKP

SEQ ID NO: 196894 - protein, 70 aa, Glycine max
  Coding DNA Sequence Number=SeqID_80116
MHSQSTRLIRERGEFGSQKSLTPTVINATTERVTHRFGYLNLRPGQKVADFNFSRMKKDSKFCRDEFQTF

SEQ ID NO: 196895 - protein, 55 aa, Glycine max
  Coding DNA Sequence Number=SeqID_80117
MTSLGRSIKNADSPLMELAFDGIENRCIVMTSHMGTLHKLHHNSRIRFQQKPPHT

SEQ ID NO: 196896 - protein, 127 aa, Glycine max
  Coding DNA Sequence Number=SeqID_80118
MKEYETGVQTRVHTYFLYLRPVGLFHKIIKVGIDGCPNRIRIRGPGPFTNLAENGFCLLPERKGIPDHIHPHVEAILIKNTLRIGKRISIQSQTTPRPCLGGFIRRGLFYIDIYMSIYYRTYDRNKN

SEQ ID NO: 196897 - protein, 116 aa, Glycine max
  Coding DNA Sequence Number=SeqID_80119
MRVIMEMDGSGIDGASNIGKRNEFLEGLCGFEEVATADGELDEFRVELGVQEVHDYVGYLGDEIRVEGVVGGEGFGREGLRWNRCVLLKGRGRRRQSSESEKEGLEELRDGEGATK

SEQ ID NO: 196898 - protein, 290 aa, Glycine max
  Coding DNA Sequence Number=SeqID_80120
MIAQHIGTKSKDQCKKFFIMGHKSHRLDLIHHRLENIGSLLNEVNLSSSTNTNYAHVGEADSVIDNDKSGTKTNNDQPSSVVNSSRDKSKPMEAMNLSAYFKESVIGNDKSGTKTNDEQPSSTMNSSHDKSKPVEARNRSPDLNESNEINREFDHQDKNMISNTYNGECKMVGTDGCGIVSYHSDKLSSVKDKRATMMSDIIEVRKDKVGDAVTELVSSASEIIEPCHSHSVAEDKLSVMLMSFRTRLDDKDGKHGGDIDDDVVELKSQSHDSNTKANTWLSSVVNMDCL

SEQ ID NO: 196899 - protein, 178 aa, Glycine max
  Coding DNA Sequence Number=SeqID_80121
KSNESERVAVDALIDMCDSLTPESTMLPCQQHAVSSFGDDFRMIAQHIGTKSKDQCKKFFIMGHKSHRLDLIHHRLENIGSLLNEVNLSSSTNTNYAHVGEADSVIDNDKSGTKTNDDQPSSIVNSSRDKSKPMSFFVPTTVIQSRGSRSLDTEIEMASSNGNFPASMPILKGKNYDD

SEQ ID NO: 196900 - protein, 70 aa, Glycine max
  Coding DNA Sequence Number=SeqID_80122
MELSHTIGAALRPLVEWPFAPTPVGTDQGLFNHQIRANVCEIDWRGANSRVRATTLLYLPRRATGDRTFE

SEQ ID NO: 196901 - protein, 272 aa, Glycine max
  Coding DNA Sequence Number=SeqID_80123
MPQEEPMEICVDNKSALALAKNPVFYERSKHIDTRYHFIRECIEKKEVKVLFPTLIHHGLENIGSLLNEVNLSSSTNANYAYVGEADSVIDNDKSGTKTNNDQPSSVVNSSRDKSKPMEAMNLSAYFKESVIGNDKSGTKTNDEQPSSTMNSSHDKSKPVEARNRSPDLNESKEINREFDHRDKNMICNTYNGECKMVGTDGCGVVSYHSDKLSSVKDKRATMMSDIIEVRKDKVGDAVTELVSSASEIIEPCHSHSVAEDKLSVMLMSFPT

SEQ ID NO: 196902 - protein, 698 aa, Glycine max
  Coding DNA Sequence Number=SeqID_80124
  Gene Ontology: Mol. function=receptor activity
  Homolog annotation: Hit_ID=Q2QXR0; Match level="QueryCoverage=74%, HitCoverage=90%, E-value=2e-47, Identity=30%"; Hit description =Expressed protein
  Pfam annotation: Domain name=Chromo; Domain location=62-116; Score =53.7; E_value=6.1e-13; Accession=PF00385.14; Description='chromo' (CHRromatin Organisation MOdifier
  Pfam annotation: Domain name=DUF668; Domain location=562-651; Score =194.1; E_value=3.3e-55; Accession=PF05003.3; Description=Protein of unknown function (DUF668)
  Pfam module annotation: Pfam domain module=Chromo::DUF668; Domain location=62-116::562-651
MRYFGPFKVLAKIGDVAYKLELPSAARIHPVFHVSQLKPFNGTAQDPYLPLPLTVTEMGPVMQPVKILASRIIIRGHNQIEQILVQWENGLQDEATWEDIEDIKASYPTFNLEDKVVFKGEGNVTNGMSRGEKVNNTAESSSERGLHNKLADFEELGRGKREKKPTMVAEAWIVKMGNQVANVMSKTVHLHRSLSESEISKLRNEILDSEGVRNLVSSDEDYLLELALAEKLEELNRVASVVSRLGKKCSEPALQGFEHVYGDIVGGVIDVKELGFLVKHMEGMVRKMDRYVTVTRNLYSEMVVLNELEQAVKKFQHNQHEESRRAFEQKLIWQKQDVRHLKDVSLWNQNFDKVVELLARTVCTIYARISVIFGESALRNNALGPGVGGGSPGTQNESGFVSGHVNAHTSSERLKRNQSKGNGFHPGSVGRMAVAERRGATSRPQIDLRRGELVPIRLEDFGFPCGTSAGRLFMECLSLSSSVSKFDDADDVNREDHHSSCCSVGIGNNSMKMEHACHSGILSHSRSGVPFTGDLRQAKSGVQSCSTLGPKSRLAVYAPPSTLGGCALALHYANVIIVIEKLLRYPHLVGEEARDDLYQMLPMSLRLSLKAKLKSYVKSLAIYDAPLAHDWKENLDGILKWLAPLGHNMIRWQSERNFEQHQIVSRTNVLLLQTLYFADREKTEESICELLVGLNYIC

SEQ ID NO: 196903 - protein, 131 aa, Glycine max
  Coding DNA Sequence Number=SeqID_80125
MERVVMSSPVFDSYCEKVIMEMDGSGIDGASHIGKRNEFLEGLCGFEEVATADGELDEFRVELGVQEVRDHVGDLGDEIRVEGVVGGEGFGGEGLRWNRCVLLRGRGRRRQSSESEKETLEELRDGEGSTK

SEQ ID NO: 196904 - protein, 32 aa, Glycine max
  Coding DNA Sequence Number=SeqID_80126
MDIGFNAREPTNEQCTCISKQYSFQNPDPALP

SEQ ID NO: 196905 - protein, 227 aa, Glycine max
  Coding DNA Sequence Number=SeqID_80127
  Homolog annotation: Hit_ID=Q1S9T4; Match level="QueryCoverage=27%, HitCoverage=4%, E-value=7e-19, Identity=75%"; Hit description =Integrase, catalytic region
DDLDFRAMLDLDFGMSIALKCTVTSFGKLEDFEFKQESEALVQCNCKVASLCLVGHGFKCWKQPFRMLGAQRLFAMRKYERGILYAALPLHMQRGCFRIRTHDQQSVRGCSENDIIYIKKDVGRVIAIVQQQQWAVPPWAAPWQPWATPPCPYPTTPNWQHQSTPRQQGILGPKPPQAHMAATSANNAQPSYASTDIQAAMHTLSMAPPDDQWYMDTGATSHMTANG

SEQ ID NO: 196906 - protein, 55 aa, Glycine max
  Coding DNA Sequence Number=SeqID_80128
MVDNALDKVEKVFYMPIILGRGSKYRRNFKDWQQFLARALSDLPNRSLVDVEWDE

SEQ ID NO: 196907 - protein, 204 aa, Glycine max
  Coding DNA Sequence Number=SeqID_80129
  Gene Ontology: Mol. function=DNA binding; Cellular component=nucleus
  Pfam annotation: Domain name=Myb_DNA-binding; Domain location=23-68; Score=38.6; E_value=2.1e-08; Accession=PF00249.21; Description=Myb -like DNA-binding domain
MVCGAAVNQRTRSGRLHLWRKSDEKWTNEEKAAFLQAVSSFGDDFTMIAQHIGTKSKDQCKKFFIKGHKSHRLDLIHHRLENIGSLLNEVNLSSSTNTNYAHVWEADSVIDNDESGTKKNDDQPSSVVNSSRDKSKPMEAMNLSAYFKESVIGNDKSGTKTNDEQPSSTMNSSHDKSKPVEARNRSPDLNESNEIIREFDHHRT

SEQ ID NO: 196908 - protein, 280 aa, Glycine max
  Coding DNA Sequence Number=SeqID_80130
  Gene Ontology: Mol. function=translation initiation factor activity; Cellular component=chloroplast; Biological process=translational initiation
  Homolog annotation: Hit_ID=Q9XIR4; Match level="QueryCoverage=70%, HitCoverage=43%, E-value=1e-32, Identity=41%"; Hit description=APO protein 1, chloroplast precursor
  Pfam annotation: Domain name=DUF794; Domain location=22-279; Score= -12.6; E_value=1.8e-14; Accession=PF05634.2; Description=Arabidopsis thaliana protein of unknown function (DUF794)
MLPRHVQTIGSLLERVMQVHVAQLRGINTHFCLWYSSVSTCNELPRKLNKYERKPPVTSFNELKRQARLERKERQKVHENKLQPPENGLLVEHLIPIAHEVYAARCHTITLVFFIVVVQAFSMLPVDILFNYDICLCGEVHVGHPPHQIRTCDVRGSPSSKEHSWVKGGVEHVLPLVESFHLYDRIGRAVSHNEMLEVDRIPAIVELCIQAGFDIPEYPTRRRSFPVYCVAGRIIDFEKRFPKEISLGEDIEAHGFWFKKKRVDVNTNSMAMQSDDIQGL

SEQ ID NO: 196909 - protein, 136 aa, Glycine max
  Coding DNA Sequence Number=SeqID_80131
  Gene Ontology: Cellular component=endoplasmic reticulum; Biological process=ER to Golgi vesicle-mediated transport
  Homolog annotation: Hit_ID=Q94CG2; Match level="QueryCoverage=54%, HitCoverage=56%, E-value=1e-23, Identity=64%"; Hit description=Bet1 -like SNARE 1-2
  Pfam annotation: Domain name=SNARE; Domain location=1-51; Score=7.1; E_value=0.06; Accession=PF05739.9; Description=SNARE domain
MGEAVKLTGDIHEEVESHNQLLDRVGNKMDGSRGVMMGTMDRFKKVFEKKSARKTCSLVGYFTLAFIFIYYLIRFINKVMFKKIKLSKAVFLVLILKHKCCCVSCKESMCLNHSIPFWLKQMASDSPVDSKNLLHT

SEQ ID NO: 196910 - protein, 204 aa, Glycine max
  Coding DNA Sequence Number=SeqID_80132
  Homolog annotation: Hit_ID=O75376-2; Match level="QueryCoverage=81%, HitCoverage=7%, E-value=3e-07, Identity=24%"; Hit description =Isoform 2 of O75376
  Pfam annotation: Domain name=Myb_DNA-binding; Domain location=23-68; Score=38.6; E_value=2.1e-08; Accession=PF00249.21; Description=Myb -like DNA-binding domain
MVCGAAVNQRTRSGRLHLWRKSDEKWTNEEKAAFLQAVSSFGDDFTMIAQHIGTKSKDQCKKFFIKGHKSHRLDLIHHRLENTGSLLNEVNLSSSTNTNYAHVGEADSVIDNDESGTKTNDDQPSSVVNSSRDKSKPMEAMNLSAYFKESVIGNDKSGTKTNDEQPSSTMNSSHDKSKPVEARNRSPDLNESNEINREFDHHRT

SEQ ID NO: 196911 - protein, 116 aa, Glycine max
  Coding DNA Sequence Number=SeqID_80133
MRVIMEMDGSGIDGASHIGKRNEFLEVLCGFEEVATANGDLDEFRVELGVQEVRDHVGDLGDEIRVEGVVGGEGFGGEGLRWNRCVLLKGRGRRRQSSESEKEGLEELRDGEGATK

SEQ ID NO: 196912 - protein, 89 aa, Glycine max
  Coding DNA Sequence Number=SeqID_80134
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=98%, HitCoverage=10%, E-value=1e-16, Identity=52%"; Hit description =Lipoxygenase
MALAKELIGFSSFVSASYKVFLHHKHGTFWVNTILLPLDNTRVVRLRKGGKFPKAAISEDLIKTTLTVHAEKPVQFKVRAVVTVRNKIK

SEQ ID NO: 196913 - protein, 133 aa, Glycine max
  Coding DNA Sequence Number=SeqID_80135
MRVIMEMDGSGIDGASYIGKRNEFLKGLCGFEEVATANEDLDEFRVELGVQEVRDHVGDLGDEIRVEGVVGGEGFGGEGLRWNKCVLLRGIVRRRQSSESEKEGLEELRDGEGATIECAYKKPSWVKSKKVPM

SEQ ID NO: 196914 - protein, 674 aa, Glycine max
  Coding DNA Sequence Number=SeqID_80136
  Gene Ontology: Mol. function=RNA-directed DNA polymerase activity; Cellular component=chromatin; Biological process=chromatin assembly or disassembly
  Pfam annotation: Domain name=Chromo; Domain location=591-644; Score =10.9; E_value=0.049; Accession=PF00385.14; Description='chromo' (CHRromatin Organisation MOdifier
  Pfam annotation: Domain name=RnaseH; Domain location=77-195; Score= -34.5; E_value=0.094; Accession=PF00075.14; Description=RNase H
  Pfam annotation: Domain name=rve; Domain location=303-457; Score =104.3; E_value=3.7e-28; Accession=PF00665.16; Description=Integrase core domain
  Pfam module annotation: Pfam domain module=Chromo::RnaseH::rve; Domain location=591-644::77-195::303-457
MVEWHTPTSTTSLRGFLGLTGFYRKFIKGYAAIAAPLTHLLRKDQFHWSPEATTAFQQLKSCMTSAPVLSTPDFSLPFILETDASAIAIGAVLIQQAHPIAYFSKVLCPRLQRVSAYVRELHAITSAVRKWRHYLLGSSFTILTDHKSLKDLMSQVIQTPEQQTYLVKLLGYDYDIRYKPGVSNVVADALSRLPQGELLSFTMPHCDFMATLRASLANNSQYQDLMAAIQAHPQDHPLLSTHNGLIFKGRRIWLPFPTLLTSTLIDEFHSSPLGGHTGVAKTLHRLQQSFDWPTIRPDVRQFVSHCLDLSLDFITGLPVSHGHTVILVVVDRYSKGAHFGALPTRHTAHQVAVRFVDMVCKHHGFPRSLVSDRDALFLSHFWKELFRLSGTQLRMSTAYHPQSDGQTEVVNRTLEQYLRDYTHHKPSQWYRYLHLAEWCYNTTVHSGTGFAPFEVIYGRPPSTLVDYIQGSSPMDAVDSMLTDRTELHALLLRRLLKAQTSMKSAADKHRRDTHFAVGDWVYLRLHPYRQTYSNVLALWLTDWPCPMRLALPNDSRIHNVFHVSLLKPHNGPLPPIDTPLPPLAVDHHPVVTPLTILDWKLDASVTPPQRMVLVQWTGLSPEDASCEPWEALRETYNLEDEVVFEGEGVDSIMQNRATHNSNSINRPKRVTRKP

SEQ ID NO: 196915 - protein, 209 aa, Glycine max
  Coding DNA Sequence Number=SeqID_80137
  Gene Ontology: Mol. function=RNA-directed DNA polymerase activity; Cellular component=chromatin; Biological process=chromatin assembly or disassembly
MCEQCRENCIQVCDVGGKIMAIDENIVEEHRYKFAQIRSQSLVHGGLEGGRGVAEPEGHDAELIMSLMRAKCRFGDVGIRHSDLMEPLAQVELREPRSFAQVIKSSFENHEALPRSSSNSSTMGMGNLSFTVMVLRARGREGTLAWSDKAGVRVTVGADVNGWRIGKEGNVVLNCAGWGKLLRSGKYGGVAGEDGGYGRRDGGGEWGRW

SEQ ID NO: 196916 - protein, 77 aa, Glycine max
  Coding DNA Sequence Number=SeqID_80138
MGDQKDEEEQLGVSSGGDRGKVIDVVVVRVANKVKAEKESVEESQWCICEKTKTIKRKIEQLKSGARRLGAMVVDLQ

SEQ ID NO: 196917 - protein, 68 aa, Glycine max
  Coding DNA Sequence Number=SeqID_80139
MLDVTGSPTQDITKRTCCLSSMRLNIHQGGDCCAWLIFDGHDKVEVECKDHLLLGYGAGCETKPLWNV

SEQ ID NO: 196918 - protein, 236 aa, Glycine max
  Coding DNA Sequence Number=SeqID_80140
  Gene Ontology: Mol. function=transferase activity; Cellular component= membrane
  Homolog annotation: Hit_ID=Q2MGQ8; Match level="QueryCoverage=87%, HitCoverage=40%, E-value=2e-37, Identity=41%"; Hit description =Exostosin-like
  Pfam annotation: Domain name=Exostosin; Domain location=6-173; Score =47.7; E_value=1.4e-12; Accession=PF03016.6; Description=Exostosin family
MELKLIHSCSMKHWKIDSTLYFITYGHAGLFNCEKLTGYLFYGYPMDKSFNLQGGIIREKLWDLLVSEPGVIMEEGFPNATGREQSIKGMQTSEFCLHPAGDTPTSCRLFDAIQSLCIPVIVSDNIELPFEGMVDYAEFSVFAAVSDALKPSWLVSHLQSFSKEQKDRFRQNMARVQPIFVYDNGHPGGIGPIPADGAVNHIWKKVHQKLPMIKEAIIRERRKPPGVSVPRRCHCT

SEQ ID NO: 196919 - protein, 107 aa, Glycine max
  Coding DNA Sequence Number=SeqID_80141
  Gene Ontology: Cellular component=membrane
MWHVKDEIAPAVLLVVDFGGWYRLDSRGGSNCSESDVIPHTQVSVIKDVIVPYTHLLPRLDLSDNKERHQLLYFKGAKHRHRLLRLHFLCCEELHTDAVDVVSDQVC

SEQ ID NO: 196920 - protein, 183 aa, Glycine max
  Coding DNA Sequence Number=SeqID_80142
  Gene Ontology: Cellular component=membrane
MGVFNGVHDLPLPLVIVVVVLLSEGAFVGAELHFGAERGEEGDENDVGEKRVEDALREGGGAVLGRGHEVARDPVLGAVLFDEWVLGVRGNLSRLMEGGRGSGVIGIGGETGIGERGPVGVEEGVVEGSREVGDVDVDCGRGEWRERRVEGGCCCGGGEDEEEEEGEGENGEEGAEEEELGDV

SEQ ID NO: 196921 - protein, 145 aa, Glycine max
  Coding DNA Sequence Number=SeqID_80143
  Gene Ontology: Mol. function=oxidoreductase activity; Cellular component=intracellular; Biological process=lignin catabolic process
  Homolog annotation: Hit_ID=Q9SR40; Match level="QueryCoverage=89%, HitCoverage=22%, E-value=1e-55, Identity=72%"; Hit description =Putative laccase
  Pfam annotation: Domain name=Cu-oxidase_3; Domain location=1-116; Score=207.3; E_value=3.5e-59; Accession=PF07732.5; Description =Multicopper oxidase
IGNLTVSRLCNEEVITTVNGSLPGPTIYVEEGDTLVVHANNNSPYNITLHWHGIFQILTAWADGPESVTQCPIRPGGKYTYRFNITGQEGTLWWHSHSSFLRATVYGALIIRPRRGNSHPFPSVYQEVPILLGITFLLSLLACFL

SEQ ID NO: 196922 - protein, 153 aa, Glycine max
  Coding DNA Sequence Number=SeqID_80144
  Gene Ontology: Mol. function=oxidoreductase activity; Cellular component=intracellular; Biological process=lignin catabolic process
  Homolog annotation: Hit_ID=Q9SR40; Match level="QueryCoverage=98%, HitCoverage=28%, E-value=5e-44, Identity=56%"; Hit description =Putative laccase
  Pfam annotation: Domain name=Cu-oxidase_2; Domain location=30-139; Score=135.9; E_value=1.1e-37; Accession=PF07731.4; Description =Multicopper oxidase
MLLGCTLEIFQISLQLCFDYTIDYTNPNITTSPDTPREFLIAPKSTKPYVIAAENHPIHIHGFNFHVLAQGFGNYNATRDEPKFNFVNPQIRNTISVPVGGWYVIRFQANNPGVWLVHCHLETHLPWGLAMAFEVENGPSTRVPPPPADLPKF

SEQ ID NO: 196923 - protein, 421 aa, Glycine max
  Coding DNA Sequence Number=SeqID_80145
  Gene Ontology: Mol. function=protein binding; Cellular component =integral to membrane; Biological process=defense response to fungus
  Homolog annotation: Hit_ID=Q1S5Q4; Match level="QueryCoverage=99%, HitCoverage=80%, E-value=4e-84, Identity=37%"; Hit description =Leucine-rich repeat
  Pfam annotation: Domain name=LRR_1; Domain location=106-129; Score =1.4; E_value=1.5e+02; Accession=PF00560.23; Description=Leucine Rich Repeat
  Pfam annotation: Domain name=LRR_1; Domain location=131-154; Score =1.5; E_value=1.5e+02; Accession=PF00560.23; Description=Leucine Rich Repeat
  Pfam annotation: Domain name=LRR_1; Domain location=157-178; Score =9.1; E_value=5.6; Accession=PF00560.23; Description=Leucine Rich Repeat
  Pfam annotation: Domain name=LRR_1; Domain location=182-204; Score =11.4; E_value=2.1; Accession=PF00560.23; Description=Leucine Rich Repeat
  Pfam annotation: Domain name=LRR_1; Domain location=207-229; Score =2.0; E_value=1.2e+02; Accession=PF00560.23; Description=Leucine Rich Repeat
  Pfam annotation: Domain name=LRR_1; Domain location=231-253; Score =11.1; E_value=2.4; Accession=PF00560.23; Description=Leucine Rich Repeat
  Pfam annotation: Domain name=LRR_1; Domain location=255-277; Score =14.4; E_value=0.41; Accession=PF00560.23; Description=Leucine Rich Repeat
  Pfam annotation: Domain name=LRR_1; Domain location=279-302; Score =5.9; E_value=23; Accession=PF00560.23; Description=Leucine Rich Repeat
  Pfam annotation: Domain name=LRR_1; Domain location=304-328; Score =1.2; E_value=1.7e+02; Accession=PF00560.23; Description=Leucine Rich Repeat
  Pfam annotation: Domain name=LRR_1; Domain location=374-393; Score =2.1; E_value=1.2e+02; Accession=PF00560.23; Description=Leucine Rich Repeat
  Pfam annotation: Domain name=LRR_1; Domain location=395-416; Score =3.9; E_value=53; Accession=PF00560.23; Description=Leucine Rich Repeat
  Pfam annotation: Domain name=LRR_1; Domain location=65-92; Score=5.2; E_value=30; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=106-129::131-154::157-178::182-204::207-229::231-253::255 -277::279-302::...
  Pfam module annotation: Domain location=304-328::374-393::395-416::65- 92
MLSSWSTQQDCCGWRGVKCDNITTRVTQLSLPCSTIPPTYIDEEDKSHCLTGSIYLSLLLLEFEFLNYLDLSNNDFLAIKFDSMHSQNCHNLSVATPPRQCVNSSALRYLDLSLNENLAMNSLQWLCFISSLEYLNLNGINLHKETNWLQLVTMLPSLSELRMDGCQLKDLSPSLQYANFTALRVLDLSKNKFYSELPKWLFNLSCGISDIYLYSSSLRGQLPKALLNLQLLEALILESNNLSGPIPNWLGELEHLQYLNLVRNMFFGSIPINLGNLSSLIVLAVGRNQLTGVVSERNFVKLSKLKILDIYSSPPLIFDFESHWVPPFQLEILVFGFAGPYLPEWLYAQRSIELLCICESSFKAQGKFWNFVSRVTELQLRENLIDGDLSNVLLNSTFLDVSSNDLKGYLPQLSSNVVFNL

SEQ ID NO: 196924 - protein, 149 aa, Glycine max
  Coding DNA Sequence Number=SeqID_80146
  Gene Ontology: Mol. function=phosphoric monoester hydrolase activity; Biological process=protein amino acid dephosphorylation
  Homolog annotation: Hit_ID=Q6J2K7; Match level="QueryCoverage=68%, HitCoverage=32%, E-value=8e-21, Identity=54%"; Hit description =Protein tyrosine phosphatase
MATNTTTASSSVVFSPEKLNFWLDNPSPISLTWDQVKHCREALTSLKDKFDHTPESITHEFKLLEANRAVTESETDKICAVALDRDNFSKNRHDVYPLDKNRIILKSTHGYINASPMSDGTRDVGKNISIIGKGVKTTLTSPLVLTHLP

SEQ ID NO: 196925 - protein, 279 aa, Glycine max
  Coding DNA Sequence Number=SeqID_80147
  Homolog annotation: Hit_ID=Q8GUI4; Match level="QueryCoverage=32%, HitCoverage=20%, E-value=4e-22, Identity=52%"; Hit description =Uncharacterized GPI-anchored protein At1g61900 precursor
MTRHCIWSGRWILIFPFRIVYCLGASSANYDGICCSAFCGSGYLMICNVNKQVHLNPIAVIIFKVLQDDFGLCTLNFTTAKSLISVTAIDCWEVFAPFLANVICCPQLEATLTILIGQSNKHSNVLALNENDAKHCLADVEQILICRDMICGIIIEHEMELQRLNQNEETDKRKRSIALKASSSMQEEEEEESDDEEDFSLFVKKFHKFVKNRRMERRHNFDNGKRSQEEKNEKKSHEERRSKKAYIAWDDNDSSDGSEKEINLLSKDYESDENISQED

SEQ ID NO: 196926 - protein, 313 aa, Glycine max
  Coding DNA Sequence Number=SeqID_80148
  Gene Ontology: Mol. function=DNA binding; Cellular component=nuclear pore; Biological process=DNA integration
  Homolog annotation: Hit_ID=Q1SF88; Match level="QueryCoverage=99%, HitCoverage=24%, E-value=4e-95, Identity=57%"; Hit description =Integrase, catalytic region
MAMDDEYNALIKNKTWELVPRPPDVNVILSMWIFRQKKSYGSFERHKARLIGDGVGQKVGMNYGENFSPIVQLLTVHTMLSLVLSKAWPIHQLDVKNAFLHNELKETVYMHQPLGIKDSDLPNHVCLLRKSLYGLKQAPRAWLFDVLDSEGSLSTVCSLSAHADWGVCPDIRRSASGHYVFLGDNLLSWSSKHQATLSRSSAEAEYRGVANVVSESCWLHNLLLELHCPIHKVALVYCDNVSAIYLSGNLVQHQCTKHIKMDIHFVREKVARGQVCVLHVPSRYQIADIFTKRTSFGVISGTVSAYKNLQHRL

SEQ ID NO: 196927 - protein, 95 aa, Glycine max
  Coding DNA Sequence Number=SeqID_80149
  Gene Ontology: Mol. function=phosphoric monoester hydrolase activity; Biological process=protein amino acid dephosphorylation
  Homolog annotation: Hit_ID=O82710; Match level="QueryCoverage=50%, HitCoverage=14%, E-value=4e-14, Identity=77%"; Hit description =Protein tyrosine phosphatase
MAMLTISKSHAYLIFFCGKLGLSAGIGRTGAYCTIHNTIQTILAGDMSAVNIADAVATFRTQRLRMVQTQGAAVVAHHAAEVLAGVKGLGHALRR

SEQ ID NO: 196928 - protein, 65 aa, Glycine max
  Coding DNA Sequence Number=SeqID_80150
MAIQHVYQENKNDKHVDIPQVFVVLENSSNSFPTLLGRVIYPTIEGGEQGGREWKKVKRGGENGG

SEQ ID NO: 196929 - protein, 820 aa, Glycine max
  Coding DNA Sequence Number=SeqID_80151
  Gene Ontology: Mol. function=protein serine/threonine kinase activity; Cellular component=cell surface; Biological process =protein amino acid phosphorylation
  Homolog annotation: Hit_ID=Q851M7; Match level="QueryCoverage=89%, HitCoverage=85%, E-value=0.0, Identity=59%"; Hit description =Putative receptor-like protein kinase
  Pfam annotation: Domain name=B_lectin; Domain location=81-192; Score =44.0; E_value=5e-10; Accession=PF01453.15; Description=D-mannose binding lectin
  Pfam annotation: Domain name=PAN_2; Domain location=330-398; Score= -2.2; E_value=0.0023; Accession=PF08276.2; Description=PAN-like domain
  Pfam annotation: Domain name=Pkinase; Domain location=496-769; Score =158.4; E_value=1.8e-44; Accession=PF00069.15; Description=Protein kinase domain
  Pfam annotation: Domain name=Pkinase_Tyr; Domain location=496-769; Score=126.4; E_value=7.8e-35; Accession=PF07714.7; Description =Protein tyrosine kinase
  Pfam annotation: Domain name=S_locus_glycop; Domain location=180-317; Score=-13.5; E_value=0.00036; Accession=PF00954.11; Description=S -locus glycoprotein family
  Pfam module annotation: Pfam domain module=B_lectin::PAN _2::Pkinase::Pkinase_Tyr::S_locus_glycop; Domain location=81-192::330- 398::496-769::496-769::180-317
  Subcellular localization annotation: CTP_CleavageSite=69; ConfidenceScore=5.30e-01
MKLQTHQLLLSFVLFSAVIISTISGTTITISPGTTLYASNTTQSWSSPNDTFSLHFLPLHPPTFPPSFTAAVVHSGGAPAVWSAGNGAAVDSAASFQFLPAGNLVLVNGSGSTVWDSGTSNMGVSSATLHDNGNLVLSNATSSVWSSFDNPTDTIVSFQNFTVGMVLRSGSFSFSVLSSGNLTLKWSDSVPYWDQGLNFSMSVMNLSSPVLGVEPKGVLQLFYPNLSAPVVVAYSSDYGEGSDVLRVLKLDGDGNLRVYSSKRGSGTVSSTWVAVEDQCEVFGYCGHNGVCSYNDSSSSPICGCPSQNFEMVNPSDSRKGCRRKVRLEDCVGKVAMLQLDHAQFLTYPPQFLINPEVFFIGISACSGNCLASNSCFASTSLSDGSGLCYIKTSNFISGYQNPALPSTSYIKVCGPVAPNLAPSLENAHWRLHGWVALVVLSTLLCFLVFQGGLWLWCCRNRQRFGGFAAQYTLLEYASGAPVHFSYKELQRSTKGFKEKLGDGGFGAVYKGTLFNQTVVAVKQLEGIEQGEKQFRMEVSTISSTHHLNLVRLIGFCSEGQHRLLVYEFMKNGSLDNFLFVDEEQQSGKLLNWGYRFNIALGAAKGLTYLHEECRNCIVHCDVKPENILLDENYNAKVSDFGLAKLLRPVDCRHRTLTSVRGTRGYLAPEWLANLPITSKSDVYSYGMVLLEIVSGRRNFEVSEETRRRKFSVWAYEEFEKGNIMGVIDRRLVNQEINLEQVKRVLMACFWCIQEQPSHRPTMSKVVQMLEGVIDIERPPAPKINSNAAPISTIATSSAPNYSSSSSLFTFEASPLALAIS

SEQ ID NO: 196930 - protein, 194 aa, Glycine max
  Coding DNA Sequence Number=SeqID_80152
  Gene Ontology: Mol. function=receptor activity; Cellular component =mitochondrion
  Homolog annotation: Hit_ID=Q1S1U3; Match level="QueryCoverage=86%, HitCoverage=23%, E-value=5e-40, Identity=52%"; Hit description=Trp repressor/replication initiator
  Pfam annotation: Domain name=DUF668; Domain location=108-194; Score =66.6; E_value=7.8e-17; Accession=PF05003.3; Description=Protein of unknown function (DUF668)
MCTLPKKNHTNNSLISLGKVNYMDYMMSLDLVKNQTLGDSLAILRAELKSQKKHVRNLKKKSLWSKILEEVMEKLVDIIHFLYLEIHQAFGSSDTDKPAKDSQGNHKKLGSAGLALHYANIITQIDTLTQMVTTALLLNLKNDRKTVGKVSRSSSVPPNTRDALYQGLPPNVKSALRSRLQSFQVKEEVALSSK

SEQ ID NO: 196931 - protein, 121 aa, Glycine max
  Coding DNA Sequence Number=SeqID_80153
MGGICSRSWKATVDGVAVDNALSRSSGHANGHANNEPGMAYQSIGLRRSADSNANVLPDDDDDGDLDKPQRESFSFTGRENVSYGSSVDDINDGIPRLSRALSHKSRSKQAVVKLSYLSPV

SEQ ID NO: 196932 - protein, 270 aa, Glycine max
  Coding DNA Sequence Number=SeqID_80154
  Gene Ontology: Mol. function=DNA binding; Cellular component =chromatin; Biological process=chromosome organization and biogenesis (sensu Eukaryota)
  Homolog annotation: Hit_ID=Q6K709; Match level="QueryCoverage=50%, HitCoverage=51%, E-value=8e-40, Identity=64%"; Hit description=DNA -binding protein-like
  Pfam annotation: Domain name=DUF296; Domain location=68-185; Score =198.9; E_value=1.2e-56; Accession=PF03479.5; Description=Domain of unknown function (DUF296)
MDLSINERSLVRERQEEEEEEEDERDNGDEPKEGAVEAGTRRPRGRPPGSKNKPKPPIFVTRDSPNSLRSHVMEVAGGADVAESVAQFARRRQRGVCVLSGSGSVANVTLRQPSAPGAVVALHGRFEILSLTGAFLPGPAPPGATGLTVYLAGGQGQVVGGSVVGSLVAAGPVMVIAATFANATYERLPLEEEEDDGGGSVQGGSTLGGSPHGIGSSGGGGGSGGGHLPGGIPGPSSLPLYNLPPNLLPNGGQVGHEAFAWAHGHGRPPY

SEQ ID NO: 196933 - protein, 598 aa, Glycine max
  Coding DNA Sequence Number=SeqID_80155
  Gene Ontology: Mol. function=protein serine/threonine kinase activity; Cellular component=flagellin-based flagellum; Biological process=protein amino acid phosphorylation
  Homolog annotation: Hit_ID=Q2QQR2; Match level="QueryCoverage=89%, HitCoverage=84%, E-value=0.0, Identity=71%"; Hit description=Calcium- dependent protein kinase, isoform AK1, putative, expressed
  Pfam annotation: Domain name=Kdo; Domain location=146-333; Score= -84.4; E_value=0.055; Accession=PF06293.4; Description=Lipopolysacchar ide kinase (Kdo)
  Pfam annotation: Domain name=Pkinase; Domain location=149-407; Score =357.2; E_value=2.6e-104; Accession=PF00069.15; Description=Protein kinase domain
  Pfam annotation: Domain name=Pkinase_Tyr; Domain location=149-405; Score=-25.4; E_value=6.5e-11; Accession=PF07714.7; Description =Protein tyrosine kinase
  Pfam annotation: Domain name=efhand; Domain location=454-482; Score =38.4; E_value=2.4e-08; Accession=PF00036.22; Description=EF hand
  Pfam annotation: Domain name=efhand; Domain location=495-523; Score =14.7; E_value=0.31; Accession=PF00036.22; Description=EF hand
  Pfam annotation: Domain name=efhand; Domain location=531-559; Score =33.0; E_value=1e-06; Accession=PF00036.22; Description=EF hand
  Pfam annotation: Domain name=efhand; Domain location=565-593; Score =37.1; E_value=6e-08; Accession=PF00036.22; Description=EF hand
  Pfam module annotation: Pfam domain module=Kdo::Pkinase::Pkinase _Tyr::efhand::efhand::efhand::efhand; Domain location=146-333::149 -407::149-405::454-482::495-523::531-559::565-593
  Subcellular localization annotation: CTP_CleavageSite=83; ConfidenceScore=5.35e-01
MGNNCVGPNVGNGFLQSVTAAVWKTRPPENRLPPPNAEAKAPGGSAPSTATTTTNTADSSKSPEPPPGMPVQSTPPEPVKMPAAAADAAKPLPLKPEKPASSHAMEPVPGGGDNNHQTKKPTHLKRVSSVGLQVESVLGRKTENMKEFFSLGRKLGQGQFGTTFLCVQKGTNKDFACKSIAKRKLTTQEDVEDVRREIQIMHHLAGHPNVIQIVGAYEDAVAVHVVMELCAGGELFDRIIQRGHYTERKAAELARLILNVVEACHSLGVMHRDLKPENFLFINHEEESPLKTIDFGLSVFFRPGETFTDVVGSPYYVAPEVLRKQYGPECDVWSAGVIIYILLSGVPPFWDETEQGIFEQVLKGELDFISEPWPSISESAKDLVRRMLIRDPKKRMTAHEVLCHPWVQVGGVAPDKPLDSAVLTRLKQFSAMNKLKKIAIRVIAENLSEEEIAGLKEMFKMIDTDNSGQITLEELKNGLERVGSVLKDSEITWLMEAVSASLADVDNSGTIDYGEFLAAMLHLNKIQKEDHLYAAFTYFDKDGSGYITKDELQQACEQFGLKDYHLDDIICEIDKDNDGRIDYSEFAAMMQDTDFGKM

SEQ ID NO: 196934 - protein, 170 aa, Glycine max
  Coding DNA Sequence Number=SeqID_80156
MEMDGSGIDGASQIGKRNEFLKGLCGFEEVATADGELDEFRVEHGVQEVRDHAGDLGDEIRVEGVVGGEGFGREGLRWNICVLLRGRGRRRQSSESEKEGLEELRDGEGATNECAYKKPSWVKSKKEPSHDSGSGSSITFQSPKDHKRKFWKNANNASLCLSSKRSIDNV

SEQ ID NO: 196935 - protein, 49 aa, Glycine max
  Coding DNA Sequence Number=SeqID_80157
MEYYLDTLKHLRPIESTTLEPQLWKKLSISKAGRWHWSTNITVYRNRYI

SEQ ID NO: 196936 - protein, 241 aa, Glycine max
  Coding DNA Sequence Number=SeqID_80158
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=95%, HitCoverage=26%, E-value=4e-55, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDSTKVFAPVARLETMILVIALASSNGFEIKGKQRMVYKLNKALKTEGILLICLYVDDLHVSGSHSEEIEKFKAKMMTKFEMKYATDVLKRFNMIECNPATTLAEVDLKLDVASDDDDEVDPTLFKKLIGYLRYLCNSRPNIAFSIGLVSRYMLEPRKSHLMVAKRILSGDRSNKNSTLGYIFKFLEAPISWCSKKQLVVALSTCEAEYIARSFVAYQAMWLDLVLKELKIDKEANTTVSG

SEQ ID NO: 196937 - protein, 90 aa, Glycine max
  Coding DNA Sequence Number=SeqID_80159
MASCGRSSSAFFREITWKKESTEEGSSAVVIFNWGRTFFCGFLQKKFFHEMAWKKVLPQLMLQLWKNLLPCDLAEEVLPQEFTEESSSAV

SEQ ID NO: 196938 - protein, 50 aa, Glycine max
  Coding DNA Sequence Number=SeqID_80160
MSQPRATPEGVGAFGVVGPSGDAAKDGVDKDYVADVTAAQGAWESWPTQD

SEQ ID NO: 196939 - protein, 439 aa, Glycine max
  Coding DNA Sequence Number=SeqID_80161
  Gene Ontology: Mol. function=nucleic acid binding; Biological process= DNA integration
  Homolog annotation: Hit_ID=Q1T010; Match level="QueryCoverage=97%, HitCoverage=64%, E-value=1e-32, Identity=36%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=177-335; Score= -11.0; E_value=0.049; Accession=PF00665.16; Description=Integrase core domain
MVGNGGFPGNLPILDGKNWERWSMQMKVFFRFQDVNEFKQNGCQELGDNPMDAQRAIHNDAVKRDSKALFLIHQSMDASIFDKISKACTTKEVWDILERCFTCGEKIRKITDQMIIGKIMHTLTQNFNRIVVVNEKSKDVEIMKIEELQGSLEAKKLKLIQRNKIKEADQALQAQVKGVSSSKAWYLDIGCSNHMTWHKEWLIDLDTSRSTKVKLVDSKTLNVEGVGNIRSKERMSKDMVVGLPNVHVPDRMCKVLRTDGGGEYTSREFEDFCEKCGIQDEVTTPYTPQHNGLYWTGRKPLVSHLKVFGSLCCKHIPDAKRKKLQDKSKPMILLIHGIGKMELATVKNSCVSIQVQDVHFECEQNRRESNDEIEAAANVNQTQRPQKERHIPSRLSDYEILHDSEEDVWKKAMLKELEAIERNHIWELTEKSYLLTRKP

SEQ ID NO: 196940 - protein, 89 aa, Glycine max
  Coding DNA Sequence Number=SeqID_80162
MAVVAIFFLTPSVHQEKEILTNLEFNNEAANLRTHLGRLLLWRKSKESERVAVDAFIDMCDSLSPEATTLPCQQHVTHDITRRDIDDGT

SEQ ID NO: 196941 - protein, 490 aa, Glycine max
  Coding DNA Sequence Number=SeqID_80163
  Homolog annotation: Hit_ID=Q2R276; Match level="QueryCoverage=73%, HitCoverage=67%, E-value=5e-21, Identity=48%"; Hit description =Expressed protein
  Pfam annotation: Domain name=DUF593; Domain location=63-156; Score =183.7; E_value=4.6e-52; Accession=PF04576.6; Description=Protein of unknown function, DUF593
MASEVVPSSGDLLKCCNCGCGCSLVAHSSGTWMRSVKRKLDEFKMDDQLPIPAFARIEIENECVALREMVSMQQRTIQDLNAELDEERNSSSTAANEAMSMILRLQREKAEVQMEARQFKRFAEEKMTHDQEELLSLEDLLYKREQIIQSLTCEVQAYKHRLMSFGLTEDEAEGDQYELPTYEYPPLKCNVMHDAMDADNDDTDIEKYVFDETPSDRLRNLENRISKMEKTSTYSQMDGDFTGKNVLEKVIVGQSPRWTKHPRRSSSDSASLSGMGKEIGPESMMDSPKLNSNYRRDYFSQSEDPSNFKKVDNASDDDDTSDRIYTIDSVHCGAPYNGFTDSKAGAFEDYATTPRESGNHAADFEDPYIKKLHMRLQALEADRESMRQAIISMRTDKAQVVLLKEIAQHLCKEMSPKRKMARKPYFAGNSNSMLFSIVKWISSIVFWRKRAHQSKYMFGLPLESVGLLMLLDKGTRARPWRCISSTQVWD

SEQ ID NO: 196942 - protein, 167 aa, Glycine max
  Coding DNA Sequence Number=SeqID_80164
MNSSHDKSKPVEARNRSPDLNESKEINREFDHRDKNMISNTYNGECKMAGTDGCGVVSYHSDKLSSVKDKRATMMSDIIEVRKEKVGDAVTELVLSASEIIEPCHSHFVAEDKLFVMLMSFPTRLDDKDGKHGGDIDDDVVELKSQSHDSNTKANTWLSSMVNMDCL

SEQ ID NO: 196943 - protein, 93 aa, Glycine max
  Coding DNA Sequence Number=SeqID_80165
MVVSWGCRGGRTSFGSGRGNGGRNGKICTHRGITGHTVEECYKKHSYPLWHQLHKPSQGANINNSVVENETSDNQNSDNQSSGSGMMIIAQQY

SEQ ID NO: 196944 - protein, 299 aa, Glycine max
  Coding DNA Sequence Number=SeqID_80166
  Gene Ontology: Mol. function=protein serine/threonine kinase activity; Cellular component=integral to membrane; Biological process=protein amino acid phosphorylation
  Homolog annotation: Hit_ID=Q10NL7; Match level="QueryCoverage=42%, HitCoverage=74%, E-value=2e-19, Identity=42%"; Hit description =Expressed protein
  Pfam annotation: Domain name=LRR_1; Domain location=16-38; Score =21.2; E_value=0.0037; Accession=PF00560.23; Description=Leucine Rich Repeat
  Pfam annotation: Domain name=LRR_1; Domain location=40-62; Score =12.6; E_value=1.2; Accession=PF00560.23; Description=Leucine Rich Repeat
  Pfam annotation: Domain name=LRR_1; Domain location=69-91; Score=7.6; E_value=11; Accession=PF00560.23; Description=Leucine Rich Repeat
  Pfam annotation: Domain name=LRR_1; Domain location=93-115; Score =5.1; E_value=31; Accession=PF00560.23; Description=Leucine Rich Repeat
  Pfam module annotation: Pfam domain module=LRR_1::LRR_1::LRR_1::LRR _1; Domain location=16-38::40-62::69-91::93-115
MLEGPIPDGFGKVMNSLEVLDLSGNKLQGEIPSFFGNMCALQSLYLSNNKLKGEISSFFQNSSWCNRYIFKSLYLSYNRLTGMLPKSIGLLSELEDLYLAGNSLEELVVSEIGPKRPIKPNRSEPDAVFQYPVAAASVNNIPELHKFQSLQSPSHAIISSAGFVDAQDEFVETQYYKELASIDKQHHTTVSGFIKAAREGGEGEYEIQLPNNHVNAAETQPRSYKSNPATNDWVPNSDEHQAQELKGTVPTGVGAKGHSTRGLRAAPMRSTKLTQRTNKEKVLAAGEDEDIVGNKAFYV

SEQ ID NO: 196945 - protein, 115 aa, Glycine max
  Coding DNA Sequence Number=SeqID_80167
MVAYNAMKCWAKDVNESIDHRGKRLYHVSIGPLREVGKSLHKTASSLEYKFTQVRYVHDAINEWVQLNGIIVDVQGPKFGVDWGFLLITVRGEKSMVFLVSCFGMGGYLKGWGVW

SEQ ID NO: 196946 - protein, 115 aa, Glycine max
  Coding DNA Sequence Number=SeqID_80168
MERYMTIFVKIRDLDLGVTLHSMITTLKLGMFIDNLCRKQPKDLDELRAKVTRSSRWRNYLLSTTKYVLESRKRGTHQRQNIEVGARAEERRHQVSPKKTLVNHQKHKPYQCHTC

SEQ ID NO: 196947 - protein, 116 aa, Glycine max
  Coding DNA Sequence Number=SeqID_80169
MRVIMEMDGSGIDGASHIGKQNEFLEGLCGFEEVATANGDIDEFRVELGVQEVRDHVGDLGDEIRVEGVVGGEGFGGEGLRWNRCVLLRGRGRRRQSSESEKEGLEELRDGEGATK

SEQ ID NO: 196948 - protein, 156 aa, Glycine max
  Coding DNA Sequence Number=SeqID_80170
MSYKFIMVIPNSHFLDHVLSSSTTPVEEQVEGNHTNVGILYVSQTKGEKKGLEDEAKKRKSNGDKEPTEKLENEKIERKKQRKKKRKRWKSLRSWPKLKKRRGQTHKSTLLMSKDNPSSRTETVSKAYEKSKVMFVQMKAIKVEVRKTKQLGAMVV

SEQ ID NO: 196949 - protein, 322 aa, Glycine max
  Coding DNA Sequence Number=SeqID_80171
  Gene Ontology: Mol. function=RNA-directed DNA polymerase activity; Cellular component=mitochondrion; Biological process=RNA-dependent DNA replication
  Pfam annotation: Domain name=rve; Domain location=101-257; Score =66.7; E_value=7.4e-17; Accession=PF00665.16; Description=Integrase core domain
MSSQLHSRTPPTEDNDEEQNNRVDALTRLTSTKRPGQHWTFIQETLTSHTTEDHTMYVLDMVHRGNYGMHTRGRNMATRFIRAGYSCNVHYTPLEELHNITFPWSFAMWGMDILRPFPITKTQIKFLLITMDYTKWIEAEPLENITTQKVQKITWKNIIYRYDLPEPIMTDNRKKFMEKGYEDFLKQLDIRHLTSLAKHPQTNGQVEAANKVILTELRKTLSKIPKGLWVDELPSMFWGIMFNTSNNSESLAVELDLAEEVRGEARFHEEACKTRVSKKYNSKLKKRSFKANNMNDAYRLEDMAERAIPRTQNATYIRPYYS

SEQ ID NO: 196950 - protein, 218 aa, Glycine max
  Coding DNA Sequence Number=SeqID_80172
MKFAMMMETTIGSSWLTGLMPLKSLSIKVPFLGLIGLSSIGKAASDGLDYTSDVLGSLLLFFCLLPSFCAAPLDVLWVLVLLGGCLGCVMLVPGPFGEKLMLVWPVPLVQLVQVDLGVYFSLVALLSGLADFILESEHFFHLDVALGSFAQFVRELARTGQGGQGHAVRPTSGVLRTESFDKGVKVVYGSRWKSVVPSQCFPLRDIGKTRHKIVSSLV

SEQ ID NO: 196951 - protein, 37 aa, Glycine max
  Coding DNA Sequence Number=SeqID_80173
MESNPTNDILRVKTMDVCKGSHGEVVAVDKKKGLVQV

SEQ ID NO: 196952 - protein, 285 aa, Glycine max
  Coding DNA Sequence Number=SeqID_80174
MASANTPTTETIPTMEITTIPKDNEPSIHRHVEFVNKKTVASKVLGVKVVLSYNTIAKATRCLREGSTYRRAGRKLKGLGGQDDIYYATFINKLLWDQGVSHVFNKMDKNYKHNLIAKGSVVTKQQNFSKTNLKAMKKRKKTKKQSQKDEEEKELLAREHRTKRSHKSIVSVPPVMTSVPQRLKDLSETDEDDEGLIQVAWRKRKATALVSLAPKRDKKVRPVLEPQVFLIPFAILRCIKMRATKANPKIGDKEWAVSFTGNKEDLTSSSSDNESTNGTPISPLH

SEQ ID NO: 196953 - protein, 389 aa, Glycine max
  Coding DNA Sequence Number=SeqID_80175
MSEESKASICCNETRMSEKERGTCLLPCAECESKLCRGDSSLEEQRVTGLSSPQSVDESCPVSSVTTLTRSALKTNVTSIFYNRHMRHTLCTLPYVSLIELARIGMVAIPHLRILTEVLPTASPPRVRGEGASCPRGGVRPSADIREPVSVTMILPLQRRKQDLVDVEVLPNSGVAVRLVELGPLTMVVVAAAWMGLSNGKGFTKGEPWVCRALDQGRSASAELGFDESCMADLGFCEPFGGLTKELSNLGFGHRALAYMPLFMVERTRDVLWVSYTRDLVGCSCAHVVGARTGDLVVCSSAHAMGGTYWRLVFVLLDDARTHMPWVACTRGLAGCLCAHVTHLGWHSPCQWFLGFYGDHGICAICESGPEDDSINCLCLSVSLGCSIE

SEQ ID NO: 196954 - protein, 70 aa, Glycine max
  Coding DNA Sequence Number=SeqID_80176
MVEGACEYGMDATWYDDAKTSFNMPELQRQLMGVHAMAVGERCIMKKEHLKTLLKLGSNKEEAIKKNEEK

SEQ ID NO: 196955 - protein, 185 aa, Glycine max
  Coding DNA Sequence Number=SeqID_80177
MQEHGAQNLSWTIPWSILQRAHKTQGPPLVSPTNSHHHASNTSHFVRGTHARAQHLHYMQDSSNPSSALADPYTSTKSKAHPWSALGTYFYKAQGTLLVRSHAAATTTIVKGPSSTRRTATPLFGKTFNQRSTFAGQDDPPPNCMTRPLIGCSSHLLLITIKGETKQVKRPIPTLVRQDLQPGAS

SEQ ID NO: 196956 - protein, 93 aa, Glycine max
  Coding DNA Sequence Number=SeqID_80178
  Gene Ontology: Mol. function=oxidoreductase activity, acting on the CH-OH group of donors, NAD or NADP as acceptor
  Homolog annotation: Hit_ID=Q84JM5; Match level="QueryCoverage=82%, HitCoverage=12%, E-value=3e-21, Identity=69%"; Hit description =Angustifolia
MESIDRRRTRKRYRTSIEIQHAHFEGQAASGQGPSGIGDSDDAENEAAAAAHAAAGQSRANRRQRGGACGGRGRGRAPWQCPRSPQRARCRRG

SEQ ID NO: 196957 - protein, 118 aa, Glycine max
  Coding DNA Sequence Number=SeqID_80179
MGGKEEEEAEGKWRKPEKKRRKKVKVSMIVMVKVFMGLEGTGIVEGKKMGVLTLSSSQRGHGHGNGMDSVAGFAEDGSVVGGSDYIDSRMGKLDLGDDVEGVEYGVTCAETKGCIGND

SEQ ID NO: 196958 - protein, 155 aa, Glycine max
  Coding DNA Sequence Number=SeqID_80180
  Gene Ontology: Mol. function=sucrose transporter activity; Cellular component=integral to plasma membrane; Biological process=sucrose transport
  Homolog annotation: Hit_ID=Q7XA53; Match level="QueryCoverage=55%, HitCoverage=17%, E-value=4e-25, Identity=70%"; Hit description =Sucrose transporter
MLNSLVLAATSLGVEVLARGVGGVKRLWGIVNFLLALCLAITVLVTKLAQHTLLPNSHQEPLPPPAAVKAAALALFSVLGIPLAHTLCSSINILQYLRGRPSIRGGCGGGSRQWHFIHNPAAISTTGFGQSSNHSRRRSLMWLYITLLKQDPALS

SEQ ID NO: 196959 - protein, 84 aa, Glycine max
  Coding DNA Sequence Number=SeqID_80181
  Gene Ontology: Mol. function=oxidoreductase activity; Biological process=lignin catabolic process
  Homolog annotation: Hit_ID=Q9SR40; Match level="QueryCoverage=98%, HitCoverage=16%, E-value=3e-18, Identity=54%"; Hit description =Putative laccase
MASIFMFWLKGLGIRMPLEMSPSSILSTLKYLTRFLCPSEDGVWLVHCHLETHLPWGLAMAFEVENGPSPSFSGPPPPSDLPKC

SEQ ID NO: 196960 - protein, 343 aa, Glycine max
  Coding DNA Sequence Number=SeqID_80182
  Gene Ontology: Mol. function=tRNA adenylyltransferase activity; Cellular component=mitochondrion; Biological process=RNA processing
  Homolog annotation: Hit_ID=Q42867; Match level="QueryCoverage=98%, HitCoverage=59%, E-value=1e-140, Identity=75%"; Hit description=TRNA nucleotidyltransferase
  Pfam annotation: Domain name=PolyA_pol; Domain location=99-238; Score= 227.0; E_value=4.3e-65; Accession=PF01743.10; Description=Poly A polymerase family
  Subcellular localization annotation: CTP_CleavageSite=60; ConfidenceScore=5.45e-01
MKVALNIATRLLVVHPRPNLNSVRDFSSSQTPTFVLPLLHTHRPAKTLLRIATPSFRSCGCAPMSKLHIRDKIDLSDIERRIFDRLLATLRHFHLQTQLRVAGGWVRDKLLGKECYDIDIALDNMMGTEFVDKVREYLLSIGEDAQGVCVIESNPDQSKHLETARMRLFDIWIDFVNLRSEEYTENSRIPSKQRFGTAEEDAYRRDLTINSLFYNINTDSVEDFTKRGISDLKSGKIVTPLPPKATFLDDPLRVLRAIRFGARFEFTLDEDLKVAAACDDVKDALAAKISRERIGTEIDLMISGNQPIKAMTYICDLTLFWIVFSLPPEFEPAISDGCERYSL

SEQ ID NO: 196961 - protein, 190 aa, Glycine max
  Coding DNA Sequence Number=SeqID_80183
  Gene Ontology: Mol. function=transferase activity, transferring glycosyl groups; Cellular component=integral to membrane; Biological process=protein amino acid glycosylation
  Homolog annotation: Hit_ID=Q5DTC7; Match level="QueryCoverage=52%, HitCoverage=25%, E-value=2e-41, Identity=76%"; Hit description=Alpha 1,4 fucosyltransferase
  Subcellular localization annotation: CTP_CleavageSite=46; ConfidenceScore=5.70e-01
MLTFTFFLLFFSGFLHFPSASSSSFPPITRPTTTPPTAEPFSDLVAAFRKWDSQVGCARFKQKPNGVPLNHSKVASLQEVSDCGGLKLNHVSVLVKGWTWIPDNLDNLYSCSCGLSCLWTKSPVLADKPDALFFESSTPPLQFFTAGSIDSENFLRLDVGVDLGHLFWCTRSGSHGKLMAPGSYKDNYPF

SEQ ID NO: 196962 - protein, 205 aa, Glycine max
  Coding DNA Sequence Number=SeqID_80184
  Gene Ontology: Mol. function=protein binding; Biological process =xylan catabolic process
  Homolog annotation: Hit_ID=Q6QM01; Match level="QueryCoverage=92%, HitCoverage=15%, E-value=1e-22, Identity=34%"; Hit description=LRR protein WM1.10
MGNIPKWIPHGAKALHLRSNKFSSSIPTQMCQMSSLIILDIANNTISGHIPTCLHNITALVFNNASLNKLSFEFPTIDTLGIVDNPYYALVDSLELVTKGQVKYHQGFSALSYVGNRDLCGPPLTKICFQGGKPNNTEPIDEDGDEFAFLSWLYIGIESGFATGFLGFCCVIFLIRKWRHAYFKFLYDLKDQLYVMVAIKMNSFR

SEQ ID NO: 196963 - protein, 77 aa, Glycine max
  Coding DNA Sequence Number=SeqID_80185
  Gene Ontology: Mol. function=nucleotidyltransferase activity; Cellular component=mitochondrion; Biological process=RNA processing
  Homolog annotation: Hit_ID=Q94K06; Match level="QueryCoverage=96%, HitCoverage=13%, E-value=4e-14, Identity=43%"; Hit description=TRNA adenylyltransferase-like protein
MVMPMNYVVVESLEKVWDIKQLINGKDVMNALQLKGGPLVKESLDKAMAWQLAHPSGTAEECIEWLREANSKRIKLQ

SEQ ID NO: 196964 - protein, 66 aa, Glycine max
  Coding DNA Sequence Number=SeqID_80186
MSLFHVELSDTSFYPIINAFVLMLIQTFSKGGDEYQSVPNQVQTDHASSSVSEAESKEYKPGDKKD

SEQ ID NO: 196965 - protein, 166 aa, Glycine max
  Coding DNA Sequence Number=SeqID_80187
  Homolog annotation: Hit_ID=Q9M621; Match level="QueryCoverage=14%, HitCoverage=5%, E-value=7e-09, Identity=100%"; Hit description =ReMembR-H2 protein JR702
LTEALLGLGMCGDMYLELRDDKDGYPMEHGGLMVGGPKRWLNIRCTGYGVVTGNRWASDDLAECKAEDAIDAVRAICIAEDEARDDLAEGKAEDAIDAVRAICIAEDEASDDLAEDKTEDAIDAGVDESKGVDSEGGGSVKPVLASRLQTGQKVLHEVSHESTQAA

SEQ ID NO: 196966 - protein, 270 aa, Glycine max
  Coding DNA Sequence Number=SeqID_80188
  Gene Ontology: Mol. function=structural molecule activity; Cellular component=intracellular; Biological process=signal transduction
  Homolog annotation: Hit_ID=Q6AT64; Match level="QueryCoverage=64%, HitCoverage=31%, E-value=2e-32, Identity=43%"; Hit description =Putative ankyrin
  Pfam annotation: Domain name=Ank; Domain location=149-182; Score =19.3; E_value=0.014; Accession=PF00023.20; Description=Ankyrin repeat
  Pfam annotation: Domain name=Ank; Domain location=183-215; Score=7.0; E_value=3; Accession=PF00023.20; Description=Ankyrin repeat
  Pfam annotation: Domain name=Ank; Domain location=28-60; Score=18.5; E_value=0.024; Accession=PF00023.20; Description=Ankyrin repeat
  Pfam annotation: Domain name=Ank; Domain location=62-94; Score=33.8; E_value=6e-07; Accession=PF00023.20; Description=Ankyrin repeat
  Pfam module annotation: Pfam domain module=Ank::Ank::Ank::Ank; Domain location=149-182::183-215::28-60::62-94
MGTRLWLQGPRPSQRLEIIFSVTKVFVLPNTALHLAVREGLRDCVRLLQANEARTDILDSRDGDTCLHVAAGVGDESMVKLLLNKGTNKEVRNFKGETTYDVAVKKGHAHVFDALRLEDGLCVVARKREVRSIKRLIEGGTSMDGRDQHGWTALHMAWFKGRVEAVRALLLEKGFEVDTRDEEGYTALHCTVETGHADVAEVPVKRQGMFDCVADLLFCSLLVQLGILNVIQAMELAPEVFHLWMITCVAGSINSSEEPIIKRGQELQKI

SEQ ID NO: 196967 - protein, 145 aa, Glycine max
  Coding DNA Sequence Number=SeqID_80189
  Gene Ontology: Mol. function=oxidoreductase activity; Cellular component=intracellular; Biological process=lignin catabolic process
  Homolog annotation: Hit_ID=Q9SR40; Match level="QueryCoverage=74%, HitCoverage=19%, E-value=1e-41, Identity=64%"; Hit description =Putative laccase
  Pfam annotation: Domain name=Cu-oxidase_3; Domain location=26-138; Score=175.4; E_value=1.5e-49; Accession=PF07732.5; Description =Multicopper oxidase
MICAWTFALVLASSLAHAAVVEHTFNVEDISVQRLCRQQPITAVNGTLQGPTINAREGDTIVVYVFNKSPYNLTLHWHGIIQFLTPWSDGPEFVTQCPIPSGGSYTYKFNLTGQEGTLWWHAHSSFLRATACISEEFSAKYDCLI

SEQ ID NO: 196968 - protein, 208 aa, Glycine max
  Coding DNA Sequence Number=SeqID_80190
  Subcellular localization annotation: CTP_CleavageSite=40; ConfidenceScore=5.68e-01
MDSSSSASVCQHAKVVPKQYDIFHAGRYPSSRRTHSSSSSCSSLSPSSSSFESFFFPEDPLLSPASPLRFSGVPFSWEYLPGIPKKQNSKKKLQESSLKLLPLPPPTTTHSSRKHTHEETRIRKKNSIQSVFQRDPFFAALVECSKDDSEETSRNLWNGAKVPRSVSDRFGFISLYASCKRTCAVSESLVYLPSSRRSTCEHVSPRSL

SEQ ID NO: 196969 - protein, 90 aa, Glycine max
  Coding DNA Sequence Number=SeqID_80191
QKGHRPERGPNIEAKTPKAYEYTREANSCTGMVSPDSPSIGRRMGMQVLCGHSFLRKLGFKTGSTVYQLHKYRSISKILSSKGFVQYQTN

SEQ ID NO: 196970 - protein, 69 aa, Glycine max
  Coding DNA Sequence Number=SeqID_80192
MAKEMIHGRNSPGKLAQVSQLLRLEGISSLRRAGCLRMKLSHGPGEDVESYGNIKMRTLSPIGHKDKGH

SEQ ID NO: 196971 - protein, 525 aa, Glycine max
  Coding DNA Sequence Number=SeqID_80193
  Gene Ontology: Mol. function=nucleoside-triphosphatase activity; Cellular component=integral to membrane; Biological process=transport
  Homolog annotation: Hit_ID=Q84TH5; Match level="QueryCoverage=96%, HitCoverage=77%, E-value=0.0, Identity=62%"; Hit description=White -brown complex homolog protein 26
  Pfam annotation: Domain name=ABC2_membrane; Domain location=259-465; Score=181.6; E_value=2e-51; Accession=PF01061.14; Description=ABC-2 type transporter
  Pfam annotation: Domain name=ABC_tran; Domain location=1-151; Score =67.3; E_value=5e-17; Accession=PF00005.17; Description=ABC transporter
  Pfam module annotation: Pfam domain module=ABC2_membrane::ABC_tran; Domain location=259-465::1-151
KLTKPVLRRTGFVTQDDILYPHLTVRETLVFCAMLRLPRALLRSEKVAAAEAAIAELGLGKCENTIIGNSFIRGVSGGERKRVSIAHEMLVNPSLLILDEPTSGLDSTAAHRLVLTLGSLAKKGKTVITSVHQPSSRVYQMFDKVVVLTEGQCLYFGKGSDAMRYFQSVGFAPSFPMNPADFLLDLANGVCHVDGQSEKDKPNIKQSLIHSYNTVLGPKVKAACMDTANVPTKNTHPWRSNSSKEFRRSNRVGFLDWFYQFSILLQRSLKERKHESFNTLRVCQVIAAALLAGLMWWHSDYRNIQDRLGLLFFISIFWGVFPSFNSVFAFPQERTIFMKERASGMYTLSSYFMARIVGDLPMELILPTIFLIVTYWMGGLKPDLWAFLLTLLVVLGYVMVSQGLGLALGAAIMDAKQASTVAAVTMLAFVLTGGYYVHKVPSCMAWIKYISTTFYCYRLLTRIQYEDGKKISYLLGCYHGDKGGCRFVEEDVVGQIGTLGCIGVLLFMFVFYRLLAYLALRRIKS

SEQ ID NO: 196972 - protein, 61 aa, Glycine max
  Coding DNA Sequence Number=SeqID_80194
MKADMEAMKEQMTTMMEAMMNMRKMMEDNTAIVVDASTSIEMDLIHPTGFNQVNHPVSDVV

SEQ ID NO: 196973 - protein, 84 aa, Glycine max
  Coding DNA Sequence Number=SeqID_80195
MAKANKRKHVRLLGRKRVKIHLVQGKLARASQLLRLQGINSPRRASCLRLKLSHGPGEPDASLGASKVIVTTIWILDTRRYDGA

SEQ ID NO: 196974 - protein, 74 aa, Glycine max
  Coding DNA Sequence Number=SeqID_80196
MSLKLLPPSNIRSCALLLYMPLKGQLYMHGVTIGIAKLSFYKAPLYYTTQQREHESSMPSISLATYHVQYIMKK

SEQ ID NO: 196975 - protein, 263 aa, Glycine max
  Coding DNA Sequence Number=SeqID_80197
  Gene Ontology: Biological process=protein transport
  Homolog annotation: Hit_ID=Q8S3U9; Match level="QueryCoverage=84%, HitCoverage=20%, E-value=5e-86, Identity=70%"; Hit description =Exocyst complex component 2
ANLIRSAAMNYLLHSGIQWGAAPAVKGVRDAAVELLHTLVAVHAEVFAGAKPLLDKTLGILVEGLIDTFISIFHENEATDLSAIDTNGFCQLMLELEYFETILNPYFTSDARDSLKSLQGLLLEKATESVTDAVDNPGHNRRPTRGSEDALADDKQQGTTVSPDELISLAQQYSSEFLQSELERTRINTACFAESIPLDSLPEPAKSAYSPFRNSMDSPSRKHRVDENLYSLHCYLFVKVDDNYHIMSFGTYVGIHVCQSQVQ

SEQ ID NO: 196976 - protein, 360 aa, Glycine max
  Coding DNA Sequence Number=SeqID_80198
  Gene Ontology: Mol. function=transcription factor activity; Cellular component=nucleus; Biological process=regulation of transcription, DNA-dependent
  Homolog annotation: Hit_ID=Q1SHW5; Match level="QueryCoverage=88%, HitCoverage=100%, E-value=2e-79, Identity=56%"; Hit description =Pathogenesis-related transcriptional factor and ERF
  Pfam annotation: Domain name=AP2; Domain location=68-132; Score =127.3; E_value=4.2e-35; Accession=PF00847.10; Description=AP2 domain
  Subcellular localization annotation: CTP_CleavageSite=16; ConfidenceScore=5.28e-01
MATSPNVTTFNTKLHSCAYKSRSIPPTSCINSTTLHCSIPIMEGCKMSPQKPWKKGPTRGKGGPQNSSCEYRGVRQRTWGKWVAEIREPKKRTRLWLGSFATAEEAALAYDEAARRLYGPDAYLNLPNVMMMQKIQPTASFTNSTITTTKSHKYFNWFPSKNFISMFPSSGGLLNLNAQPSVHVIHQRLQELKQNGVVATSQNQSSPHASSLSTHPKVVVELENLDIQNHAETLVPPLQEGNSQVSSQKTIIGGDFEKPQIDLLEFLQQMGILKEEREEEKTDSSGSSTTVSEAVSRDDQSEQQPGVFSDDMSSVNWEELMEMHEHDRGVVDNYHALEEIQFEAYDINEDLTFSTSIWNY

SEQ ID NO: 196977 - protein, 87 aa, Glycine max
  Coding DNA Sequence Number=SeqID_80199
MESNIRFLEVYSGLNTKQIYNLKIECSQQQNGSVKAPDHTGNGCGVEVSGDCDFVYQGEKINLEMKKQAEQDLCLNKPQASLVFPGI

SEQ ID NO: 196978 - protein, 222 aa, Glycine max
  Coding DNA Sequence Number=SeqID_80200
  Subcellular localization annotation: CTP_CleavageSite=45; ConfidenceScore=5.22e-01
MSRPFGVRSCGWTFMKPSLLAMMEATMLSIAKSFKCYILSRCNTLMMLVSSSPRMLTTTPSFNDEEEAAIFANDIASSIQVQSSAKAMANTIVCGVTIDPTNTSVMEENLEVSNVAMANEIQHHVQDPAFKQSRTSNKATSRDKGEHNVVIVYSTSPDPAPLNYAQLATVTCDQVEDMIGQDMETFAEHQRQENEQFWLSIQPSLPSSPPPSQPPPPPPAQD

SEQ ID NO: 196979 - protein, 93 aa, Glycine max
  Coding DNA Sequence Number=SeqID_80201
MGAPSETLSLEVPLLVKGPFNVSLIDPKRYCFESSFYPSTSAYYDMFEWSLPYDKSAGEKPKEHLPKRKMCGSHHQCLFEENVRKTKKEVCEF

SEQ ID NO: 196980 - protein, 100 aa, Glycine max
  Coding DNA Sequence Number=SeqID_80202
  Homolog annotation: Hit_ID=Q5BLY1; Match level="QueryCoverage=59%, HitCoverage=6%, E-value=2e-23, Identity=80%"; Hit description =Plastid alpha-amylase
MSLTYLDAAWKDGKAPIDSFTLKTSSLVILFCFMIRKIDELKNSVKRFDEIGIKVLGDAVLNHHCAHYRNQNGIWNIFGGPLNWDDRAVVADDPHFQETE

SEQ ID NO: 196981 - protein, 679 aa, Glycine max
  Coding DNA Sequence Number=SeqID_80203
  Gene Ontology: Mol. function=protein serine/threonine kinase activity; Cellular component=cell surface; Biological process =protein amino acid phosphorylation
  Homolog annotation: Hit_ID=Q1S9U2; Match level="QueryCoverage=97%, HitCoverage=97%, E-value=0.0, Identity=67%"; Hit description=Protein kinase; Concanavalin A-like lectin/glucanase
  Pfam annotation: Domain name=APH; Domain location=354-535; Score= -13.4; E_value=0.051; Accession=PF01636.13; Description =Phosphotransferase enzyme family
  Pfam annotation: Domain name=Lectin_legB; Domain location=36-271; Score=257.8; E_value=2.3e-74; Accession=PF00139.10; Description =Legume lectin domain
  Pfam annotation: Domain name=Pkinase; Domain location=351-620; Score =179.3; E_value=9.8e-51; Accession=PF00069.15; Description=Protein kinase domain
  Pfam annotation: Domain name=Pkinase_Tyr; Domain location=351-620; Score=125.4; E_value=1.5e-34; Accession=PF07714.7; Description =Protein tyrosine kinase
  Pfam module annotation: Pfam domain module=APH::Lectin_legB::Pkinase:: Pkinase_Tyr; Domain location=354-535::36-271::351-620::351-620
  Subcellular localization annotation: CTP_CleavageSite=56; ConfidenceScore=5.68e-01
MVFFASVSNSNQCRKQTLLFIFTIFTLFHTLFTTVVSLSFNSSTFQLNSNNLIDFKGDAFSSNGVLQLTKNQIDDKITFSVGRASYNQPVRLWDGRTKKLTDFTTHFSFVMKAIDPSRFGDGLAFFLAPFDSVLPNNSAGGYLGLFSNESAFNTKKNQLVAVEFDSFKNEWDPSSDHVGINVNSIQSVTNVTWKSSIKNGSVANAWIWYNSTTKNLSVFLTYANNPTFNGNSSLWYVIDLRDVLPEFVRIGFSAATGSWIEIHNILSWSFSSSLDEGSRKKVKVGLVVGLSVGLGCLVCVVGLLWFTFWRRKNKGKEDNLGVDASIDDEFERGTGPKRFTYPELSNATNNFAEEGKLGEGGFGGVYKGIVVHSNLEVAVKRVSKGSKQGKKEYVSEVRVISRLRHRNLVQLIGWCHEQGELLLVYEYMPNGSLDSHLFGNRVMLSWVVRHKVALGLASALLYLHEEWEQCVVHRDIKSSNVMLDANFNAKLGDFGLARLVDHELGSQTTVLAGTMGYLAPECVTTGKSSKESDVYSFGVVALEITCGRKPVEVREEPSKVRLVEWVWSLYGKGKLLEAADQKLNWEFEEQQMECLMIVGLWCCHPDHTMRPSIRQVISVLNFEAPLPSLPSKLPVPMYYAPPMDMCKFSYTSSGVTSTTKASSPYSSISEGSGKSLLKH

SEQ ID NO: 196982 - protein, 79 aa, Glycine max
  Coding DNA Sequence Number=SeqID_80204
MWWSNDKKQELWWPPMVMGGGKEGVRNCAQCTCLAKRDVQKYYFANPNSQSLKSWVTKLQSKFEGDPTFNKFGITGLPK

SEQ ID NO: 196983 - protein, 65 aa, Glycine max
  Coding DNA Sequence Number=SeqID_80205
MKYFHCSAQVNFIPMLNGTNFKSSKELIGIILGGMDLDLTWMTERPILTPETSNEGKLEKWDWFN

SEQ ID NO: 196984 - protein, 230 aa, Glycine max
  Coding DNA Sequence Number=SeqID_80206
  Gene Ontology: Mol. function=hydrolase activity; Cellular component =nucleus; Biological process=metabolic process
  Homolog annotation: Hit_ID=Q0ZPW1; Match level="QueryCoverage=96%, HitCoverage=64%, E-value=2e-55, Identity=51%"; Hit description=CXE carboxylesterase
  Pfam annotation: Domain name=Abhydrolase_3; Domain location=84-230; Score=64.2; E_value=4.2e-16; Accession=PF07859.3; Description =alphabeta hydrolase fold
MAFPPHVVEDCMGLLKLLSDGTVLRSNINFQEQPQPTQHDNLVQFKDFVFLKKFNLHLRFYKPKFEDNDDDDNENNNKKLLPVVMFLHGGGFCFGSRAWPHMHSCCVRLATSLRAAVVAPDYRLAPEHRLPAAVDDGVEAVRWLQRQKGHHGGDEWVTRGVDFDRVFILGDSSGGNIAHHLAVQLGPGSREMDPVRVRGYVLLGPFFGGVVRTRSEVGPPEQMLTLELLD

SEQ ID NO: 196985 - protein, 128 aa, Glycine max
  Coding DNA Sequence Number=SeqID_80207
  Gene Ontology: Mol. function=protein dimerization activity
  Homolog annotation: Hit_ID=Q9ZWT4; Match level="QueryCoverage=98%, HitCoverage=24%, E-value=9e-20, Identity=35%"; Hit description =Transposase
MGMLKRVFFYPIHVADTSSLTLKKEISSVLSRHCLDIQNLRGQGYDGASNMREKLAIMFKNFFSSLSLIVNVVIASPKQHDQLPAAHATIIANLIASDDIAMVLQNAIEDGNYSLRDDANSAYDILTS

SEQ ID NO: 196986 - protein, 64 aa, Glycine max
  Coding DNA Sequence Number=SeqID_80208
  Homolog annotation: Hit_ID=Q8H3G8; Match level="QueryCoverage=72%, HitCoverage=5%, E-value=8e-11, Identity=68%"; Hit description=Myosin heavy chain-like protein
IEEYVRKSICNSCECWENAENEGTSLKKQVQAPTLKNSTLEDRVTHLDNALKECVRQLRQTRCL

SEQ ID NO: 196987 - protein, 186 aa, Glycine max
  Coding DNA Sequence Number=SeqID_80209
  Homolog annotation: Hit_ID=O22901; Match level="QueryCoverage=21%, HitCoverage=41%, E-value=4e-07, Identity=69%"; Hit description =Expressed protein
  Subcellular localization annotation: CTP_CleavageSite=59; ConfidenceScore=5.23e-01
MGISSQPSLVSFSLKDLIQGTEENKTSSSYGCLWSKVLTAQAKKVKGTKRSVRRPRRILMMNRRSGSRRGSYNGIRRRVRTLKSLVPNSDSLGLDGLFRQTADYILSLQTRVRVMQVMVKLQKHWFQNFMFIIVSCHLDLDQFYDHGLKGESSKNDATCTSILDAVNVARTKNRISGLDAMSQSKI

SEQ ID NO: 196988 - protein, 518 aa, Glycine max
  Coding DNA Sequence Number=SeqID_80210
  Gene Ontology: Mol. function=protein serine/threonine kinase activity; Cellular component=cytoplasm; Biological process=protein amino acid phosphorylation
  Homolog annotation: Hit_ID=O24430; Match level="QueryCoverage=99%, HitCoverage=100%, E-value=0.0, Identity=93%"; Hit description =Calmodulin-like domain protein kinase isoenzyme beta
  Pfam annotation: Domain name=Pkinase; Domain location=24-282; Score =375.4; E_value=8.9e-110; Accession=PF00069.15; Description=Protein kinase domain
  Pfam annotation: Domain name=Pkinase_Tyr; Domain location=24-286; Score=-27.8; E_value=9.2e-11; Accession=PF07714.7; Description =Protein tyrosine kinase
  Pfam annotation: Domain name=efhand; Domain location=328-356; Score =40.7; E_value=5.2e-09; Accession=PF00036.22; Description=EF hand
  Pfam annotation: Domain name=efhand; Domain location=364-392; Score =26.8; E_value=7.8e-05; Accession=PF00036.22; Description=EF hand
  Pfam annotation: Domain name=efhand; Domain location=400-428; Score =34.5; E_value=3.8e-07; Accession=PF00036.22; Description=EF hand
  Pfam annotation: Domain name=efhand; Domain location=463-490; Score =2.6; E_value=7.7; Accession=PF00036.22; Description=EF hand
  Pfam module annotation: Pfam domain module=Pkinase::Pkinase _Tyr::efhand::efhand::efhand::efhand; Domain location=24-282::24 -286::328-356::364-392::400-428::463-490
MQKHGFASKRNVLPYQTARLRDHYVLGKKLGQGQFGTTYLCTHKVTGKLYACKSIPKRKLMCQEDYDDVWREIQIMHHLSEHPNVVQIQGTYEDSVFVHLVMELCAGGELFDRIIQKGHYSEREAAKLIKTIVGVVEACHSLGVMHRDLKPENFLFDTPGEDAQMKATDFGLSVFYKPGQAFHDVVGSPYYVAPEVLCKQYGPEVDVWSAGVILYILLSGVPPFWAETEAGIFRQILNGDLDFVSEPWPSISENAKELVKQMLDRDPKKRISAHEVLCNPWVVDDIAPDKPLDSAVLTRLKHFSAMNKLKKMALRVIAERLSEEEIGGLKELFKMIDTDNSGTITFEELKEGLKSVGSNLMESEIKSLMEAADIDNNGSIDYGEFLAATLHLNKMEREENLVAAFAYFDKDGSGYITIDELQQACKDFSLGDVHLDEMIKEIDQDNLIKFGMLEVENGYLPKEIPCCIRIVLAVDGRIDYAEFAAMMKKGDPNMGRSRTMKGNLNFNIADAFGMKDSS

SEQ ID NO: 196989 - protein, 265 aa, Glycine max
  Coding DNA Sequence Number=SeqID_80211
  Gene Ontology: Mol. function=hydrolase activity; Cellular component =integral to membrane; Biological process=cell redox homeostasis
  Homolog annotation: Hit_ID=Q75IA4; Match level="QueryCoverage=84%, HitCoverage=82%, E-value=9e-78, Identity=64%"; Hit description =Expressed protein
  Pfam annotation: Domain name=SNARE_assoc; Domain location=111-232; Score=83.6; E_value=6.2e-22; Accession=PF09335.1; Description=SNARE associated Golgi protein
MAAPRNVTATRDEEKGEDDDSPSAKKPKSERFPLNTWEFAVAVAVFLVFSTGLFCIYLTMPSAAYTNLKLPRTLSDLRLLKEHLSTYASNHPAQFILGYCSTYIFMQTFMIPGTIFMSLLAGALFGVVRGILLVVFNATAGASSCFFLSKLIGRPLVSWLWPEKLRFFQAEIAKRRDRLLNYMLFLRITPTLPNLFINLASPIVDVPFHIFFSATLIGLVPASYITVRLPIGFCKVEKIMILHLGLHYSTVSLASPCSSQCRIAT

SEQ ID NO: 196990 - protein, 85 aa, Glycine max
  Coding DNA Sequence Number=SeqID_80212
  Homolog annotation: Hit_ID=Q00M75; Match level="QueryCoverage=32%, HitCoverage=4%, E-value=3e-08, Identity=100%"; Hit description=PPR -repeat containing protein
MTGGLSQIIKVRIKKLRTPLPRGSSLCEGMGEGCCTQCKEAVSGFEPITNKSPRHNFTAAPGLALYQSKDISKKNSGRNLLRRSI

SEQ ID NO: 196991 - protein, 294 aa, Glycine max
  Coding DNA Sequence Number=SeqID_80213
  Gene Ontology: Mol. function=protein serine/threonine kinase activity; Cellular component=cytoplasm; Biological process=protein amino acid phosphorylation
  Homolog annotation: Hit_ID=O24430; Match level="QueryCoverage=98%, HitCoverage=59%, E-value=1e-126, Identity=76%"; Hit description =Calmodulin-like domain protein kinase isoenzyme beta
  Pfam annotation: Domain name=Pkinase; Domain location=1-91; Score= -102.7; E_value=0.019; Accession=PF00069.15; Description=Protein kinase domain
  Pfam annotation: Domain name=efhand; Domain location=138-166; Score =36.3; E_value=1e-07; Accession=PF00036.22; Description=EF hand
  Pfam annotation: Domain name=efhand; Domain location=174-202; Score =27.9; E_value=3.5e-05; Accession=PF00036.22; Description=EF hand
  Pfam annotation: Domain name=efhand; Domain location=210-238; Score =32.6; E_value=1.3e-06; Accession=PF00036.22; Description=EF hand
  Pfam annotation: Domain name=efhand; Domain location=244-272; Score =38.5; E_value=2.3e-08; Accession=PF00036.22; Description=EF hand
  Pfam module annotation: Pfam domain module=Pkinase::efhand::efhand::ef hand::efhand; Domain location=1-91::138-166::174-202::210-238::244-272
MAPEVLRKQTGPEVDVWSAGVILYILLRGHPPFWAKSESAIFQEILHGEIDFVSDPWPSITESAKDLIKKMLDKDPEKRISAHEVLCHPWIVDDSVAPDKPLDPAVLTRLKHFSTMNKLQKMALRIIAERLSEEEIGGLKELFKMIDEDNSGTITFEELKDSLKSVGCDLIESEIKFLMEAADIDNNGTIDYGEFLAATLHLNKMEREENLVAAFAYFDKDGSGYITIEEIQQACKDFGLGNLHLDEIINEIDQDNDGRINYAEFAAMMRKGGPDVGRSRKDNYNASLLDMLVE

SEQ ID NO: 196992 - protein, 195 aa, Glycine max
  Coding DNA Sequence Number=SeqID_80214
  Gene Ontology: Mol. function=DNA binding; Cellular component=nucleus; Biological process=regulation of transcription
  Homolog annotation: Hit_ID=Q9C8W9; Match level="QueryCoverage=94%, HitCoverage=55%, E-value=2e-15, Identity=31%"; Hit description=NAM -like protein; 48543-50167
MKRYPPLSPKEEGWVVCRAFRKPSPSHRQGFDPWCSTSSQQQHFFRDQIQSYARPLSIADILNETNNVPHPVEGTSFSHSFNSDNQQHLNNIISNQTAIIMDKQLLELPQLDSPTASLAIKECNQQQHNGLTNEEYCSDERSNSSAQGIDWKSFDNLFGSQLSDNAAYFSHPNLPLVMPHNHDQASHILGCFPDS

SEQ ID NO: 196993 - protein, 262 aa, Glycine max
  Coding DNA Sequence Number=SeqID_80215
  Gene Ontology: Mol. function=structural constituent of ribosome; Cellular component=ribonucleoprotein complex; Biological process =translation
  Homolog annotation: Hit_ID=P51412; Match level="QueryCoverage=94%, HitCoverage=94%, E-value=1e-36, Identity=40%"; Hit description=50S ribosomal protein L21, chloroplast precursor
  Pfam annotation: Domain name=Ribosomal_L21p; Domain location=145-236; Score=141.4; E_value=2.5e-39; Accession=PF00829.11; Description =Ribosomal prokaryotic L21 protein
  Subcellular localization annotation: CTP_CleavageSite=64; ConfidenceScore=5.67e-01
MATATVSISTLCATFGTHCAISHNPKPLFSQPFNLNHFPSNSYKLAFSPRSPLSPLPKASESAVAETEPGSAEPEPAQISPAQPPSWEPGLFAVVMLFPMLGVGFGDPMWKSFKLWSEIVDPDEFFLVIVHVLVDVALWQLLSKMIGGRQYIVHPGRHLTVQRLKGANVNDKIALHKVLLVGTDTSCYIGKPIVTNAVVYATVEEQGLDPKVIVFKYKKKKHYRRNIGHRQPNTRIRINSIMGYENYPKVTMDDIKSDEPES

SEQ ID NO: 196994 - protein, 93 aa, Glycine max
  Coding DNA Sequence Number=SeqID_80216
MAIGYALLFVKVIIGYKLILASSKKTLGDEIFRSNDDDDCTLNACWWWRKTCPVVITIHDHQAHTCSHPDTDKSPLISLSQFSEFYSKDTIDH

SEQ ID NO: 196995 - protein, 495 aa, Glycine max
  Coding DNA Sequence Number=SeqID_80217
  Gene Ontology: Mol. function=transferase activity; Cellular component= membrane
  Homolog annotation: Hit_ID=Q10R19; Match level="QueryCoverage=82%, HitCoverage=70%, E-value=1e-176, Identity=70%"; Hit description =Exostosin family protein, putative, expressed
  Pfam annotation: Domain name=Exostosin; Domain location=69-430; Score= 281.8; E_value=1.3e-81; Accession=PF03016.6; Description=Exostosin family
MSVNKVDIVYFQCDNGWYGVDCSMPSVISSIKEWPSWLRPARIHIADDTHANEKMINLNAVVAKKRPLVYVYDLPPEFNSLLLEGRHYKLECVNRIYDDNNITVWTDQLYGAQIALYESLLASPHRTLNGEEADFFFVPVLDSCIITRADDAPHLSMQEHMGLRSSLTLEYYKNTYTHIVEQYPYWSHSSGRDHIWSFSWDEGACYAPKEIWNSMMLVHWGNTNTKHNHSTTAYWADNWDKISSDRRGIHPCFDPDKDLVLPAWKVPDAYVLTSKLWARSHEKRKTLFYFNGNLGPAYPHGRPEDTYSMGIRQKLAEEFGSSPNKDGKLGKQHAKDVIVTPERSEDYHMDLASSVFCGVFPGDGWSGRMEDSILQGCIPVVIQDGIFLPYENVLNYDSFAVRIPEAEIPNLIKTLRGFNDTEIEFKLANVQKIWQRFLYRDSVLLEAERQKTAIGHVDDWAVEFLKLTEDDAFATLIQTRILDARKKICIDCKEC

SEQ ID NO: 196996 - protein, 453 aa, Glycine max
  Coding DNA Sequence Number=SeqID_80218
  Gene Ontology: Mol. function=RNA-directed DNA polymerase activity; Cellular component=chromatin; Biological process=chromatin assembly or disassembly
  Pfam annotation: Domain name=zf-CCHC; Domain location=277-294; Score =10.3; E_value=0.02; Accession=PF00098.13; Description=Zinc knuckle
  Pfam module annotation: Pfam domain module=Retrotrans_gag::zf-CCHC; Domain location=111-201::277-294
MAPRTDKPDKSADEVSAQFREMQLCLEAVTKQQTDFQNFLTTQLPLLIREQISSQSAAHSSSPVRTDPPQSTIKLPKITLSSFDGKDPLDWIFKAEHYFDLTDTPPPRRLILIPFFLQGPALSWFKWLHSNHLLTTWSEFLHALEVRFGPSSFANHEASLYKLQQTGSVLEYQQQFESLSNRVTGLSPTSLLNCFLSGLRKDIHHELSILKPSSLTQAIDLAKLIETKNLATKYPASRPTKPPFPPNNPQPSLLGPPPTVPIRRLTPAEQNERRSKGLCFNCDEKFHVGHRCTKKQFLIMLMDDIDEVVGSPTSDTEHQMVESCPLLSPAPMSPPSSPDSSSPAAAEHFQLSQAALVGPPSPRTLRVQGRVGELEVTVLIDSGSSHNIMQPRVAEFLGLPMVAIKPFSVVVGNGDSITCSGFCAEVPVNLAKQMFHIPFFIIPIHGADLVLGV

SEQ ID NO: 196997 - protein, 157 aa, Glycine max
  Coding DNA Sequence Number=SeqID_80219
  Gene Ontology: Cellular component=membrane
MGFVIVRNSDFMVAISGYDVKAAWCSWSLAATIASVVALVSVVHLFLFPLTPTFNYFKIAQDSCFPTNASAEFPSNHDQERPAVDFKHQFPADLHGAFVYHGVPWKAEIGQWLAGCDSVIKDVNITEVALTAKMTAVARGFVIDNWDNVDVFMVILD

SEQ ID NO: 196998 - protein, 118 aa, Glycine max
  Coding DNA Sequence Number=SeqID_80220
MCLVELKLMAITIASRVGLVLADTNVSRVVDTSGKYTLMYHILSKKHEKTLGRLCINYTCSSTNELLGSSHPEVGTPNGRFVSLNGSKQASRGTMKEPKVLQNEGGQGKGATMKAARV

SEQ ID NO: 196999 - protein, 176 aa, Glycine max
  Coding DNA Sequence Number=SeqID_80221
  Gene Ontology: Cellular component=membrane
  Homolog annotation: Hit_ID=Q10R19; Match level="QueryCoverage=84%, HitCoverage=25%, E-value=3e-58, Identity=64%"; Hit description =Exostosin family protein, putative, expressed
MLISEVTGDGCTKNLQLECNFLGSPDQPFGRWVVSICPANCDKTRAMCFCGEGAKYPNRPLAETCGFQFDPPSEPDGPRIVNWTKIDQDVFTTNRSIPGWCNVDPAEAYAGKAKVKEECDCKYDGLAGRFCEVPVESVCINQCSGHGHCRGGFCQARVERKDTFEQYQLQKIREKG

SEQ ID NO: 197000 - protein, 268 aa, Glycine max
  Coding DNA Sequence Number=SeqID_80222
  Gene Ontology: Mol. function=RNA-directed DNA polymerase activity; Cellular component=extracellular region; Biological process=RNA -dependent DNA replication
MNCTKATNLSLKWNNPILESFSPQRGLSQDDPLSSPYLFILCMEKLAILIQENVNDGSREPVKISRNGPAICHLVFANDCLLFVKATCSQVRIVKEVLHQFCRVSASKNVTRRKIEKYNSILEFQHTTTIGRYLGFPLLAGRGKKEDFAFVVDKINSKLDGWKSKLINQARSFCVTLVEAAIPTYTIKPFWLTEGICETIDARVRSFINYPYTNKALTWLTWTIFAYMSAYGAFQFPPQNNTKEGGRKKNEGDWNNLLLPHSKICIMG

SEQ ID NO: 197001 - protein, 67 aa, Glycine max
  Coding DNA Sequence Number=SeqID_80223
MRSIEVKICIVGNQTFVDNHLGSLSLKLSRGMDNQYIVRKAAAEKKLLEGEMGDDGPYYITMQFSSF

SEQ ID NO: 197002 - protein, 90 aa, Glycine max
  Coding DNA Sequence Number=SeqID_80224
MGINLVKLPIISPKHPIPTKLCEKEVYPNLKFEVPQCRGALHDSENGFLSRFGAEMVSKGWSFDGASMVEEKGRKNQREGEGKASELLAE

SEQ ID NO: 197003 - protein, 228 aa, Glycine max
  Coding DNA Sequence Number=SeqID_80225
MTALCTSGGGFVFNANGAPWKLLRKDLATLAQTWSVLSYFNLAPTSHTSYLNVDKARLIYGLVMKMDMDLGSFISGQITHIAQSSTSRLGFSALIIALCDAQGGVSNTLTFESLSHVIILAYIKKNCWNSADPSIAFPRPLHARARAAAPDAPSLAQPPPPTCRMPPAAIHLGPDRSTYKLLGQDSSLLLMGRGVEPSEVRETTEIGVGDDIMVDLVAADWGPWPNLG

SEQ ID NO: 197004 - protein, 98 aa, Glycine max
  Coding DNA Sequence Number=SeqID_80226
MDATSSPFVSSRRMGVYDPIHQIRAWEENLGIRAAVRVMSSAGCAVRARGRSCKTTGNVMQSYPPRALDRRLQEDWAKDAREGLRVLMSLRVDFGPMG

SEQ ID NO: 197005 - protein, 147 aa, Glycine max
  Coding DNA Sequence Number=SeqID_80227
  Homolog annotation: Hit_ID=Q9SI36; Match level="QueryCoverage=28%, HitCoverage=32%, E-value=3e-13, Identity=80%"; Hit description =Expressed protein
  Pfam annotation: Domain name=DUF423; Domain location=40-106; Score= -44.6; E_value=0.047; Accession=PF04241.6; Description=Protein of unknown function (DUF423)
MWDLRWQCRVKSGFSMSQQQCRIRRVEVGQQVVKVQELGMKGQVVWHTASLYHLVHTAALVASPITKHPNVFGGLLTTGILAFSGTYSESVPTTYKSQLNKRYLSLLKLNKIKLRYICSGVRTLRKFMFKPQRCKRLSHCHIDVEDE

SEQ ID NO: 197006 - protein, 132 aa, Glycine max
  Coding DNA Sequence Number=SeqID_80228
PCWTSPGPLGVLWARSLQIVDGIRNQFSHMHTYVCRNGTDQLGRMLLSSNVIYICVRVVMLVRMTNTCLFAVARVKSCPGMHSSCVIASLSGCACTVGRPPISGVAHKLIKGNYWPLNWECKSRLGIKGGGP

SEQ ID NO: 197007 - protein, 285 aa, Glycine max
  Coding DNA Sequence Number=SeqID_80229
MVPGQPPDPGGGPTMQVQPEEEAIALLLCIPGQDFTCVATGRRVRIMRTSMTTLTQTWMTLLLSNILPSDHNFDLPQPKCQLVYAILTRMSVHVAQVIADAIYLFAGMAPTRHPLDPDKSNRALGFPALIMGLYQSFGVPVAPSKVIRPPITRAFIEKYCTARQAPGDAPQAAGAPPPPHQADPAGSFDTERYLRHSIRQHTANHRGLGQVHECLYQLSLSMQNQGFTPFASPTPDQFKAEVAWPGDWPEAQAGEAPAEAPDDGEEASMDEMSDLLGFLGGSGAT

SEQ ID NO: 197008 - protein, 239 aa, Glycine max
  Coding DNA Sequence Number=SeqID_80230
  Gene Ontology: Mol. function=protein kinase activity; Cellular component=integral to membrane; Biological process=protein amino acid phosphorylation
  Homolog annotation: Hit_ID=Q2A9G3; Match level="QueryCoverage=82%, HitCoverage=55%, E-value=4e-30, Identity=41%"; Hit description =Kinase domain containing protein
  Pfam annotation: Domain name=Pkinase; Domain location=2-220; Score= -10.4; E_value=6.1e-08; Accession=PF00069.15; Description=Protein kinase domain
  Pfam annotation: Domain name=Pkinase_Tyr; Domain location=9-225; Score=-65.8; E_value=2e-08; Accession=PF07714.7; Description=Protein tyrosine kinase
  Pfam module annotation: Pfam domain module=Pkinase::Pkinase_Tyr; Domain location=2-220::9-225
MEDAPMSPRVALPPKGRLRQNLFISARHKNVVILLVLCTNKSQLMIVYEQVCNSSLEQYLTRGSFQSLTWKQRLKVAMGTAKGLKYLHGNNIILGNIKPSNILLTHDFEPRIGDFDFGKVKHGPKKSSKDKSVRNSGYAAPEYVENGKASNKTDVYSFGVVLLELIYYYANECRMSLSAMIGLLPVDQKARPLLGGKKYPKLVDLKIRKNPKERITMNMVSLSDVEYDKKVHKTEKKAC

SEQ ID NO: 197009 - protein, 80 aa, Glycine max
  Coding DNA Sequence Number=SeqID_80231
MKIVSGTESFGSDESGVDGEEEGVVEICFPDRGGKHNEKGEAEGGGKLPWEGEATWFLLVVVALQRKKMGKVGSLPLEAE

SEQ ID NO: 197010 - protein, 310 aa, Glycine max
  Coding DNA Sequence Number=SeqID_80232
  Gene Ontology: Mol. function=glutamate carboxypeptidase II activity; Cellular component=integral to membrane; Biological process =regulation of inflorescence meristem size
  Homolog annotation: Hit_ID=Q9M1S8; Match level="QueryCoverage=96%, HitCoverage=43%, E-value=6e-47, Identity=39%"; Hit description =Probable glutamate carboxypeptidase 2
  Pfam annotation: Domain name=PA; Domain location=147-237; Score=14.4; E_value=0.011; Accession=PF02225.12; Description=PA domain
  Subcellular localization annotation: CTP_CleavageSite=8; ConfidenceScore=5.55e-01
MVPSNTVTAFTAKPSPLLTFVMLIVLGVVGFYSLHFPPRPTTSPDPSRFRHVFVSSSSNSTVASYLRALTVHPHLSGTKPASLTARYVVNHFTTLGFQTKTVQHSALLSYPVRSSLAAHFSDGTSFEFQLTEPDTEKEVVAPYHAYSPSGAAEAAAVFVNYGREEDYRQLVAAGVEVAGCVVVARGGALPRGAVVEAAERHGAAAAAVFVERDTWREGFERGHVMRGGIGDPLSPGWSGVEGGESLGLEDSEVLKRFPKIPSLPLSAEAAERILESLGGAPLPLDWRGTLKSSKVKNVGPGPTILNFTYQ

SEQ ID NO: 197011 - protein, 316 aa, Glycine max
  Coding DNA Sequence Number=SeqID_80233
  Homolog annotation: Hit_ID=Q1SHY8; Match level="QueryCoverage=62%, HitCoverage=26%, E-value=6e-15, Identity=32%"; Hit description=WD40 -like
MDVFFDSVDSLSAQDFVLAKEEFGSGRCGYDEIWVKEPGLGLLDSSSKVCSQEKMSLDDSSISLGLERIRECSGAISNACILHTDQVVSEKWILSGGKAASKEKISLDEFKGCPQDEAEANIQGKDHEFSSIAQEHRPREAVSQEEFQDFDMGKRKKKNWWKRFVNLRKSGEGNVRSKLNAGTNKTRRIKVKRNKKRWLHMLQRGVAKVVVKKGKTQLFKDGNPMVYNGVVDRIIGRPPPKTGDVVLVADGTKKPIGWGMYNSVSMFCVRLMQLEDEATSLSPLNKQCRTNQECASWLGTPLINKARVLLLGKVFP

SEQ ID NO: 197012 - protein, 41 aa, Glycine max
  Coding DNA Sequence Number=SeqID_80234
MYHFPVLLRVCERIDRPCSSLFDSDWKKIEAFVVSKTVIHC

SEQ ID NO: 197013 - protein, 155 aa, Glycine max
  Coding DNA Sequence Number=SeqID_80235
  Gene Ontology: Mol. function=peptidase activity; Cellular component =integral to membrane; Biological process=proteolysis
  Homolog annotation: Hit_ID=Q9M1S8; Match level="QueryCoverage=85%, HitCoverage=18%, E-value=2e-55, Identity=75%"; Hit description =Probable glutamate carboxypeptidase 2
  Pfam annotation: Domain name=Peptidase_M28; Domain location=46-155; Score=-28.3; E_value=0.00054; Accession=PF04389.7; Description =Peptidase family M28
MTFCDCLFLDSVSLMIASFGDVQGELKVATIENVFAIIKGREEPDRYVLLGNHRDAWTYGAVDPNSGTAALLDIAGRFSILLRLGWTPRRTIILCSWDAEEFGMIGSTEWVEQNLVNLRSKAVAYLNVDCAVQGPGFFAGSTPQLDDLLVEVIKQ

SEQ ID NO: 197014 - protein, 105 aa, Glycine max
  Coding DNA Sequence Number=SeqID_80236
  Gene Ontology: Mol. function=peptidase activity; Biological process =proteolysis
  Homolog annotation: Hit_ID=Q9M1S8; Match level="QueryCoverage=53%, HitCoverage=8%, E-value=2e-18, Identity=70%"; Hit description =Probable glutamate carboxypeptidase 2
MVADKLRLGYEVISYIYFVWRPSIDGMLSLIDRFQWMYNATWKINLKIQRLSGVDSDFAPFVQHAGVPSVDVYYGKDYPVYHTAFDSYNWMTKFGDPFFQRHEAG

SEQ ID NO: 197015 - protein, 144 aa, Glycine max
  Coding DNA Sequence Number=SeqID_80237
  Homolog annotation: Hit_ID=Q7XAC2; Match level="QueryCoverage=27%, HitCoverage=12%, E-value=2e-10, Identity=75%"; Hit description =Peptide transporter 2
MGSHSPVQCGALSDKKCGGLSYDDAWNACSNQNRNHFHHLVTTTGISQPLSASEVRLNPYAFVQSVPSSEKAATQSLKLWNSTIAFAYGFHGQGQEAIKVFNEMEQENLPESEVIFLRLTKEETGFDDVSYGGTFVVCEFWKSV

SEQ ID NO: 197016 - protein, 201 aa, Glycine max
  Coding DNA Sequence Number=SeqID_80238
  Gene Ontology: Mol. function=methyltransferase activity; Biological process=metabolic process
  Homolog annotation: Hit_ID=Q01AF6; Match level="QueryCoverage=85%, HitCoverage=56%, E-value=7e-51, Identity=56%"; Hit description =Homology to unknown gene
  Pfam annotation: Domain name=Methyltransf_11; Domain location=105 -178; Score=29.5; E_value=1.2e-05; Accession=PF08241.2; Description =Methyltransferase domain
MQPISAPHVRTSIKIVSTLNESYHTNQPPLAGKIKRLVLTQEGRTKLNIYPDREFYAFPRFVKHVDDGFVSTLTNLYRERLRSDMEILDLMSSWVSHLPSDVKYKKVVGHGLNGQELSKNPRLDFFVVKDLNKDQQFEFESCSFDAVLCTVSVQYLQQPEKVFEEVFRVLKPGGAFIVSFSNRMFYEKAISAWREGTAYSR

SEQ ID NO: 197017 - protein, 105 aa, Glycine max
  Coding DNA Sequence Number=SeqID_80239
MGHGSGSKSTPGFDSLQPKTIGDEIGLASLAFDTIQLRSLNPNSCKACSPTDKKSTSRNCIFIGDILISWKRKKHVVKSSADAEHRASSTFELTWLKELIFGNIS

SEQ ID NO: 197018 - protein, 154 aa, Glycine max
  Coding DNA Sequence Number=SeqID_80240
MARTVLCKPIYATLMHIKNLFESSNELSLRPEGFQKAFRKLGRLTTRKTFGFLNSFNIVIESPECSIILQKINMFLLKKSKFHIVKDEAKIEYKSERQSYELPFGLELSTNLHSKMIQELILNPYKGLSTMLSMTSNPKCVGNEGVKKLKFPID

SEQ ID NO: 197019 - protein, 114 aa, Glycine max
  Coding DNA Sequence Number=SeqID_80241
MSGLVHVGQMGQSDESIIEDNDGKDSRTRHHALGTRAVVWPVKNTRMRMRDCENNYHNFQNDVVLKGQHGDNMERNSREANFLGMRLVQMKRPGGKHTSRRYWPKKTRQKKVGE

SEQ ID NO: 197020 - protein, 89 aa, Glycine max
  Coding DNA Sequence Number=SeqID_80242
MEFLSDGLAKVDALNSEVDYSVFYCHSPQGCIYLIAYVDDNTTVITMQFAMIRSEVDYPVFYCHSPQGWIYLIVYVDDNTTEITVVLSA

SEQ ID NO: 197021 - protein, 78 aa, Glycine max
  Coding DNA Sequence Number=SeqID_80243
MYDKWNEDRYHGTHVYGYLVGMGIVRIDNRYALNKVVVVVILLWAELGNKMWISNPWVSQPNQYLSSQLAKYVPYQHK

SEQ ID NO: 197022 - protein, 50 aa, Glycine max
  Coding DNA Sequence Number=SeqID_80244
MEHRSAARAKGWLVRRKPWACLGVIKLSSGSSPKRIKKVSTRFAKAQVNS

SEQ ID NO: 197023 - protein, 198 aa, Glycine max
  Coding DNA Sequence Number=SeqID_80245
METQIGQLSKQLQTSSIGFFATTEENPKDHYKVIISTVECDMGGEEEEEVEESTAIEEEMKAQSNLSFQGASCNLMPHSFLEKIGRLNLKPTNMTLQFIDGSKMKVLWKVVNVTIKRRTYKFQSFRKILHKNHSCNRSVFVKESIHLERARKKCSTTFKALRIFPTNWLSNNTIIHQAIDVEKSPTRKQPSIFCILNS

SEQ ID NO: 197024 - protein, 78 aa, Glycine max
  Coding DNA Sequence Number=SeqID_80246
  Subcellular localization annotation: CTP_CleavageSite=66; ConfidenceScore=5.17e-01
MTKEVIHGHNSVAPRLHFFFFFFFYVFPSAFRLLGSFFLFPYMAIYRKSHLVQGKLAQASWLLRVEGQARARPSEWLA

SEQ ID NO: 197025 - protein, 99 aa, Glycine max
  Coding DNA Sequence Number=SeqID_80247
MTKLGLCLSSGPPPLDDKRVRITIRMTKLGLCLSSGPPPLDDKRVRITVRMTKLGLCLSSGPPPLDDKRVRITVRYLRVSWVQNDQTWSLLVIGPAASG

SEQ ID NO: 197026 - protein, 68 aa, Glycine max
  Coding DNA Sequence Number=SeqID_80248
MRLPGKESLPMGSPVTINEILDVSISFLNDHLEETPGSTKIEENHSKCINLAQCGARKKVASARDFGW

SEQ ID NO: 197027 - protein, 88 aa, Glycine max
  Coding DNA Sequence Number=SeqID_80249
  Subcellular localization annotation: CTP_CleavageSite=72; ConfidenceScore=5.69e-01
MTYTTTLDHNFRSTIKTSLKPSMPVNTSTLHRMMSSNGYTSTPNRHSMSSDTVFLKEENHQREGRVTSSSMRCQKLSGGRKDEVIKEI

SEQ ID NO: 197028 - protein, 398 aa, Glycine max
  Coding DNA Sequence Number=SeqID_80250
  Gene Ontology: Mol. function=zinc ion binding; Cellular component =plastid; Biological process=peroxisome organization and biogenesis
  Homolog annotation: Hit_ID=Q85V22; Match level="QueryCoverage=85%, HitCoverage=77%, E-value=1e-168, Identity=83%"; Hit description =Histidine amino acid transporter
  Pfam annotation: Domain name=Aa_trans; Domain location=72-398; Score =351.1; E_value=1.8e-102; Accession=PF01490.8; Description =Transmembrane amino acid transporter protein
  Pfam annotation: Domain name=Trp_Tyr_perm; Domain location=72-317; Score=-263.9; E_value=0.014; Accession=PF03222.4; Description =Tryptophantyrosine permease family
  Pfam module annotation: Pfam domain module=Aa_trans::Trp_Tyr_perm; Domain location=72-398::72-317
MMNVNYTHVYLDEDQNFLFTSYDQLGFVGPTRISLDILAYSLLYLPLLIKQTEEELQRQKAINDWLPITSSRNAKWWYSAFHNVTAMVGAGVLSLPYAMSELGWGPGVTVLILSWIITLYTLWQMVEMHEMVPGKRFDRYHELGQYAFGEKLGLYIVVPQQLVVEIGVNIVYMVTGGKSLQKFHDTVCDSCKKIKLTFFIMIFASVHFVLSHLPNFNSISGVSLAAAVMSLSYSTIAWAASAHKGVQENVEYGYKAKSTSGTVFNFFSALGDVAFAYAGHNVVLEIQATIPSTPEKPSKGPMWRGVVVAYIVVALCYFPVALIGYWMFGNTVEDNILISLEKPKWLIAMANMFVVIHVIGSYQIYAMPVFDMIETVMVKKLNFKPSMTLRFIVRNLYV

SEQ ID NO: 197029 - protein, 156 aa, Glycine max
  Coding DNA Sequence Number=SeqID_80251
  Gene Ontology: Cellular component=plastid; Biological process =peroxisome organization and biogenesis
  Homolog annotation: Hit_ID=Q85V22; Match level="QueryCoverage=83%, HitCoverage=27%, E-value=5e-35, Identity=59%"; Hit description =Histidine amino acid transporter
MAYVTLASNWYQYMQLYAMPVFDMIETVMVKQLRFKPTWQLRFVVRNVYVAFTMFVGITFPFFGALLGFFGGFAFAPTTYFLPCIIWLAIYKPKKFSLSWITNWFYLLGFPVFSDLHYIWPPTHDSVTNWWIKEYHTQCQELWVLPMRENVLKERC

SEQ ID NO: 197030 - protein, 151 aa, Glycine max
  Coding DNA Sequence Number=SeqID_80252
  Gene Ontology: Mol. function=kinase activity
  Homolog annotation: Hit_ID=Q9AV92; Match level="QueryCoverage=53%, HitCoverage=11%, E-value=2e-19, Identity=60%"; Hit description =Kinase-like protein
ARLQAEAKAAEDARKRADAEAAAEARRKRELEREAARQVLLQMEKSVEINENSQFLEDFELLSAVPAEQLPSSVDETSPDISQDGMGSFKFGGGNPLEQLGLYIKDDDEEEEGDPLCVPNPPATQQSSSDEKGEGDERGSDGQGLELHGGY

SEQ ID NO: 197031 - protein, 141 aa, Glycine max
  Coding DNA Sequence Number=SeqID_80253
  Gene Ontology: Mol. function=kinase activity
  Homolog annotation: Hit_ID=Q9AV92; Match level="QueryCoverage=62%, HitCoverage=12%, E-value=5e-23, Identity=62%"; Hit description =Kinase-like protein
VDPTHYRAEKARLQAEAKAAEDARKRAEEEAAAEARRKRELEREAARQALLQMEKTVEINENSRILEDLEMLRAVPAEQLPSSVDETSPAHSQDGLGSFKFGSSNPLEQLGLYIKADDEEEEGEPPCIPNPVNDVEEGEID

SEQ ID NO: 197032 - protein, 539 aa, Glycine max
  Coding DNA Sequence Number=SeqID_80254
  Gene Ontology: Mol. function=kinase activity; Cellular component =intracellular; Biological process=regulation of transcription, DNA -dependent
  Homolog annotation: Hit_ID=Q9LYA2; Match level="QueryCoverage=81%, HitCoverage=54%, E-value=4e-82, Identity=43%"; Hit description =Kinase-like protein
  Pfam annotation: Domain name=Bromodomain; Domain location=177-266; Score=109.5; E_value=9.7e-30; Accession=PF00439.15; Description =Bromodomain
MAKSRLSGGYYENAVETGGGDSEGSGTSGRIDAGNTILEDSSVRRRKCISLNSSGNDAFGVPMQVVPMSNLAPLQRKELVDRLTSELEQIRVFRKRIELQRMNDVMLSSKNDIISSRRNDHNGPQVERKPSMSSSVPGNESKPLGQSQKPREWNRGSSGKFESATRTSLLSAANALLMKDCELLLKRLMSHQYGWVFKTPVDVVKLKLPDYFSIIKHPMDLGTVKSKIAAGEYAGPIEFADDVRLTFSNAMIYNPRGNDVHVMADTLSKYFELRWKAIEKKLPRRDDVPFPSKPDTCEDVKTTRTLPPSKPNSCQDVIKTTRPMPPSKKRKISTLPCQPVVMPPAKKVMSDQEKHNLGIELESLLGEMPMHIIDFLKENCSNGEECGEDELEIDIDDLKDDTLFALRKLLDDFLLEKQMNETKVEVREIEVLNDSGPSNSSLLPFKGNDSDDEEVDIGGNEPPVSSYPPVEIEKDTTCRINTCLSPGSSDTDSSDSSDSESDDVKSNPANVAKEPENMESGAQMVENSRADDTSERNRE

SEQ ID NO: 197033 - protein, 173 aa, Glycine max
  Coding DNA Sequence Number=SeqID_80255
  Gene Ontology: Mol. function=kinase activity
  Homolog annotation: Hit_ID=Q9LYA2; Match level="QueryCoverage=67%, HitCoverage=16%, E-value=7e-26, Identity=53%"; Hit description =Kinase-like protein
MAFYCFSHPKWNPDGGISYPITSSNFRYLSAFSILDGDTDSDSSSDSEADDVKASPANVAKAPENLGSEAQLDEMTMAAATLERNQSVSGLDQLEDNSQHKPSSFDSDCQQDGDSAPTERQVSPDKLYRAAVLKKRFLDTILKAREKTLTQGEKGDPEKLRQEREKLEMEQKK

SEQ ID NO: 197034 - protein, 477 aa, Glycine max
  Coding DNA Sequence Number=SeqID_80256
  Gene Ontology: Mol. function=kinase activity; Cellular component =intracellular
  Homolog annotation: Hit_ID=Q9LYA2; Match level="QueryCoverage=88%, HitCoverage=54%, E-value=3e-85, Identity=45%"; Hit description =Kinase-like protein
  Pfam annotation: Domain name=Bromodomain; Domain location=180-269; Score=112.2; E_value=1.5e-30; Accession=PF00439.15; Description =Bromodomain
MVISKSRLSGGYFGNALDTAGESEGSGSSGRIDTEITVSEDSSIPTRKCISLNSSRHDAFGAPVQVVPLSNMPLSQRKDLVQRLRSELEQIRLLQKKIEQQRTNGVALSSSSDILSCSNGNNGHRVERDKKPSMSSSAPGNKVKPSGNKNQKSRGWNRGSSGKFESAVQSASPSTANAMLMKDCELLLKRLMSHQYAWVFKTPVDVVKLNLPDYFTIIKRPMDLGTVKSKLAAGEYAGPLEFADDVKLTFSNAMNYNPSGNDVHLMADTLNKYFELRWKAIEKKLPKSDVLPIPAKPDNSEGVKTKRQAPPSKKRKIASLPPQPKVMPPTKKVMSDQEKHDLGRELESLLGEMPMHIIDFLKEHSSNGRECGDDEIEIDIDDLSDDTLFTLRKLLDDFLQEKQKNKAKVEACEVEVLNDSGPSNSSLQPFKGNDPADEEVDIGGNEPPVSSYSHVEIEKDTTYRVNKSLSPGSSNGK

SEQ ID NO: 197035 - protein, 307 aa, Glycine max
  Coding DNA Sequence Number=SeqID_80257
  Gene Ontology: Mol. function=electron carrier activity; Cellular component=mitochondrial respiratory chain; Biological process =electron transport
  Homolog annotation: Hit_ID=Q1SNF6; Match level="QueryCoverage=93%, HitCoverage=93%, E-value=1e-133, Identity=82%"; Hit description =Cytochrome c, monohaem
  Pfam annotation: Domain name=Cytochrom_C1; Domain location=72-297; Score=559.6; E_value=3.1e-165; Accession=PF02167.6; Description =Cytochrome C1 family
MQQDDCLLLLLIAVVYSLQNSPLLSPIVAKKDDAGSTGSQSLRALALIGAGLSGLFSFSTMAAADEAEHGLACPSYPWPHKGILSSYDHASIRRGHQVYTEVCASCHSMSLISYRDLVGVAYTEEEVKAMAAEIEVVDGPNDEGEMFTRPGKLSDRFPQPYANEAAARFANGGAYPPDLSLVTKARHNGQNYVFALLTGYRDPPAGVSIREGLHYNPYFPGGAIAMPKMLNDGAVEYEDGTPATEAQMGKDVVSFLTWAAEPEMEERKLMGFKWIFVLSLALLQAAYYRRLRWSVLKSRKLVLDVVN

SEQ ID NO: 197036 - protein, 547 aa, Glycine max
  Coding DNA Sequence Number=SeqID_80258
  Gene Ontology: Mol. function=RNA-directed DNA polymerase activity; Cellular component=chromatin; Biological process=chromatin assembly or disassembly
  Pfam annotation: Domain name=rve; Domain location=447-546; Score= -14.4; E_value=0.095; Accession=PF00665.16; Description=Integrase core domain
  Pfam annotation: Domain name=zf-H2C2; Domain location=388-429; Score =10.3; E_value=0.016; Accession=PF09337.1; Description=His(2)-Cys(2) zinc finger
  Pfam module annotation: Pfam domain module=rve::zf-H2C2; Domain location=447-546::388-429
MAPEDISKTAFRTHHGHYEFLVMPFGLCNALASFQATMNQTLGPYLRKFVIVFFDDILIYSQTFSDHLDHLRKILQLLVDHSFVLKLSKCSFATQQVEYLGHLVSEKGVEPVPAKVTAVQQWPTPRTTRALRGLLGLSGFYRRFIKGYASLAAPLTALLAKDQFHWNEEADRAFSQLKLALCQAPVLGLPDFKSPFVVETDVSGIGMGAILSQNHHPLAFFSKPFCSKLLSASTYVRELAAITAAVKKWRQYLLGHHFVILTDHRSLKELMAQAVQTPEQQIYLARLMGFDYTIQYRAGKANLAADALSRLPPPSRSQLYVLTIPNFLFLQELRAALAVNQDFVLQRQQLQDNPHPDWGLREDLIMYQGRIWLPLKFSLIPAILTELHSTPTGGHMGVMKTLARVRENFVWTSMKKDVHHFVTTCFTCQQIKTDNRRSPGLLCPLPIPAKPWEDLSLDFIVGLPLYRGHSVILVIVDRFSKGLHLGSLPQHHTAAGVAKLFMEISEKLHGMPKSLVSDRNPLFLSHFWQELFKLSGTKLCMSSAYHP

SEQ ID NO: 197037 - protein, 88 aa, Glycine max
  Coding DNA Sequence Number=SeqID_80259
MTGSLELIELVLMTSERIFFLMSHSQLLGDDLEKREALWYDPRSRLEFEVLAPPREKNYVILTEFGICALEEFAKRYGSCSQDAFLTV

SEQ ID NO: 197038 - protein, 422 aa, Glycine max
  Coding DNA Sequence Number=SeqID_80260
  Homolog annotation: Hit_ID=Q6ZK44; Match level="QueryCoverage=78%, HitCoverage=84%, E-value=1e-133, Identity=64%"; Hit description =Kelch repeat-containing protein-like
  Pfam annotation: Domain name=Kelch_1; Domain location=259-320; Score =14.8; E_value=0.082; Accession=PF01344.15; Description=Kelch motif
  Pfam annotation: Domain name=Kelch_1; Domain location=324-376; Score =8.3; E_value=0.44; Accession=PF01344.15; Description=Kelch motif
  Pfam annotation: Domain name=Kelch_2; Domain location=121-166; Score =0.5; E_value=33; Accession=PF07646.5; Description=Kelch motif
  Pfam annotation: Domain name=Kelch_2; Domain location=205-257; Score =24.7; E_value=0.00032; Accession=PF07646.5; Description=Kelch motif
  Pfam annotation: Domain name=Kelch_2; Domain location=258-320; Score =7.7; E_value=3.7; Accession=PF07646.5; Description=Kelch motif
  Pfam module annotation: Pfam domain module=Kelch_1::Kelch_1::Kelch _2::Kelch_2::Kelch_2; Domain location=259-320::324-376::121-166::205 -257::258-320
MASPTTRFLHHHSHYSSASKILIFFCLSAFLALALIANLFRASLSTHYLAIATNWVDTNAPLLIPNLTAIPHNNNNNKLVQKGKDGKIAKRRGPERFLSATFADLPAPEWHWKQMPSAPVPRLDGYSIQIKNMFYVFAGYANLDHVHSHVDVFDFSSNKTIWYPMQWAYYRILFVRHCNKEMETFATIASPQINADDGTEIVVIMWYAPATQLWKGRLHVMGGSKENRHTPGIDHWSLAVKDGEALEQQWRDEVPIPRGGPHRACIAVNDRLFVIGGQEGDFMAKPGSPIFKCSRRHEVVYGDVYMLDEEMKWKILPAMPKPDSHIECAWVIVNNSIIITGGTTEKHPVTKRMMLVGEVFQFRLDTMKWSVIGKLPYRIKTTLTGFWDGWLYFTSGQRDRGPDNPQPKQVVGEMWRTKLHLS

SEQ ID NO: 197039 - protein, 157 aa, Glycine max
  Coding DNA Sequence Number=SeqID_80261
MKHSSWAALYTIFTSCYLFEQLPKSVSATLYFTELGCSNVAEDKAYQLTVSPGAWSSFQIHQMKQRLQKCKTQFTCKTLLKAAGSGLLGAPHHQTLYSVILKQMTVPSGSDRLAKETFENFQVRHYGTGIRKFNLFSSFHSELPCTIHGSNSYRNHE

SEQ ID NO: 197040 - protein, 152 aa, Glycine max
  Coding DNA Sequence Number=SeqID_80262
  Gene Ontology: Mol. function=oxidoreductase activity; Biological process=electron transport
  Homolog annotation: Hit_ID=Q7EYS3; Match level="QueryCoverage=86%, HitCoverage=21%, E-value=6e-42, Identity=62%"; Hit description =Glycine/D-amino acid oxidases-like
MQNRCGFERKGDIWVNDIRNLGVSPAKLIEIVKTRFISLGGVIFEGCGVSCINVYEDAAVLKLSGDKILSSRLIIDAMGNFSPVVKQIRGGRKPDGVCLVVGTCARGFETNSTSDVIFSSSSIKKVGDSKAQLFWEVTSTVSIETQYPHLYF

SEQ ID NO: 197041 - protein, 726 aa, Glycine max
  Coding DNA Sequence Number=SeqID_80263
  Gene Ontology: Mol. function=ionotropic glutamate receptor activity; Cellular component=membrane; Biological process=ion transport
  Homolog annotation: Hit_ID=Q84QE2; Match level="QueryCoverage=92%, HitCoverage=77%, E-value=3e-83, Identity=28%"; Hit description =Avr9/Cf-9 rapidly elicited protein 141
  Pfam annotation: Domain name=ANF_receptor; Domain location=1-301; Score=4.8; E_value=4e-05; Accession=PF01094.18; Description=Receptor family ligand binding region
  Pfam annotation: Domain name=Lig_chan; Domain location=451-684; Score= 69.3; E_value=1.2e-17; Accession=PF00060.17; Description=Ligand-gated ion channel
  Pfam annotation: Domain name=SBP_bac_3; Domain location=346-642; Score=-59.3; E_value=0.00038; Accession=PF00497.10; Description =Bacterial extracellular solute-binding proteins, family 3
  Pfam module annotation: Pfam domain module=ANF_receptor::Lig _chan::SBP_bac_3; Domain location=1-301::451-684::346-642
MDLTQSKQVLAIIGTITHSEANLASEFDDTIKNIPILSLISPVARSEKSSPLLPYFIQEGYDINLHMQCIAAIVGEFRWRKVTVIYELDNWFSSDPGILLDLSYSLRLVGSEIDNHVALPSLSSLLDPKSTIENELNRLKNKSNRVFLIAHSSLELANILFEKAKQMSLVGKGSVWVIPDGVAGLLDSVNSSSILNMQGVIGFKTHFMETSKAFRRFKFKFRRRFVLEFPEEENINPSFFALQSYKATRAVAQAARESQGKLTLEQLFKSKSYRELALWSPELGFSKNLITQQLTEMNTNSASSGILSTVYWPGGIQFVPKGWTHSTEQRKLQIGVPAKGAFTEFVNVTYDKNRNKTSITGFSIDVFKEAVHNLSYDLDFAFVPFNGSYDEMVEQVYNKTLDAAVGDTSIMAYRYHLVDFSQPYVDSGIDMVVTEQSAKSKETWIFLKAFTKGMWLMMAALHIFVGFVIWLIERQVNEELKGFGSMLWFLVTVIFYAHREPIRSPLARTVLAPWLFVILIATSTFTASLTSMMTVSQLEPSVLDIKSLLKRNSPVGCNGNSFIVKYLTEVQKFKPENIRRINSINDYPSAFQNKDIEAAFFIAPHAKVFPKGSTLATDISEALLKVLESGEIEQLEKDMLTIEGNASCSPLESKAKDGSPTGFQPFLGLFCICSIVALHTSNINTIKENMEMDNQIFCSEQFKVPIRKFEKCEYSHSNKKCRGDSH

SEQ ID NO: 197042 - protein, 207 aa, Glycine max
  Coding DNA Sequence Number=SeqID_80264
MRVGFKGGDAVDKAIKLFRNVDMASSEFGNCLLKAIKGLGTGRFSHGSMKAPVGMTRGFLADCADKAAADKVIEKVGTSQRKGNQELGKVGLISTLAQRFEHFSIGRTSKMSLIICFFVLQLLTWSRVLLAHESRNNCSRSIMSIGAVLDLSSQMGKHQKIAMQIALQEFNRLSCSKLDLKIENSHGNSAHAVASGKVNDLFQLFVL

SEQ ID NO: 197043 - protein, 46 aa, Glycine max
  Coding DNA Sequence Number=SeqID_80265
MASIKMHQEEGNEQKASPGTVGCRKSDCGHYPADTSLWTDNIDYYT

SEQ ID NO: 197044 - protein, 99 aa, Glycine max
  Coding DNA Sequence Number=SeqID_80266
MSLIICFFVLQLLTWSRVLLAHESRNNCSRSIMSIGAVLDLSSQMGKHQKIAMQIALQEFNRLSCSKLDLKIKNSHRNSANAVASGNVSVHFPTFVSRD

SEQ ID NO: 197045 - protein, 265 aa, Glycine max
  Coding DNA Sequence Number=SeqID_80267
  Gene Ontology: Mol. function=RNA-directed DNA polymerase activity; Cellular component=chromatin; Biological process=chromatin assembly or disassembly
MAESTRSKSFDRLQEAIAKLATSHIHVSEKLDSLINRVTALESNPHSPSSSSANPSSHPQTLSPHRLKLDVPRFDGSDPSGWVFKISQFFEYHGVPNSERLTVASFYMDGPALAWFQWMARNHQLPTWTGFLQAIEARFALSPYEDPTGQLFKLVQKGTLREYLAQFESLANRIIGLSPSSLLSCFISGLEPDIRREVQALQPLTLVHAAGLARLQEEKLHDSRRSVRSRPSFTPSPSTPPPLSVVPPPSPLPLLPSPPKPPPLP

SEQ ID NO: 197046 - protein, 167 aa, Glycine max
  Coding DNA Sequence Number=SeqID_80268
VDPLHPPALVVAHAGDLFEATDHHAAVGAEGEKLGFQEVRDRAWHPGAELGKGVHAHALNMPIQPLVKNGVHVDRAHDGLTWIVVAAAFAEVVCPDFGYFGRAMEYTLEWVRRNEYYWAGPPGWTICRVFLDGMWQYELWFSRGDGGTIYGMLASLAAAQDLFDQKL

SEQ ID NO: 197047 - protein, 89 aa, Glycine max
  Coding DNA Sequence Number=SeqID_80269
MVEKIKKKLEEDAQSESTEGVIDPPSPITREVEDWVDDDSLEEQASQGSFVPHGRQDLLTAAIGRPEHPGRVRASRVGVTIKQYFGLAP

SEQ ID NO: 197048 - protein, 233 aa, Glycine max
  Coding DNA Sequence Number=SeqID_80270
  Gene Ontology: Mol. function=signal transducer activity; Cellular component=membrane; Biological process=signal transduction
  Homolog annotation: Hit_ID=Q93ET6; Match level="QueryCoverage=92%, HitCoverage=39%, E-value=6e-55, Identity=54%"; Hit description =Putative methyl-accepting chemotaxis protein I
MKVGVRLGIAFGLVVALLVVIGITSIMKINNIKSGITSIVEDRYVKVRLGFDVRDGVNDQIKYLRGIVIDTTRPQFNVQRFQQLADATARTNAAMKKIEAIQITAVGKKKIASLLAASQQFEQQKNEVLDLVRAGKADDASYYVLKKITAVQNAYLDLAVAFADSQSSQLQQEGAGIIDDGTTAIEVTLVFSALAILAAVVMGWLLTRSIVHPLNEADDHRQQSGCRRSQQTH

SEQ ID NO: 197049 - protein, 784 aa, Glycine max
  Coding DNA Sequence Number=SeqID_80271
  Gene Ontology: Mol. function=ionotropic glutamate receptor activity; Cellular component=membrane; Biological process=ion transport
  Homolog annotation: Hit_ID=Q5VMN1; Match level="QueryCoverage=85%, HitCoverage=77%, E-value=3e-92, Identity=32%"; Hit description =Putative Avr9/Cf-9 rapidly elicited protein
  Pfam annotation: Domain name=ANF_receptor; Domain location=2-290; Score=5.5; E_value=3.6e-05; Accession=PF01094.18; Description =Receptor family ligand binding region
  Pfam annotation: Domain name=Lig_chan; Domain location=466-703; Score= 56.4; E_value=1.4e-14; Accession=PF00060.17; Description=Ligand-gated ion channel
  Pfam annotation: Domain name=SBP_bac_3; Domain location=353-682; Score=-58.1; E_value=0.00031; Accession=PF00497.10; Description =Bacterial extracellular solute-binding proteins, family 3
  Pfam module annotation: Pfam domain module=ANF_receptor::Lig _chan::SBP_bac_3; Domain location=2-290::466-703::353-682
MADQRKKVLAIIGTITHNEATLASEFNDTIKDIPILSLISPIARSKQLSPLLPQFIQVGHDINLHMQCIAAIVGEFRWRKVTVIYELNNLFSSDPGMLLDLTYALRHVGSEIDNHLPLPSLSSLSDPKSTIESELNRLKNKSNRVFLIVQSSLELANILFEKAKQMGFMEKGCVWIIPDGIAGHLDSVNPSVIINMQGVIGFKTHFMETSDALRRFKFKFRRRFALEFPEEENINPSFFALQSYEATLAVAQAAKESEWKFTLEQLFRTNLSRNRKLQQSPTFNIINVIGKSYRELALWSPALGFSKNLVTQQLTEVMKTNTASTGVLSSVYWPGGLQFVPKGWTHGTEERTLQIGVPAKSVFHQFVKVNNTSITGFSIDIFKAAVSNLPYYLKYTFVPFNGSYDEMVKQVYNKTLDAAVGDTSIMAYRYHLVDFSQPYVESGLDMVVREQSTKSKETWIFFDAFTKEMWLMLVALHIFVGFVVWLIERQVNAELKGLGSMLWFLVTVIFYAHREQIKSPLARTVLAPWLFAIYIASGTFIASLTSRMTISQLEPSVLDIQTLQERNSPVGCDGNSFIVNYLTDVLEFKPENIRKINSLRDYPEAFQNKDIEAAFFVSPHAKVFLAKYSCHGLIKAGNTFRLGGFGFVFPKGSILATDISEALLKVIENGKAEQLETDMLSIEGNAREYGDGQPHILLGTVQETPIREHEKYTPSDSLYMDLSARKISIQEILICMDLSPIPFYSFESITKSNHLSVVPRSRNMQPDPLYVNYTPLTIVGKSKG

SEQ ID NO: 197050 - protein, 584 aa, Glycine max
  Coding DNA Sequence Number=SeqID_80272
  Gene Ontology: Mol. function=ionotropic glutamate receptor activity; Cellular component=membrane; Biological process=ion transport
  Homolog annotation: Hit_ID=Q84QE2; Match level="QueryCoverage=87%, HitCoverage=58%, E-value=4e-78, Identity=32%"; Hit description =Avr9/Cf-9 rapidly elicited protein 141
  Pfam annotation: Domain name=Lig_chan; Domain location=242-503; Score= 121.5; E_value=2.4e-33; Accession=PF00060.17; Description=Ligand -gated ion channel
  Pfam annotation: Domain name=SBP_bac_3; Domain location=137-458; Score=-43.7; E_value=3.5e-05; Accession=PF00497.10; Description =Bacterial extracellular solute-binding proteins, family 3
  Pfam module annotation: Pfam domain module=Lig_chan::SBP_bac_3; Domain location=242-503::137-458
VQIQFQRNFASEFPEEEKINPSFFALQLYDATWAIAQAAKESQGKFTPEQLFKNYLSRNDKLQQSPTFNIINVIGFSKNLITQQLTEVNTDTTSTKVLSTVYWPGGLQFVPKGSTRSTEERTLQIGVPANGVFRQFVNVTHDQNTNNTSITGFSIDVFKAVVNTLPYDLKYTFVPFNGSYDEMVEQVHNKTLDAAVGDTAIMAYRYHLVDFTQPYIESGLDMVVKEKSAKSKETWIFLDVFTKEMWLMIVALHIFVGFVIWFIERRHNAELKGLGSMLWFLVSVIFYAHREPITSPLARTVLAPWLFVILIATSTFTASLTSMMTVSQLEPSVLDIQTLQERNSPVGCNGNSFIVKYLIDILKFKPENIKKINSIGDYPAAFQNKDIEAAFFVTPHAKIFLAKYSCKGLIKAGSTFKLGGFGFVFPKGSTLATDLSEALLKVIEKRETEQLEKDMLLIGGNANCSPSESKAKGRSSTGFQPFLGLFLICSSVAILALLYNMICVFKISVEIFSSYMHVTLTKLKSMWRCTTTCFTWSCSRLQSGSMRSISTATVTRNAEETVISDQQSTMNVELIDVVLAAHAS

SEQ ID NO: 197051 - protein, 37 aa, Glycine max
  Coding DNA Sequence Number=SeqID_80273
MELRLGFSPQSQPNVGCINHCTQDVDYPFGGYSGKSK

SEQ ID NO: 197052 - protein, 70 aa, Glycine max
  Coding DNA Sequence Number=SeqID_80274
MSSLLLSPFSFATDTSMAQEEETSPDPMLEPFPAPISEDTMPSAPAMELEQPILQDVPAAPVLDLNEDQP

SEQ ID NO: 197053 - protein, 219 aa, Glycine max
  Coding DNA Sequence Number=SeqID_80275
  Gene Ontology: Mol. function=dUTP diphosphatase activity; Cellular component=cytosol; Biological process=nucleotide metabolic process
  Homolog annotation: Hit_ID=Q9STG6; Match level="QueryCoverage=73%, HitCoverage=97%, E-value=3e-60, Identity=73%"; Hit description=DUTP pyrophosphatase-like protein
  Pfam annotation: Domain name=dUTPase; Domain location=88-218; Score =197.6; E_value=3e-56; Accession=PF00692.10; Description=dUTPase
MAGKFSAMRTFRAISLPLPLYKPYPHLQFPFLSSNLSIHHRVSSMAQPQPESHATNGSHEPLLKIPKLHQNGDVSATAPFLRVKKLSDKAVLPSRASPLSAGYDLSSAVETKVPARGKALVATDISIAIPEGTYARVAPRSGLAWKHSIDVGAGVIDADYRGPVGVILFNHSDTDFEVKVGDRVAQLIIEKIVTPNVVTEVEDLDETVRGEGGFGSTGV

SEQ ID NO: 197054 - protein, 550 aa, Glycine max
  Coding DNA Sequence Number=SeqID_80276
  Gene Ontology: Cellular component=ribonucleoprotein complex; Biological process=mRNA metabolic process
  Subcellular localization annotation: CTP_CleavageSite=40; ConfidenceScore=5.41e-01
MGTCLSKKNGSSTSPNKSDSQHRNSENSVTVTLSKPTEPEVSLKNKTLQEKQQGSESAPQDEGEVKKEILIIKHRKSHDEREKTATSKTPSPCIAPQQGDGVFTNEETMVVNKIIAPSTPSIGVVGVRTSSCTKDEVDEILIQCGRLSRSSSRRKYSGSKRSFDFDHCDNDTTSAEDDQRKSKGNGNGREENDVAAAASESGRHHQSPRRSQGRRRTPSRERDQSSGRERRVSRSPGRRSSDTNTTNASNNNTSSRPGKMVSVPATVSSLVMDKSNNCGGESGAKRITVKRNVGDAGSRGTASPRAQSPARVNGNVGRDKVLNENQQHQQQPSLSRNNSSRKAEQSPYRRIPQSEVDHKSSRKAEQSPYRRNPQSEVDHNSSRKAEQSPYRRNPLSEVDTNRKVQQNKPKIEGEAIQKPNGRVALEKGMSVDCKTKEQHEEESSLPVGAVVKTTVVSSGVDNLKPQGLTRSRSSRRSRDLDISNPEAVVNPTNSYASLLLEDIQNFHQKNTQQQQSSISLPACLNKACSILEAVADLNSTTSSNFTEDKR

SEQ ID NO: 197055 - protein, 554 aa, Glycine max
  Coding DNA Sequence Number=SeqID_80277
  Gene Ontology: Mol. function=catalytic activity; Cellular component =nucleus; Biological process=metabolic process
  Homolog annotation: Hit_ID=Q9FFE6; Match level="QueryCoverage=99%, HitCoverage=100%, E-value=0.0, Identity=64%"; Hit description=AMP -binding protein
  Pfam annotation: Domain name=AMP-binding; Domain location=41-470; Score=346.1; E_value=5.9e-101; Accession=PF00501.18; Description=AMP- binding enzyme
  Subcellular localization annotation: CTP_CleavageSite=75; ConfidenceScore=5.45e-01
MEQLKPSAPNSSPLTPLAFLDRAATVYAHVPSLVYNHTTFTWSLTRRRCLQLASSLSSLGIRRGSVVSVLAPNVPAMYELHFAVPFAGAILNNINTRLDARTVSVILRHANSRLVFVDCASRDLVLEALSLFPENQNQRPTLILITDETVEKEKAAPAVDNFLDTYEGLVSKGDPGFKWVLPNSEWDPMVLNYTSGTTSSPKGVVHCHRGTFIISVDTLIDWAVPKNPVYLWTLPMFHANGWSFPYGIAAVGGTNICVRKFDAEIVYSLIKRHHVTHMCGAPVVLNMLTNSPDNKPLEKPVQILTAGAPPPAAVLFRTEALGFVVSHGYGLTETGGLVVSCAWKGEWNKLPATERARLKARQGVRTAGMAEVDVVGPTGESVKRDGVSIGEVVMRGGCVMLGYLKDPSGTASCFKNGWFYTGDVGVMHEDGYLEIKDRSKDVIISGGENLSSVEVESVLYGHPAVNEAAVVARPHEYWGETPCAFVSLKREIKEKEKPTEKEIIEYCRDNMPHYMVPRTVIFKDELPKTSTGKIQKFVLRQIAKEMGSFTQSRI

SEQ ID NO: 197056 - protein, 345 aa, Glycine max
  Coding DNA Sequence Number=SeqID_80278
  Homolog annotation: Hit_ID=Q0H8D7; Match level="QueryCoverage=81%, HitCoverage=48%, E-value=2e-33, Identity=35%"; Hit description=NBS1
MSKMNVWLHKKRQDTEWLYIDICVAPMEVIIENWLRWLDMQKRPLLALMRTEESSLYDFNPGSDYGEDNHVVCVIPGGPACKSNLFNKLSSLLRVNEMDVICAAFSGQLDLSILKSPCVLVSSSCSTDETIVADSDIEVETATSVRSNDAFSNDNNVKYEKTKELYVDSDPLDKRKHERIEASSDDVLHDTKRAKTETSLDGASVRSHSTSFRNDNDDIKVKKDKVNDDESGNSDIVYSQYLIVRDTNIRTSISTAPNSSVPNFKRFRKAQTQSGNSFENLVPFGKYPYKDSDCGNEDVTELVKEEKRRKKMEAMADDMFNNEARKRGTAGSRGTVGSLRGILTS

SEQ ID NO: 197057 - protein, 551 aa, Glycine max
  Coding DNA Sequence Number=SeqID_80279
  Gene Ontology: Mol. function=catalytic activity; Cellular component =nucleus; Biological process=metabolic process
  Homolog annotation: Hit_ID=Q9FFE6; Match level="QueryCoverage=97%, HitCoverage=98%, E-value=0.0, Identity=62%"; Hit description=AMP -binding protein
  Pfam annotation: Domain name=AMP-binding; Domain location=41-463; Score=343.3; E_value=4.1e-100; Accession=PF00501.18; Description=AMP- binding enzyme
MEDLTPNPANSPPLTPLTFLERAAIVYGDSHSILYDRTSFTWSQTHRRCLQLASSLTSLGLGRGHVISVLSPNTTSMYELHFAIPMCGAILNNLNLRLNPHTLSVLLRHSESKLVFVHSHSLSLILLALSNFPITTPRPSLVLITDDADAITRSPVIDTYEDLIRKGNPNFKWVQPNSEWDPITLNYTSGTTSSPKGVVQSHRATFIMTLDSLIDWCVPKQPVYLWTLPMFHSNGWTFPWGIAAAGGTNICARKIDAPTIYRLIESHNVTHMCAAPVVLNMLLTRTEPVKNPVHVLTGGSPPPAAILTRAEELGFRVSHGYGMTETLGVVVSCAWKKEWDKFPSTERARFKARQGVRTVAMTEVDVVDPTTGISVKRDGVTPGEIVFRGSCVMLGYLKDIEGTKRCIRNNWLYTGDVGVMHGDGYLEIKDRSKDVIISGGENLSSVEVESVLYGHPAVNEVAVVARPDEFWGETPCAFVMLKEGLVAPPSEKELVEFCRERLPHFMVPKTVVFKEALPKTSTGKIQKHVLRMNAKAMGSLVAPPPAIPSRM

SEQ ID NO: 197058 - protein, 260 aa, Glycine max
  Coding DNA Sequence Number=SeqID_80280
  Homolog annotation: Hit_ID=Q9ZVD2; Match level="QueryCoverage=55%, HitCoverage=55%, E-value=2e-16, Identity=29%"; Hit description =Expressed protein
  Pfam annotation: Domain name=Hin1; Domain location=96-234; Score =180.8; E_value=3.3e-51; Accession=PF07320.4; Description=Harpin -induced protein 1 (Hin1)
MADPQKIHPVHHDVEAQNHPSAPLVPRSMSKSDAGDPQRVVVVQQQQQQQQQHIPVKHTKPPTKKRRSCCCRFFCWLISILLILIVAIGITIGILYLVFRPKLPKYSVDELKVTNFDLADNNSLSVTFNLTITARNPNKKIGIDYRGGSHISAWYMDTKLCEGSLPKFYQGHRNTTILSIPLTGKTQDATGLQNTLQNQLQETGNVPLNLRVKQPVRIKLGKLKLFKIKFRVRCRIVVDSLSANSSIRIQSSSCKFRFRL

SEQ ID NO: 197059 - protein, 210 aa, Glycine max
  Coding DNA Sequence Number=SeqID_80281
  Gene Ontology: Mol. function=transcriptional repressor activity; Biological process=regulation of nitrogen utilization
  Homolog annotation: Hit_ID=UPI000052DC82; Match level="QueryCoverage =99%, HitCoverage=66%, E-value=5e-90, Identity=76%"; Hit description =NmrA family protein
MKLAQAALQARIPRYFPWQFGADFDAIGRGSPQEIFDAQIDVRDLLRSQDETEWVIISTGIFMSYLFEPDFGVVDLQNNTVHALGSIDNTMTLTTPDDIGMLTAAIVFKTPRIRNEIVYIAGDTLTYAEVADKLQSALGRPFSCTEWSEQYLMDKLALTPQDMMSKYRAVFAQGRGVAWSKEQTFNERHNIPVTNVDTWINANLIQSNSD

SEQ ID NO: 197060 - protein, 262 aa, Glycine max
  Coding DNA Sequence Number=SeqID_80282
  Gene Ontology: Mol. function=catalytic activity; Cellular component =membrane; Biological process=metabolic process
  Homolog annotation: Hit_ID=Q13U56; Match level="QueryCoverage=96%, HitCoverage=83%, E-value=2e-53, Identity=47%"; Hit description =Putative regucalcin family protein
  Pfam annotation: Domain name=SGL; Domain location=1-228; Score=211.7; E_value=1.6e-60; Accession=PF08450.2; Description=SMP-30Gluconolaconas eLRE-like region
LYWTDIEGSELLALEEGTDIVMRWALPERLGSFALTEKDNVLLMALASRLAFCNIDTGEFIPLADSPGEPGTRTGDGRCDRAGNFVFGTMDDGFPAKVIGKFHRLNAVTLSIETLPLPEVAIPNSICFSPDGGTMYYCDSMQNRIMCCDYPSLDHQRVFTETGGDGAPDGSCVDAMGYVWNAEWGGNRVVRYRPDGTTDCILPSPGIQSTCPALAGEAFTTLYCTSASVGLSLPSEHDGALLKADSAVFAGLPESRFSAHLP

SEQ ID NO: 197061 - protein, 183 aa, Glycine max
  Coding DNA Sequence Number=SeqID_80283
  Gene Ontology: Mol. function=diacylglycerol kinase activity; Cellular component=mitochondrial inner membrane; Biological process=protein kinase C activation
  Homolog annotation: Hit_ID=Q8H8U1; Match level="QueryCoverage=51%, HitCoverage=16%, E-value=3e-23, Identity=60%"; Hit description =Putative PPR repeat containing protein
MAFNLWWSIMLAWWVFLVELVSSQKQQNSFLKYQLNQVLKFGVLCYTGLLFMVVLKWASLLVFEMEPENTGNYMIMANLYSHAGKWKQAGEVREIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 197062 - protein, 233 aa, Glycine max
  Coding DNA Sequence Number=SeqID_80284
  Homolog annotation: Hit_ID=Q8PKQ5; Match level="QueryCoverage=44%, HitCoverage=37%, E-value=7e-17, Identity=42%"; Hit description=Zinc transporter zupT
MRVRNEVVDQHDHDHAQQEGQGAVGEAGALAIGQGERRNGLVEDLRQRHIDHRAAGEGQAEGQQARIGSAREQHQQAADRGGEAGREGDRQRDPDVFGGDLQHLPTRSWSTDNRPGQCRGGEGEAGVGWPRRGARDQPPRRRRSSMAKHWSGFGCGGLKLTGTWMVAGTGWPLRVAALNCQPCTAVLASSSSCGLPAPVSSATSLGLPIEFLQPGGSTSSRAAATAVELQFAL

SEQ ID NO: 197063 - protein, 73 aa, Glycine max
  Coding DNA Sequence Number=SeqID_80285
  Pfam annotation: Domain name=zf-CCHC; Domain location=36-53; Score =25.5; E_value=6e-05; Accession=PF00098.13; Description=Zinc knuckle
MEEGEKVYLIAQGKKKGDQAKNKGKISTHSVIKKESKCFFCKKKGHMKKDCSKFKSWLNKKGMENLRKLVGSE

SEQ ID NO: 197064 - protein, 113 aa, Glycine max
  Coding DNA Sequence Number=SeqID_80286
  Homolog annotation: Hit_ID=Q2PMM5; Match level="QueryCoverage=100%, HitCoverage=4%, E-value=1e-60, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKE

SEQ ID NO: 197065 - protein, 166 aa, Glycine max
  Coding DNA Sequence Number=SeqID_80287
  Gene Ontology: Mol. function=nucleic acid binding; Biological process= apoptosis
MSMTQDHEKLDSDLIATCVVGMIREDPSIKISLIQERINSEFSYKVSYRKAWMAKQKAIAIEYDDWEESYAKLSSWLTHMQNHSPGSYFQILHDNFIVGNRVSREHRQFYRVFWTFGQCKEAFKYCKPIIQVDDTHLYRKYRGTLLMATSQDGNGGVLPLAFAVVE

SEQ ID NO: 197066 - protein, 102 aa, Glycine max
  Coding DNA Sequence Number=SeqID_80288
MRGYRMVIRTFCHPETASPMTCRGIVWKSGGMRGYRMVIRTFRQPRESEPADAQRLKSSSAPFVIQGQRVRWQAEIPYGRPHLSSTKANEFDGIRMMLVIRF

SEQ ID NO: 197067 - protein, 55 aa, Glycine max
  Coding DNA Sequence Number=SeqID_80289
MSLMTHQDFQVQAIGQGQPFPCVQESSTTRDPRSLNPFSEIRRREEEVSRKKGRL

SEQ ID NO: 197068 - protein, 91 aa, Glycine max
  Coding DNA Sequence Number=SeqID_80290
VVGASDGPWRRWAIAVAVEDDLFLFFDGVKKWKIGLYDTCFGEDLSKIRRFEDLGMEEARGEALAAQQHWSNKPSGNRLQDVVIDYRLPAL

SEQ ID NO: 197069 - protein, 128 aa, Glycine max
  Coding DNA Sequence Number=SeqID_80291
MVEDARTALGNQFVGIRTQWWRMHERQSIPGAPNKIRWWRMHEQRLTINSWRSGLDVLGNQFVGLQTRWWRMRELRLRIISWRSGLDGGGYMNDDQFMGFRIRFDDGGCTNSARRSIHGTPNSMVEDA

SEQ ID NO: 197070 - protein, 51 aa, Glycine max
  Coding DNA Sequence Number=SeqID_80292
MNTICHWKLYMHVPKAPAGLSMKVMKDNIRTGVDNQHITSLLHLSYKQHTT

SEQ ID NO: 197071 - protein, 168 aa, Glycine max
  Coding DNA Sequence Number=SeqID_80293
MEAMKEKMDTMMEAMMSMKKIMEANAVTVSATSAVAKVNPMPPSGINQMNHPTSAMRKDSGPLKGGKDYAFVNLEELLLVPNIITLPKFKVPDFDTYKGTTCPKNHLKMYYRKMGAYAKDEELLIHSFQESLTGVAVTWYTNLEPSRVHSWKDLVVAFVRQCQYNVFG

SEQ ID NO: 197072 - protein, 86 aa, Glycine max
  Coding DNA Sequence Number=SeqID_80294
  Gene Ontology: Mol. function=ribonuclease H activity; Biological process=DNA integration
MDPVKYIFEKPALTGRIARWQVLLSEFHIFYVTQKAIKGIALADYLAQQSLNDHQPMHPEFPEEDIMALFEEKPDEDWDKWIVWFD

SEQ ID NO: 197073 - protein, 96 aa, Glycine max
  Coding DNA Sequence Number=SeqID_80295
MVPFIAPMLGSEHKLENPDESLETSNNSFQNCPMCGVAGSYSAQWNAPGLLPDMHMLRSSRILEKMEVEEPWLGLWLPLNYQVDMGASQHRTPKLG

SEQ ID NO: 197074 - protein, 193 aa, Glycine max
  Coding DNA Sequence Number=SeqID_80296
HPFQASYPRLILVVNLLLPWLIQDEATTSPSSSESEEAKGEESSEEIYPQEEGQPLMTNIKEASPLRQPPHLLLCKKTLVSTATPLGFEVIPQVNELLDEDPKRIKVIPDWPTSLSIREIWGCHDLTNFYKRFVPYLSILVAPLIELVRNYVPLREDVHERGVEGRIPEYEEPQDLRSNPFQGGGDDAILPPR

SEQ ID NO: 197075 - protein, 346 aa, Glycine max
  Coding DNA Sequence Number=SeqID_80297
  Gene Ontology: Mol. function=unfolded protein binding; Cellular component=integral to membrane; Biological process=cell division
  Homolog annotation: Hit_ID=Q2NQY3; Match level="QueryCoverage=80%, HitCoverage=88%, E-value=1e-53, Identity=45%"; Hit description=Cell division protein
MGLRVPQDLSIVGFDDLKLAQYCDPPLTTVAQPRFQIGQQAMLLLLEQLNGQTVASGSRLLDRHSGIIVAQKDYVSRGRAAGAKRKTPSRKKRSSPKVSKTVLALAAALLVVFVGGLYFITHNKPEDAPLLPAHTTRPGNGLPPKPEERWRYIKELENRQIGVQTPTEPTAGGELNSKTQLTAEQRQLLEQMQADMQQRPTQLNEVPYNDPGQANARSTRQQQQMQQQQMQQQPVQQQQQVSQPPRNPFNNGATTAPVQQHPQPKPTTQQPVQVKQPEPKPQPKPEPKPEVKQETAKQETKPESKQKWMVQCGSFRATDQAESVRARLAFEGIESRITAGGGWNRV

SEQ ID NO: 197076 - protein, 100 aa, Glycine max
  Coding DNA Sequence Number=SeqID_80298
MESPTIAIYPSAGGRCETNGCVFHGRKMRGVTTNVYSRKTSEKTGKVWSTIYNHERETLRHWTINDLLGWLTKAVKLHIDFMFFERSMLTEKSKDDHLRR

SEQ ID NO: 197077 - protein, 159 aa, Glycine max
  Coding DNA Sequence Number=SeqID_80299
MDRKPAVTAIPTWPNFPPAQQYQYSANISPSHYPPPYQPRTLNHPQRPPLNYPIPNTTLNTDQNTNQGRKFPAKKPIEFTPILVSYANLLLYLLNNIMVALTLVKVPQPPFFQRYNSNTTCAYHGGVSGNSIEHCMTLKHKVQNLIDAGWLKFEEDNRL

SEQ ID NO: 197078 - protein, 112 aa, Glycine max
  Coding DNA Sequence Number=SeqID_80300
MCKMFKRGAKWSLWGHFPAPRPTRKLRDEAITSLGRAGLLLEEERRRKKKKNQGRGVSYPNFVRGPLLDDVRPFFGPREKAVASGGSNPARLGELSSPGRAGRQPPPLFCYK

SEQ ID NO: 197079 - protein, 97 aa, Glycine max
  Coding DNA Sequence Number=SeqID_80301
MSQNPMDYTTISVKQLNSADKNPNVGKDHPRTKLGYYKERPKGVLRGSKVQEVSELREERKKKNKKEEETKSRCYRIVTAIIPYIVLLFCVLRATVS

SEQ ID NO: 197080 - protein, 43 aa, Glycine max
  Coding DNA Sequence Number=SeqID_80302
MCFSEENPSRGAVVTLPRHFREQIHEDFPSFFTVIRSFCGLQS

SEQ ID NO: 197081 - protein, 225 aa, Glycine max
  Coding DNA Sequence Number=SeqID_80303
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=3e-29, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=70; ConfidenceScore=5.38e-01
PLKVSVCSPLKARVCRPFKVRACCPLKAKTVSPLKVRACSPLKARLCSPLKVRACCPQEVRTCSPLKVTVCSPLKARMCSPLKVSMCNPLKGRACSPMKARARSPLKARTCSPLKVRASSPVQARACSLLKVSTCSHLKVRTCSPMKAGTCSPLKVWACSPLKGRACSPTKAREWSPRKAITLGTLKVRASIPVKARMCSLLNVRTCTPSEGGDPSEGVGVYAFK

SEQ ID NO: 197082 - protein, 153 aa, Glycine max
  Coding DNA Sequence Number=SeqID_80304
MAPTRHHLDPNKSNRALGCPTLIMGLCQSYGVPITPSKVIRPPITRAFIEKCCTPRQAQGDAHQAVGAPPPPRQADPAGPLGMEQPTTVGRCRYMSVSTGSASISRGRVAWPGDWPDAQAGEEPAGSPGETDESRMDEDMTDLLGFLGGIGAA

SEQ ID NO: 197083 - protein, 291 aa, Glycine max
  Coding DNA Sequence Number=SeqID_80305
  Gene Ontology: Mol. function=nucleoside-triphosphatase activity; Cellular component=chloroplast
  Homolog annotation: Hit_ID=Q2PMM5; Match level="QueryCoverage=95%, HitCoverage=12%, E-value=1e-162, Identity=99%"; Hit description =Protein ycf2
MDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDQMVRTSSEFESYWR

SEQ ID NO: 197084 - protein, 97 aa, Glycine max
  Coding DNA Sequence Number=SeqID_80306
  Gene Ontology: Mol. function=serine carboxypeptidase activity; Biological process=proteolysis
  Homolog annotation: Hit_ID=Q9FMX9; Match level="QueryCoverage=61%, HitCoverage=12%, E-value=1e-15, Identity=70%"; Hit description =Serine carboxypeptidase II-like protein
MALCSVFLNLHLLLFVCLTIEALGVAKPSVASYLSQEILAEQKADRVHRLPAQPPVKFHNMVVISLSMKLKEEHCSIGFSRPLTNQNKNPFSYGSME

SEQ ID NO: 197085 - protein, 52 aa, Glycine max
  Coding DNA Sequence Number=SeqID_80307
PDNYLKGIINSALKVLDKKSQPQSKAPARWIVVKYFNDPRTLEPERLKALQI

SEQ ID NO: 197086 - protein, 159 aa, Glycine max
  Coding DNA Sequence Number=SeqID_80308
MEDSIGKITNITFPSQEGPLLTVKNTLENVGFNRENNKDHISQSRGSALDGEEHIGEWRNPIGKIIKITFPSQDGPLLTVKNTLEIKLIDTVDLEGGPVGKPVVPAALMNRPTRGERRFAYWALAECILAYYVGTDEGVSEVLHVAGEKKAAPVRQQNM

SEQ ID NO: 197087 - protein, 575 aa, Glycine max
  Coding DNA Sequence Number=SeqID_80309
  Gene Ontology: Mol. function=amino acid transporter activity; Cellular component=membrane; Biological process=amino acid transport
  Homolog annotation: Hit_ID=Q9LZ20; Match level="QueryCoverage=94%, HitCoverage=94%, E-value=1e-149, Identity=49%"; Hit description =Amino acid transport-like protein
  Pfam annotation: Domain name=AA_permease; Domain location=61-488; Score=1.4; E_value=9.1e-06; Accession=PF00324.11; Description=Amino acid permease
  Pfam annotation: Domain name=Aa_trans; Domain location=55-459; Score=- 155.0; E_value=0.049; Accession=PF01490.8; Description=Transmembrane amino acid transporter protein
  Pfam annotation: Domain name=Spore_permease; Domain location=56-408; Score=-144.9; E_value=0.0048; Accession=PF03845.4; Description=Spore germination protein
  Pfam module annotation: Pfam domain module=AA_permease::Aa _trans::Spore_permease; Domain location=61-488::55-459::56-408
  Subcellular localization annotation: CTP_CleavageSite=50; ConfidenceScore=5.13e-01
MSNIHTATNSMKKLSSYLHSLSQTPHRLRKRMLATWTPDQEFNQVRHRSGADMKRKLKWHDLVALGVGGMLGVGVFVTTGSVALHHSGPSVFISYIIAGISALLSSLCYTEFAVQVPVAGGAFSYLRLTFGEFLGYFAGANILMEYVFSNAAVARSFTEYLSIAFGENDPNVWRVEVPGLPKDYSMLDFPAVALILILTLFLCHSTKESSMLNLIMTAFHVIFFGFIIIAGYCNGSAKNLVSPKGLAPFGARGVLDGAAIVYFSYIGYDSASTMAEEVKDPFKSLPIGIVGSVLITTLLYCLMALSLCMMVPYNKISEKASFSIAFLKIGWNWASNLVGAGASLGIVASLLVAMLGQARYLCVIGRARLVPSWLAKVHPSTGTPMNATVFLGLCTATIALFTELDIIIELISIGTLLVFYMVANALIYRRYVITSHAPPTHTLVFLFLLSLSALCFSLAWKFKQQWWGLVLFGGFMIAITAFFQHVVSTTTTTTTTNWSVPFMPWPPAMSIFLNVFLMTTLKILSFQRFAIWACLITIFYVLYGVHNTYEAEEIENEVDSSVNNLQTKVEIIQVH

SEQ ID NO: 197088 - protein, 280 aa, Glycine max
  Coding DNA Sequence Number=SeqID_80310
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=1e-41, Identity=32%"; Hit description= UPI00006A17C9 related cluster
  Subcellular localization annotation: CTP_CleavageSite=46; ConfidenceScore=5.55e-01
RATRPHLQQTTHPPLQRTIRRLLQKAACPRLQRTTRPLFQRTTCPRLERATRPRLQRTTHPRLQRITRPLLQRATRPHLQRTTPPPFQRTTRPLLQRATCPHLQKTTPPHLRGLHALTFRGLHVHTFSGLHVLPFSGLHVLLFRGLHVLAFRGLHALTFRGLHVLAFKGLHILPFRRLHVVAFRKPQALAFRGLHVLGLRGLHALAFRGLHVLPFRGLHVLPFRGLDVLSFRGLHVLTFRGLHLVPFRGLQVLSFRGLHVLTFRGLHPLTSEGYMPSPSE

SEQ ID NO: 197089 - protein, 130 aa, Glycine max
  Coding DNA Sequence Number=SeqID_80311
MKSKGVLSARLANLLTKAHPFTHQSHTRPQMIIMSLILNPSNSIPILVHTQNCLVDRQSTMRRLPDYRHFLDQQQQSDSHNDELYVGQRFCQLEDLKHTVKMWHIKNHVTFKAKRCVKDTWVLCCPVEGC

SEQ ID NO: 197090 - protein, 91 aa, Glycine max
  Coding DNA Sequence Number=SeqID_80312
IMPARYSMDPKKSNRVLELPALIMGLCRFYGVPIAPSKVIRPPTNRAFIKKYCAPRQVQGETPQQPGDGRQWATDAPPPPLEFTSAHPQKG

SEQ ID NO: 197091 - protein, 266 aa, Glycine max
  Coding DNA Sequence Number=SeqID_80313
  Gene Ontology: Mol. function=RNA-directed DNA polymerase activity; Biological process=RNA-dependent DNA replication
MTYSAPLIHTIQQEVEPIFQAENVVAFDKMEELQERFDGMQREVEALRGRDLFGKDACELCLVPNVTIPHKFKVPDFKKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLTEESVPAASNAKKFGGHFAKKKDQEVGMVAH

SEQ ID NO: 197092 - protein, 352 aa, Glycine max
  Coding DNA Sequence Number=SeqID_80314
MPYKQNALNVWEFSQIHIDTCMLEGVEIAPKKLSIKRCRRDALGEGFSAPVEFDNHRFRSVEHQQCFEAIKGWSFHRERRVQLIEDEYPNFQEEIARRHWEPLVTPMAKFDPEIVLEFYANAWPMEEGDQQCEFSQKSYQASGFDEETIAQLLCIPGQDFARTAVGRRVWIMRTSMTTLIQIWMTLLLSNILPNDHNSDLPLPKCQLVYAILTQMTVHVAQIIADAIYLFAGTAPTRHPLDPKKSNRALGFPALITGLCQFYIVPVTPSKVIRPPITRAFIEKYCTPRQAQGGAQQAANHRGQPTEEGAGPAGSPGDAEEAHMDEDMTDLLGYLGGSESHDQGCRTCNSIVL

SEQ ID NO: 197093 - protein, 129 aa, Glycine max
  Coding DNA Sequence Number=SeqID_80315
MSRQCGSKKSRFDLFDFPQDPLAKDAQRGLGSYLQYGQQPGGMILCVSFLLIPDPAADTTRTVSGIRLCCYANKLANNRDQHGPLVSRIVSRISACQDSAVPPLIDKVHGAYPPARFERAKGYLTVQTS

SEQ ID NO: 197094 - protein, 245 aa, Glycine max
  Coding DNA Sequence Number=SeqID_80316
  Homolog annotation: Hit_ID=UPI000068CCCB; Match level="QueryCoverage =30%, HitCoverage=20%, E-value=3e-21, Identity=62%"; Hit description =endonuclease I
MAHFDIKEHEDFYYNEQGYKVFTEKFHLKRGYCSAATLGLTSCSPFQVRSDYAETANFTSYKTYKIRIDDLKLNDIDKDRVLNELSKQLQSKGLSSGENPDLIVNVKANHKKVTDINSYSPYGMWGWGGPFGWGIGMNRTWTSNYNEGALIVDLVDTKSNKLVWQGIAKAQAPAGYYSSANGLTGAALKTELSSIITNGHQDKGYGGLWTGYKTTDIDKTYENDGSIMDIYSEKPNGADPYNYTP

SEQ ID NO: 197095 - protein, 68 aa, Glycine max
  Coding DNA Sequence Number=SeqID_80317
  Gene Ontology: Biological process=protein folding
  Homolog annotation: Hit_ID=Q10T60; Match level="QueryCoverage=72%, HitCoverage=14%, E-value=1e-10, Identity=60%"; Hit description =Expressed protein
MCWLKKQKGSLAPEQIDAEGETVSWTSGLIFGKGEGIVGQETEFGTLRVKVTEALKEKSTTIGSMLMV

SEQ ID NO: 197096 - protein, 73 aa, Glycine max
  Coding DNA Sequence Number=SeqID_80318
  Gene Ontology: Mol. function=signal transducer activity; Cellular component=heterotrimeric G-protein complex; Biological process=G -protein coupled receptor protein signaling pathway
  Homolog annotation: Hit_ID=P93163; Match level="QueryCoverage=64%, HitCoverage=14%, E-value=2e-12, Identity=71%"; Hit description =Guanine nucleotide-binding protein alpha-2 subunit
MTGDSLKRMLHVAAFAVSGMRSSLEGAGESGKSTIFKQIKLLFQIGFDKAELKSYLPVIHANNGGSKTLSQWV

SEQ ID NO: 197097 - protein, 166 aa, Glycine max
  Coding DNA Sequence Number=SeqID_80319
MSAINDQYKEKLDLDLTHEQRLEDEYAKVLVLQAEREARERVIDSLHREAMMWMDRFAFTLNGSQELPRLLAKAKAMVDVYSAPEEVQEQMKVDMEALKDQMTSMMEAMISMKRMMESNAAAVAATSVAVEVDSTYPSTINQANQPISDMVGQGGEVLGSISGPHM

SEQ ID NO: 197098 - protein, 88 aa, Glycine max
  Coding DNA Sequence Number=SeqID_80320
MTEWHYGISKKRLQIAVALRVAYRDTMAVMRNTQLRAHTEQNKARIEKSPARPAAQQQLTAATAKAMHMTPAPARNQQHNDDEQQRST

SEQ ID NO: 197099 - protein, 82 aa, Glycine max
  Coding DNA Sequence Number=SeqID_80321
MSLPAPPWPYAFWPARLDLALTGLPPSCKDSAPPLDALRPRFVQAALLGYVLPIAKAVLLPGFFSAKLGNLPFSERLYPGTK

SEQ ID NO: 197100 - protein, 176 aa, Glycine max
  Coding DNA Sequence Number=SeqID_80322
MGSNPVPLVKKRFYQVKIKNLGVTSLKELGQLMGQLQRQAFRKAYVNAHGREFEEIPGCPLGGRKPYLFSGFYPSLARISKIVKISAQELDQGKQVKNGVVGVPRKCLEAKARALASQDEWAPFIDVLALLIFRVVLFPNVDGLVDLATIDAFLAFHDCKESPVVAILANLYDTFD

SEQ ID NO: 197101 - protein, 90 aa, Glycine max
  Coding DNA Sequence Number=SeqID_80323
MLAIISKYKEESDLTTAHEHKVVDEYAQIEKNGSQDLPRLLAKAKAMANAYSAPEEIHGLLSYCQHMIDLMTHKIRNRQGVCVVTQILTS

SEQ ID NO: 197102 - protein, 119 aa, Glycine max
  Coding DNA Sequence Number=SeqID_80324
MGMRGCINYNPILAKRQLGNPMRGAPPEEGLTPFIARGFNSPNVGILQGVCKACEMVQRKDKELRGSSNGAVGSYRRWLKVYAQGLDWLPRLRVVKEEEVEASEESEQMQALKMELEKA

SEQ ID NO: 197103 - protein, 62 aa, Glycine max
  Coding DNA Sequence Number=SeqID_80325
MDDLQGTLGYSVHRGHQECCLPRKTIRYAYEQRSHPYNQQLSGTDVRGNHDDLMPAEIEEYK

SEQ ID NO: 197104 - protein, 718 aa, Glycine max
  Coding DNA Sequence Number=SeqID_80326
  Gene Ontology: Mol. function=phospholipase C activity; Biological process=intracellular signaling cascade
  Homolog annotation: Hit_ID=Q53KW8; Match level="QueryCoverage=81%, HitCoverage=74%, E-value=2e-50, Identity=34%"; Hit description =Expressed protein
MIVEQSSCDFVAAAAAEDMESLYLKRQEKRNVHVDEGRSKRSPFLDKPLMLPPSYDSIRVIGAFEHFKVGRFHEIDHSTLSPISPVQLKSVRIVMVSDIGEHLVSLRYPSLHSLRKHFSDQSFGKPDGKKIPTLDEKYVMGMDMAIKALVRSIPTEEFAQRRNSWSFWVSSPSNENPQEYENPALIDAARSLICKQGSCWSQLKFTGMVQWGARRQVRFLGRHEEQKVESLPKMSKEKRVGVEVGEGGGCEKKRKNGEEEEEMEGTKAGSLGVMMRVTRQCWKNHIQNVSSSSSGVKKSNKAKNDDPIKKQVVVYNDNKRKITINRWSAERYNLAEENMLKVMKEKEAVYGNPILRPDLRTEARKYIGDTGLLDHLLKHMAGKLAPGGAERFRRRHNAEGAMEYWLESADLVDIRKEAGVQDAYWTPPPGWKLGDRISHDYVTQRELREVMDEILKLKQEMRDLASKKGEEEALVLVTTPSFCLSSLNSDDCGSLAPTQEIYAELVSKKAKLEEQLKEISLTLSGMEEQLKMLKPTTVEEQTVPELATPPALLPGPTSVVENIGGETRKEKKSRNKNKATKSADDTQMQESNTTAAEDKAAKIKRLKSGFQICNPQGTFAWPNMGLSPQVVVSNDGNDDHTVVPTTPSVSSSSTSAPKLSISIPQTQPLPLQILHLPSSPVKPLAERRPVSTATLTHVTGPFSPSGSTPRSKITHHHY

SEQ ID NO: 197105 - protein, 104 aa, Glycine max
  Coding DNA Sequence Number=SeqID_80327
MQANEKKRKNLLTINNRTKHVLEEHKHAQTKTTKQQKTDSNLQPQKNGNHELETTASRQNAKQQNRYIEDGSQLKTNEKSETEQDIKIKKKQCKPSINQQLGTC

SEQ ID NO: 197106 - protein, 88 aa, Glycine max
  Coding DNA Sequence Number=SeqID_80328
MKTTFVDCASYTMLCTLRITVYCVVTIFLGNCTSLAIFLFLYAGVLLFSYIHVYLLLKHLITSTSWYQQHQDATADDKGCDYEDAQYV

SEQ ID NO: 197107 - protein, 173 aa, Glycine max
  Coding DNA Sequence Number=SeqID_80329
MIINTWLKVAVPCDGRVRLRAPSFLGRRTREPCVALPPKGCTSKTILPAWFPLGRIYEGSTAVHNIPLLHGQVKVGVVEVKDAEALVPVPTDEIVVSPGKPPDRSDHEVDDPLYLMTLTISQLFLKPLQVMWDATVFRVLNQDFPLYIKHKHLSEIAHGSQCLSISVIQLWIL

SEQ ID NO: 197108 - protein, 112 aa, Glycine max
  Coding DNA Sequence Number=SeqID_80330
MESWLESKGFGRCKPATLETIIARLCMFKSQVLDKEVFQKQMLEKLIWICSVMLVGAPHGGVSVGVMDKEFRSERSGFGDTKLRAPHPIYRVCPSQSSLNLLSEREIGSYQT

SEQ ID NO: 197109 - protein, 153 aa, Glycine max
  Coding DNA Sequence Number=SeqID_80331
MTSGGTLWLSAPFVIQGRDDESDDMPGYLMVIRTFCQPNPSELIDMQRLTSSSAPFVNLGDGKSDDMRGYLMVIRTFCQPEKSEPVDMQRLTSSSAPFVNQGDGESNDMRGYLMVIRTFCIPEASEPVDMQRLTSSSAPFVNQGQVSPLTHRD

SEQ ID NO: 197110 - protein, 180 aa, Glycine max
  Coding DNA Sequence Number=SeqID_80332
  Subcellular localization annotation: CTP_CleavageSite=38; ConfidenceScore=5.52e-01
MAESSKKHKGSSSSAAAHRTSRFGATEASSAPIPPSLSSSTLFSSDKQHIRYSSLFQSRQILDPKYLDLEFFDGETFDCYQVFQNTGLILFMSLKLPYYHELVRFFYSNLKIQDGTLISEVHGIPMIIDESLFFSLTQLPSQGAPFDGTLVDDWKFDYSSHDARRMVCIDQADMTGRLLA

SEQ ID NO: 197111 - protein, 66 aa, Glycine max
  Coding DNA Sequence Number=SeqID_80333
  Gene Ontology: Mol. function=cysteine-type endopeptidase activity; Biological process=proteolysis
  Homolog annotation: Hit_ID=Q6Y1E4; Match level="QueryCoverage=100%, HitCoverage=19%, E-value=1e-19, Identity=66%"; Hit description =Cysteine protease 12
MVAKNQFYQISLALLFCSGFLAFQVTCRTLQDASMYERHEEWMGRYAKVYKDPQERERRFKIFKEN

SEQ ID NO: 197112 - protein, 74 aa, Glycine max
  Coding DNA Sequence Number=SeqID_80334
MLAAHVQLSGRFPAKPILQNLKILQLPLSGSTYGDAILPRKGPVTRAMSKRLQENWARAAEEGPRILMNLRIDF

SEQ ID NO: 197113 - protein, 544 aa, Glycine max
  Coding DNA Sequence Number=SeqID_80335
  Homolog annotation: Hit_ID=UPI00006DBBD9; Match level="QueryCoverage =42%, HitCoverage=80%, E-value=5e-58, Identity=49%"; Hit description =COG2207: AraC-type DNA-binding domain-containing proteins
  Pfam annotation: Domain name=AraC_binding; Domain location=197-340; Score=93.9; E_value=4.9e-25; Accession=PF02311.9; Description=AraC -like ligand binding domain
  Pfam annotation: Domain name=HTH_AraC; Domain location=358-404; Score= 31.9; E_value=2.2e-06; Accession=PF00165.13; Description=Bacterial regulatory helix-turn-helix proteins, araC family
  Pfam module annotation: Pfam domain module=AraC_binding::HTH_AraC; Domain location=197-340::358-404
YSAGCLHYAAVPRSAAAGGNAGSIAGAQRARMAADCPTGRHSTVVDDRQSARLIRCVGRAGRGVGVNFRTCIYIAGILGVATVVVDSGLGRLIANALLHLLPLHDSPSFRAGCRFGLSATERGDVAGFCLRHPAAAISGVAHRGGNGAGECACQSRFAAVPAGVCAERAAAVTAGLSVVPAARLCLIRRQRSRIRYETGIESVNAHFCGHAYDPHDHDELLVGVTQQGLQRFNCHRALHTSTPGRAILIEPGAVHDGHAPDAAGFTYVMLYLPQPWVAEMMQRRGLGDVANIQGAFRSTLTDDAQLASAIQQAWFAVHQREGRLARDQSLDHLLTLLSRHLENKPGVQLSDAQRQMHLLRDYLHDFMAQDIGLDDLSRLSGIDRFRLTRQFKQAFGQSPHAYLVRLRLRSARALLAQGVEPVQVAAQRLNVVAFLATGIAAAAPEMMGEPYVDAHGRQYGNMAGQPMLVFAADLAGLQRAHRQGVERELTLIPYVEAMFSTGHDAANRAVFLAEDADNLNLVGIALRGPKKAVDKAIKGLALHG

SEQ ID NO: 197114 - protein, 300 aa, Glycine max
  Coding DNA Sequence Number=SeqID_80336
  Gene Ontology: Mol. function=amidase activity; Biological process =translation
  Homolog annotation: Hit_ID=Q2KVD0; Match level="QueryCoverage=94%, HitCoverage=51%, E-value=6e-33, Identity=34%"; Hit description =Putative amidase
  Pfam annotation: Domain name=Amidase; Domain location=1-292; Score =20.1; E_value=4.2e-13; Accession=PF01425.11; Description=Amidase
  Subcellular localization annotation: CTP_CleavageSite=70; ConfidenceScore=5.71e-01
ELAAGITGASSLSGFTHNAWQQGRSPGGSSSGSAVAVAAGFVPLAIGSDTAGSVRIPAAFNGLFGLRMTRGALSSAGIVPLSPTQDIPGPLVRYAADLRLISEILTGQRFSRPDRPLRIGIWQEGFAAEETEINQAVQDAVAPFQPRMLSWPQLETLATEANIIAYEFADALAAWLADKSQAPLRTLAAIAASGHYHPQLEATFKTRAQHPGMQSDGYREVQLRQQRLYQQLAQFFQQQQIDLLAYPVVRHPPVKHGELQPGSNALISAVTGAPAISIPVGLTSGTARPGRCAVKGGRTD

SEQ ID NO: 197115 - protein, 68 aa, Glycine max
  Coding DNA Sequence Number=SeqID_80337
MEAWGAAIYAVSVSNGVLERGGGVLGEENSPPAPFHLTFAGGARPGELTLILGCLSVALLDRPEPDVG

SEQ ID NO: 197116 - protein, 66 aa, Glycine max
  Coding DNA Sequence Number=SeqID_80338
  Homolog annotation: Hit_ID=Q2NU75; Match level="QueryCoverage=82%, HitCoverage=51%, E-value=1e-14, Identity=65%"; Hit description =Putative ribosome modulation factor
MRETRYEETEERPPGTSTFTRLSGRHYRPLKRDMPLSNDRCPVSPVGRLATTMEDRSRWLRHVGCL

SEQ ID NO: 197117 - protein, 156 aa, Glycine max
  Coding DNA Sequence Number=SeqID_80339
  Homolog annotation: Hit_ID=Q66CF7; Match level="QueryCoverage=94%, HitCoverage=73%, E-value=2e-50, Identity=67%"; Hit description =Putative lipoprotein protein precursor
  Pfam annotation: Domain name=DUF330; Domain location=1-150; Score =163.1; E_value=7e-46; Accession=PF03886.4; Description=Protein of unknown function (DUF330)
MARVSSDASASQPMIWVEQVSVPDYLAGNGLVYQTSDVKYVIAANNLWASPLDQQLQQTLVSNLGQALPGRLVASQPLGDTHDTLSVHVTGFHGRYDGKVVVSGEWLLQHQGRLIKHGFNLTLPQTEDGYDALVRTLALGWQQTAQQIANSVVTLN

SEQ ID NO: 197118 - protein, 231 aa, Glycine max
  Coding DNA Sequence Number=SeqID_80340
  Gene Ontology: Mol. function=chitin binding; Cellular component =extracellular region; Biological process=chitin metabolic process
  Homolog annotation: Hit_ID=UPI000044A8F0; Match level="QueryCoverage =83%, HitCoverage=100%, E-value=1e-28, Identity=32%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDTSEPYTGAMKGTVHYPQANLRADQKFSPVDVQVPIAFRGLHVLAFRGLHALAFRGLHILAFRGLHVLAFRGLHILAFRGPHPLAFRGLHVLTVRGLHVLTFRGLLILPFRGLLLLPFRGLLVLAFRGLHVLTFIGLHVLAFRRLHALAFIGLHVLAIRGLHGYTPSPSEDYTFSPSEGNTPSPSEDYASLPTEGYTSSPSEDYMSSPLVDYMSSPSEGYMPLPSEDYKS

SEQ ID NO: 197119 - protein, 129 aa, Glycine max; identical to SEQ ID NO: 193722
  Coding DNA Sequence Number=SeqID_80341

SEQ ID NO: 197120 - protein, 73 aa, Glycine max
  Coding DNA Sequence Number=SeqID_80342
MVKCLVKLQTKFREDPTVNEGWATFLPRQLHTKFREDPTVNEGWAAFLPRQLHVAFSRSFIKRLPLEASSWLL

SEQ ID NO: 197121 - protein, 225 aa, Glycine max
  Coding DNA Sequence Number=SeqID_80343
  Homolog annotation: Hit_ID=Q47522; Match level="QueryCoverage=23%, HitCoverage=64%, E-value=9e-24, Identity=100%"; Hit description=LacZ protein
MASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQGRSQRELMTSRLLGIPQRPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 197122 - protein, 378 aa, Glycine max
  Coding DNA Sequence Number=SeqID_80344
  Homolog annotation: Hit_ID=Q4IYW9; Match level="QueryCoverage=74%, HitCoverage=52%, E-value=2e-11, Identity=27%"; Hit description =Forkhead-associated
  Pfam annotation: Domain name=FHA; Domain location=26-95; Score=20.2; E_value=0.0075; Accession=PF00498.16; Description=FHA domain
MRFTIITTKPGHQPPQTRCDFMPPGGTIGRGVDNNLVLPDDDRTISRLQAIVHITAAGECRLTNRGNVTRVLLNDIPLERGRQVELQDGDVLGIDDYQLLVNDLNGAQQPQAATLAPQPVVQAAVMADAPPAEKDASTAAIPSEIWDSLAKEFSISDDLSKRKAAAEVLPEANPLTAPASLDRNPEDPLAQLVNDAPLDIGQQPKNTSLFDEGDALFAQESIFDDRTPSTLSAQQNAAAQPQVESATELDPLSLFGSQSSSDVRNHDDPLGLMMGNAVPLAQPEIAPAQTVQPQPVAQPETPSEPSPETAPVGLADLSSSPLFDDTETQATSPLIEPQAEQPETVAPQMDYGGITLPTPQAVQRVPSPTPKGRLRIDP

SEQ ID NO: 197123 - protein, 165 aa, Glycine max
  Coding DNA Sequence Number=SeqID_80345
  Homolog annotation: Hit_ID=Q6D565; Match level="QueryCoverage=66%, HitCoverage=83%, E-value=3e-24, Identity=48%"; Hit description =Putative exported protein
  Pfam annotation: Domain name=DUF1311; Domain location=58-162; Score =60.9; E_value=4.1e-15; Accession=PF07007.3; Description=Protein of unknown function (DUF1311)
ETINTHCPDVCDFQGYQFKNGEYEYSFYPSVKEVNLWDYIVTYKDKVIAQDVAFAAALCSSEPSDSAVYQCTLHEKQLAEDALNQEYTAAKKRIASSYRADKKLADDYLSTLTNTQRGWLKYRDGQCKLEAFDAEEGSIAHEVATNICIVRINKERLESLRQIPY

SEQ ID NO: 197124 - protein, 365 aa, Glycine max
  Coding DNA Sequence Number=SeqID_80346
  Homolog annotation: Hit_ID=Q1RTB4; Match level="QueryCoverage=53%, HitCoverage=44%, E-value=4e-21, Identity=36%"; Hit description=IMP dehydrogenase/GMP reductase
RIATVVKDSARGLDRIKQTRNGIAGLPQKYLEDKAKDMASQGDWVPFMDVLALLIFGVVLFPNIDGLVDLAAIDAFLAYHHSKESPVVAVLADLFDTFDRSKTRGIHVRSRAIAREGKEGVLFSCGGYPNIPLIGMRGCINYNPALAIRQLGYPMRGAPTEESMSPFLVRDFGAQNFKAIQRIHKAWETPLRKDQELRGIRNGIIGGYHEWLKVHIRGLDWLAKLKVVSEESFEAPEEDEEVQALNSKLGKAKLAKEKFKLAATHIRKECVGLQEENATTARALEQETKRARKEEYGRNKFRGALWGSNNELKLRREERDQSRAHSMVLKEELVACSRSKRSLSQCLCETETNMLAIIAKYQEEL

SEQ ID NO: 197125 - protein, 153 aa, Glycine max
  Coding DNA Sequence Number=SeqID_80347
MNLIIVIKRKEHALLRPYQTLVRARVMGEVEEVQEKMKADTEALKEQMATMMEAMISIKEIMEVSAAAIAATSTIVEVDLTPSYVLNQINHPTSDMVGLEGKELGGTGGTHLVRKTSMPSHHMACLPTIHHRIWRTLLVRMSITSSPILIESR

SEQ ID NO: 197126 - protein, 266 aa, Glycine max
  Coding DNA Sequence Number=SeqID_80348
  Homolog annotation: Hit_ID=Q88BS0; Match level="QueryCoverage=32%, HitCoverage=43%, E-value=1e-12, Identity=44%"; Hit description=TraX protein
MAKRAGWIALNIFLPAWEVSSWSRHAGRNVSRLWQRLREVTAGRGAGDYRPASWAQAPLDLVGADVADRPAGGGLSADAHRRRQQHQRYRLAARGHRDVRAVTAGGHRLRAGARGELPAVAAHGKAGLGVRERQFSGVSAGDALAPPRVKRRSARGKIRCGKSGVSSSLSGCAPFLTTPCWASDAKPSCTWARHSLRVAGAGADALSPLDAAIAGLQSVCDEAMAQAMEAADGASVRAAACRRDRGAVRGGRANPYPLRHADFLTT

SEQ ID NO: 197127 - protein, 217 aa, Glycine max
  Coding DNA Sequence Number=SeqID_80349
MKRCQLLQRACEKTVYRRQIVAFHAADIRRQEDHLPRPQFQRAEAEPRRARKGLGHVRVMVNGHAAADGRGGVTGAVMREQLTRGLKGRMIRVLPAPARQGNPQIVRPQLPGQRAEPGGVTAEVPRVIRKSDDAGHQAPGQTSPSCVCPGARRHACHSRDQRGVFQKAAHISPQGSSTRTGPAPASSSEESAPASGAKVPLVVMKFSRRLLCAYAGA

SEQ ID NO: 197128 - protein, 210 aa, Glycine max
  Coding DNA Sequence Number=SeqID_80350
  Homolog annotation: Hit_ID=Q88BK9; Match level="QueryCoverage=88%, HitCoverage=46%, E-value=3e-53, Identity=56%"; Hit description=TrbA protein
MMPPDQWQPHERALLAIFGLQVFSGDRKAATTLLDDLNRSCVIRRPFRAPEFRTVPDWRVAEKHVARVLASPGVSEWLKTHRTVRSALAGLYGRDLRLPPARFRWLKGCDRTLWYGLHTADTAKVFVEGAGIVAQARAEQLAARLGLPCPPLMTGEAVDGLQLELESLGLVYPRDVRPKRAKPQREMPFPDALYLPGEGEDEFTDGAGAR

SEQ ID NO: 197129 - protein, 99 aa, Glycine max
  Coding DNA Sequence Number=SeqID_80351
MTKARQKGVRKECSTKFFISPPIYSKMGEMLATQLAQASKVTSSRSNRLLEESSGGPKWAWLLFAPPFLLNTPPAFFGGSFFVKLRKLTNFVTILVFFL

SEQ ID NO: 197130 - protein, 138 aa, Glycine max
  Coding DNA Sequence Number=SeqID_80352
  Subcellular localization annotation: CTP_CleavageSite=60; ConfidenceScore=5.49e-01
MDPALTASQPPLVLTPCVYKVLLRNYSSQSLSTRPHVMLFSVNCVEDKLSVRGNSTKLVEAAKLQPDIAQLIHYHASVFSIPEGLPPHRLQDHHIHLNLESQPYDEPVRVIGAVQNDEPAKERTKRMRKTPSWLKDYV

SEQ ID NO: 197131 - protein, 621 aa, Glycine max
  Coding DNA Sequence Number=SeqID_80353
  Gene Ontology: Mol. function=nucleoside-triphosphatase activity; Cellular component=integral to membrane; Biological process=transport
  Homolog annotation: Hit_ID=Q9SZR9; Match level="QueryCoverage=96%, HitCoverage=95%, E-value=0.0, Identity=54%"; Hit description =Probable white-brown complex homolog protein 9
  Pfam annotation: Domain name=ABC2_membrane; Domain location=353-559; Score=167.9; E_value=2.5e-47; Accession=PF01061.14; Description=ABC -2 type transporter
  Pfam annotation: Domain name=ABC_tran; Domain location=66-254; Score =148.9; E_value=1.3e-41; Accession=PF00005.17; Description=ABC transporter
  Pfam module annotation: Pfam domain module=ABC2_membrane::ABC_tran; Domain location=353-559::66-254
MESQTSYKATVQEEESDIFLTRNSPVTLKFHDVIYKIKTTKWGFLKNTKAEEKVILNGVTGMAQSGEILAMLGPSGSGKTTLLAALGGRLGGKLHGSITYNGKAFSNVMKRNTGFVTQDDILYPHLTVVETVVFTALLRLPKSFTTKEKIVHAKSVMAQLGLTKCKDSIIGGPLLRGISGGERKRVSIGQEMLINPSLLFLDEPTSGLDSTIAKRIVSTLWELANGGRTVVMTIHQPSSRMYCMFHKVLLLSEGNLLYFGKGSKAMEYFSSIGYAPMTMAMNPSDFLLDLSNGVYTDQSNEDHALNKRKLISAYRNYFDAKLQPVLHEITEYDKCKGRIEDNGFGEWPTSWPQQFLVLLKRDVKERKYASFSGMRICQVLMVALIAGLLWYKSDISHLQDQIGILFFISSFWSSMALFQAIFTFPQELTILKKERSSGMYRLSSYFMSRMVGDLPMELGLPTIFLAIVYWMAGLKPNVANFIYTMLSVFLNVLVSQGLGLAISAIVMEQKSASTLASVIMPTSILLGGYYNQHVPKFIAWLKYFSTHYYVYHLVIGSQYGTSDTYPCSNGQCLVAEHPVIKQVGLHLQGKITAALALFIMLIGFRLVAYLALMRIGVTKKA

SEQ ID NO: 197132 - protein, 185 aa, Glycine max
  Coding DNA Sequence Number=SeqID_80354
MTGRLLAGSLAFESRILHYLIVRILLPRSSNLAQVFEEDLIVMWAFHTGRQIDWALRLNAPLPYPHLVTLFLQHFNIPLDSEPYVPIKRSFLIGAAVIASFGYRKEHDGSWVKKGAQPIDEEGHLQGGEDSSILQKILERFDTLELQVDMRFEEMESRITKVEEDVSYIRTSFDLPPPPPPSSSS

SEQ ID NO: 197133 - protein, 133 aa, Glycine max
  Coding DNA Sequence Number=SeqID_80355
  Gene Ontology: Mol. function=transmembrane receptor activity; Cellular component=membrane
  Homolog annotation: Hit_ID=Q7XIJ6; Match level="QueryCoverage=72%, HitCoverage=51%, E-value=2e-20, Identity=47%"; Hit description=TIR/P- loop/LRR disease resistance protein-like protein
  Pfam annotation: Domain name=TIR; Domain location=3-83; Score=-33.9; E_value=0.097; Accession=PF01582.10; Description=TIR domain
MKPGDKLFDKINRAILECKIGLAVMSPRYCDSYFCLHELALLMECKKKVIPIFVDIKPSQLRVINNKKWTLEDQRRFKLAIEEAKYTVGLTFNSLQGNFSGIVTSASDIIIESLIEFEDEEAQMHQYSYLPIS

SEQ ID NO: 197134 - protein, 234 aa, Glycine max
  Coding DNA Sequence Number=SeqID_80356
  Gene Ontology: Mol. function=nucleic acid binding; Cellular component= beta-galactosidase complex; Biological process=DNA integration
MICTRLDIAYVVGVVSRFLSNPGKEHWNVVKWILRYLRETAKWCLCFVNGDSMLLGYADENMAGDVNSRKSTSGYLITFVGGAVSWQSKLQKYIALSIIEVEYITAAEAFKERLWMKKFLNDLGHDVDDYLVNCDNQSVIHLAKNPMFHSRFRHMYICKLKLKKIHTDFKLSDIMTKTIPTKRVKDHCQGAGFDDAKSIIKQDCFNKHSRLSKQRLHQRLIQGQANKIKKKIRP

SEQ ID NO: 197135 - protein, 70 aa, Glycine max
  Coding DNA Sequence Number=SeqID_80357
MDLFISKTFRPKLLQPLGVGGLSSMMQSYPPRALDRRLQEDWANDAREGPKVGCPRNIGFFSPCILGHRD

SEQ ID NO: 197136 - protein, 53 aa, Glycine max
  Coding DNA Sequence Number=SeqID_80358
MIKGSYETTRDVGARLKVLRMPKYYLKMVVIIKKGENVNEYHACFDDAKKVTR

SEQ ID NO: 197137 - protein, 274 aa, Glycine max
  Coding DNA Sequence Number=SeqID_80359
  Gene Ontology: Mol. function=DNA binding; Cellular component=beta -galactosidase complex; Biological process=DNA integration
  Subcellular localization annotation: CTP_CleavageSite=51; ConfidenceScore=5.12e-01
MVSRHVIFHGDCFPSASPRASQSFPTFLVHSYHTIYDHDISSNPSNSPVIVASRRFGKERTRPTKFQDFHTTFTLTITGESSGTHYPLASVLSYKNLSPAYHSFIMTASSKIEPKSFKEASQLDKLIKAMNVEIEALEANHTWILTDLPPNKSTIGCKWVYKVKHKADGLVERYKAKLVAKGYTQIEGQDYFDTFSLVAKISIVVLLLALAAVNNCHLKQLDVNNAFMHGDLDEEVYISLPPGMHSTKSNQVFRLQRSLYGLKQVSRKWYALIP

SEQ ID NO: 197138 - protein, 98 aa, Glycine max
  Coding DNA Sequence Number=SeqID_80360
MAQPPPRERTLREMVAPDFTYESLCIQYPDEDVSYVLKTGLIHLLPKFPGLAEGVAKDWLYYLAPRSITSWDDLKRVFLEKKFPCFHGHDHQKGYFRH

SEQ ID NO: 197139 - protein, 104 aa, Glycine max
  Coding DNA Sequence Number=SeqID_80361
  Subcellular localization annotation: CTP_CleavageSite=50; ConfidenceScore=5.41e-01
MPSPCVKTTPEPFILKVHRPTFGFLTFSSTKRWWQLRAFSFLGRCTREPRVALPSKGKLRQLATPLGTIRELGHSIIRNIFFYTHMAPTPRTHIEIFGPTPGSM

SEQ ID NO: 197140 - protein, 95 aa, Glycine max
  Coding DNA Sequence Number=SeqID_80362
MKLASTEAFNGPPPSREYICFLEKTLLRTREAFVEALHDTTHVERETKRWKVLRKFFFKMFVEAPMDSSSDHESVGEFFHKLGKEEEAVKQKEEN

SEQ ID NO: 197141 - protein, 294 aa, Glycine max
  Coding DNA Sequence Number=SeqID_80363
  Gene Ontology: Mol. function=metallopeptidase activity; Cellular component=extracellular region; Biological process=proteolysis
  Homolog annotation: Hit_ID=Q6D6B0; Match level="QueryCoverage=98%, HitCoverage=60%, E-value=7e-74, Identity=48%"; Hit description =Putative iron-regulated membrane protein
  Pfam annotation: Domain name=PepSY_TM; Domain location=119-145; Score= 18.2; E_value=0.03; Accession=PF03929.6; Description=PepSY-associated TM helix
  Pfam annotation: Domain name=PepSY_TM; Domain location=74-100; Score =19.5; E_value=0.012; Accession=PF03929.6; Description=PepSY -associated TM helix
  Pfam module annotation: Pfam domain module=PepSY_TM::PepSY_TM; Domain location=119-145::74-100
MGDEVRIYAVRPAPGAMDTTCVQFASADLGASESRALFVDPYTLAIKGDMTVYGTSGVLPLRTWLDKLHSSLLLGDLGRNYSELAASWLWVAALGGMALWLATRPKRKLKRSKGGFAASRHWHITLGVALLAGLLFFSATGLTWSQWAGGNIDALRANLGWLTPQVNTCLQADAPQTPADPHAEHRGMMPGMKMGPAAQSNALNGDWDRALHAARAAGIDAVKVELRQPKGEGKAWTVTEVDRSWPTQVDAVAIAPEIFAVVDQVRFDTFPLIAKLTRWGIDAHLGVLFGVPNQ

SEQ ID NO: 197142 - protein, 236 aa, Glycine max
  Coding DNA Sequence Number=SeqID_80364
  Gene Ontology: Cellular component=integral to membrane; Biological process=lipid transport
  Homolog annotation: Hit_ID=Q9F0Y5; Match level="QueryCoverage=53%, HitCoverage=34%, E-value=4e-49, Identity=80%"; Hit description=Outer membrane protein FadL
  Pfam annotation: Domain name=DUF406; Domain location=147-236; Score =184.5; E_value=2.5e-52; Accession=PF04175.3; Description=Protein of unknown function (DUF406)
FGFGVHRIEAQTEAEVLIQTICAAEVQVEGGQIGLAAVSAGGIAVVEFCRQTVVAGDRAAYGELIVNRVNIMQVRHPGGRRDVFRIQTGAGRGLTGNVNAAVSAMAPSPEYERPKPADENSFSWNPAADTFEEIIATAAARADLVNSAQETAACCCVDVGTVMDNTDCTASYSQVFSNQQDAEAMLAALSEKARAVESDPCDISSSIKPVDGGVQLEADFTFACQAETLIFQLGLR

SEQ ID NO: 197143 - protein, 722 aa, Glycine max
  Coding DNA Sequence Number=SeqID_80365
  Gene Ontology: Mol. function=3-hydroxyacyl-CoA dehydrogenase activity; Cellular component=fatty acid beta-oxidation multienzyme complex; Biological process=fatty acid metabolic process
  Homolog annotation: Hit_ID=UPI00005F8E65; Match level="QueryCoverage =97%, HitCoverage=94%, E-value=0.0, Identity=67%"; Hit description =COG1250: 3-hydroxyacyl-CoA dehydrogenase
  Pfam annotation: Domain name=3HCDH; Domain location=503-596; Score =136.7; E_value=6.5e-38; Accession=PF00725.12; Description=3 -hydroxyacyl-CoA dehydrogenase, C-terminal domain
  Pfam annotation: Domain name=3HCDH; Domain location=630-720; Score =17.2; E_value=2.3e-05; Accession=PF00725.12; Description=3 -hydroxyacyl-CoA dehydrogenase, C-terminal domain
  Pfam annotation: Domain name=3HCDH_N; Domain location=319-501; Score =276.9; E_value=3.8e-80; Accession=PF02737.8; Description=3 -hydroxyacyl-CoA dehydrogenase, NAD binding domain
  Pfam annotation: Domain name=ECH; Domain location=28-201; Score =214.6; E_value=2.3e-61; Accession=PF00378.10; Description=Enoyl-CoA hydrataseisomerase family
  Pfam module annotation: Pfam domain module=3HCDH::3HCDH::3HCDH _N::ECH; Domain location=503-596::630-720::319-501::28-201
MMSFENALHEQRAKPSAFQLTIRPDNIGVITIDVPGDKVNTLKAEFVEQVNDVLIRAQQHSALEGLVIVSGKPDSFIAGADITMIAACTSAKEAETLARKGQSTLAQIAAFPVPVVAAIHGACLGGGLELALACHGRVCSLDDKTALGLPEVQLGLLPGSGGTQRLPRLVGAAKALDMILTGKHIRARQALRMGLVDDAVPQSILLQTAIERVKQGWKHQRELPWQDRLLNGPLGRSLLFSIVRKKTLAKTHGNYPAAERIIQVVRTGLDHGSASGYEAEARAFGELAMTPQSAALRSLFFASTALKKERGGNAQPHALHRVGILGGGLMGGGIACVTATRGGLPVRIKDINETGINHALKYSWDVLGKRVRRRRMRPAERQKQMMLISGSTDYTGFEQVDIVVEAVFEDLALKQQMVAEVEANCAPHTVFASNTSSLPIGRIAEKAQRPQQVIGLHYFSPVDKMPLVEVIPHAGTSEETIATTVALAHKQGKTAIVVGDSAGFYVNRILAPYINEAARCLLEGEPIESLDKALVDFGFPVGPITLLDEVGIDVGTKIIPVLVEALGPRFAAPAAFDAVLKDGRKGRKNGRGFYLYPSEGQQRQRRKRADTSLYTLLGVTPKAHMLPASVAQRCVMMMLNEAARCLDEGVIRSARDGDIGAVFGIGFPPFLGGPFRYMDELGAEKVVKTLDYLRQQHGEHFAPCERLQRMAQQGERFYPLGS

SEQ ID NO: 197144 - protein, 68 aa, Glycine max
  Coding DNA Sequence Number=SeqID_80366
MSLSGSVFYKGQLSGPYLAKRLSQPTLRREGDAGLMGASSKKGKCTELPPTFIRGKCPKNRKGVVYEL

SEQ ID NO: 197145 - protein, 170 aa, Glycine max
  Coding DNA Sequence Number=SeqID_80367
MASKIQILPVVGVVAMYIMNSIITFLYFNGRVYEDNDGVIFEGRKYVALQICDDEDVETMIESFQQQQQMSILELYVEKDVAGGSMFHAANSVTSCGRNVSHHESELPRNISNLHVDEDDDDDDDDDDYLASNSYVEESFDEDDSDDGISDTDDEVTDIVEPVSIVHPTE

SEQ ID NO: 197146 - protein, 57 aa, Glycine max
  Coding DNA Sequence Number=SeqID_80368
MRGYFMVPRTFRQPGANEPVDARRLTSSSAPFVVVTMKSGLPYGYPHLSSTGGKRAR

SEQ ID NO: 197147 - protein, 571 aa, Glycine max
  Coding DNA Sequence Number=SeqID_80369
  Homolog annotation: Hit_ID=O22943; Match level="QueryCoverage=94%, HitCoverage=70%, E-value=0.0, Identity=71%"; Hit description =Expressed protein
  Subcellular localization annotation: CTP_CleavageSite=47; ConfidenceScore=5.31e-01
MVQERSLPKSVNSKPHARTAALASTKSLDFSAWVSDNLVRIVAVVLLVATVAAVFFLRNAGDTAALLCFENQARELERIAYPRVDWSAIAPIADRTSKFSSFRSEKWIVVSVSGYPSDALRRLVKMKGWQVVAVGGSNTPSDWTLKGAIFLSLEEQVNLGFRVVDYLPYDSFVRKSVGYLFAIQHGAKKIFDADDRGEVIDGDLGKHFDVELVGEAARQEVLLQYSHDNPNRTVVNPYVHFGQRSVWPRGLPLENVGEIGHEEFYTQVFGGKQFIQQGISNGLPDVDSVFYFTRKSGLEAFDIQFDEHAPKVALPQGMMVPVNSFNTMYHSPAFWALMLPVSVSTMASDVLRGYWGQRLLWEVGGYVVVYPPTVHRYDRIEAYPFSEEKDLHVNVGRLINYLISWRSDKHRLFEKILDLSFAMAEEGFWTEKDVKLTAAWLQDLLAVGYQQPRLMSLELGRPRANIGHGDQKEFVPQKLPSVHLGVEETGTVNYEIANLIWWRKTFGNVVLIMYCNGPVERTALEWRLLYGRIFRSVVILSEKKDVDLVVEEGHLDYAYRQVCKSMDIEKH

SEQ ID NO: 197148 - protein, 47 aa, Glycine max
  Coding DNA Sequence Number=SeqID_80370
MQVYPLESPQQLISEPMVQVGDRLRRVCKYRSWPEWLATLRAPSSTI

SEQ ID NO: 197149 - protein, 182 aa, Glycine max
  Coding DNA Sequence Number=SeqID_80371
MGWEIGFFIIGVGRRGNKGWNFKGMEMNVGNGLLVSKFWRMRDFSTRRHWERWLLEAIIQLLAADLAINALGWMLLRKPYHGSWRGGIKNHSVLVISLSSLSSEATKEVDKRGVESEATMKDKLKMKDPKMGVESKLEGDNKGIEDEEIEFMEDLLAMVLLYGGGGLAIGGYGAIEAKRLFG

SEQ ID NO: 197150 - protein, 200 aa, Glycine max
  Coding DNA Sequence Number=SeqID_80372
MIEHMEERLRAIEGGGNYAFADMAELCLVLNVVIPPKFKVPNFDKYKGTTCPKNHLKIEEHHHRFKVIKDWFFLKGRRVKLAEGFDGETIGQLLCSPRHDFAPPRHPVDPEKSNRALRFPALITGTVARARLAAPAGGRRTTAASTSIVILGVHLSPHAEDGAPNAQGLADAQGAAQGDESEAEDDGDMEDLLGYFIGGG

SEQ ID NO: 197151 - protein, 67 aa, Glycine max
  Coding DNA Sequence Number=SeqID_80373
MTVAEYAARFENLVRIFNEDLWEKVAFCESNDFQDYFDDAKESRAKQIRKIQESSFKNQDSRFKNQV

SEQ ID NO: 197152 - protein, 86 aa, Glycine max
  Coding DNA Sequence Number=SeqID_80374
  Subcellular localization annotation: CTP_CleavageSite=51; ConfidenceScore=5.33e-01
MASLSNNSLMELSFVATYLTTGQQKKVMAFSSPMKNTCGSRHQRLFKENVRKTKERYQLVQASRLLKDKGIPWPKRAKCWPGQAQA

SEQ ID NO: 197153 - protein, 56 aa, Glycine max
  Coding DNA Sequence Number=SeqID_80375
MKKAVRISVIDYTIPVIDYAIDYNIPVINYRASVSINSKFQKLRERDFCRNSNPNP

SEQ ID NO: 197154 - protein, 100 aa, Glycine max
  Coding DNA Sequence Number=SeqID_80376
MFRWFEDPFAAQDQNQRVVISWESSTIRFSYQCNDDLYSVVSKREIKTSTSSIDIVQTDVTKSSTTKLPRSILLLHKQDERRVQALTRPYEVATKHVLDL

SEQ ID NO: 197155 - protein, 138 aa, Glycine max
  Coding DNA Sequence Number=SeqID_80377
  Gene Ontology: Mol. function=magnesium chelatase activity; Biological process=biosynthetic process
  Homolog annotation: Hit_ID=O65808; Match level="QueryCoverage=90%, HitCoverage=9%, E-value=8e-66, Identity=96%"; Hit description =Magnesium chelatase subunit
MTSIGPSGDDPFQVRTLAETVRLDARTKLLNPKWYEGMLSTGYEGVREIEKRLTNTVGWSATSGQVDNWVYEEANTTFIQDEEMLKKLMNTNPNSFRKLVQTFLEANGRGYWETSEDNIDKLRQLYSEVEDKIEGIDR

SEQ ID NO: 197156 - protein, 100 aa, Glycine max
  Coding DNA Sequence Number=SeqID_80378
  Subcellular localization annotation: CTP_CleavageSite=66; ConfidenceScore=5.37e-01
MRCYLMVTRTFGQLVAKKPVDAQRLASSAAPFVVLTREVSRTFRQPGGNEPVDARRLTSSSTPFVVLTREVSTFHQPGANEPVDARRLTSSSAPFCRPDP

SEQ ID NO: 197157 - protein, 131 aa, Glycine max
  Coding DNA Sequence Number=SeqID_80379
MTLSGQNSKTSTSLPLGTLERWQRHSKRHDFGYVAVVGAAGPLRLQVLHGGKQNVRMITGRSSRRDEVVQAIAGALGFWSVQERVFTARLYKLQNLRRCLMTPTLYVTISRTVYLQAPSLMTSIKTTTTGL

SEQ ID NO: 197158 - protein, 99 aa, Glycine max
  Coding DNA Sequence Number=SeqID_80380
MVQKGKRRVVVTQEAATTPEKSPEATPELPAPIADTTSPQQATDPSTLEDQTTPVQSPNASLVSTPVLHLADEEEVQTQDTQETNHRTFKFMLIIFCAF

SEQ ID NO: 197159 - protein, 67 aa, Glycine max
  Coding DNA Sequence Number=SeqID_80381
MEHKAYWDLKFLNFDESLSREKRKLQLQELEENEAEHVKPYGAIELVDPSSNEPEQSWIVNGQRLKA

SEQ ID NO: 197160 - protein, 133 aa, Glycine max
  Coding DNA Sequence Number=SeqID_80382
MWAKCSLRTKPKCPILKFYVLHWARASYVENIILRNIFPERNVELGTGENDEVWEELKRRNWVKRLTNLPDNNINVALVKEFYANIYYPEDSFPKHCKPLRALVRKLQEDWARDAGEGPRVLMSLRELMKHWA

SEQ ID NO: 197161 - protein, 147 aa, Glycine max
  Coding DNA Sequence Number=SeqID_80383
MVILLPLSFGDTKSRGGRRQIMVIPYTFLPSGGDHVRWDAETNYGHSAPCRPGSFTSKDTQTQIMVPLTGRFTGGAYSNQAHLGLPGSSPEGGAFRRKQPSSPGQAGKSKPRRFRNASVTFPWVISRRFSTVLCHSSFVLQCSSVFN

SEQ ID NO: 197162 - protein, 48 aa, Glycine max
  Coding DNA Sequence Number=SeqID_80384
MDSLFPSSQVKLPHLISVKLDDKNFKQWKQQIDGVIRGHRLQRFVTVP

SEQ ID NO: 197163 - protein, 94 aa, Glycine max
  Coding DNA Sequence Number=SeqID_80385
  Homolog annotation: Hit_ID=Q3K6C5; Match level="QueryCoverage=44%, HitCoverage=8%, E-value=3e-12, Identity=78%"; Hit description=AMP nucleosidase
MKHFTDTLISANIGTKAGTGPPLEVDGIDKLDTYECHGEVPASTRAYAKVQAPGVYSVTVTHPAAFRAYLLDQLKRGSTSSRAAATAVELQFAL

SEQ ID NO: 197164 - protein, 237 aa, Glycine max
  Coding DNA Sequence Number=SeqID_80386
MKPIKSTSSVHYGMQMNLIFKHFGVSNNGEPKDDEILSWVAKKVVALRLNPQPRMETACTCFDEESAQNKEKKKKKKNKEKKRRRIDPHPLLTKLIRSVKRLESRVCRSPLSKLDKVKETLEEALDKKIVSSPTVEASSLEKSPEKTRNLEKHTEDDFEDVQNEVEKEESPLHKKDVSKEDPLEEPLNYGSYHVDSKHHYKEEQKDEEDHYEPQKKEERAQKEERPWYIDHGRGQFQ

SEQ ID NO: 197165 - protein, 52 aa, Glycine max
  Coding DNA Sequence Number=SeqID_80387
RRNGDGGERRSRREGDARGTLHQNHLIQILLQTLIPMIKAAGERRGIIEDVE

SEQ ID NO: 197166 - protein, 120 aa, Glycine max
  Coding DNA Sequence Number=SeqID_80388
  Subcellular localization annotation: CTP_CleavageSite=68; ConfidenceScore=5.05e-01
MEAIKEQMATMMKAMMSMKKIMEANVVIVAATSAVAKVNPMLPSGLKQMNHPTSNMPTSSLGLGYTTEGQAVGGIPLQNPLEGPQYHPQLHLLHSTAVKNPHDYGRNGKVGSSRGKAQGH

SEQ ID NO: 197167 - protein, 41 aa, Glycine max
  Coding DNA Sequence Number=SeqID_80389
MAPKTCSLPASAPDHTSSIKWCVNYLCKKENHAREMMCKNK

SEQ ID NO: 197168 - protein, 87 aa, Glycine max
  Coding DNA Sequence Number=SeqID_80390
  Gene Ontology: Mol. function=pectate lyase activity; Cellular component=anchored to membrane
  Homolog annotation: Hit_ID=Q1T4K8; Match level="QueryCoverage=90%, HitCoverage=18%, E-value=2e-32, Identity=77%"; Hit description =Pectate lyase, N-terminal; Pectolytic enzyme, Pectin lyase fold
  Pfam annotation: Domain name=Pec_lyase_C; Domain location=1-70; Score= -51.1; E_value=0.00052; Accession=PF00544.9; Description=Pectate lyase
MLFGASDSYDGDTIMQITLAFNHFGKRLVQRMPRCRYGFVHVVNNDYTHWEMYAIGGSKHPTIISEGNRFIAPDNINAKEYLTMIPS

SEQ ID NO: 197169 - protein, 118 aa, Glycine max
  Coding DNA Sequence Number=SeqID_80391
MTKLGLCVPSDTTVSEWQRGADNRKVSPRIIMTKLGLCVPSDTTVSEWQRGADNRKVSPRIIMTKLGLCVPSDTTVSEWQRGADNRKLSPRIIMTKLGLCVPTDTTVSEWQRGADNRK

SEQ ID NO: 197170 - protein, 140 aa, Glycine max
  Coding DNA Sequence Number=SeqID_80392
  Subcellular localization annotation: CTP_CleavageSite=37; ConfidenceScore=5.38e-01
ARKTKLRAADVPSFFATITGIPASSTSSPLPALADLSAQSFETSDAKFQSLPIMSVEQFIEKVAWPGARPSFVGHNESFTAQAPQKHEPEPENDHSSEATIPGAVDFAKRRLETRSNEAAHPGLVPASADAPFYLFVKNG

SEQ ID NO: 197171 - protein, 110 aa, Glycine max
  Coding DNA Sequence Number=SeqID_80393
MKNIILEVYTKLASYKFMYLEWGCTLHLFVGFRFHFHFVPFTKIINGGVGWCCLRAGGWVEVGLRWWWWWCLRGSFACLDFCEVQEKKWNVGSNSLDHLTNKKPKAQRDT

SEQ ID NO: 197172 - protein, 75 aa, Glycine max
  Coding DNA Sequence Number=SeqID_80394
MENLTPHSHMPYFIPSFLTTNSTDTFFSFSSFLIHLCIEIQDIDQGALPATNPMRAQWCSECDCVEAQWLWRLHG

SEQ ID NO: 197173 - protein, 134 aa, Glycine max
  Coding DNA Sequence Number=SeqID_80395
MHVARLCIPYKGFVLNAEGQPWKLLRKDLTTLAQTWSVFSYSNLAPTSHTSDLNMDRARLVYGLATNMDMNIRAFISVQISSIAQSNSSRLRFPALITALCRARGVTSNSLTYESLSPTINLAHIKKIVGMSMI

SEQ ID NO: 197174 - protein, 141 aa, Glycine max
  Coding DNA Sequence Number=SeqID_80396
  Subcellular localization annotation: CTP_CleavageSite=64; ConfidenceScore=5.25e-01
MICVFVQTHRGPGGPGEVQQGPGVSSSGYGPLSVLSGARPPSKVTPSLLRDRSHKTPSGPGEVQQGLGVSNSGCGPLIAPARHPVDPKKSNRVLGFPALSVGLCQFYGEPVAPNKVIGPPINQAFIKKYCAPRQAQGEASQ

SEQ ID NO: 197175 - protein, 102 aa, Glycine max
  Coding DNA Sequence Number=SeqID_80397
  Gene Ontology: Mol. function=metal ion binding; Biological process =cobalamin biosynthetic process
  Homolog annotation: Hit_ID=Q1SC37; Match level="QueryCoverage=56%, HitCoverage=36%, E-value=8e-11, Identity=76%"; Hit description =Cobalamin (Vitamin B12) biosynthesis CbiX protein
  Subcellular localization annotation: CTP_CleavageSite=36; ConfidenceScore=5.78e-01
MLVKSLSPYSHAFSSFSASFGTNPSWVPLKSSNSLCCSSKPRNLSRFLCLSTQNGGGFRENSGEVGRGDAVIIVDHGSRRKESNLMLRISRTINKRCFSILR

SEQ ID NO: 197176 - protein, 666 aa, Glycine max
  Coding DNA Sequence Number=SeqID_80398
  Gene Ontology: Mol. function=protein serine/threonine kinase activity; Cellular component=mitochondrion; Biological process =protein amino acid phosphorylation
  Homolog annotation: Hit_ID=Q9FNE1; Match level="QueryCoverage=95%, HitCoverage=97%, E-value=1e-167, Identity=49%"; Hit description =Receptor-like serine/threonine kinase
  Pfam annotation: Domain name=DUF26; Domain location=200-253; Score =59.5; E_value=1.1e-14; Accession=PF01657.8; Description=Domain of unknown function DUF26
  Pfam annotation: Domain name=DUF26; Domain location=89-142; Score =63.5; E_value=7e-16; Accession=PF01657.8; Description=Domain of unknown function DUF26
  Pfam annotation: Domain name=Pkinase; Domain location=328-572; Score =142.1; E_value=1.6e-39; Accession=PF00069.15; Description=Protein kinase domain
  Pfam annotation: Domain name=Pkinase_Tyr; Domain location=328-596; Score=111.9; E_value=1.9e-30; Accession=PF07714.7; Description =Protein tyrosine kinase
  Pfam module annotation: Pfam domain module=DUF26::DUF26::Pkinase::Pkin ase_Tyr; Domain location=200-253::89-142::328-572::328-596
MASKYHYNKYNNPSYVVVIFIVLCFFSQSALSDPRISEVGHYCSTQKSQTSGDYLPIFTKEMEKLLELVTKQNWGTHSEGMSSTTTTPIYGLAQCFQDLSSIDCLQCFAASRTKLPRCLPSVSARIYLDGCFLRYDNYSFYTENYDPLRDTVNCTSEYGSEGERLVFAESVGKVVESVVRVAVNNNEGRGFFAVGEGGGVYALAQCWKTVGVKGCSDCLRKAENEVKGCLPKREGRALNTGCYLRYSTVKFYNQGGQDGQGDDSSRKRVIIAAGSVLAAAVVVLTLAVSYVAFTKKRRKNNFIEVPPSLKNSSLNYKYETLEKATDYFSSSRKIGQGGSGSVYKGTLPNGNDVAVKRLVFNNRQWVDDFFNEVNLISGMQHKNLVKLLGCSIEGPESLIVYEYLPNKSLDQFIFEKDITRILKWKQRFEIILGTAEGLAYLHGGSEIRIIHRDIKSSNVLLDENLSPKIADFGLARCFGTDKTHLSTGIAGTLGYMAPEYLIQGQLTDKADVYSFGVLVLEIASGRKNNVFREDSGSLLQTVWKLYQSNRLGEAVDPGLGEDFPAREASRVFQIGLLCTQASASLRPFMVQVASMLSNSNLDVPIPKQPPFLNSRFLDQTSPLGFSIDSSSSNTFKKIGVSYSPSEFSSTCSLIRPSRSEETIMEA

SEQ ID NO: 197177 - protein, 67 aa, Glycine max
  Coding DNA Sequence Number=SeqID_80399
MSTSSGRDCEKVSFAILQTQGSDSMRRYPAVIRTHVVLLPRPMRSQVACGDTQGLSACTHKSVTPTC

SEQ ID NO: 197178 - protein, 68 aa, Glycine max
  Coding DNA Sequence Number=SeqID_80400
  Subcellular localization annotation: CTP_CleavageSite=27; ConfidenceScore=5.04e-01
MASLLCNAHVAWKPPPRVASCVQVETASMTGASGPGFGNRQSNWRVGLLDSLYLNQIFPHKVMEFGQI

SEQ ID NO: 197179 - protein, 71 aa, Glycine max
  Coding DNA Sequence Number=SeqID_80401
MLNPTQFQAKEEKVKVVDASLNEPDPLSEMHLLSEASSSLSRWETLEEEVRDLHAQHAIGPLNEDIVSSRT

SEQ ID NO: 197180 - protein, 111 aa, Glycine max
  Coding DNA Sequence Number=SeqID_80402
  Gene Ontology: Mol. function=protein serine/threonine kinase activity; Biological process=protein amino acid phosphorylation
  Homolog annotation: Hit_ID=Q5NDD1; Match level="QueryCoverage=52%, HitCoverage=18%, E-value=2e-15, Identity=67%"; Hit description =Putative serine-threonine protein kinase
MTGEMRGAFELLGEAGSGRVVGSLLDEVDVGEATFPELAHDAKAVLVDPNITSAIRSRKEWSILEARLRHRVRVMELQGPRCGAVGGGVDVVLVGADDFSDCWYRSEKKAA

SEQ ID NO: 197181 - protein, 93 aa, Glycine max
  Coding DNA Sequence Number=SeqID_80403
MGTVFSYLPISMATEPAADDSILSLLRVFWPILEKFFGSEHMENGNLSVAACRALSLAVRSSASIVIEEFGHLEEYIPLFVTSDDIPDIDKKK

SEQ ID NO: 197182 - protein, 108 aa, Glycine max
  Coding DNA Sequence Number=SeqID_80404
  Subcellular localization annotation: CTP_CleavageSite=20; ConfidenceScore=5.03e-01
MPFSVFGKLLSLTLAEEIFRATPRKKNCGRTFFRGITRKNFFCESQRKKVLPWNSTEEEMTNKAKGKGKEVAEKGSAGKRKGAFDDDKTGGDRKRNKRGVLQFFLTMN

SEQ ID NO: 197183 - protein, 93 aa, Glycine max
  Coding DNA Sequence Number=SeqID_80405
  Gene Ontology: Mol. function=drug transporter activity; Cellular component=membrane; Biological process=multidrug transport
  Homolog annotation: Hit_ID=Q1SD89; Match level="QueryCoverage=89%, HitCoverage=24%, E-value=2e-23, Identity=67%"; Hit description=Multi antimicrobial extrusion protein MatE
MHMNIEILYDFNRSCYWSRVAKHCSIRVVLGNVLHLQVKGIWFGMLFGTFIQTIVLIIITYKTNWDEQVIIARNHINKWSKVDSHHKIIPSEN

SEQ ID NO: 197184 - protein, 147 aa, Glycine max
  Coding DNA Sequence Number=SeqID_80406
  Gene Ontology: Cellular component=nucleus
  Homolog annotation: Hit_ID=Q05A31; Match level="QueryCoverage=80%, HitCoverage=18%, E-value=8e-13, Identity=36%"; Hit description =Nucleolar protein 9
  Pfam annotation: Domain name=NUC156; Domain location=9-137; Score =182.3; E_value=1.2e-51; Accession=PF08160.2; Description=NUC156 domain
MGVLVQKDARLLRDLRIMAYFKQCFSSDSNISTIKELAHALASHCPYEVPIASIKIRHLHCEVPSSEIFFSLNATIVGLAVDSEGPENLPSCLGLGIVRGIDIVKAMLYVITPVPHNSLEKVNVLLQGFARVVPGFLWSLPAKKGIL

SEQ ID NO: 197185 - protein, 141 aa, Glycine max
  Coding DNA Sequence Number=SeqID_80407
  Gene Ontology: Mol. function=oxidoreductase activity, acting on the CH-OH group of donors, NAD or NADP as acceptor; Cellular component =mitochondrion; Biological process=isocitrate metabolic process
  Homolog annotation: Hit_ID=Q7Y0W7; Match level="QueryCoverage=56%, HitCoverage=13%, E-value=4e-19, Identity=63%"; Hit description=NADP -specific isocitrate dehydrogenase
MAGQLVISVPSSGKKRCYDRVRSLKREVQREIRQVYEVSEHSEDLKSTNGTVFREPIICHNIQRIVSGEEVPFRTYSLVTGWKKPICIGRHAFGDQYRATDAIITGSGKLKLVFGMLISKALLSMDFYRQGPLGVLITDIC

SEQ ID NO: 197186 - protein, 530 aa, Glycine max
  Coding DNA Sequence Number=SeqID_80408
  Gene Ontology: Mol. function=protein binding, bridging; Cellular component=nucleus; Biological process=cell division
  Homolog annotation: Hit_ID=Q1SC21; Match level="QueryCoverage=98%, HitCoverage=99%, E-value=1e-160, Identity=58%"; Hit description=WD40- like
  Pfam annotation: Domain name=WD40; Domain location=138-177; Score =46.8; E_value=7.5e-11; Accession=PF00400.22; Description=WD domain, G-beta repeat
  Pfam annotation: Domain name=WD40; Domain location=232-271; Score =0.9; E_value=29; Accession=PF00400.22; Description=WD domain, G-beta repeat
  Pfam annotation: Domain name=WD40; Domain location=284-322; Score =8.1; E_value=4.1; Accession=PF00400.22; Description=WD domain, G -beta repeat
  Pfam annotation: Domain name=WD40; Domain location=330-368; Score =8.9; E_value=3.3; Accession=PF00400.22; Description=WD domain, G -beta repeat
  Pfam annotation: Domain name=WD40; Domain location=373-412; Score =32.1; E_value=1.9e-06; Accession=PF00400.22; Description=WD domain, G-beta repeat
  Pfam annotation: Domain name=WD40; Domain location=96-134; Score =27.5; E_value=4.6e-05; Accession=PF00400.22; Description=WD domain, G-beta repeat
  Pfam module annotation: Pfam domain module=WD40::WD40::WD40::WD40::WD4 0::WD40; Domain location=138-177::232-271::284-322::330-368::373 -412::96-134
MDTPSSHSLFTHIASRELFRVPKRPRMDGFVSGFNETGLLAVQHNAQHTIPLSLSFCKTSKFGHILAVSDEEGYVTLFDTRRKFPVTSNFEENSEKVKICDWVSHHNAVFDTCWNKEDTQILTASGDQTIKVWDVQEQKCLGLLTGHTGSVKSMCSHPTNSDIIVSGSRDGSFRIWDLRCKSTAKSRCGEVSICSMGGVKGAHISSQARRTRRGRVSLCWIKVPSYFEKPNFLTISICQAASMSITSVLCLKDQVSIATAGAVDSVLKFWDTRNLKSTVTQTSPSPQSTEKQTLHGISSLSQDESGLFLSASCMDNRIYLYNTLQLEKGPLKSFSGCRIESFFVKSAISPDASNIVSGSSDGNAYVWKVDKPLEDPTILKSHDGEVTAVDWCSSEIGKLATCSDDFTVRTWNKNSYVSSTQCASAIRRRVMAIPSIECKMLLNNGKRYSKTNEDAFLPYDALHPITSPTPITPPKMNISEGNQLSSGLDLNASSEKTPESALKSPSSVLNPPSSLKRTIRDYFLASSRTL

SEQ ID NO: 197187 - protein, 164 aa, Glycine max
  Coding DNA Sequence Number=SeqID_80409
MASRKKARAEDIPSSSNPPPPTATMEPDGLQAQPIVPMLQSLFRGQLIIVYNQQQLAHNKPIVSMEQFLDKVVWPEAQLSLGRSPEVVPPSPIPTRTEPAPAESQPPVVDPPASPEIEILPPPLAPPAPPLILIPDDSNNEVAAPPDSPAYYLEDGSDFSDWMD

SEQ ID NO: 197188 - protein, 96 aa, Glycine max
  Coding DNA Sequence Number=SeqID_80410
MSRNFTNCLMMGAKHLTRTKQKSHVINQRSPDEIRKTPTYGFTKPIQLNIFIDDLRPQSKQSLDTSARGKIKLKTPEEAMELIENMAASDHAIVSR

SEQ ID NO: 197189 - protein, 39 aa, Glycine max
  Coding DNA Sequence Number=SeqID_80411
MALGVRLLESTQAAFSTGPELGRDDDLSVVTLASICVRS

SEQ ID NO: 197190 - protein, 428 aa, Glycine max
  Coding DNA Sequence Number=SeqID_80412
  Gene Ontology: Mol. function=protein binding; Cellular component =actin cytoskeleton; Biological process=red or far red light signaling pathway
  Homolog annotation: Hit_ID=Q1RT71; Match level="QueryCoverage=97%, HitCoverage=97%, E-value=0.0, Identity=93%"; Hit description=Cyclin -like F-box
  Pfam annotation: Domain name=F-box; Domain location=66-113; Score =33.5; E_value=7.3e-07; Accession=PF00646.23; Description=F-box domain
  Pfam annotation: Domain name=Kelch_1; Domain location=157-203; Score =30.5; E_value=5.9e-06; Accession=PF01344.15; Description=Kelch motif
  Pfam annotation: Domain name=Kelch_1; Domain location=205-252; Score =62.0; E_value=1.9e-15; Accession=PF01344.15; Description=Kelch motif
  Pfam annotation: Domain name=Kelch_2; Domain location=157-203; Score =1.6; E_value=23; Accession=PF07646.5; Description=Kelch motif
  Pfam annotation: Domain name=Kelch_2; Domain location=205-252; Score =26.1; E_value=0.00012; Accession=PF07646.5; Description=Kelch motif
  Pfam module annotation: Pfam domain module=F-box::Kelch_1::Kelch _1::Kelch_2::Kelch_2; Domain location=66-113::157-203::205-252::157 -203::205-252
MDQSVLRFEVDTTACLCRVDTGLKTVAGAKKYVPGTKLCLRPDIKPSIHPTRNKPARGDRSRSQSPLLPGLPDDLAIACLIRVPRVEHRKLRLVCKRWYRLLVGNFFYFLRKSLGIAEEWIYVIKRDRDGKISWHAFDPVYQLWQPLPPVPKEYSGALGFGCAVLNGCHLYLFGGKDPLKGSMRRVIFYSARTNKWHRAPDMLRRRHFFGSCVINNCLYVAGGENEGVHRSLRSAEVYDPNKNRWSFISDMSTAMVPFIGVVYDGKWFMKGLGSHRQVLSEVYQPENDSWYTIYDGMVSGWRNPSCTLNEKLYALDCKDGCKIRVYDEVADSWSKHIDSKMHLGSSRALEAAALVPLNGKLCIIRNNMSISLVDVSKLEDLKGSSAEQLWETIAGKGQFKTLVTNLWSSLAGRNRLKSHIVHCQVLQA

SEQ ID NO: 197191 - protein, 43 aa, Glycine max
  Coding DNA Sequence Number=SeqID_80413
  Homolog annotation: Hit_ID=Q7Y0W7; Match level="QueryCoverage=97%, HitCoverage=9%, E-value=4e-12, Identity=79%"; Hit description=NADP -specific isocitrate dehydrogenase
MTKDLAILIHGPKVSREFYLNAEEFIDAVAHTIERKLREPAVV

SEQ ID NO: 197192 - protein, 71 aa, Glycine max
  Coding DNA Sequence Number=SeqID_80414
  Subcellular localization annotation: CTP_CleavageSite=39; ConfidenceScore=5.11e-01
MESSITLETMKYAKNLRKCLLIFSHGGQVTSVEFSSVCSASIKMTLAPPQPFVTSSLLRRPRVTEVSMPQE

SEQ ID NO: 197193 - protein, 100 aa, Glycine max
  Coding DNA Sequence Number=SeqID_80415
MATARCTQQNCWCTQQLHEVTKMPLNKNYKKEKFEWYSAFVPFLLHACADSFLPPTSSFVFFFLPEDLRVDDVNLSRSGSLDTGYRVWMTPLPVKEDKSR

SEQ ID NO: 197194 - protein, 77 aa, Glycine max
  Coding DNA Sequence Number=SeqID_80416
MGCYKGGYISCGSLLVKDFTRLKRNLKNRKSLGDCMLCLNKHPKVEIWWHSLNAHITQSAAVAPVRTLMTCVPALPQ

SEQ ID NO: 197195 - protein, 79 aa, Glycine max
  Coding DNA Sequence Number=SeqID_80417
YTMNSVITVLYFNGRIYEDNDDVIFEGSKKAIQIKRGISFNALKKKIGDKENILLCKFAMTKTLKRCWKVLNNNKKCQF

SEQ ID NO: 197196 - protein, 128 aa, Glycine max
  Coding DNA Sequence Number=SeqID_80418
MVWCMDSLSLSPYTIQKIDVLNVNITSKHGLRNPKESAMMTLKTTLDGQSIQVEPQWIKVKSHVLSGGYECGYYVMHWMWNIVSGELKNDWTMWFDDGTPLNIETMTTIRKKLAAYFLKVKNICSRKL

SEQ ID NO: 197197 - protein, 157 aa, Glycine max
  Coding DNA Sequence Number=SeqID_80419
MELMTTFSQGKFSRSFTISHSLDTTPQNEVPYLDRRNCHYQGRPETSSTMLCPKFEGGPLSSYQRARKTLSSLWGSNSQVMSIVEEFQVRTLSVYETTMGNLSDTFNVDPRDDTIEKGPRPIEELSKLQVGPKPGKCTQLRKDLTIHEHRYHGIRTI

SEQ ID NO: 197198 - protein, 483 aa, Glycine max
  Coding DNA Sequence Number=SeqID_80420
  Gene Ontology: Mol. function=transferase activity, transferring glycosyl groups; Cellular component=integral to membrane; Biological process=metabolic process
  Homolog annotation: Hit_ID=Q9LK73; Match level="QueryCoverage=98%, HitCoverage=98%, E-value=1e-125, Identity=50%"; Hit description =Flavonol 3-O-glucosyltransferase-like protein
  Pfam annotation: Domain name=UDPGT; Domain location=4-480; Score= -76.6; E_value=9.1e-07; Accession=PF00201.9; Description=UDP -glucoronosyl and UDP-glucosyl transferase
MKEAVVFYPAPLIGHLVSTIELCKFILTHQPSLSIHILITIAPYDTSSTSNYISTVSTTLPSITFHTLPTFNPPKTLLSSSLNHETLLFHVLHHNNPHIHQTLISLSKTHTLHALIVDILCSQSIFLASQLNLPAYLFATTSASLLGAFLYHSTLHETYHKSFKDLNNTFLDIPGVPPMPARDMPKPLLERNDEAYKNFLNCSLAAPKAAGFIVNTFEALEPSSTKAICDGLCIPNSPTSPLYSFGPLVTTTDQNQNKNTSDHECLRWLDLQPRKSVVFLCFGSLGVFSREQLSEIAIGLEKSEQRFLWVVRNPVSDQKHNLALGTQEDPDLESLLPKGFLDRTKGKGLVVKNWVPQAAVLNHDSVGGFVSHCGWNSVLEAVCAGVPLIAWPLYAEQRFNRVVLVEEMKVALWMRESAVSGFVAASEVEERVRELMESERGKRVRDRVMVFKDEAKAATREGGSSRVALEKLLKSWKVGQLSE

SEQ ID NO: 197199 - protein, 196 aa, Glycine max
  Coding DNA Sequence Number=SeqID_80421
  Gene Ontology: Mol. function=RNA-directed DNA polymerase activity; Biological process=RNA-dependent DNA replication
MWFDHKACRNLVKNIWSKQVVGCPMFVLKQKLNNLKISLKTWNSEVFGNVHLKVSLVVDNLSSIQHRIQEDNLNDELYKLEASTQVNHQQALFFVKSFWKEKARTCNHINFLKIDGMLTQSQDQIQQHIVNYYSNLFASDNDITDNDFVRPRRTMNIKVNDQELDSRNTTVLEAPTRAGRGGGGDGGGCGGGHQRR

SEQ ID NO: 197200 - protein, 180 aa, Glycine max
  Coding DNA Sequence Number=SeqID_80422
MCVRGVVFVHGIVGLSRRQLSLGLELSEWIVVHHGGHRSRVATGGVLLRPHGRRQMHLLKFGVDLTSKFTIVNVDFGDLCSGEFVGILRLSIGEGVPAKGTLMLKEKKDFGTRRKKNEIERKTKRTNVNGKPCFMVVIYGSTSCTLRKHLWKHLTDLQYKHPGSWTFIGDFNATLEAHEK

SEQ ID NO: 197201 - protein, 49 aa, Glycine max
  Coding DNA Sequence Number=SeqID_80423
MKEDDGECLLQPLNPKSPSFSRSELGRAKREQRQRPRWVGWLHAGRTDL

SEQ ID NO: 197202 - protein, 108 aa, Glycine max
  Coding DNA Sequence Number=SeqID_80424
  Homolog annotation: Hit_ID=Q1SKD7; Match level="QueryCoverage=89%, HitCoverage=25%, E-value=3e-09, Identity=31%"; Hit description =Ankyrin
MAPRKLSAKRSRRDAEAEGTSAAPEFDSHRFRSVEHQQGFEAIKGWSFHRERRVQLRDDEYTDFQEEIARRRWTSLVTPMAKFDPDIVLEFYANAWPTEEGARDMQSW

SEQ ID NO: 197203 - protein, 89 aa, Glycine max
  Coding DNA Sequence Number=SeqID_80425
MAEKKEMYIEKKEEIERGASHIEHLTLLEGMKNMLTLGKLSVLTQTTFVHAGGLDKPATLKFVKVATLNIGQTLSPKSLTQSLGGFCTV

SEQ ID NO: 197204 - protein, 200 aa, Glycine max
  Coding DNA Sequence Number=SeqID_80426
MHVRGPKIDSSTEHIPMWHLNMVPSQLHPNNWVMLTGKIGWVLLNSASKKMFEFDSNMFRIFKDCFFKVKVGLVGDDVPSPPPSFLTLVPGKEDEVVEVTLDVPLLAPTKRKRNEGVEGSSQRRRSPASSQSPPLALLVVQVAIATVLVFHPLISLSLPIHVVLVPSSTASATSAPSVVPISTPPSSVTVPLLSAGVTIA

SEQ ID NO: 197205 - protein, 110 aa, Glycine max
  Coding DNA Sequence Number=SeqID_80427
MIGFVQPRSGRRYGGSCMGISALKASSRMVAQFAIKVRSAHCILGTKVFDKSIKVVNGPGKESSIPRQCCPYEGHWKDSTQDCIIIGVEISLSEENIQVLLWISSSIVTL

SEQ ID NO: 197206 - protein, 214 aa, Glycine max
  Coding DNA Sequence Number=SeqID_80428
  Pfam annotation: Domain name=RnaseH; Domain location=16-126; Score= -24.0; E_value=0.0098; Accession=PF00075.14; Description=RNase H
MADFLAKFIGDIRPTQDRWNLYVDGMSNEKGSGASIILERPNNVTLERALKFNFMASNNQAEYEALIEGLKLQDKLGQGNSDATMTRSLSKDRESNTRAKLLSKLASTKKTGHLKTIIQETLQAPTIGIEEVMAGVATYPSMGGRGEKQRCIFQKGERMGVATNVYSRKMLEKPKRGLRILKRRVRELFTHREGISTLRARHKGRQPLIKCAKT

SEQ ID NO: 197207 - protein, 212 aa, Glycine max
  Coding DNA Sequence Number=SeqID_80429
EPSLRFDEEAIGQLLCSPGHDFAWSVARRQVWIMRTSMTTLTQIWMTLLLSNILPNDYNSDLPLPKCQLFDAILTQTSVHVARLISDAIYQFIGIAPLRHPVDPEKSNKGLGFSALITGLYQFYGQQPTTDVPSSPPHQPPSLESISTHMQRMELQMHTYMQYLADQTTIAWPGNRPNFQGGAGPTEAQGDEDEAEEDGDMENVMDFFLLGD

SEQ ID NO: 197208 - protein, 100 aa, Glycine max
  Coding DNA Sequence Number=SeqID_80430
MKDTTNKINGNLVFPIFLGEGRADGLFYHRKYGCALVKVSFYSTVGNYESYKISVANPKGAFFKVEVHVIVLNFSESLLQICHMLGHAVRLDHHFVLFVV

SEQ ID NO: 197209 - protein, 136 aa, Glycine max
  Coding DNA Sequence Number=SeqID_80431
DVRKKTQAIQKQNTAPHVLSHRGYEYLQKKLMDEKTKKKLEEAAQSGSTDTLIDPLSPIRRHVKWKMARTKKTGQMTSKATKQIANKIDVLTAAIGRPEHPGHLRATGAGVMIKQYFGPAPRTSRTSSSMAPEDLE

SEQ ID NO: 197210 - protein, 187 aa, Glycine max
  Coding DNA Sequence Number=SeqID_80432
  Homolog annotation: Hit_ID=UPI0000162D04; Match level="QueryCoverage =19%, HitCoverage=5%, E-value=1e-10, Identity=86%"; Hit description =GTP binding
  Subcellular localization annotation: CTP_CleavageSite=34; ConfidenceScore=5.09e-01
MSSIFRWHPRKKRSSARPPTAHSHTRKKARLLPRATKPSTDQTCLLPYGHHKRLKEKNEVRTLTYRAEHECKAGSKLQSAGNGGRRARGEEEELEPGRKELWSRKKKNSKLEEEELLVAEEEFEPGNYVDRTRWFSTILRRLPLCQMGRTWSTSSSLAPSVKHQPLCTNVFLLSEKDEIATSWLHHV

SEQ ID NO: 197211 - protein, 76 aa, Glycine max
  Coding DNA Sequence Number=SeqID_80433
MLVVVRTIVKGYFGEEGLAIDISLGVTMGSATQISMFVDGTSRYMKGVTLCYIVIGAWQSPKDSFGAKPSFEAITT

SEQ ID NO: 197212 - protein, 69 aa, Glycine max
  Coding DNA Sequence Number=SeqID_80434
MDCRCKFYRILSTPKKQCKARRNKIKDMKLLAERDAIALSVSDALSMRLPPFSLSAAIALSVKVVRKPR

SEQ ID NO: 197213 - protein, 101 aa, Glycine max
  Coding DNA Sequence Number=SeqID_80435
MALSAAIDEGRRRRHSKKNFYTANHSGISASHRDSNVSMTDLVSAEDDVNLRVSTCLSAAFDEGRRRRYSKKNVYTANHSGISAGQCDSNVSMTDLVSRGR

SEQ ID NO: 197214 - protein, 98 aa, Glycine max
  Coding DNA Sequence Number=SeqID_80436
MHHQKRKTLNETSLLSSESETQHDHRSTSTPSISHRPRLSATLALSSNSLTRAKHENGAKRDVEIRKPFLSLICTELKGESRELYTTQKPEECEFQIA

SEQ ID NO: 197215 - protein, 78 aa, Glycine max
  Coding DNA Sequence Number=SeqID_80437
  Subcellular localization annotation: CTP_CleavageSite=39; ConfidenceScore=5.31e-01
MKSGNVRRYPSSYPYKRFLSSRPVKSGANELVDTRRLTSSSAPSVILTREVRRRYPSGYPYKHSFAIRQTQSPVACRD

SEQ ID NO: 197216 - protein, 132 aa, Glycine max
  Coding DNA Sequence Number=SeqID_80438
MAFLGETSIQTVVNSTLGFIFPNGSIVHNDSGVSFQASTPVPIQLLCSIARTPYGILNLLQATMTPTHDALLYYNGRWNMSRQNEFVGYSFTGKNPKKFDIPTGCIMDELKDLIKQIAPTGIPPYGIDETQM

SEQ ID NO: 197217 - protein, 69 aa, Glycine max
  Coding DNA Sequence Number=SeqID_80439
MVESFTTAVATAIASETANSEVPPQPSLERTCESKDKQHIPLPFPPRAISNKNMEEAEKEILETFSKVE

SEQ ID NO: 197218 - protein, 348 aa, Glycine max
  Coding DNA Sequence Number=SeqID_80440
  Gene Ontology: Mol. function=hydrolase activity, acting on ester bonds; Cellular component=intracellular; Biological process =nucleobase, nucleoside, nucleotide and nucleic acid metabolic process
  Homolog annotation: Hit_ID=Q8P8T5; Match level="QueryCoverage=99%, HitCoverage=43%, E-value=1e-176, Identity=89%"; Hit description =Transcription-related protein
  Pfam annotation: Domain name=S1; Domain location=293-348; Score=27.5; E_value=4.6e-05; Accession=PF00575.13; Description=S1 RNA binding domain
STPHEPRRQWDQSLQTIKQLCAKHNVELIAIGNGTASRETDKLAGEAIKAAGNPKLQKVVVSEAGASVYSASEFAAKEFPGLDVSLRGAVSIARRLQDPLAELVKIEPKAIGVGQYQHDVDQYRLARALDARVEDCVNAVGVYVNTASAALLSRVSGLSATVAENIVRHRDDNGPFKRRKDLLKVARLGEKTFEQCAGFLRIADGDQPLDASAVHPEAYPVVERIVASTARPIKALIGDGSFLRGLKAEQFTDDTFGVPTVRDILKELEKPGRDPRPEFKAARFAEGVEDIKDLREGMVLEGVVSNVAAFGAFVDIGVHQDGLIHISALSDTFVKDPRDVVKAGDIVK

SEQ ID NO: 197219 - protein, 95 aa, Glycine max
  Coding DNA Sequence Number=SeqID_80441
MRKLIKERMENKVVNFVGLNKVVSGIKWMNGMKYRNGNNGSYRAPNEVIPKREVDFLELWFERTRVEMIGRKESLFPARATHKGCESPLIQPRCS

SEQ ID NO: 197220 - protein, 57 aa, Glycine max
  Coding DNA Sequence Number=SeqID_80442
MGVDFVANLGVAFVANWVALVGRVVGNGLDYCWMSSDISGEDIGTWDYKGLVGNLAM

SEQ ID NO: 197221 - protein, 108 aa, Glycine max
  Coding DNA Sequence Number=SeqID_80443
MAPDRMQLQNICKRDNESFKENAQRWRDLAAQVMPPMTEREMITMIMDILSVFYYEKIVGYMPSSFTDLVFAGERIAVGLGRGKFDYAAITGSSNRKIGMGGGKKKEG

SEQ ID NO: 197222 - protein, 255 aa, Glycine max
  Coding DNA Sequence Number=SeqID_80444
  Gene Ontology: Mol. function=RNA-directed DNA polymerase activity; Biological process=RNA-dependent DNA replication
MVAIGPAKIPQPPFLRGYNPNVMCAYHGGALGHSIEHCMAIKHKEDNPNVQTNSLVNHESSSVNAIENEEIWELKRGVEDISTSKRFILKALCKAGMVDYEGDEEDRCPLHPKTLHDVEECLVFKELLQDLMNHSQIKISHRRKEEGKAPSSFPYDNSKAIPWRYDVQVSKGGQEVSLVHDGHNASTPKVTNIFGISGMTCSGCVFTTPDLRAESKDKGKSYQLKGGGIIRPCMCRSKYGDYMGGQGACGHWFFS

SEQ ID NO: 197223 - protein, 138 aa, Glycine max
  Coding DNA Sequence Number=SeqID_80445
  Gene Ontology: Mol. function=RNA-directed DNA polymerase activity; Biological process=RNA-dependent DNA replication
MVAFIRQYQHNSNMSPDRMKLQNMCMKKHESFKVYAQGWRDLAAQVAPSMMEREMITMIVDTLPVFYYEKMVGYMPSSFENLVFTGERIQVGLRRGKFDYAASMNSGDRRPRENGGNKKKGETHVVAAVPTWPNFPLA

SEQ ID NO: 197224 - protein, 242 aa, Glycine max
  Coding DNA Sequence Number=SeqID_80446
  Gene Ontology: Mol. function=protein binding; Cellular component =integral to membrane; Biological process=xylan catabolic process
  Homolog annotation: Hit_ID=Q1T435; Match level="QueryCoverage=91%, HitCoverage=74%, E-value=1e-53, Identity=36%"; Hit description =Leucine-rich repeat; Leucine-rich repeat, cysteine-containing type
  Pfam annotation: Domain name=LRR_1; Domain location=153-175; Score =13.0; E_value=1.1; Accession=PF00560.23; Description=Leucine Rich Repeat
  Pfam annotation: Domain name=LRR_1; Domain location=177-199; Score =16.2; E_value=0.12; Accession=PF00560.23; Description=Leucine Rich Repeat
  Pfam annotation: Domain name=LRR_1; Domain location=201-223; Score =10.3; E_value=3.4; Accession=PF00560.23; Description=Leucine Rich Repeat
  Pfam annotation: Domain name=LRR_1; Domain location=225-239; Score =0.7; E_value=2.1e+02; Accession=PF00560.23; Description=Leucine Rich Repeat
  Pfam annotation: Domain name=LRR_1; Domain location=30-53; Score =12.4; E_value=1.4; Accession=PF00560.23; Description=Leucine Rich Repeat
  Pfam annotation: Domain name=LRR_1; Domain location=55-77; Score=9.4; E_value=5; Accession=PF00560.23; Description=Leucine Rich Repeat
  Pfam annotation: Domain name=LRR_1; Domain location=6-28; Score=14.0; E_value=0.54; Accession=PF00560.23; Description=Leucine Rich Repeat
  Pfam annotation: Domain name=LRR_1; Domain location=79-101; Score =6.3; E_value=19; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=153-175::177-199::201- 223::225-239::30-53::55-77::6-28::79-101
MGSLLHLQALLLRNNNLTDEIPISLRSCTNLVMLDISENRLSGLIPAWIGSELQELQFLSLGRNNFHGSLPLQICYLSDIQLLDVSLNRMSGQIPKCIKNFTSMTQKTSSRDYQGHSYLVNTIGIYYYYTYDLNALLMWKGSEQMFKNNVLLLLKSIDLSSNHFSGEIPLEIEDLFGLVSLNLSRNHLTGAIPSNIGKLTLLDFLDLSRNHLIGSIPWSLTQIDRLGVLDLSHNNLSGEIPT

SEQ ID NO: 197225 - protein, 71 aa, Glycine max
  Coding DNA Sequence Number=SeqID_80447
MPNEHLVVWICSLHNKPDNYLKRIINSALKGLDDAPQPKSKAPARWIVIKTIGAREIKGVADLVGTVLSPS

SEQ ID NO: 197226 - protein, 87 aa, Glycine max
  Coding DNA Sequence Number=SeqID_80448
MFKRGGGEHFLHSKTPPPPFKKEKLTGIKGFSPLRHHFCAFASILSVVTHSIKDGLRPRVHPEAMGHATLPPLSCYSCLNMRPPSAR

SEQ ID NO: 197227 - protein, 165 aa, Glycine max
  Coding DNA Sequence Number=SeqID_80449
MEEASQFGSIEAVIDLPSPIRWHVKWKMAHTKNTGQMTSESAKEIVEKIDSLEEQASQGFFVPHGRQDVLTAAIGRPEHHGRVRAIGASVTVGFPLQLLFGPLFLYANMFKGNPVCRKAHQIVKYLKLKWMNPSIKLMDLVLDRVKFINKALLKETLIIDDLEQN

SEQ ID NO: 197228 - protein, 85 aa, Glycine max
  Coding DNA Sequence Number=SeqID_80450
MSHGRLYQQRMKNVFDKKGQNHLRPWSDVGTKLKAETNQGKTVLRDRRKYRLGSQPIDRHPLPSFGQTESVAARQPNLRSRLRVQ

SEQ ID NO: 197229 - protein, 75 aa, Glycine max
  Coding DNA Sequence Number=SeqID_80451
  Subcellular localization annotation: CTP_CleavageSite=38; ConfidenceScore=5.32e-01
MLATHSGYRATAKKPASNCYLTSSLIPSGVANCRNVPYAGERGRGSWVRFRKDARSRHQRLFVENVGKTEGNRSK

SEQ ID NO: 197230 - protein, 115 aa, Glycine max
  Coding DNA Sequence Number=SeqID_80452
  Gene Ontology: Mol. function=DNA binding
  Homolog annotation: Hit_ID=Q7N7P7; Match level="QueryCoverage=86%, HitCoverage=97%, E-value=8e-31, Identity=62%"; Hit description =Similar to putative DNA-binding prophage protein
  Pfam annotation: Domain name=HTH_3; Domain location=46-99; Score =16.6; E_value=0.067; Accession=PF01381.12; Description=Helix-turn -helix
MAKSVLHDDAMVQLLKDSPDFAPVYLHQAFIEIDEPGGYEAFMLALRHVIEASGGMTVIAKRAGISRESLYKSLSPNGNPSFKRIAEVASATGYPISRIATAGLNDNTRPHQAAL

SEQ ID NO: 197231 - protein, 76 aa, Glycine max
  Coding DNA Sequence Number=SeqID_80453
MGVKHFEAVKRRSHANKQWCPDEIRIGGLWMEFPSGNKEFEEAMNLEVVKLFYKILALIPLVGSSGLGIIKKGGLN

SEQ ID NO: 197232 - protein, 211 aa, Glycine max
  Coding DNA Sequence Number=SeqID_80454
  Gene Ontology: Mol. function=metal ion binding
  Homolog annotation: Hit_ID=Q9LDD1; Match level="QueryCoverage=73%, HitCoverage=50%, E-value=2e-09, Identity=30%"; Hit description =Arabidopsis thaliana genomic DNA, chromosome 3, P1 clone: MGH6
MADNSQAAYGHRQQPVEQHHAWQMNQNMSLVDPNFSCFSNSNVHHYALHKNVIQPLASYPQSLAIVFDQQREIDHCIRSQNEKLSILLQEQRKQHVSELLKKVEANALHLLRQKDEEIAQATKKTTELKEFLTRLEVENQSWRKVAEENEAMVLSLHNTLEEMKERALYRVTAEDAESCWDENMRNRAMEEGTGENRLCRGGGVEEAPLFV

SEQ ID NO: 197233 - protein, 211 aa, Glycine max
  Coding DNA Sequence Number=SeqID_80455
HPEKILRKDLTTLARVWSVLSYSNLAPTSHTSDLTVDRDRLIFGLVSQMDMNVGALISSQITSMAQSNSSRLRFPALITALCKSRRVASDSLVFKHLSLVINLAYIKKNYWNPDEGPTAQVPQQMKNESSKTTTPKPLVRRKKADETQEAVATSKKSLEATSKPSEPVADTTSPQQAADPSTAEDHTTPVLSPNTSPTATLVLHLTDEEDV

SEQ ID NO: 197234 - protein, 97 aa, Glycine max
  Coding DNA Sequence Number=SeqID_80456
  Gene Ontology: Mol. function=nucleic acid binding
MLHISMNVAKCAYTAIRLSLFSFSLAGEAKRWLHTFKGNSLKTWEEVVEKFLKKYFPESKTAEGKAAISLFHQFPDKSLSEALERLQVVPSVVRLMK

SEQ ID NO: 197235 - protein, 138 aa, Glycine max
  Coding DNA Sequence Number=SeqID_80457
MGLCGGDNEAKEGGWLTGSMKVKRLERGGWLTGHADNNMVEEVDDNFAWGGGYLVGGVVVMVVDRGKKVGTTMLHLVTTPVLMPPHVPNVYGEITVDWSLVKLQFYGQNMEFERVTVDKEHFFHHSSCGLSTTAKLKY

SEQ ID NO: 197236 - protein, 241 aa, Glycine max
  Coding DNA Sequence Number=SeqID_80458
  Gene Ontology: Mol. function=acid phosphatase activity; Cellular component=cellulose and pectin-containing cell wall; Biological process=translation
  Homolog annotation: Hit_ID=P27061; Match level="QueryCoverage=71%, HitCoverage=68%, E-value=1e-64, Identity=66%"; Hit description=Acid phosphatase 1 precursor (EC 3.1.3.2) (Apase-1(1))
  Pfam annotation: Domain name=Acid_phosphat_B; Domain location=44-240; Score=213.5; E_value=5e-61; Accession=PF03767.5; Description=HAD superfamily, subfamily IIIB (Acid
  Subcellular localization annotation: CTP_CleavageSite=58; ConfidenceScore=5.21e-01
MVPSAFLFHFLFFFSLLISFSFSDSDSDSDSNSVGPTFHRVFPRPLIVEYPEFEAGLRCGAWRVAGEANNLGAWRTIPEECTEYVKEYMTGKGYAVDLEMVSKEAEEFARSVPLGSDGKDAWIFDIDETLLSNLPYYAAHGYGLEVFDHEKFNNWVEKGVAPAIEPSLKLYEDVLNLGFKVILLTGRSERHRSVTVDNLINAGFKEWDQLILRRNLANNPLIPASFFRWTAESAYLKSSWR

SEQ ID NO: 197237 - protein, 91 aa, Glycine max
  Coding DNA Sequence Number=SeqID_80459
MEELLGWVPLLGESKEGKCKMRRKGNEERGNANLTYGEERVAGLNDDVTCDRGERGDGVLEYSVFSVELNWGVRKRGVGLVGRWTKEDTEK

SEQ ID NO: 197238 - protein, 112 aa, Glycine max
  Coding DNA Sequence Number=SeqID_80460
KNAITKRAPRHPYRTRSKSRTMGDQEEIQEQMKADMSALKEQMASMMDAMLGMRQLMENNVATAAAVSSTVEADPTLPATAHHPFPNMVGRERSTLGHISNPHQGYNRVAYP

SEQ ID NO: 197239 - protein, 83 aa, Glycine max
  Coding DNA Sequence Number=SeqID_80461
MGFEHQRIIDLFEENKPIPYQNVCLQVMEGDKEIFGLAKLIMGELSEIQLGLNWAKPEPSAKRVMFSGLAQSPCAKPYSLRPI

SEQ ID NO: 197240 - protein, 65 aa, Glycine max
  Coding DNA Sequence Number=SeqID_80462
  Subcellular localization annotation: CTP_CleavageSite=39; ConfidenceScore=5.34e-01
GRSEEQKGSAFLALLILSKLLRKIVSVKKSKPRHFRNVSVSNYAKVFNRSSTFIVRSSFSSVFNW

SEQ ID NO: 197241 - protein, 463 aa, Glycine max
  Coding DNA Sequence Number=SeqID_80463
  Homolog annotation: Hit_ID=Q9ZUH9; Match level="QueryCoverage=14%, HitCoverage=24%, E-value=2e-13, Identity=57%"; Hit description =Expressed protein
  Pfam annotation: Domain name=DUF593; Domain location=1-91; Score =133.8; E_value=4.7e-37; Accession=PF04576.6; Description=Protein of unknown function, DUF593
MKETLRTQQQLLEKLYAELDEEREASATATSEALDMILRLQGEKAVVKMEASHYKRVAEEKIGHAEASIEAFEELMYQKEMQIASLEFQGQAYRLKLMSFGCEGFNEFEFLEDLLLKRGDQRNGENGGRGSTIRRLHSMPPIQFLSSLTAAKRERSTSPVLDVIPMIMEESTDKEVAQPGLDLTRKLVDFACGSGTLDSYLNKIKESDEQVRVISDCDEGEKSANLSSRRGRSSSILSKASTKMACDQTERLLSTNFDEVSPGESTHTRVVVNDSPCLLNVHDVYEVPQTSEKHEVSEHREKRLERLNSDALNKLTKPDSVSEGMVESLVKHGAEKKKGMFKVYGEIKTPCPKDMMTIIGHMDCNSQAEIQKLNQRIERLERERIIARQEVTHEGNGEEKLRLLKGIQRQLQIIQSEMKSLKTEKATTMDDVSLASLQEDFFMIELNLVPANVCNSTTTSGIY

SEQ ID NO: 197242 - protein, 41 aa, Glycine max
  Coding DNA Sequence Number=SeqID_80464
MLLSLRRFVVQPKIVQADYQPRSPYDKTAQITVFGTTYLEK

SEQ ID NO: 197243 - protein, 112 aa, Glycine max
  Coding DNA Sequence Number=SeqID_80465
MRKGENSQSKESEESKNGKFPIKENGGKQKRKRILDQRSEEKRRNMQKGLRTRQYLNDTDLSPSKQEKKGNHDLKWSSPMITHVIFDLIGNDLQDQVMAYLWFGIRTKHLPV

SEQ ID NO: 197244 - protein, 145 aa, Glycine max
  Coding DNA Sequence Number=SeqID_80466
MGVAFVQRAQPSWEHGGDVIPMMGLYVQRKDGTLGLVAMGKIMEGDSVMHIVAYEDDVVRDVEIIPHNEDAHVPKPANVDADDPLRGLIKYSFDIYEKPVEINFDGSCFGIADAPTSIFITYSDVSEIIAGDKSLNISVQQLWLM

SEQ ID NO: 197245 - protein, 223 aa, Glycine max
  Coding DNA Sequence Number=SeqID_80467
  Gene Ontology: Mol. function=microtubule motor activity; Cellular component=microtubule associated complex; Biological process =microtubule-based movement
  Homolog annotation: Hit_ID=Q75UP8; Match level="QueryCoverage=78%, HitCoverage=32%, E-value=8e-34, Identity=44%"; Hit description =Kinesin heavy chain-like protein
MKTVKVVLINTLMNVAKKFKVLNWKNQVEMTLNMLIHHKSGAMHRTPASSFKKCFPRRPDGLQRKFLPLTYGSSTKFPMNGSPSSIGSPFMDELRTNNMRSYANEDVSSLQTFVAGMKEMDQQAETTTFRFENNMKDVGVGSMLEAPESPVEWPMQFKQQQTEIVELWRAYNVSLFHRTYFFLLFRGDPTDSIYMGVELRRLSFLKETFACGNQSMNDTHTSH

SEQ ID NO: 197246 - protein, 190 aa, Glycine max
  Coding DNA Sequence Number=SeqID_80468
  Homolog annotation: Hit_ID=Q1SMW0; Match level="QueryCoverage=21%, HitCoverage=10%, E-value=7e-10, Identity=82%"; Hit description =Pyridoxal-5-phosphate-dependent enzyme, beta subunit
MAKVLALKEGLMVGISTGANIVGALRLAQLPENKGKLIVHVRQQALQNVKNNYAPKALDTSFDEVTTCKSILEKVGLKGYQDMTKSKGKDPLEGLGGPMTRARARKAKEALQQVLSILFEYKPKFQGKKFKHSSEWLSGGENFWCEDLEGQQRLKRKLSCRVLDESLSDCEVSRASQLWRAKSSVGSSYG

SEQ ID NO: 197247 - protein, 160 aa, Glycine max
  Coding DNA Sequence Number=SeqID_80469
MQIIISVPPITCDFCRREHYQDNCYMYSTNNSRWRQELTPYNQYEEERALDLDIVFAEFMAYHASYYQGEPESQFFYQNEAKKSFNLEILFMQFKDTIGFIQRAFKSAEIQVEDQKISFDLIEAIKHPDDSEDWYEAEISEQEMELTTSAMVLQTPGERI

SEQ ID NO: 197248 - protein, 98 aa, Glycine max
  Coding DNA Sequence Number=SeqID_80470
MKSNREEDLAEEVLEGDDNVKIKIYYKRVGKGKTGKEDTFIGIGDGYGPRNEMGEKNTAQACVVSAKRNIPSLSLSLSLSATLASLSCSCANCNFERI

SEQ ID NO: 197249 - protein, 659 aa, Glycine max
  Coding DNA Sequence Number=SeqID_80471
  Gene Ontology: Mol. function=protein phosphatase type 2A regulator activity; Cellular component=protein phosphatase type 2A complex; Biological process=signal transduction
  Homolog annotation: Hit_ID=Q1SJ09; Match level="QueryCoverage=99%, HitCoverage=99%, E-value=0.0, Identity=58%"; Hit description=WD-40 repeat
  Pfam annotation: Domain name=WD40; Domain location=241-279; Score =42.9; E_value=1.1e-09; Accession=PF00400.22; Description=WD domain, G-beta repeat
  Pfam annotation: Domain name=WD40; Domain location=345-382; Score =37.3; E_value=5.4e-08; Accession=PF00400.22; Description=WD domain, G-beta repeat
  Pfam annotation: Domain name=WD40; Domain location=385-423; Score =0.4; E_value=33; Accession=PF00400.22; Description=WD domain, G-beta repeat
  Pfam annotation: Domain name=WD40; Domain location=435-474; Score =4.7; E_value=10; Accession=PF00400.22; Description=WD domain, G-beta repeat
  Pfam annotation: Domain name=WD40; Domain location=476-515; Score =13.5; E_value=0.77; Accession=PF00400.22; Description=WD domain, G -beta repeat
  Pfam annotation: Domain name=WD40; Domain location=612-651; Score =2.3; E_value=19; Accession=PF00400.22; Description=WD domain, G-beta repeat
  Pfam module annotation: Pfam domain module=WD40::WD40::WD40::WD40::WD4 0::WD40; Domain location=241-279::345-382::385-423::435-474::476 -515::612-651
MGSFSEDEECRFFDAQEDVVVSIADDEGVSNGFDYEMWIRSPRSVSERRGTFMKRMGLSSVDLVALENENSVDVCSVECKEEVMDRVNVNSGAVTRNCVMEEEFCSSRTSMSCWSRENSSGGFGIVDNSPCQDGNLDQEGLQCREMSEGRDLDSDRSVVAEEHKESENAFRETDANVSVGKMNKYKKGWLRRLRSITCMLNRQDEGDNGREEGLGEMSGTCRLQKVKVRQSKKQMKELSALYIRQDFQAHEGSILTMKFSPDGQYLASGGEDGVVRLWQVVEEDRCNEVDIPEIDPSCIYFTVNNLSELTPLFMDKEKISKLKSLKKTSDSACIVFPPKIFRLLEKPLHEFRGHRVTCIQFNPVDDNYFISGSIDGKVRIWAIPDCHVVDWIDIKDIVTAVCYRPDGQGGIIGSLTGNCRFYNVSENLLQLDSQLCLIGKKKLPGRGITGFQFLPQDSNKVMVSCADSQVRILDGLNVIGKYKSLSTGSPMCASMTSDGKHILSACEDSNVYLWNVSQEESNPLKAKKITSCERFFSNASVAVPWHGLKSQNIEIEHQLDALDKTSSQVIQLSPPASFSLSQEFFLESFPKGSATWPEEKLPVSSPKAKASVMRKSEYKFLKSSCKSTSSAHAWGMVIVTAGWDGRIKSFHNYGLPIPA

SEQ ID NO: 197250 - protein, 210 aa, Glycine max
  Coding DNA Sequence Number=SeqID_80472
  Homolog annotation: Hit_ID=Q9AVH2; Match level="QueryCoverage=22%, HitCoverage=16%, E-value=4e-18, Identity=93%"; Hit description =Putative senescence-associated protein
MTEGCGEGFCLANLPGDAFSLWGNFFEAKKQMMADAKVGGAGLWPRAKFRIGWAPPPPVISLLPGFCQLWLAPRWLSLCLGGGSSWEGRIKETRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNFGNQRFLSY

SEQ ID NO: 197251 - protein, 74 aa, Glycine max
  Coding DNA Sequence Number=SeqID_80473
MTTRRIISFNFILRIMCVALLLTSGSALMESCTKAGNCPDDKACNTLCNLFGFKDYGGFCVYYGTIDYCCCQYR

SEQ ID NO: 197252 - protein, 668 aa, Glycine max
  Coding DNA Sequence Number=SeqID_80474
  Gene Ontology: Mol. function=RNA binding
  Homolog annotation: Hit_ID=Q9LVU6; Match level="QueryCoverage=99%, HitCoverage=98%, E-value=0.0, Identity=55%"; Hit description=RNA -binding protein-like
  Pfam annotation: Domain name=KH_1; Domain location=169-220; Score =25.4; E_value=0.00021; Accession=PF00013.19; Description=KH domain
  Pfam annotation: Domain name=KH_1; Domain location=349-410; Score =16.1; E_value=0.016; Accession=PF00013.19; Description=KH domain
  Pfam annotation: Domain name=KH_1; Domain location=433-499; Score =27.4; E_value=5.2e-05; Accession=PF00013.19; Description=KH domain
  Pfam annotation: Domain name=KH_1; Domain location=594-656; Score =50.8; E_value=4.5e-12; Accession=PF00013.19; Description=KH domain
  Pfam annotation: Domain name=KH_1; Domain location=62-116; Score =39.3; E_value=1.3e-08; Accession=PF00013.19; Description=KH domain
  Pfam annotation: Domain name=KH_2; Domain location=169-215; Score =3.4; E_value=0.047; Accession=PF07650.7; Description=KH domain
  Pfam module annotation: Pfam domain module=KH_1::KH_1::KH_1::KH_1::KH_ 1::KH_2; Domain location=169-220::349-410::433-499::594-656::62 -116::169-215
MERSRSKRNYYYDQDYDSETLARTRPRYNHHYTTAGNQRHRGGGAARHAKTQQDSPLTVTTSYRILCHDLKAGGVIGKSGSIIKSIRQHTGAWINVHELMPGDEERIIEISDTRRRDPEGRMPSFSPAQEALLLIHERILESDAAFGVAEDDEEYGAGRGGGAGRDRVATRLVVSRMHVGCLLGKGGKIIEQMRMETKTQIRILPRDHNLPRCVSMSEEIVQLKSWKGGNMFIAIFFWIGGSEVVGDVNAVKNALVIISSRLRESQHRDRSHFHGRVHSPERFFSPDDDYVPHVTSGSRRSSVDGASFGSRGSNTNSRNNNHPSLSYAMEPGAAPVVDDAQGFYGEELVFRILCPVEKVDLIIGESDGIVEFLQSEVGVDVKVTDPVGGSDEQIIIITSEEGPDDELFPAQEALLHIQTRIVDLVLDKDNTITTRLVVPSSEIECLDGKDVSLSEIRRLTGANIQILPRDDLPLCVAKTDELVQIVGEIKAARDAVVEVTSRLRSYLYRDFFQRDPIPLPAPLPGAEASSSNNIVPVAETSTTYQNVQTVAAALPPKETGGSSTEVGKQKESGRRDDVLSGLNRIAVPLVTRSTLEVVIPEYAVPKLIAKSKSKLAQISELSGANVTLVEDRPDVTQKIIQISGTPEQAERAQSLLQGFILSTQEDVP

SEQ ID NO: 197253 - protein, 166 aa, Glycine max
  Coding DNA Sequence Number=SeqID_80475
  Gene Ontology: Mol. function=RNA-directed DNA polymerase activity; Biological process=RNA-dependent DNA replication
  Homolog annotation: Hit_ID=Q1RW82; Match level="QueryCoverage=89%, HitCoverage=57%, E-value=2e-10, Identity=26%"; Hit description =Multicopper oxidase, copper-binding site
  Subcellular localization annotation: CTP_CleavageSite=47; ConfidenceScore=5.45e-01
MELRGGNSRLWVSSQFSWASASTGKVFAFKCNLMVPSKVTVFSWKVVLDRVQTRLQFRKRKLLRHFDDISCPFCKQHVETANHLLFLCQVSHYVWMRGCNWLELDIVLPNEVIAHFWQHAGLIAGTKKLRGWRLWGMQCYVRWRVPRWQNYYVNTFVGLFKREYTF

SEQ ID NO: 197254 - protein, 253 aa, Glycine max
  Coding DNA Sequence Number=SeqID_80476
  Gene Ontology: Mol. function=protein phosphatase type 2C activity; Cellular component=protein serine/threonine phosphatase complex; Biological process=protein amino acid dephosphorylation
  Homolog annotation: Hit_ID=O82471; Match level="QueryCoverage=98%, HitCoverage=58%, E-value=3e-79, Identity=60%"; Hit description =Protein phosphatase-2C
  Pfam annotation: Domain name=PP2C; Domain location=1-205; Score=19.9; E_value=4.2e-07; Accession=PF00481.12; Description=Protein phosphatase 2C
MNGEEDESGATSTAVFIGDDELLISHIGDSSAVLCRSGKAEVLTSPHRPIGSSKTSLHEIRRVREAGGWINNGRICGDIAVSRAFGDCFLKDIYLLHVKRMLQKGVQEGRWSAKFISRVQLNNDLVVAYPDIYQVTLGSDAEFVVLASDGLWDYMSRELPSHSSYYCSSEAVSLVRDQLRKHGNIQQACEALAEAALDRRTQDNVSIIIADFGRTDWQNAPLERQNTILELVQALATIGIVSIGIWFSSQLSL

SEQ ID NO: 197255 - protein, 871 aa, Glycine max
  Coding DNA Sequence Number=SeqID_80477
  Gene Ontology: Mol. function=protein transporter activity; Cellular component=nuclear pore; Biological process=protein import into nucleus, docking
  Homolog annotation: Hit_ID=Q9FJD4; Match level="QueryCoverage=99%, HitCoverage=100%, E-value=0.0, Identity=77%"; Hit description =Importin beta
  Pfam annotation: Domain name=HEAT; Domain location=127-162; Score =1.2; E_value=30; Accession=PF02985.12; Description=HEAT repeat
  Pfam annotation: Domain name=HEAT; Domain location=170-207; Score =6.5; E_value=7; Accession=PF02985.12; Description=HEAT repeat
  Pfam annotation: Domain name=HEAT; Domain location=214-250; Score =6.3; E_value=7.3; Accession=PF02985.12; Description=HEAT repeat
  Pfam annotation: Domain name=HEAT; Domain location=362-398; Score =17.1; E_value=0.063; Accession=PF02985.12; Description=HEAT repeat
  Pfam annotation: Domain name=HEAT; Domain location=404-441; Score =22.5; E_value=0.0015; Accession=PF02985.12; Description=HEAT repeat
  Pfam annotation: Domain name=HEAT; Domain location=453-488; Score =4.3; E_value=13; Accession=PF02985.12; Description=HEAT repeat
  Pfam annotation: Domain name=HEAT; Domain location=498-537; Score =6.4; E_value=7; Accession=PF02985.12; Description=HEAT repeat
  Pfam annotation: Domain name=HEAT; Domain location=87-123; Score=1.9; E_value=25; Accession=PF02985.12; Description=HEAT repeat
  Pfam annotation: Domain name=IBN_N; Domain location=23-103; Score =88.1; E_value=2.7e-23; Accession=PF03810.9; Description=Importin -beta N-terminal domain
  Pfam module annotation: Pfam domain module=HEAT::HEAT::HEAT::HEAT::HEA T::HEAT::HEAT::HEAT::IBN_N; Domain location=127-162::170-207::214 -250::362-398::404-441::453-488::498-537::87-123::23-103
MAMEVTQVLLSAQSIDGNVRKHAEDSLRQFQEQNLPGFLVSLSGELASEDKPVDSRKLAGLILKNALDAKDESRKQELVQRWLSLDPVAKTQVKSCLLQTLSSLVPDARSTATQVIAKVAGIELPQKQWPELIGSLLSNIHQVPSHVKQATLETLGYLCEEVSPQVVDQDQVNKILTAVVQGMNASEGNNDVRLAATRALYNALGFAQANFGNDMERDYIMRVVCETTVCPEVKIRQAAFECLVSIAAMYYEKLAPYIQDIYNITEKAVRGDEEPVALQAIEFWSTICDEETDILEEYMGDSNGDSDIPCFYFIKQALPALIPLLLETLLKQEEDQDLDEGAWNIAMAGGTCLGLVARTVGDDIVPLVMPFIEENITKPDWRQREAASYAFGSILEGPSPDKLAPLVNHALPFMLSALVKDPNNHVKDTTAWTLGRMFEFLHSSVVGTSIINEGNCQQIITVLLQSMKDVPNVAEKACGALYFLAQGYEDVGPTSPLTPFFQEIVQSLLTVTHREDATESRLRTAAYETLNEVVRCSTDETASLVVQLVSVIMMELHKCLEVQNLSSDEREKQSELIGLLCGCMQVIIQKLGSLDSTKYLLLQYSDQIMGQFFRVFACRNATAHEEAMLAIGALAYSIGHEFAKYMPEFYKFLEMDLQNFEEYQVCAVTVGVVGDICRALEEKILPYCDGIMTQLLKNLSSDNLHRSVKPPLFSCIGDIALAIGDNFNKYLMYAMNTLQLAAEMYAHTSGFDDEMTEYINSLRNGILEAYSAIFQGFKNSSKTQLLIPYAPHILQFLDSIYVEKDMDEVVMKTAIGVLGDLADTLGSNAGSLIQQSLSSRDFLNECLTSEDHLIKESAEWARLAINRAISV

SEQ ID NO: 197256 - protein, 305 aa, Glycine max
  Coding DNA Sequence Number=SeqID_80478
  Gene Ontology: Mol. function=acyl-CoA binding
  Homolog annotation: Hit_ID=Q9ZRC2; Match level="QueryCoverage=85%, HitCoverage=73%, E-value=1e-72, Identity=54%"; Hit description=Acyl -CoA binding protein
  Pfam annotation: Domain name=ACBP; Domain location=103-189; Score =65.6; E_value=1.6e-16; Accession=PF00887.9; Description=Acyl CoA binding protein
MAEWQSLLQSILVGLIFSYLLAKLISIVVSFKDDNLTVTRASAAETTATRAEQFEDALKRDDAVSSDARPFEEESVVAEHGSVRIDSDGDYDDDWEGVESTELDEAFSAATAFVAAAAADRLSQKVSSDVQLQLYGLYKIATEGPCSTPQPSPLKMTARAKWQAWQKLGAMPPEDAMQKYIDIVTEIYPTWLDGSSLRNKSGDSGGHGSEAKGPMGPVFSTFVYEEEYGSDSQMEAIHGFAREGDMANLLKCIENGVSMNLKGLAPSDGESFLLLAISHIILSHPSMGLYLADSLLRVPLAPSNG

SEQ ID NO: 197257 - protein, 112 aa, Glycine max
  Coding DNA Sequence Number=SeqID_80479
MQQSAPSEEGLTPFIARGLNSPNAGVLQGVRKAWELVQKKDKELRGSSNGAVGGYRRWLKAYTQGLDWLTRLRANKEVEFEALEEGEEVQVLRMELRKAQAVKEMFKSTASL

SEQ ID NO: 197258 - protein, 125 aa, Glycine max
  Coding DNA Sequence Number=SeqID_80480
MVVSLFLTHLLLEVTSPIIFLLIHSTDIDLQEEKDSIDEEDPRPTSSTWSYIIKSYVLSSCATSSPSDTKRVPVATGQTRWWTQPVYKEVIAEKDWETLDRVIISSGVTTSGWVSGNWLLGRGEQ

SEQ ID NO: 197259 - protein, 141 aa, Glycine max
  Coding DNA Sequence Number=SeqID_80481
MVMGDFISRLSFPACLHFSGENTETFSSLTSYPELRRSEFLIGGYVGARASLLSTTPPFVAMTQELVARGDTLRLSAPRNSVTPSVIHEQRPIWSSAPFPEMSAFSDGDFSSLTSYQELRRSEFLIGGYVGARALLLSAAP

SEQ ID NO: 197260 - protein, 65 aa, Glycine max
  Coding DNA Sequence Number=SeqID_80482
MRLRRSTDSSAPSSFFGYDLKEQRGFCVLRVSERNEVNGKGLGLQACSLYGLMMKMVGRKQRPPI

SEQ ID NO: 197261 - protein, 211 aa, Glycine max
  Coding DNA Sequence Number=SeqID_80483
MAKTDDSDSALTLGRMRADDLTSPPPLALLAPPKAEGKGLQGGLAIRGTSASILKRGITYRDYLLVHDELLNRAPRIATTQTNGGIRQEGRHYSGREYLKHRRKKKGKTGNQIAQGSKESARKVRMQGSKPITEDLTEASQTMHVSAWGLDKPHRPVILTLVKAPPCPTPDNTRPHMGGSTNSSPSACQDYYPRHKIDSCSTDDKCTKSRK

SEQ ID NO: 197262 - protein, 120 aa, Glycine max
  Coding DNA Sequence Number=SeqID_80484
MLMTGEVLTEPHALFGFRSKLQLDKLFDRFWAFVRGVISWIYVKFIAQACLVDGQGSDLRAFVHAYNLSAFSRYRVRPSRFPGGRICLDGYNLPGQSKEFHFQMGHGDCGSKLVECLPVD

SEQ ID NO: 197263 - protein, 350 aa, Glycine max
  Coding DNA Sequence Number=SeqID_80485
MSWETSTLWKVFQIHDISGTTLVDKDPGHHEVCNDDGDDHEVVLVDEVVACVVVVVVFVCLDLPLFFCLLRGSYVVPLGVLQYLIAFDLDLEGFIGGSLMGTSKLKASSRLVVQLVVSLGTSFALVTLLSDLSDFIPEFQHFFHLDTVCELVEAYGEEHEMQCYLRVKISDMDVRSTGWVLRIESFDEGVIATYGPRHESTVPSLPKARRHLDARLDLLYHHTPRCCVVSTPRERHKSPGVLIVRQGHEPPIDHGQPLAFSASPHGVAPSSQCSCRMRMRVFERGWASPKWASGLHTSALRMTFAERTGGGTWKTKDSDAQVGRIWKKDELCMFAERRVIPLSAPLQSIH

SEQ ID NO: 197264 - protein, 97 aa, Glycine max
  Coding DNA Sequence Number=SeqID_80486
MSWPMAYHLCLIGTGSPTSQSNPTRFKSYDEDLLTLVERVDKAILEKLSALLDTWAILSLLSVSDPLASLDEGVCPMSRESVFPYIGSFFNNKQGLD

SEQ ID NO: 197265 - protein, 73 aa, Glycine max
  Coding DNA Sequence Number=SeqID_80487
MHETQCGPLRVHRMNRKAWFEQNRGGGCRPARPGEIKIAQASQVASSRSNSLLEEYSGGPKWARPTNMHPHFY

SEQ ID NO: 197266 - protein, 248 aa, Glycine max
  Coding DNA Sequence Number=SeqID_80488
  Gene Ontology: Mol. function=protein binding; Cellular component =chloroplast
  Homolog annotation: Hit_ID=P81760; Match level="QueryCoverage=76%, HitCoverage=79%, E-value=1e-71, Identity=70%"; Hit description =Thylakoid lumenal 17.4 kDa protein, chloroplast precursor
  Pfam annotation: Domain name=Pentapeptide; Domain location=138-177; Score=29.0; E_value=1.7e-05; Accession=PF00805.12; Description =Pentapeptide repeats (8 copies)
  Pfam annotation: Domain name=Pentapeptide; Domain location=183-222; Score=42.6; E_value=1.4e-09; Accession=PF00805.12; Description =Pentapeptide repeats (8 copies)
  Pfam module annotation: Pfam domain module=Pentapeptide::Pentapeptide; Domain location=138-177::183-222
MGEKKEAMMWCHVTYLSADKALAEWSGSSNTEVKRETMANVSIPLPRNGVAEFDGSHQKKGGLFNFNGIKGVACGILAACAVTSAAFPVTAATQRLPPLSTEPNRCERAFVGNTIGQANGVYDKPLDLRQCDFTNEKTNLKGKSLSAALMSDAKFDGADMTEVVMSKAYAAGASFKGVDFSNAVLDRVNFEKADLEGAIFKNTVLSGSTFDDAKLDNAVFEDTIIGYIDLQKLCTNKTIGDEWRVELG

SEQ ID NO: 197267 - protein, 37 aa, Glycine max
  Coding DNA Sequence Number=SeqID_80489
MADNIASTFCGRVHESLSLNSHKTEKQHRTELSIDLI

SEQ ID NO: 197268 - protein, 125 aa, Glycine max
  Coding DNA Sequence Number=SeqID_80490
LDGGGRMNSARQSIHGSLNKIENGELGNRARQSIRGAPDSIVEDASTAPGNQCMGLRIRLEIGDLANSARQSIRGSPDSILDGGGRTNSARQSIHGSPNKIENGDLANSARLSICGAPDSMVDDA

SEQ ID NO: 197269 - protein, 57 aa, Glycine max
  Coding DNA Sequence Number=SeqID_80491
MKAKKKGKYGEGMNEKVKVKKRLSFELQKVSVGLSSAVGLSARSQILSLFKAYFVQN

SEQ ID NO: 197270 - protein, 791 aa, Glycine max
  Coding DNA Sequence Number=SeqID_80492
  Gene Ontology: Mol. function=transferase activity; Biological process= fatty acid biosynthetic process
  Homolog annotation: Hit_ID=UPI000038CDAB; Match level="QueryCoverage =56%, HitCoverage=23%, E-value=3e-59, Identity=31%"; Hit description =COG3321: Polyketide synthase modules and related proteins
  Pfam annotation: Domain name=KR; Domain location=246-440; Score =199.4; E_value=8.7e-57; Accession=PF08659.1; Description=KR domain
  Pfam annotation: Domain name=adh_short; Domain location=246-426; Score=130.6; E_value=4.5e-36; Accession=PF00106.15; Description =short chain dehydrogenase
  Pfam module annotation: Pfam domain module=KR::adh_short; Domain location=246-440::246-426
MPAWKRTIPARFMAGSRIDPDSECWLLFVDAMVIAEHIQRQLAESAQRVLTVWRGTHYEEDAANGCYVIDPSKREDYVRLLKSVKNLALRPTRIINMWNLSADNGAPQCHGDGYALQVDAFYSPLYLQQALVSENLLENLHLLFVTNNIFNVTEERLYSPQKALVVGPARVFYHEYPEVRCHVVDVDLFGYTAPHDLAQQLIDESHIDTHGNLVAYRGRNRWEEDYQAVHLKQDDTGIAAELKDEGVYLITGGLGGLGMLVAGHVSEVSNATLILTYRTELPPRDQWQAWLQQHSVDDSVSEKIAGVLRLEERGNTVHLAQVDVCDYAGMRDVLAGFTRIDGVFHTAGIAGGGIIPLKNDADCAGVLNPKVNGSLILDELLKDKQPDFFILFSSITSIVGDEARIDYCAGNAFMDAFAHYRNQQRSGHTVSLNWGKWGDIGMAVRWSNHLIEQKNSKSAQFEEVEGDLLTLIGREGMQERYRVNLAVQKDWVIDEHRLTHQPSLVGATILSMLYEWMSHFKPQERLQVKNLLLTQPVIYHHAWPRNMQLLVTAESHGYKFSLRSRGLLDLAWQEHALGLVSSKVAESEDEPASLESLRQRCTKALAYEPLECELGNANTGDVFLSLSPRWDNHQDILQGENEWLMHKVIGSDFHDDFARYPFHPAMIDATAIRCLTYITQENFLPISYGKITYHAPLETDCYAHLKLKGPYQHTDNAITMDIVFLSHAGVPLLTLENYTLIKMTQVNQVVESDEKAAPAAVKVNLADKDILFNEGLDALKRQLAHLEFEQL

SEQ ID NO: 197271 - protein, 63 aa, Glycine max
  Coding DNA Sequence Number=SeqID_80493
LYGVRVAPCKVIKHRSNQAFFKKYYAPKKAQGETPQQPGRGRQRTTDALPPSPKFTSDHPQKG

SEQ ID NO: 197272 - protein, 140 aa, Glycine max
  Coding DNA Sequence Number=SeqID_80494
  Gene Ontology: Mol. function=nucleic acid binding; Biological process= RNA-dependent DNA replication
  Homolog annotation: Hit_ID=Q1SU57; Match level="QueryCoverage=70%, HitCoverage=73%, E-value=3e-19, Identity=36%"; Hit description=Zinc finger, CCHC-type
  Pfam annotation: Domain name=zf-CCHC; Domain location=102-119; Score =22.1; E_value=0.00022; Accession=PF00098.13; Description=Zinc knuckle
MVDVENLYCDGFCAPWQDALVVKLLGKIIGYHVMMDRLNKNWKLTTSFDMLDIGNNFYMVKFDIEADRTKDFISTATKIDETLVWIWLKGHWHRVEYEGLYHSCASCGRYGHLARNCPTSLHVDTHHPTPAKTHGGTKGN

SEQ ID NO: 197273 - protein, 109 aa, Glycine max
  Coding DNA Sequence Number=SeqID_80495
MMHWDWKACKICNTFEGPNSQHGKPLTLQVVLRIARARERDNNKWWGFKELLRWRRKRVESGDTDHMVAKFQRGERRWWHYDRVLKATLPLLLRKYYKRLEKTIKTQTR

SEQ ID NO: 197274 - protein, 163 aa, Glycine max
  Coding DNA Sequence Number=SeqID_80496
  Gene Ontology: Mol. function=RNA-directed DNA polymerase activity; Cellular component=integral to membrane; Biological process=RNA -dependent DNA replication
  Homolog annotation: Hit_ID=Q1S4N5; Match level="QueryCoverage=87%, HitCoverage=28%, E-value=3e-36, Identity=52%"; Hit description =Peptidase M, neutral zinc metallopeptidases, zinc-binding site
MNSLTLRVFSFPLFLRRTSTLEDVKHVIFSMSSYKAPRVDGFQLICLETYWEVVAIDVWTMVSNAFSIGTFDPGLVETLIVPIPKIDAPKSFKDLCPIILCNVLLKVITKVMVNRIHPHLGKLIDPLQKKFIPKKAKASQVRLVKEVLDEFCNASGLKGLKLI

SEQ ID NO: 197275 - protein, 130 aa, Glycine max
  Coding DNA Sequence Number=SeqID_80497
  Homolog annotation: Hit_ID=Q1S4N5; Match level="QueryCoverage=25%, HitCoverage=6%, E-value=2e-07, Identity=67%"; Hit description =Peptidase M, neutral zinc metallopeptidases, zinc-binding site
MEMSKKDDDSQLVGQDDMVQETFLGDQSATLSRIALALYSCSFRKLLVILEKRDVVWYCTSLVGAPGEYEKSNYGPVLDMMNVCGVMDMDALGGKKLDKCLVDSDWCLMFPHALLELLPMHNSGHNPLAS

SEQ ID NO: 197276 - protein, 96 aa, Glycine max
  Coding DNA Sequence Number=SeqID_80498
DNAVTIEGGENMEGVQTTDAEIAQYDQESQEDISVTEEHLHNRDDPKFMEVNAKGPTKRNLPTALVRKHHVQHTKGRGVEMIQAKPSFTRLQLGLS

SEQ ID NO: 197277 - protein, 319 aa, Glycine max
  Coding DNA Sequence Number=SeqID_80499
  Gene Ontology: Mol. function=protein serine/threonine kinase activity; Cellular component=membrane; Biological process=protein amino acid phosphorylation
  Homolog annotation: Hit_ID=Q1SF45; Match level="QueryCoverage=77%, HitCoverage=76%, E-value=1e-112, Identity=74%"; Hit description =Protein kinase
  Pfam annotation: Domain name=Pkinase; Domain location=37-271; Score =96.1; E_value=1.1e-25; Accession=PF00069.15; Description=Protein kinase domain
  Pfam annotation: Domain name=Pkinase_Tyr; Domain location=37-279; Score=100.2; E_value=6.1e-27; Accession=PF07714.7; Description =Protein tyrosine kinase
  Pfam module annotation: Pfam domain module=Pkinase::Pkinase_Tyr; Domain location=37-271::37-279
MDKSFVEKTKRELGKNKKANDTRGLVAINTPIDEMDLSTSKDAKVEAGQLDNGQEIAVKRLSKASGQGLEEFMNEVVVISKLQHRNLVRLLGCCIERDEQMLVYEFMPNKSLDSFLFDPLQRKILDWKKRFNIIEGIARGVLYLHRDSRLRIIHRDLKASNILLDDEMNPKISDFGLARIVRGGDDDEANTKRVVGTYGYMPPEYAMEGIFSEKSDVYSFGVLLLEIVSGRRNTSFYNNEQSLSLVGYAWKLWNEDNIMSIIDPEIHDPMFEKSILSEITHLPPPRQVAFVQKQNCQSSESSQKSQFNSNNDVTISEIQ

SEQ ID NO: 197278 - protein, 53 aa, Glycine max
  Coding DNA Sequence Number=SeqID_80500
MESKDAIHALLMKVGWKLWNHPNDLWDDESNMFWRVGNGGQPNFGRMLGFLIR

SEQ ID NO: 197279 - protein, 242 aa, Glycine max
  Coding DNA Sequence Number=SeqID_80501
MADNLDDGEFWLPPQFLTDEDDDDTSFCNNLTAQNYAVSRSLFFSSSSSETESDEEDHLAELTRRVALELDLNNKGVFGDGGGSPQSTLSVFENSGKGSSPNDAVPPHVNSSSTWDLLRAAAGEVERICDESCNRYGQNFLTPSSIDASVQQPNAVNCANGVGLGFYPQQKQHQQQPSLCHQQLQIAQFEMMKKQQQQRQMVPPNRGINNNNNNNNNVVTVGNVVNGLGLSGSAWVPPPGLA

SEQ ID NO: 197280 - protein, 390 aa, Glycine max
  Coding DNA Sequence Number=SeqID_80502
  Gene Ontology: Mol. function=6-phosphofructokinase activity; Cellular component=6-phosphofructokinase complex; Biological process=glycolysis
  Homolog annotation: Hit_ID=Q3BPM8; Match level="QueryCoverage=55%, HitCoverage=51%, E-value=1e-77, Identity=73%"; Hit description=6 -phosphofructokinase
  Pfam annotation: Domain name=ADK; Domain location=240-390; Score =272.3; E_value=9.8e-79; Accession=PF00406.12; Description=Adenylate kinase
RRLVIGAFGQQDDVRRFVIAVAGKAGGRSQPARVAAHGLVDDNAGGGLGHRRHVQRRFAHRDGGVLGRRAEAGAGVGHCQVVVDGLGHADAGQVVAGGLGQLRDLQCGIGRVVAAVVEEPANVVRAQHLQQAVVAGAVGVQRFQLHPARAEGATRGMGQGADRGGALLAGVDQLLAQRAEDAVAGGKDLDALGPGLLDHRCRRGIDDRGDTAGLGRYRSVRDANLLCFQHVGVRSMRLVLLGPPGSGKGTQATRLKEKLGIAHISTGDMLRAEIAAGTELGKQAKTVMDAGNLVSDDILLGMLESRLTQADVAKGFILDGYPRNVAQANAMDGLLAKIGQPLDAVVQLDVATELLVDRIAGRAKEQGRADDTPEAVRQRLQVYNDQTAPV

SEQ ID NO: 197281 - protein, 104 aa, Glycine max
  Coding DNA Sequence Number=SeqID_80503
MKTLTTTLEGKSDQPVPRWIEPNVCHYFINRFELVSCVTLKVLALVNIFDIAFRVMFKLEAKCGYYVIHWMWCIVSGGLKNEWNGWFFDGTTLDIEAMTTLRKK

SEQ ID NO: 197282 - protein, 89 aa, Glycine max
  Coding DNA Sequence Number=SeqID_80504
  Gene Ontology: Mol. function=hydrolase activity
  Homolog annotation: Hit_ID=Q9MB07; Match level="QueryCoverage=40%, HitCoverage=7%, E-value=7e-14, Identity=86%"; Hit description=Purple acid phosphatase
MSKCSDKLGPSLELGSFAAGVMIATIDLAQHTLEQHMLDNVRWDTSGRFIERSTAYEPWIWSTGNHELDYAPEILMVILDTPLSLEITL

SEQ ID NO: 197283 - protein, 117 aa, Glycine max
  Coding DNA Sequence Number=SeqID_80505
  Homolog annotation: Hit_ID=Q1SXC2; Match level="QueryCoverage=33%, HitCoverage=2%, E-value=2e-08, Identity=72%"; Hit description=IQ calmodulin-binding region; Myosin head, motor region; Dilute; AAA ATPase; Myosin, N-terminal, SH3-like
MAARSEVCFNLQTHAAIVIQPLPEIPDTTSFYKLKEGCNCNTMCTERKSCSAKITKAQDGKNYQAYIPSSAPYSTRTIVRLPLFKAHPYTLEHCMNLNTLKLYKLALNLSCSRKHFH

SEQ ID NO: 197284 - protein, 85 aa, Glycine max
  Coding DNA Sequence Number=SeqID_80506
MTPVALALYAASTCAPTMSMLVGLIPQDTQLPRLAATTAKATEGEALTGSWVRQEVVAAKRASKRRKNIKGGGDDNAIGEDERKR

SEQ ID NO: 197285 - protein, 64 aa, Glycine max
  Coding DNA Sequence Number=SeqID_80507
MSFCLQVSKEGQLSYPNFVRGLSFMDVLVKDAENTQGEGQKGHLKPFSGPQVAQASLWLAWTPK

SEQ ID NO: 197286 - protein, 92 aa, Glycine max
  Coding DNA Sequence Number=SeqID_80508
MKVDIRRSRHIPLADQDDIQQRRQKKLARTMADEDKALESFGLAKKKRKTRVGQKSLTPKEPIKIPSSDGSSSYDNKATPTPTPQPSNPLPV

SEQ ID NO: 197287 - protein, 179 aa, Glycine max
  Coding DNA Sequence Number=SeqID_80509
MYPNLARMSPQWLPNGTTRTTHPSPATTEEKQKQATKSSHPFEKAFKLTPLATIHSMDPSKENPTPQPLWSKEMYVLDEAIAYPPKLHISRCTDIKMVSDRVCPRLPICNEGKKKESEVEESKMDESTLVIIVEKPKAKGDEAPIESTSHEDTSKEATTIIFHTISSGSTPINFAPPEI

SEQ ID NO: 197288 - protein, 108 aa, Glycine max
  Coding DNA Sequence Number=SeqID_80510
  Gene Ontology: Mol. function=actin binding; Biological process =cytoskeleton organization and biogenesis
MAIQGILPNKVGVAITLREIRLCGPVYLRWMYSIKRYMKVLKGHTKNQYCPEASIVERYIVEEPIEFCSEYMEKPKSVGFVESRHDNKWGSKGSQGFEVVTMGHEELN

SEQ ID NO: 197289 - protein, 277 aa, Glycine max
  Coding DNA Sequence Number=SeqID_80511
  Gene Ontology: Mol. function=protein binding; Cellular component =membrane; Biological process=defense response
  Homolog annotation: Hit_ID=Q8GZF0; Match level="QueryCoverage=89%, HitCoverage=19%, E-value=2e-84, Identity=63%"; Hit description =Resistance protein KR4
  Pfam annotation: Domain name=LRR_1; Domain location=121-144; Score =13.6; E_value=0.71; Accession=PF00560.23; Description=Leucine Rich Repeat
  Pfam annotation: Domain name=LRR_1; Domain location=193-216; Score =2.4; E_value=1e+02; Accession=PF00560.23; Description=Leucine Rich Repeat
  Pfam annotation: Domain name=LRR_1; Domain location=218-241; Score =13.0; E_value=1.1; Accession=PF00560.23; Description=Leucine Rich Repeat
  Pfam annotation: Domain name=LRR_1; Domain location=29-48; Score=6.7; E_value=16; Accession=PF00560.23; Description=Leucine Rich Repeat
  Pfam annotation: Domain name=LRR_1; Domain location=51-74; Score =11.5; E_value=2; Accession=PF00560.23; Description=Leucine Rich Repeat
  Pfam annotation: Domain name=LRR_1; Domain location=96-118; Score =9.4; E_value=4.9; Accession=PF00560.23; Description=Leucine Rich Repeat
  Pfam module annotation: Pfam domain module=LRR_1::LRR_1::LRR_1::LRR _1::LRR_1::LRR_1; Domain location=121-144::193-216::218-241::29 -48::51-74::96-118
MALECVGGAVLSSFLGALFQKLASPQLSSLKKLILLDCPNLQQLPEGLPNSISYLNIGGCDSLKTFPLDFFPALRTLDLSGFGNLQMITQNHTLNHLEFLSIKECPQLESLPGSMHMLLPSLKELRIYDCPRVESLPQGGLPSNLKEMELSNCSSELMASLKGALVDNPSLETLNIEWLNAESFPDEGLLPLSLTCIRIRYSPNLKKLDYKGLCQLSSLKVLNLEFCDHLQQLPEEGLPKSISHLTIFFCPNLKQRCQNPEGEDWPKIAHIPTLHIW

SEQ ID NO: 197290 - protein, 742 aa, Glycine max
  Coding DNA Sequence Number=SeqID_80512
  Gene Ontology: Mol. function=protein binding; Cellular component =membrane; Biological process=defense response
  Homolog annotation: Hit_ID=Q8GZF0; Match level="QueryCoverage=99%, HitCoverage=76%, E-value=0.0, Identity=67%"; Hit description =Resistance protein KR4
  Pfam annotation: Domain name=LRR_1; Domain location=478-499; Score =12.5; E_value=1.3; Accession=PF00560.23; Description=Leucine Rich Repeat
  Pfam annotation: Domain name=LRR_1; Domain location=501-523; Score =12.5; E_value=1.3; Accession=PF00560.23; Description=Leucine Rich Repeat
  Pfam annotation: Domain name=LRR_1; Domain location=525-546; Score =6.0; E_value=22; Accession=PF00560.23; Description=Leucine Rich Repeat
  Pfam annotation: Domain name=LRR_1; Domain location=690-713; Score =11.1; E_value=2.4; Accession=PF00560.23; Description=Leucine Rich Repeat
  Pfam annotation: Domain name=NB-ARC; Domain location=113-405; Score =153.3; E_value=6.4e-43; Accession=PF00931.13; Description=NB-ARC domain
  Pfam module annotation: Pfam domain module=LRR_1::LRR_1::LRR_1::LRR _1::NB-ARC; Domain location=478-499::501-523::525-546::690-713::113 -405
MALECVGGAVLSSFLGAVFQKLASPQVLDFFRGTKIDQKLRKDLENKLLSIQAVLDDAEQKQFGNMQVRDWLIKLKVAMLDVEDVLDEIQHSRLQVQPQSESQTCTCKLPNFFKSSPLSSFNKEINSNMKNVLDDLDDLASRMDNLGLKKASDLVVGSGSGGKVPQSKSSVVESDICCRDADKEMIINWLTSDTDNMLSILSIWGMGGLEIVHTKLKDKLRGNRFLLVLDDVWIESRPKWEAVQNALVCGAQGSRILVTTSSEKFASTMRSKEHELEQLQEDYCWKLFAKHAFRDDNLPRDPGCPEIGMKIVKKCQGLPLVLKSMGSLLHNKSFVSDWENILKSEIWEIEDSDIVPALALSYHHLPPHLKTCFAYCALFPKDYVFHRECLIQLWMAEKFLNCHQGNKSPEEVGQQYFNDLISRSFFQQSSKYEDGFVMHDLLNDLAKYVCGDIYFRFGVDDEGKSIEKLPDSVCNFKHLRSLDLSYTGIEKLPESTCSLYNLQILKLNYCRCLKELPSNLHELTNLHGLEFVNTKIIKVPPHLGKLKNLQVAMSSFDVGKCSEFTIQKFGELNFLHERLSFRELQNIENPSDALAADLKNKTHLVELEFEWNSHQNPDDSAKERDVIVIENLQPSKHLEKLSIINYGVSIGADFHGNSTSSFPSLERLKFSSMKAWKKWECEAVTGAFPCLQYLSIRKCPNLKGDLPEQLLHLKQLAIRECKQLEASAPRALELDLQDFGIL

SEQ ID NO: 197291 - protein, 39 aa, Glycine max
  Coding DNA Sequence Number=SeqID_80513
MASPMTCGGSLWFYFRHPETFKPDDARDSSLLGRDDRVR

SEQ ID NO: 197292 - protein, 440 aa, Glycine max
  Coding DNA Sequence Number=SeqID_80514
  Gene Ontology: Mol. function=protein serine/threonine kinase activity; Cellular component=membrane; Biological process=protein amino acid phosphorylation
  Homolog annotation: Hit_ID=Q1SF47; Match level="QueryCoverage=90%, HitCoverage=48%, E-value=1e-164, Identity=66%"; Hit description =Protein kinase; EGF-like, subtype 2; S-locus glycoprotein; Curculin- like ...
  Homolog annotation: Hit description=(Mannose-binding) lectin; Apple -like
  Pfam annotation: Domain name=B_lectin; Domain location=71-181; Score =99.9; E_value=7.7e-27; Accession=PF01453.15; Description=D-mannose binding lectin
  Pfam annotation: Domain name=PAN_2; Domain location=337-405; Score =83.3; E_value=7.5e-22; Accession=PF08276.2; Description=PAN-like domain
  Pfam annotation: Domain name=S_locus_glycop; Domain location=195-320; Score=110.7; E_value=4.2e-30; Accession=PF00954.11; Description=S -locus glycoprotein family
  Pfam module annotation: Pfam domain module=B_lectin::PAN_2::S_locus _glycop; Domain location=71-181::337-405::195-320
MGSLTQVNYLIFLLILSSFYFGIISVNDTITSTRFIRDPEAIISSNGDFKLGFFSPEKSTNRYVAIWYLSETYIIWIANRDQPLNDSSGVFQIHKDGNLVVMNPQNRIIWSTNVSIIATNTSAQLDDSGNLILRDVSDGKILWDSFTHPADVAVPSMKIAANRLTGEKIAYVSWKSSSDPSSGYFTGSLERLDAPEVFFWFNKTKPYWRTGPWNGRVFLGSPRMLTEYLYGWRFEPNDNGTAYLTYNFENPSMFGVLTITPHGTLKLVEFLNKKIFLELEVDQNKCDFYGTCGPYGSCDNSTLPICSCFEGFKPSNLDEWNRENWTSGCVRNMQLNCDKLNNGSDVQQDGFLEYHNMKVPDFAERSINGDQDKCRADCLANCSCLAYAYDSYIGCMFWSRDLIDLQKFPNGGVDLFIRVPAQLLVVGMFFSPSTQYFGVI

SEQ ID NO: 197293 - protein, 61 aa, Glycine max
  Coding DNA Sequence Number=SeqID_80515
  Gene Ontology: Mol. function=ribonuclease H activity
  Homolog annotation: Hit_ID=Q1SZM6; Match level="QueryCoverage=82%, HitCoverage=16%, E-value=5e-09, Identity=50%"; Hit description =Ribonuclease H
MESLTFRLRPCKHVSWEPPPPPRIKINIDGSSFGNPGRVGFGGLFRDHCGNWISGFSGYSA

SEQ ID NO: 197294 - protein, 32 aa, Glycine max
  Coding DNA Sequence Number=SeqID_80516
MECVSRKATMQDPGAVLSLWDIGDGFSAVSHL

SEQ ID NO: 197295 - protein, 164 aa, Glycine max
  Coding DNA Sequence Number=SeqID_80517
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=64%, HitCoverage=12%, E-value=1e-53, Identity=91%"; Hit description =Lipoxygenase-4
  Pfam annotation: Domain name=Lipoxygenase; Domain location=2-164; Score=-291.0; E_value=0.00029; Accession=PF00305.9; Description =Lipoxygenase
MDQFLRPHLAYFKAQAEELLLKDPSAPHGVQLLIEDYPYASNGLEIWDAIKSWVEEYVSFYYKSAEELQKDPELQAWWKELVEMGHGDFKDKPWWQKMQTREELVEAFATLIWIASALHAAVNFGQPLEAFKRFGKNLEEIEKKLIEKNNDETLRNRYGPAKMP

SEQ ID NO: 197296 - protein, 218 aa, Glycine max
  Coding DNA Sequence Number=SeqID_80518
MLQSCEIGTSLKEHSNQVTTKAYTPKNSSGPLPPDSDEYGNIGFGKTDVNFVELKLDISQPAPSKTLHSLFSLSSCLKSLFSFSSRLKSAGNHSLNIHIVLNTAGNPSLEPTEPPTVLLELWLKENPTYTPPLGTRVLKHSWVLKAFSTRYEESFKFHAIVTVWVRGSEQKAGPYIVCVAFFSFFDNFQDSNNSGKATYFAVFVRLVNCLSLLVNCVY

SEQ ID NO: 197297 - protein, 33 aa, Glycine max
  Coding DNA Sequence Number=SeqID_80519
MASDGAGQGDSGTRAHGIGAAYVHQSFHLKLMN

SEQ ID NO: 197298 - protein, 1342 aa, Glycine max
  Coding DNA Sequence Number=SeqID_80520
  Gene Ontology: Mol. function=RNA-directed DNA polymerase activity; Cellular component=chromatin; Biological process=chromatin assembly or disassembly
  Pfam annotation: Domain name=Chromo; Domain location=1229-1279; Score= 34.0; E_value=5.4e-07; Accession=PF00385.14; Description='chromo' (CHRromatin Organisation MOdifier
  Pfam annotation: Domain name=rve; Domain location=984-1135; Score =40.0; E_value=8e-09; Accession=PF00665.16; Description=Integrase core domain
  Pfam module annotation: Pfam domain module=Chromo::RVT_1::Retrotrans _gag::rve; Domain location=1229-1279::536-722::106-196::984-1135
MAESTRSKTSVDRLEDAIAKLTTSQFAMNSKIDDLLHRMSQLEAHQQQPQPLTPPSSSTGHTPSHNPQYRMKLDVPCFDGSDPTRWIFKITQFFEYYATPEQERLTIASFYMEGPALAWFQRMHRNAQLSSWSAFLHTIHSRFSTTTYEDPTGLLCKLQQRSSVSAYLSEFESQANKIIELPTPFVLSCFISGLNPSIRREVQVLQPLSLTQAVSYVRLQEEKLPDARRSSTYRALTPTAGSITPRSSSTNAPPPLLSTPARSSSTIPLKRLTPEELASRREKGLCFQCDEKFSRGHKCASSLFLLVMEDEENVEDVELILHTLSGHLAQETLRLRGFVNNQPISILIDGGSTHNFLHNRVVMRLGLTPTETTPLRVTVGNADVVLGVQWLKTLGPVLTDYDALTMKFIMNGKLIELQGDREKEFEQVSPSQLRRFAHTNPASTFFHIRIEATTETTPQMTHPIPEIETLITKYASLFQPLTTLPPSRATDHTINLLPNSIPVNVRLYRYPYFQKKEIEEQVAAMLARGFIQPSSSPFSSPVLLVRKKDDSWRFCVDYRALNAITVRDRFPIPTVDELLDELGGAWWFSKLYLMQGYHQILMNPNDISKTAFRTYQGHYEFRVMPFGLCNAPSSFQATMNQLFQPYLRKYIIVFFDDILIYSKTIHDHLLHLETAFQQQLEYLGHVVAGHGVTPIPEKVQAIQQWPTPRSPRALCGFLGLVGFYRRFIQGYATLAAPLTRLLCQGQFNWNQEATDAFQNLKNALTAAPVLALPDFSAPFVVETDASGAGMGAMLMQKGHPLAYFSKQFYPQLLNSSTYVRELAAIAAAYRAGKANIVADALSRAMEYQTATLYLLFVPRFVFLEDLRKELASLPAFLALRDSIQKDPKAHEDYALKEGLILHQGRIWLPSTSSFIKLLLEEFHQSPTRGGGHMGVQKTLQRLQDNFTWPSIKEDTRKFVASYVTCHFTKYDNRKTTGFLCLISVPTQPWEDLFMDFITGLPVYRDNTCIFVVVDRFSKGFHLGMLPTQHTAHTVALLFINMVGRLHGMPKSIILDRDPLFVSKFWRELFTLSGTKLRLSSAYLPQSDGQTEAEWSYNTSCHSATGMSPFEAVFELLRRKLLKAQDRMKTSVDRHRREQEFMVGDWVMVKLRPRRQTSVTGTAYSKLEKRYYGPFRVVERMGKVAYKLQLPEYSRIHPVFHVSLLKLAVAPITAAAIDLPPLTTDNHPVVTPLAIVASKIVPSETGPKHMVLVQWRGLPPEETSWEDWSILKTIHHLEDKVFLEGQGNVTRGGTEGVPSAREVQEASRTRPLRGREKENLFVISVRRVGCSVVRKLRESSPHL

SEQ ID NO: 197299 - protein, 109 aa, Glycine max
  Coding DNA Sequence Number=SeqID_80521
  Subcellular localization annotation: CTP_CleavageSite=56; ConfidenceScore=5.17e-01
MEQKTHFTSRKTKSSSGEGSTTSTAPSAKRCGNLKKRHQIAVALWVADGGAMAELRASRNSNMELQRHHANATQHTAPAPAPRRQTQHPAPCSRHGTPHQRTTHTTNGR

SEQ ID NO: 197300 - protein, 75 aa, Glycine max
  Coding DNA Sequence Number=SeqID_80522
  Homolog annotation: Hit_ID=Q1SDG1; Match level="QueryCoverage=69%, HitCoverage=4%, E-value=2e-07, Identity=50%"; Hit description =Integrase, catalytic region; Zinc finger, CCHC-type
MMEEGFAVNKPPMFKGANYDYWKEKMIAFESTHIDMWDVVEKGSHIPLDAQKNELCNDPPCRYDITTLNRENFNF

SEQ ID NO: 197301 - protein, 70 aa, Glycine max
  Coding DNA Sequence Number=SeqID_80523
MWKNKNSSRFNSSSKRSFCKKKSLMSTCEDLDDSSSDEDNEEEDNQYLMVDASTSKVEPALDASLDDEDP

SEQ ID NO: 197302 - protein, 189 aa, Glycine max
  Coding DNA Sequence Number=SeqID_80524
  Gene Ontology: Mol. function=oxidoreductase activity, acting on CH-OH group of donors; Biological process=alcohol metabolic process
  Homolog annotation: Hit_ID=Q8H052; Match level="QueryCoverage=58%, HitCoverage=18%, E-value=6e-40, Identity=72%"; Hit description =Putative mandelonitrile lyase
IFGKSNEYGVAHIYSVPNYTFMHNATTAPDVSYYDYIVIGGGTAGCPLAATLSQNYSVLLLERGGSPYGNPNISDLAAFGAALSDTSPTSPAQRFISEDGVINSRARVLGGGSCLNAGFYTRASPQYVSNLARPGKLSSPKRAGYFTPRGQKKLQNDPFALPYGYFPYSLPKCRKTFGIARQLVSSSSI

SEQ ID NO: 197303 - protein, 79 aa, Glycine max
  Coding DNA Sequence Number=SeqID_80525
YILCGTSRGYIYLGLTENKRGYISCGSVLVEGTSTRFKENKGGPLDPTDSDEQVRGALSSIYGYDVATAVGASDGASSL

SEQ ID NO: 197304 - protein, 96 aa, Glycine max
  Coding DNA Sequence Number=SeqID_80526
HIRWDHVVVKHRPERDMRKSGYVQTIPSETTGSMSMCIRFMHWFFMISHPFITPTQPIDPARHPPVMQNDTYMEPHIPQVPLSPAATPTQAPSDVE

SEQ ID NO: 197305 - protein, 137 aa, Glycine max
  Coding DNA Sequence Number=SeqID_80527
  Subcellular localization annotation: CTP_CleavageSite=21; ConfidenceScore=5.04e-01
MVLVVAPSGGGGGGNGRGGTVGSNGGGALSMVMLMATMVLVVPPCGGGGGDGGGSGGDNDTGNHINGGGNGIHASGDGDVDGMVVVEVVTVLVGLDTSSDLGRRWCDGGELGRDEKGWGHREREEGGRTERGKKVFS

SEQ ID NO: 197306 - protein, 483 aa, Glycine max
  Coding DNA Sequence Number=SeqID_80528
  Gene Ontology: Mol. function=nucleic acid binding; Cellular component= intracellular
  Homolog annotation: Hit_ID=Q6H4V9; Match level="QueryCoverage=97%, HitCoverage=51%, E-value=1e-106, Identity=47%"; Hit description =Putative RNA-binding protein 10
MLEKNGQILRVAYAKSILGPGSGTSGTSQSSSLAAAAIEAATFAQQYDSVGWAPKEYNPDAKQSTGPEVGAPQSGFVWDEASGYYYDAASGFYYDGNTGLYYDGNNGIWYSYDHQTQQYTPCTDQNQNKTSNNESEPSKVSDSSESKKVISAPATTVASVEKPASLADAVQAAAAAALAAEKKEKEKSKEIKLASKSSILANKKKMNNVLTMWKQRSHEGQATRVALEDNQPSVSADDRSYSSGHSAKNKLKNETMVRESNASNPGSHTTLAQVAAIDSRAQPRPVSNSLGGTVMGVIRGSGRGVVKSDTYSGSTSVASSMPSLPSANADAQTFATPFRTDVSALGSYTPSATVGSGRRRFSEMPQSASTHKEQPQTTYRDRAAERRSLYGSSSSVGNDLADLEIGDSNRDFASRKGDPMPFPPGVGGGRIVGDANLDTFEVITAEKAIDENNVGNRMLRNMGWQEGLGYASTLILDLDNIFL

SEQ ID NO: 197307 - protein, 63 aa, Glycine max
  Coding DNA Sequence Number=SeqID_80529
MREQPARTLQQPVEWILPTPTPYRLVEPVQLIKVSSSEEDLEEDPEELSPEPAMDAPDLSEDD

SEQ ID NO: 197308 - protein, 58 aa, Glycine max
  Coding DNA Sequence Number=SeqID_80530
MVNESGMRTLLRLGGVDGDPVLRGMRKRATYGVRRPWGRQMGSYWPKPSLANLDPTRA

SEQ ID NO: 197309 - protein, 96 aa, Glycine max
  Coding DNA Sequence Number=SeqID_80531
MEVKELIWARLDERKCDFRNLHLCRIFAVKLCSRILHKCRKMLLRRIDGDPVLRETRIWATWEYVSSVGGGQQGMVGLCAHCGCGKLVVHHRPTAT

SEQ ID NO: 197310 - protein, 130 aa, Glycine max
  Coding DNA Sequence Number=SeqID_80532
  Gene Ontology: Mol. function=nucleic acid binding; Biological process= DNA integration
MDDSSAYIFLNLANLAEGDDIIVAVISQVNVVTNKCVYLLHCVRDGEEQVYVGDSKTTLILGKGKVLLKLTFGKTLALSDVLHVRTIRVNLVCIALLRKVGVKVSFELDKIVMTKNNVFVGKGYYDQYIL

SEQ ID NO: 197311 - protein, 39 aa, Glycine max
  Coding DNA Sequence Number=SeqID_80533
MIEGEGLNFYHIVKGGPGGGLDFGRGSGGYGAPISPNIP

SEQ ID NO: 197312 - protein, 197 aa, Glycine max
  Coding DNA Sequence Number=SeqID_80534
  Gene Ontology: Mol. function=protein serine/threonine kinase activity; Biological process=protein amino acid phosphorylation
  Homolog annotation: Hit_ID=Q9C6K9; Match level="QueryCoverage=67%, HitCoverage=19%, E-value=4e-16, Identity=32%"; Hit description=Wall -associated kinase, putative
MATVDAAKERDEANLANLAMKKMQNVKLSELVDQSFGFESDQVVKRILTSVAGLAFRCVQRDNELSPSMDEVLEALNNFQNENYESENLEKEDDDGVISSTSSTEVHPPQPASQDSGQVGILMNNKLPSSLNSLTEKLEGWYVDLELAKRVRIMHIQKKGKHEVWWILHNVNLTKAVLTVNRLSDYYFLRRFSGHPS

SEQ ID NO: 197313 - protein, 498 aa, Glycine max
  Coding DNA Sequence Number=SeqID_80535
  Homolog annotation: Hit_ID=Q2HUT4; Match level="QueryCoverage=66%, HitCoverage=59%, E-value=1e-66, Identity=48%"; Hit description =Putative RING zinc finger protein-related
MGKPGEDHLSLPSAEDPRRNAAAASGCAVGLRCLVVLLFSVAVFLSALFWLPPFAHFADPKDLYLNSKYKENNIVRENVEYIGKGIQTNPEFGWEVGYLFQFGIGTMVHYYFPVSFDIVECDHDIVASFYVQKPVSLLEDNILQLSNDIFEEIGAPSTKVIILSLDPLPRSNTTKVVFAVDPDGKYSEMSAAAISLIRASFKYLVIRQSYLQLTTFLFGVPSVFEVLKFKGGITIIPQQSVFPLQTVQTLFNFTLNFSIYEIQSNFDELTSQLKSGLHLAPYELEDFQTGHTKLMWFSLLERLKQLAQTIMGHHSWNLGLNNTQFGRAKQVRLSSILQHSLHGSGGSGSPSPSPLPYPHHHYHHHHHHQSHHHNTHVFPETSPAPTPTTGEGATLHNFGAPAPARSVPAPGRSSYAQPPNCRFAHVTPAAPPTTAPHYPVASPWVGPPAHGFDSSVPALSPLPNVAFAHAEPPPKNEAAAEHLNSHFHGPSPSSCKYF

SEQ ID NO: 197314 - protein, 160 aa, Glycine max
  Coding DNA Sequence Number=SeqID_80536
MVVIKTIFGDNARMLNYPTRPSSRVEYPSTSSGITFDVKLREIFRFSGVQVFGKGKYLGTFIRITYRVKLEYFSNDHLQCQGEGSNQVEYLSTSIRITYGVKVREILRYSAKPSTRVLLNGFPLVLRKNEGYYLVFDLAGYPYSIQAPQASRSVVNKKAF

SEQ ID NO: 197315 - protein, 218 aa, Glycine max
  Coding DNA Sequence Number=SeqID_80537
MASLMHKIPSPRPSPTNTCPPPQKKKDKRKRGKGKKPEEVVFKLKKALEETNKEKNHALEANAQSVTKKTNLKVDVKKGARDMVIKENMVGFEKGLCQVRFKFEILDEFEFDLSKDVHEGVLMSINDIPKKNRHSSRPPTPPTETFMTNIASAKEEKRHPDDEKVNNHGSIEWCLEGKLCKRVEGGKPYKEIEGASVAKEVYLGRIPCKESKGESLVE

SEQ ID NO: 197316 - protein, 463 aa, Glycine max
  Coding DNA Sequence Number=SeqID_80538
  Pfam annotation: Domain name=Transposase_23; Domain location=289-359; Score=-8.0; E_value=0.0085; Accession=PF03017.5; Description =TNP1ENSPM transposase
  Subcellular localization annotation: CTP_CleavageSite=55; ConfidenceScore=5.75e-01
MATPPASPPPLSPPSPSPATALASPSTLKRTRKATQLRSLATRPPGAERPMVHVNPATGKADGPHKKKLRTYLGIVAHDKAKFDIPEAYDCRTNKKVLQTIGEQDPSWEDVREKAQAIQKQNTDPHVLSHGGYEYLEQKLMAEKIKKKLEEAAQSGSIEGVIDPPSPIRRHVKWKMGRHRENWADDDSLEEQASQGSFVPYGRQDLLTAAIGQPEHPGRVRAEPFFLHGSQRTGAADSTNKGLARGVDHIKSDSAADVILQPDPEVGPSAARVSTKGSYVDPSLTDPDTGDSDKCGLYIKENLSCLVALGRFYEGSTAVHNIPLLHGQVKVGVEEVKDAEALVPVPIDEVILVGQTLNTFLAWLTHLVKRLSDQPFAFETQKAYNTLTTAMTTVMVVVASTKMFGSPAIVVTTTRATSMTIAVDSIEEYRRFLWNILLKVAFAMDKKKHGTICAMIHSSPTRA

SEQ ID NO: 197317 - protein, 52 aa, Glycine max
  Coding DNA Sequence Number=SeqID_80539
MVRQNTTTEGGGVRGELAEVWEDYLLSIPSRDSDLVEAREGVAARRLVWNVL

SEQ ID NO: 197318 - protein, 110 aa, Glycine max
  Coding DNA Sequence Number=SeqID_80540
MVMPKRANTPLRVDPSKHCQYHRNLGHSTKECTTLKDKIKELINKAPSIETMTKVMTQTKIGREEKIDQEVALEREENTDQPRRVINTIAKGLQVKDVPLRQGKKHLGNV

SEQ ID NO: 197319 - protein, 98 aa, Glycine max
  Coding DNA Sequence Number=SeqID_80541
MILLNTRVLGLVECPSTFLTLTAKKYLGTRPSQIPEHFPHLTPKVHFGAHYGAQENYHVPQEEHGCYQVNGGSHLSTPRRDSEHVMKTCRGHSGVAAR

SEQ ID NO: 197320 - protein, 97 aa, Glycine max
  Coding DNA Sequence Number=SeqID_80542
MLRAPYPLQLPPSVTECLIHCGDHMTILRRFGPPLQWNVVVLDKGIGDKYITQPWYKFLQEGDFSHGDELSFYYRRVEKIWEVVIRRAIDWDDNDID

SEQ ID NO: 197321 - protein, 107 aa, Glycine max
  Coding DNA Sequence Number=SeqID_80543
  Homolog annotation: Hit_ID=Q6L517; Match level="QueryCoverage=34%, HitCoverage=8%, E-value=6e-11, Identity=81%"; Hit description =Putative lung seven transmembrane receptor 1
MEARSARYVQRNCKMAKDEDDSILQARVPPASLTQTKLSTLWEKKVLMIVIPLQVLANLASVVIGETGPFIKYWVTWNQVLVLRGVVGDGGFASGKGGDDGAVRRKE

SEQ ID NO: 197322 - protein, 117 aa, Glycine max
  Coding DNA Sequence Number=SeqID_80544
  Gene Ontology: Mol. function=ribonuclease H activity; Biological process=RNA-dependent DNA replication
  Homolog annotation: Hit_ID=Q1SZM6; Match level="QueryCoverage=93%, HitCoverage=51%, E-value=2e-17, Identity=35%"; Hit description =Ribonuclease H
MSPSPFVKLNVDGSSLGNPGASEFGGILRDHEALNLILHNGNASHPYNALISLIRNCINQPWNVTFMHTLREGNACADWLAKHGATHEDNLTIWHACSPQLDTLVLADRIGVVHFKT

SEQ ID NO: 197323 - protein, 57 aa, Glycine max
  Coding DNA Sequence Number=SeqID_80545
MLRVTTMMVVAIVVEPVAVTMVIWGCFKIRINLADRIDSSPTRRSDWVKLPIRSTMH

SEQ ID NO: 197324 - protein, 321 aa, Glycine max
  Coding DNA Sequence Number=SeqID_80546
MTSALSSIPPKGNNLLSAKCRAQLEISHFFPKVEFRLAIQAVDYKYVHQCKKMCFSFSFPKTLAQSPNPHPPPPITTGDRHKLSLLSIRPPNKEEHFNRSRIFKTHLKDLVENEALNPPFVVSSSSAFKLMDVNMRDLQTTQRGANKEISIKNRDFKHGCHHALVAVRGQTQNAREKERIVCECFRNNVVADHASVILGHILVSIDGCAKQDANTHITPIFPLIWVFEGCGARFTVEQEWDSEQNRGTSFVVQVEGTSTWVVVTENKRRYISCGSVQVEGTSTWLFKENKGGYIPCGSLLVKAFTRLKRNLKDRKSLGDWM

SEQ ID NO: 197325 - protein, 139 aa, Glycine max
  Coding DNA Sequence Number=SeqID_80547
MTFEEKTIYQTTLASIPHYTLLECVLGICFTVITILLQLPYEYIDNNPVPTIVFKGRPRTFHAFIICIIFAFSGATNALVAFNKSRFSRLCGYYAMASMASALAILLWALCCTYFWLQPLRKLLVCESQYDKTFDQNLN

SEQ ID NO: 197326 - protein, 52 aa, Glycine max
  Coding DNA Sequence Number=SeqID_80548
MVTTTTTLVGWNSDSNSNNDDINYEIVIVTVVVIMVTVATTGCVAVETAIAV

SEQ ID NO: 197327 - protein, 148 aa, Glycine max
  Coding DNA Sequence Number=SeqID_80549
  Gene Ontology: Mol. function=transition metal ion binding; Cellular component=cytoplasm; Biological process=electron transport
MICDLGQEYFHQAHAPMFDTLESDSKKPLYLGCKKSLTLFSAVLSLVNVKARYGWSDKSFTSLLKVVYDMLPEENKLPKSYYEVKILCPMGMEYQKIRACPNDCILYKYEYKEMHKFPRCKVSRYKVNDDDECSCDENTKKGPLAKVL

SEQ ID NO: 197328 - protein, 76 aa, Glycine max
  Coding DNA Sequence Number=SeqID_80550
MHAVPKLPEPLAIRTCTVKKSPLRMATCREHREPPRSGRGSAGTSGQQGAEQIAICIGGLRFTGIANMAGGLCFVL

SEQ ID NO: 197329 - protein, 73 aa, Glycine max
  Coding DNA Sequence Number=SeqID_80551
  Gene Ontology: Mol. function=transferase activity
  Homolog annotation: Hit_ID=Q1SP37; Match level="QueryCoverage=98%, HitCoverage=22%, E-value=3e-14, Identity=46%"; Hit description =Bacterial adhesion
MEVDALCRKGLSSLQKCATTLHILAYGSLADSVDEYVRISETNTVECLEQFVSSICTIFGNEYLRRPNSKDTE

SEQ ID NO: 197330 - protein, 61 aa, Glycine max
  Coding DNA Sequence Number=SeqID_80552
MDRVLHNRLIWWKTKTDSVWATNYQKLEDISEDMSFNLVRACPPNLKLNNRKIIELPVVVS

SEQ ID NO: 197331 - protein, 133 aa, Glycine max
  Coding DNA Sequence Number=SeqID_80553
MEENHTRSASMFTKNIRITMLLNNLQEVKHQNGKLFPQHPYRTCSQVKIMNEFEECNEELGSDIDQLKQQMEQILKILQALQMKASERTQAQPITLHLNRPGQYVDPAQAHLYGLSPNYIPLIAHNKTHSANG

SEQ ID NO: 197332 - protein, 639 aa, Glycine max
  Coding DNA Sequence Number=SeqID_80554
  Gene Ontology: Mol. function=protein homodimerization activity; Cellular component=extrinsic to plasma membrane; Biological process =early endosome to late endosome transport
  Homolog annotation: Hit_ID=Q15075; Match level="QueryCoverage=78%, HitCoverage=38%, E-value=3e-10, Identity=18%"; Hit description=Early endosome antigen 1
MDELANKIPGDFYAVDEAFEQPYSLQGFSTKENDVQEISLQALTDIDHRLAYFSEKLVNLHVLYVYLLGEESDLEAMDSTNNCILENLFEKAVTFDLLSGILDSEVRELDSFMDTLQEEIVDARHKIFSCKHLTEVFFMMDKKLHGSKESVKQFQQQLLELKIQSSQLQKTIEAFRHENCKTGKALNLSGNGQLTDVKAKSNDQMVEQRRYILRMLEKSLARELELERKLAESKNNEDLNLKLCYTEQVAFYMEEAAEVVWGRFLEADNTAEVLMGISKGIMGHLQVTEFNLNGYIQRENELRSKVQILIEQLKAKDASLEKLEACNVESAKEKSEVLALREKVKLLEEEQKDFELRINNVMAENEACHEHLIEMENFVESLKESIDIAENRAESAEAKVTQLTETNLELTEEVNFLKGSASTAEKKVGSLEKQLRELDIQLQNAKASSEASQEQQNMLYTAIWDMEILIEELKSKVAKAETNKESAAEQYFVLSETNLELNKELDILRSRTVSLKTSLDQASNAKSSRAKEIDTKTKLIMDMVMQLASERERINNQLHALKQENKHLVEKLNNTKIDASFDACNNGLNNRNEDQASNNDSSNDSCAKSSDEEGIDLFNKTFQAGRGKLQTIPKFWYIN

SEQ ID NO: 197333 - protein, 102 aa, Glycine max
  Coding DNA Sequence Number=SeqID_80555
MSGLSLGVEYICQVDFGFVASAKSIMGLNVGPGLFSELNDGVESTPTLPAGVELDCWCQALAAGAGSASGFEDGMLMLDRLVIETKMIVSCARWYWASRKTM

SEQ ID NO: 197334 - protein, 66 aa, Glycine max
  Coding DNA Sequence Number=SeqID_80556
MSYTELMPLLLQNLLVVPIPMQPQELPYPMGHREPSVSVIEQGGEQLKRMRVEDVKTPIDDIFEEM

SEQ ID NO: 197335 - protein, 118 aa, Glycine max
  Coding DNA Sequence Number=SeqID_80557
  Gene Ontology: Mol. function=RNA-directed DNA polymerase activity; Cellular component=intracellular; Biological process=RNA-dependent DNA replication
  Homolog annotation: Hit_ID=Q0ZCD0; Match level="QueryCoverage=77%, HitCoverage=8%, E-value=1e-28, Identity=64%"; Hit description =Integrase
MEPHYKGINRSYYMYKIMMEEEYRLVRQLQRKLNPSMKEEVPKEVLKLLKAKLIYLISNSDWVSPVQVVPKKRGMIMVCNEKNDIILTQTITGWRMCIDYHKLNDSTRKDYFPLPFMD

SEQ ID NO: 197336 - protein, 165 aa, Glycine max
  Coding DNA Sequence Number=SeqID_80558
  Gene Ontology: Mol. function=mercury ion binding; Cellular component =integral to membrane; Biological process=response to mercury ion
  Homolog annotation: Hit_ID=Q7BRH8; Match level="QueryCoverage=61%, HitCoverage=96%, E-value=1e-38, Identity=86%"; Hit description=Inner membrane Hg(II) uptake protein
  Pfam annotation: Domain name=MerC; Domain location=4-120; Score =210.7; E_value=3.4e-60; Accession=PF03203.5; Description=MerC mercury resistance protein
MGLITRIAGKTGALGSVVSAMGCAACFPAIASFGAAIGLGFLSQYEGLFIGILLPMFAGIALLANAIAWLNHRQWRRTALGTIGPILVLAAHIAAAGRTAVNCQNNVADGNSRSHHRKGKIHDHPENHRDDLRLVRGSRQGSLGESARRAIGAGVLSEGHSATRH

SEQ ID NO: 197337 - protein, 115 aa, Glycine max
  Coding DNA Sequence Number=SeqID_80559
MRTCFSKETKLPTDQSNICFLDEKQCVYRGRRHFVSKRPFRGNTGSNKNRRKPLKVYQSHTGQGLTFSPKVKVYDKLGFWLKACRTAGHDICQGLASGSGIKGMSYIISMIHMQQ

SEQ ID NO: 197338 - protein, 58 aa, Glycine max
  Coding DNA Sequence Number=SeqID_80560
MGRKQRSNLFVDELRLLWCFALRLPGDAVLLDESSISRGPDALAGGDRHSVEMTETRN

SEQ ID NO: 197339 - protein, 337 aa, Glycine max
  Coding DNA Sequence Number=SeqID_80561
  Gene Ontology: Mol. function=protein dimerization activity; Cellular component=nucleus; Biological process=regulation of transcription
  Homolog annotation: Hit_ID=Q1SP83; Match level="QueryCoverage=92%, HitCoverage=100%, E-value=1e-115, Identity=72%"; Hit description =AUX/IAA protein
  Pfam annotation: Domain name=AUX_IAA; Domain location=26-299; Score =416.0; E_value=5.4e-122; Accession=PF02309.7; Description=AUXIAA family
MSRALEHDYIGLAENPSMDGKNSSSLNLKETELRLGLPGCESPERKSGSALCLFGKELQNNNNNVCSLKAGAKRGFSDAIDTSSVTEGSQGASALFSPRGGNVGKPLIGLDTQTNTTIKEVGAVPQSAKPVQENNDQFAATNAHAIAPAAKAQVVGWPPIRSFRKNTMASNLTKNNDEAEGKSGFGCLYVKVSMDGAPYLRKVDLKTYNNYMELSSALEKMFSCFTIGQCNSPGLPGKDGLSESSLRDLLHGSEYVLTYEDKDGDWMLVGDVPWEMFTDSCRRLRIMKGSEAIGLGSSKEVLQGPWKNLGAKTNAEKTPLDQSGGYSLKHIKISKGV

SEQ ID NO: 197340 - protein, 61 aa, Glycine max
  Coding DNA Sequence Number=SeqID_80562
  Homolog annotation: Hit_ID=Q1SP75; Match level="QueryCoverage=79%, HitCoverage=12%, E-value=5e-09, Identity=59%"; Hit description=WD40 -like
MATYTTGTREGDYWKIMKIVAAPFALGALMGSSSFGVSLITITAHPHLGPSTLISARDFHD

SEQ ID NO: 197341 - protein, 174 aa, Glycine max
  Coding DNA Sequence Number=SeqID_80563
MLASLTDTGIFISIQITVQEQHMQLKLKDQEIIRTKRLTAGHAEGSEIGVEAIEAEEAGAGDGGVGRGDADEAARCEEEGESEEDEEDDGDAGEVEGAGTGDSGEVIGGSGGDAEENVLVLLSLGFVGVYIGVGVVVSVGVDAAGGECPLQHGGRGEIGMAVSRGAAAALCLWR

SEQ ID NO: 197342 - protein, 392 aa, Glycine max
  Coding DNA Sequence Number=SeqID_80564
  Gene Ontology: Mol. function=RNA binding; Cellular component =cytoplasm; Biological process=regulation of transcription
  Homolog annotation: Hit_ID=Q1SP68; Match level="QueryCoverage=79%, HitCoverage=92%, E-value=1e-69, Identity=51%"; Hit description=KH, type 1
MEQQKMNSIWRPIATNASSYEESLMKDALVKSVDGGKVQETGCSTSSNISNEHLTKVVADSATSSSQLQDNAENRVLEGDSSVSTEKHSISWDCYDRAGFYEDQPLQKLDNVEQECRWKKIFEDSVNDSAFPGVVAILRRSHPATEGISINSGNSASEKIQAIIDETVNSRSLDYSHFISLPLAIHPELVDKLINFQHSILEIGSCMDENTDTETDSNEDESTTTDTKKVDQLSKENSGVAVELKVNDNSKSVKVNVTNIPLVSYAPKASKSSAPSDLGIDKSIFIKPKTFHLTVLMLKLWNKERIKTASEVLQECIKGSLAKARVLYAPVEETGEVIIDAYVEAGLVLENDAKQKLKLHATVMNARHRKRNKNKWTRKVDSFDARGIFKQY

SEQ ID NO: 197343 - protein, 88 aa, Glycine max
  Coding DNA Sequence Number=SeqID_80565
  Gene Ontology: Cellular component=membrane
MDMPDDKDAPPTSKKTSTKPIYSKFSQQELPAWKPILTPGWVEEADMRRVAFLPHMLKMQWLIFKAIPPTRPASPNGLLVHFLPNKTC

SEQ ID NO: 197344 - protein, 918 aa, Glycine max
  Coding DNA Sequence Number=SeqID_80566
  Gene Ontology: Mol. function=hydrolase activity; Cellular component =nucleus; Biological process=tRNA processing
  Homolog annotation: Hit_ID=Q9BQ52; Match level="QueryCoverage=88%, HitCoverage=87%, E-value=1e-61, Identity=26%"; Hit description=Zinc phosphodiesterase ELAC protein 2
  Subcellular localization annotation: CTP_CleavageSite=31; ConfidenceScore=5.67e-01
MAQVSKFGYFLLHSSLPKPSNIQFRSLLTVLASSSKRHRRKSTTPKPMEVKEESSSFNKRRAQGRDKNDISKKNLLLKVRKLNPINTISYVQILGTGMDTQDTSPSVLLFFDNQRFIFNAGEGLQRFCTEHKIKLSKIDHIFLSRVCSETAGGLPGLLLTLAGMGEEGMSVNIWGPSDLKYLVDAMRSFIPNAAMVHTKSFGPISNIDGPIVQCQSKLLDPIVLIDDEVVKISAIILQPNCIEGQLLTPSESSSRKSMDHNLETLDSPNGKKLSAAKPGDMSVVYVCELPEIKGKFDPEKAKALGLRPGPKYRELQLGNSVKSDRQNIMVHPSDVLGPSVPGPIVLLVDCPTESHLEALLSVQSLASYCDQADNQPEAGKSVTCVIHLTPSSVVSCSNYQKWMKKFGSAQHIMAGHEKKNVEIPILKASARIATRLNYLCPQFFPAPGLWSLPNHNSSKFGCLASSEGSFSELSEVISAENLLKFTLRPYAHLGLDRSCIPTTAASSEIIDELLSEIPEVLEAVRHVSQLWQECSQTKEDLTPVADHGMMIEEPWLCANGIPACLENIRRDDLEIVLLGTGSYGVTGADDAVRTLRCIWISHIHADHHTGLARILALRRDLLRGVPHEPLLVVGPRQLKRYLDAYQRLEDLDMLFLDCKHTTAASLEAFEDDFPGNSVNSRNLNNNNGDLIASKVDSTLFARGSRMQTYFKRPGSPVDKDVVSPILKKFKEVIQEAGLKALISFPVVHCPQAFGVVLKAEERTNTVGKVIPGWKIVYSGDTRPCPELIEASGGATVLIHEAKVCEYSSLNFLRATFEDAMVEEAIARNHSTTNEAIEMGQSANAYRTILTHFSQRYPKIPVFDETHMHKTCIAFDMMSVNVADLSVLPKALPYLKLLFRNEMMVDESDDVVEAVTSAS

SEQ ID NO: 197345 - protein, 305 aa, Glycine max
  Coding DNA Sequence Number=SeqID_80567
  Gene Ontology: Mol. function=nucleoside-triphosphatase activity; Cellular component=membrane; Biological process=defense response
  Homolog annotation: Hit_ID=Q1SP75; Match level="QueryCoverage=91%, HitCoverage=61%, E-value=1e-116, Identity=76%"; Hit description=WD40- like
  Pfam annotation: Domain name=WD40; Domain location=131-167; Score =8.5; E_value=3.7; Accession=PF00400.22; Description=WD domain, G -beta repeat
  Pfam annotation: Domain name=WD40; Domain location=192-230; Score =17.7; E_value=0.043; Accession=PF00400.22; Description=WD domain, G -beta repeat
  Pfam annotation: Domain name=WD40; Domain location=234-271; Score =35.3; E_value=2.2e-07; Accession=PF00400.22; Description=WD domain, G-beta repeat
  Pfam annotation: Domain name=WD40; Domain location=90-127; Score =16.4; E_value=0.1; Accession=PF00400.22; Description=WD domain, G -beta repeat
  Pfam module annotation: Pfam domain module=WD40::WD40::WD40::WD40; Domain location=131-167::192-230::234-271::90-127
  Subcellular localization annotation: CTP_CleavageSite=50; ConfidenceScore=5.79e-01
MDDSAKSPDPTASFAFRSSSTTPPQSNLLRSHSTKETPFTNLIHSPPRLSCPTLSRSLQNSPLHHRRQFSPPPSPPSPTKLSDSDPQTTYHCASSVLRNDGQILSISLSSNGLVYTGSDSNLVRVWKLPEFTECGQLRTKACRVVALQVSNDTVYAAYGDGKIRVWRRTWDKVLKHVRLATIPKTLGYVRSYIAGKDKTMHKGLITSMVINTAEDILYTASLDKTVKVWRISDMKCIETIKAHTEPINAIIVADDGVLYTASDDATVRVWRRNFCSHDQPHSLTVTLHAKYSPVKALTLTPDAGI

SEQ ID NO: 197346 - protein, 141 aa, Glycine max
  Coding DNA Sequence Number=SeqID_80568
  Gene Ontology: Mol. function=protein binding; Cellular component =membrane; Biological process=cell division
  Homolog annotation: Hit_ID=Q655Y4; Match level="QueryCoverage=76%, HitCoverage=28%, E-value=4e-29, Identity=68%"; Hit description=LEM3 -like
  Pfam annotation: Domain name=CDC50; Domain location=1-93; Score= -145.0; E_value=0.0053; Accession=PF03381.6; Description=LEM3 (ligand- effect modulator 3) family  CDC50 family
MRTAALPTFRKLYGKIEVDLEVNDEIEIAIENNYNTYEFGGKKKLVLSTTTVMGGKNPFLGTAYLFVGGLSLLCAIGFILLYVIKPSILLFMQTSWGPVLPALEQKSREYQMTSMNSNLSNLTILYISLCEARPSFRDYYY

SEQ ID NO: 197347 - protein, 249 aa, Glycine max
  Coding DNA Sequence Number=SeqID_80569
  Gene Ontology: Mol. function=transcription factor activity; Cellular component=nucleus; Biological process=regulation of transcription, DNA-dependent
  Homolog annotation: Hit_ID=Q1SP67; Match level="QueryCoverage=68%, HitCoverage=88%, E-value=3e-57, Identity=62%"; Hit description =Pathogenesis-related transcriptional factor and ERF
  Pfam annotation: Domain name=AP2; Domain location=43-107; Score =145.6; E_value=1.3e-40; Accession=PF00847.10; Description=AP2 domain
  Subcellular localization annotation: CTP_CleavageSite=30; ConfidenceScore=5.16e-01
MTETARCHETPSSSTSNSSTSKPLKTETPKQSKAKRNRDPTKHSDYHGVRMRNWGKWVSEIREPRKKSRIWLGTFATPEMAARAHDVAALSIKGHTAVLNFPNIVNMLPRPVTCAPRDIQAAAAEAAAMVEFDRESSEAESTELSEIVELPNIEESFDSVESRSEFALIDSVDSWVYPPPMTVGSICDMMMLGEHECGLFQFGTDHQTYKNKIGFNGKNEMSAFSPIRYGRWWDRISFLSLSVTTKGVG

SEQ ID NO: 197348 - protein, 87 aa, Glycine max
  Coding DNA Sequence Number=SeqID_80570
MDMNIGALISGQISSIAQSNSFRLKFPALITALWKARGVASDSLTYESLSLAINLAYIKKNYWNMDDLTVNFRGARKARVSCSTVGK

SEQ ID NO: 197349 - protein, 76 aa, Glycine max
  Coding DNA Sequence Number=SeqID_80571
MVIPHTFSPSIGDYVRWHAKTNYGHSAPCHPGSIVSVDTQRQIMVILHLVSTKRNEFDSSAGREIHWSNGVSLERN

SEQ ID NO: 197350 - protein, 149 aa, Glycine max
  Coding DNA Sequence Number=SeqID_80572
MTQKLVTRGDTLRLSAPRHSVTPSVIDEQRPMWSSGPFSEMSASSGGDFFKSHKLSRTTGGGPDDTRRQNLVIPHPFAIQTQSCPMVRRDKIWSFCTLCHPEAAGPMTRRDKIWSFRTPLPFRHSRVRWRAETKFGHSAPFVIQRRRAP

SEQ ID NO: 197351 - protein, 53 aa, Glycine max
  Coding DNA Sequence Number=SeqID_80573
MLGIDAILPRKGPITKAMTRRLQKDWARDTGEGPRVLMSLRVDVGPMDYDSIV

SEQ ID NO: 197352 - protein, 76 aa, Glycine max
  Coding DNA Sequence Number=SeqID_80574
MPKPLKRLDWEVEKSENFVASWGGGGDFEVTHLHSGHNMKRCPLPPPVVPEEENEEPSGAAEEVAEGATQGAAAGV

SEQ ID NO: 197353 - protein, 117 aa, Glycine max
  Coding DNA Sequence Number=SeqID_80575
  Gene Ontology: Mol. function=ATPase activity, coupled to transmembrane movement of substances; Cellular component=integral to membrane; Biological process=protein transport
  Homolog annotation: Hit_ID=Q1MN92; Match level="QueryCoverage=99%, HitCoverage=15%, E-value=3e-48, Identity=82%"; Hit description =Putative ATP-binding component of ABC transporter
  Pfam annotation: Domain name=ABC_tran; Domain location=1-87; Score= -3.3; E_value=3.4e-07; Accession=PF00005.17; Description=ABC transporter
GYQTVVAADGAPLSGGQKQRISLARAFFCYPKFVVLDEPNSNLDTQGEQALAKALLHAKRQGITTVTITQRPALLQCVDKIMVLKDGSVAMFGERMDVLKALSGNGRQASQSPQIEG

SEQ ID NO: 197354 - protein, 126 aa, Glycine max
  Coding DNA Sequence Number=SeqID_80576
  Gene Ontology: Mol. function=RNA-directed DNA polymerase activity; Cellular component=mitochondrion; Biological process=DNA integration
MDKYLHKRNFVKFPYDLIFTCSNPSMFDEFKKEIMKEFEMIDIGLMSYYLGIELNCYMENPTTTHLKAAKRTLRYIKGTTNFGLHYSTFDYYKLVGYSDSDWSGDVDDRKSTNGFVLYMGDTAFTW

SEQ ID NO: 197355 - protein, 130 aa, Glycine max
  Coding DNA Sequence Number=SeqID_80577
  Gene Ontology: Mol. function=nucleic acid binding; Cellular component= intracellular
  Homolog annotation: Hit_ID=Q1RZD5; Match level="QueryCoverage=91%, HitCoverage=29%, E-value=2e-16, Identity=39%"; Hit description=Zinc finger, C2H2-type
MWAKAKPDVDPYGAKRKAGKPPTIDDNHHSGFSVEKKPKREWSCGLCQITTTNEKGLNNHLEGKKHKAKASLRTKKIGLDARLDGQKLQRGITSTNIGILEPRKEDQVVQNSQGLGGLDNENEIATSKET

SEQ ID NO: 197356 - protein, 355 aa, Glycine max
  Coding DNA Sequence Number=SeqID_80578
  Gene Ontology: Mol. function=nucleoside-triphosphatase activity; Cellular component=membrane; Biological process=transport
  Homolog annotation: Hit_ID=Q1H129; Match level="QueryCoverage=100%, HitCoverage=96%, E-value=1e-140, Identity=55%"; Hit description=ABC transporter related
  Pfam annotation: Domain name=ABC_tran; Domain location=1-139; Score =51.2; E_value=3.6e-12; Accession=PF00005.17; Description=ABC transporter
  Pfam annotation: Domain name=ABC_tran; Domain location=220-355; Score= 40.7; E_value=4.2e-11; Accession=PF00005.17; Description=ABC transporter
  Pfam annotation: Domain name=oligo_HPY; Domain location=142-190; Score=11.6; E_value=4.7e-05; Accession=PF08352.2; Description =Oligopeptidedipeptide transporter, C-
  Pfam module annotation: Pfam domain module=ABC_tran::ABC_tran::oligo _HPY; Domain location=1-139::220-355::142-190
MTALNPLFTIGEQIVETIVAHQPLSRTEATRKTLELLTRTGIRQPEKNINSYPHQLSGGQRQRAMIAMALSCKPKLLIADEPTTALDMTIRARIVKLLIELQEEDVREHGEQGMAILLITHDLNLVRKFAHRVAVMERGRLVETAETQTLFAQPQHPYTIKLINSIPERNVSPVAADARTLLEAHKLRVEYPLPRKGWRGLLRSHTFTALHGADVTLREGETVGIVGESGSGKSTLAQAVLNLIKVKSGSIEVDGAPLYQLSKRLQRELRARLQVVFQDPFGSLSPRQTVRQIVGEGLALHFPELTEQERYARIVQILSEVGLSAQVLDSYPHEFSGGQRQRIAIARAFVLSPKV

SEQ ID NO: 197357 - protein, 117 aa, Glycine max
  Coding DNA Sequence Number=SeqID_80579
  Subcellular localization annotation: CTP_CleavageSite=66; ConfidenceScore=5.25e-01
MFAHSIKGCRPLGRACGVLIPSPSRLFRFFRRFPQINVGGDSARIPFVEHASRESRVALPPKGRLRQSSIFGLKKTNCKWYSQCIDQTLVISPVKQRLSLETPLVTWKTYMMIIPVK

SEQ ID NO: 197358 - protein, 215 aa, Glycine max
  Coding DNA Sequence Number=SeqID_80580
  Gene Ontology: Mol. function=transcription factor activity; Cellular component=intracellular; Biological process=regulation of transcription, DNA-dependent
  Homolog annotation: Hit_ID=Q982X9; Match level="QueryCoverage=59%, HitCoverage=55%, E-value=6e-29, Identity=59%"; Hit description =Transcriptional regulator
MPALLQQMFPQLFYRHRRDFFDCRVNDAGLDQPAGRKYLPRLVGRRIGNESAPIALGLHEALIGKHLQRRAHHRAADIEQPGDRQWRRAKCLEWPGHDPHAMNREIRLCGQGSWARPVCSRVLARSVGRRQTGIMGDSRSATIHSATVQQAGCISLTIEFATGSSLPPGWKNTMSSFAAKTVMAIAVAAATIAPFNSASAGDWDRHDRRDAALLG

SEQ ID NO: 197359 - protein, 141 aa, Glycine max
  Coding DNA Sequence Number=SeqID_80581
DVQKKTDVIQKQNTAPHVLSRGGYEYLEQKLMAEKTKKKLEEATQFKSTEGVIDLPSPIRQHMKWKMARTKKTGQMTSEEAKEIAETIISHFQLRIDSLEEQVSQGSFVPHGRQHLLIAAIGRPEHPGRVRAAGASVTIKQ

SEQ ID NO: 197360 - protein, 94 aa, Glycine max
  Coding DNA Sequence Number=SeqID_80582
MTDFLRFFRCFPQINVGGDSTHFPPLEDEPVSLASLARKRLHVELGGLGSSSPMESFASRRSVTAEWRRRKGHWRCHFKEKMSQEQAHHYRSHG

SEQ ID NO: 197361 - protein, 113 aa, Glycine max
  Coding DNA Sequence Number=SeqID_80583
MDGIKNSDNDIEDQNRKMALGGASRQVGCLKMTSLRHISVEYQHVISLIDIKFEILLELSPDSWVKLNDHNNDKAGCGGLIRDSLGRWVHGFARNLGCCSIVGNNLGPATNQG

SEQ ID NO: 197362 - protein, 1004 aa, Glycine max
  Coding DNA Sequence Number=SeqID_80584
  Gene Ontology: Biological process=pollen maturation
  Homolog annotation: Hit_ID=Q5Z6I4; Match level="QueryCoverage=99%, HitCoverage=99%, E-value=0.0, Identity=45%"; Hit description =Putative Osnop
  Pfam annotation: Domain name=C2; Domain location=4-85; Score=66.7; E _value=7.2e-17; Accession=PF00168.20; Description=C2 domain
  Pfam annotation: Domain name=C2; Domain location=520-602; Score=69.4; E_value=1.2e-17; Accession=PF00168.20; Description=C2 domain
  Pfam annotation: Domain name=GRAM; Domain location=671-737; Score =78.0; E_value=3e-20; Accession=PF02893.10; Description=GRAM domain
  Pfam module annotation: Pfam domain module=C2::C2::GRAM; Domain location=4-85::520-602::671-737
MLRLYVCVLEAKDLPVKDTYVKLRLGKFKCRTRILRNTSNPVWNKEFGFNVHGAEDMLVVSVVNHDNINECRVTNGSVEFVGEVRIPVGSVAFEDKQTFLPTWFSLESPKSGKFFNEYCGKILLTVSLHGKGRSSFINHKHSSNSTIAVDNSRDLEGLHVACQVPCDKMGAGKQLLKAIANGLHRIFKKKEENSKSGDSSELSTSLSDYEDSVQENSSPCSFEEAIALMESGDDKPEMPENLPGGVLVDQIYLVSPNDLNVFLFAPNSQFSKDMVELQGTTNVQEGPWTWKNGDMSCLTRVVTYTKAATKLIKAVNAIEEQTYIRVSRKEFAILVSVSTPEVPYGNSFRIELLYKIMPGEASSGEESSHLVVSWGIVFLQSTMMKGMIEGGARQGLKESLVQFSDQLALNFKVLDKADLPDKEHLLATLQTEDQWNWWQTITYFWNFTVASTIFMCGPSLPQGLEFSGLELPDSFGELITSGILIIQLQRVYNMVSHFVQARFQMGTDHGLKANGDGWVLTVALIEGVDLASLESEGLSDPYVVFTCNGQTRSSSVKLQMPDPLWNEILEFDAMEEPPSVLHVEVFDFDGPFDQDVSLGHAEINFLKHTSTELADMWVMLEGKLAQSSQSKLHLRIFLDNNNGVETIKEYLEKMEKEVGKKLNLRSPQRNSTFQKLFALPPEEFLIKDFTCYLKRKMPLQGRLFLSARILGFHANLFGHKTKFFFLWEDIEEIQVLPPSLATLGSPTLVIILRRGRGLDARHGAKTQDEEGRLRFHFQSFVSFSAASRTIKALWRTRILNPYQKEQISEEHEDQESFVILEDSASILEDEEKMSRIFSAELPIKMKSVMGIFDGGNLEHKIMQRTGCMNYETTSWEQVKPDFFERHVSYQFNRHVSVFGGEVTCTQQKFPNTNTGGWTVIEVMALHSVPFADHFHIHFRYEIEKSSLGDCACKCDAYIGIMWLKSSKFQQRINRNITAKFNLRLKEIFELVQKEILLMSQNSHG

SEQ ID NO: 197363 - protein, 56 aa, Glycine max
  Coding DNA Sequence Number=SeqID_80585
MENWQTALHNNFAGLQTRSEERRIGGQRYAITSRGSRLEGGGDMNSARQLHSWVSE

SEQ ID NO: 197364 - protein, 189 aa, Glycine max
  Coding DNA Sequence Number=SeqID_80586
  Gene Ontology: Mol. function=RNA-directed DNA polymerase activity; Biological process=RNA-dependent DNA replication
MGSLDHLEERLRVIEGVGDYAFANLEELFLVPNIVTPPKFKVPDFDKYKGTTCLKNHLKMYCRKMGAYAKDEELLNMGKKGHESFKEYAKRWRDLAAQVAPPMTEKEMITIIVDTLPMFYYEKMVEYAPSSFADLVFVGERIKVGLKRGKFDHPALMNSKTRANEEDENEGETLAVTTIPTRPNFPSAQ

SEQ ID NO: 197365 - protein, 229 aa, Glycine max
  Coding DNA Sequence Number=SeqID_80587
FSSYRQQKVYTNNHSGISARQRDSKVSMTDLVSAEDNVNLHVSTGLSAAIAKGADDDVSLCVLYGFSSYKQQKVYTNNHSGIYGRQRESKVSMTDLVSAEDDVNLHVSTGLSAAIEEGFSSYRQQKVYTDNHSGISARQRDSKVSMTDLVSAEDNVNLHVSTGMSAAIDEGRRRRLSMTDLVSAEDDVNLHVSTGLSAAIEEGFSSYRMQKVYTDNHSGISGRQRDSKV

SEQ ID NO: 197366 - protein, 169 aa, Glycine max
  Coding DNA Sequence Number=SeqID_80588
MASGFHVLKMCNSSLASGNRLPMLCNRLPEKKTLEIAMAAELIHDRVEMECLEGVWETLEGNERCRFRGTIRLTATSLRNVEWILPTPAPYRLVEPVEVIKVSSSEEDPEEDPEELPPEPAVDALDFPEGDEDPLPDVDSPEDVMSASEADSMEESGPGGIATSGDSSS

SEQ ID NO: 197367 - protein, 219 aa, Glycine max
  Coding DNA Sequence Number=SeqID_80589
  Gene Ontology: Cellular component=integral to membrane
  Homolog annotation: Hit_ID=UPI00006AB8F1; Match level="QueryCoverage =51%, HitCoverage=97%, E-value=2e-14, Identity=38%"; Hit description =conserved hypothetical protein
MAASGLDAESAQGDVDGGASGWHVDACFVEGRLAHHLRVVAEAVAFHRHADQVGVELAVVVLVVGEQHGIAAGRYTLEREVSAVAAGRRLLGLHGLGLAVPGGSAVDQRNAQGAALRVDVVHGHGQVGGVGTGGQGQCSQGGAEQGGADHGSGSGSVCGGVAPVWVARCTGFRASGHRFDVPEVTFCAGPIAAGVCGGQHLAMPSLFRHLLRPLSLAGL

SEQ ID NO: 197368 - protein, 433 aa, Glycine max
  Coding DNA Sequence Number=SeqID_80590
  Gene Ontology: Mol. function=nucleoside-triphosphatase activity; Cellular component=membrane
  Homolog annotation: Hit_ID=P96063; Match level="QueryCoverage=53%, HitCoverage=71%, E-value=5e-90, Identity=74%"; Hit description=PhnT
  Pfam annotation: Domain name=ABC_tran; Domain location=2-122; Score =53.2; E_value=8.6e-13; Accession=PF00005.17; Description=ABC transporter
MKVEDNVSFGLRAQKQPRGLIAERVTEALKIVGMADYATRYPHQLSGGQQQRVAIARAIAVRPRVLLLDEPLSALDAQIRHNMVEEIARLHRELPELTILYVTHDQTEALTLADKIGIMKDGSLIAHGGTHELYHYPPNRFSAEFLGRANILQATALKDSTEPGLVSVSCGGGLINAFSRGGLHGRSDASAVRCCRRSGADCDDPREPAAARGGQAGALLRTWRCGSDRGAMMAQTLTLARPARNLRPYLWLALPLLVLATLFFYPLLLIAEQALRDASGNLSLETFWQVIDSKRFIGALLNTLQIAVFATLGCLVLGSVLALILVFIPFPGSQLVSRVIDTFIALPTFLITLAFTFIYGSAGLLNGTLMALFAFELPPVDFLYSINGVILAEITVFTPLVMRPLMAGLRQIDKSQLEAASILGAHPLRVITQ

SEQ ID NO: 197369 - protein, 523 aa, Glycine max
  Coding DNA Sequence Number=SeqID_80591
  Gene Ontology: Mol. function=nucleic acid binding; Cellular component= intracellular
  Homolog annotation: Hit_ID=Q6H4V9; Match level="QueryCoverage=40%, HitCoverage=23%, E-value=2e-77, Identity=66%"; Hit description =Putative RNA-binding protein 10
  Pfam annotation: Domain name=DUF1777; Domain location=167-357; Score=- 82.0; E_value=0.012; Accession=PF08648.2; Description=Protein of unknown function (DUF1777)
  Pfam annotation: Domain name=RRM_1; Domain location=312-385; Score =54.2; E_value=4.2e-13; Accession=PF00076.12; Description=RNA recognition motif. (a.k.a. RRM, R
  Pfam annotation: Domain name=RRM_1; Domain location=469-522; Score =13.3; E_value=0.0085; Accession=PF00076.12; Description=RNA recognition motif. (a.k.a. RRM, R
  Pfam annotation: Domain name=zf-RanBP; Domain location=412-441; Score= 24.0; E_value=0.00052; Accession=PF00641.9; Description=Zn-finger in Ran binding protein and others
  Pfam module annotation: Pfam domain module=DUF1777::RRM_1::RRM_1::zf -RanBP; Domain location=167-357::312-385::469-522::412-441
MDPGRYALHQGWDNNSVIVALEGYGAVHDPNFRVGGSYDERRFIDERYPRDAVYQRNNFHRDILDREAYLPPGPPVGHWSQAKRRGYDEDYALDRESRRFQRPYHESYNQIDGFRDREIDTYPEYERFRDGYTGIENYGDRGYDKPARFVGNDHGDDYAYDDDYDYKSRASSHHHREDSHERDYDHSRHSYDSDYERGSRRDSNWRQRESRDRERDKRGHSRERDLSPHRRRERSRSHSRSRSRSHSHSHSRSQSRGHDDHPRSRSPRGRSHGRSYKADSYSDSRYDKSERRRDRDDKRQREHYSVAPSATVVVKGLSQKTTEEDLYQILAEWGPLRHVRVIKERNSGVSRGFAFIDFPSMGAAQGMMDKLGDDGLVVDGRKLFFEYSSKPTGGPGPDGAMKSGHNYKSITVPSDWMCTICGYINFARRTSCYQCNEPRTDDAPAADISLSNSAAIGKKGSEAGPTHVLVVRGLDENADEEMLRYEFSKHAPIKDLRLVRDKFTHVSRGFAFVHFYSVGTTCD

SEQ ID NO: 197370 - protein, 50 aa, Glycine max
  Coding DNA Sequence Number=SeqID_80592
MDLVPELISFEFSLIHHLEKERESLEEPKTRNSSWQWLEFVTSQVKGLVS

SEQ ID NO: 197371 - protein, 200 aa, Glycine max
  Coding DNA Sequence Number=SeqID_80593
  Gene Ontology: Mol. function=transferase activity, transferring hexosyl groups; Cellular component=cytoplasm; Biological process =metabolic process
  Homolog annotation: Hit_ID=Q1SIP8; Match level="QueryCoverage=90%, HitCoverage=40%, E-value=1e-48, Identity=50%"; Hit description =Probable indole-3-acetate beta-glucosyltransferase T27E13.11- Arabidopsis thaliana
MSVLYISLGSFLSVSCAQMNEIVSALNTSGVCYLWVVRGEVSWLKEKCGDRGLVVPWCDQLKVLSHPSVGGFWSHCGWNSTLEAVFGGIPMLTFPLFLDQVPNSRQILEEWKNGWELKRSDLGSAELITKDEIVQVIREFMDLGKRKEIRDRALEFKGICDRAVAEGGSSNVNLDAFIKDVLCVQRSLRGRGYVMYKIGK

SEQ ID NO: 197372 - protein, 126 aa, Glycine max
  Coding DNA Sequence Number=SeqID_80594
  Homolog annotation: Hit_ID=O64732; Match level="QueryCoverage=77%, HitCoverage=21%, E-value=4e-08, Identity=38%"; Hit description =Putative glucosyltransferase
MEPPFDHLLRRLHPPVTALVADVELHFPVAVARRSNIPVALLWTMSASFYLTLHQLGSLVRNHSLKVDVLGRVSKVTAKYDYEEHIPGISAAQLADLRTVLRENDLRFLQLELECISVVPKADCLI

SEQ ID NO: 197373 - protein, 120 aa, Glycine max
  Coding DNA Sequence Number=SeqID_80595
MKNAIMWGFANARHWLCAWHLLCNANSNVGREPSKLRLKQVNHQQAEDVDTGTINEAVRDLVVVKLKGLVEVEKLEHLPIREAIIVKIVVQLVTIKGHAQLGKKYPKCLEPVLLMSPMVT

SEQ ID NO: 197374 - protein, 165 aa, Glycine max
  Coding DNA Sequence Number=SeqID_80596
MARFCSVVLSRHIPDYLKEEEEKDSRSEVRVRVGGRRVGVGVGVDTGIPYPYPYPTFGYRGKPEPEPIPGQLGYYPSKSGRVRAGTHRKLRFFEKWIPIRRVYNHMVVRVYTFVQVALTYHKGFVDDCLRWCGRGVPEQSLGGVPKELESDIRVSRRCLYVYQRR

SEQ ID NO: 197375 - protein, 91 aa, Glycine max
  Coding DNA Sequence Number=SeqID_80597
MQETPFKLTYNTEAMILVEIGEPSLRRGMFNMTNNSESLAVELDLAEEVRSEARVHEEACKKRNDVYKLQDMAGMVVPRTWNVTYLRPYYS

SEQ ID NO: 197376 - protein, 234 aa, Glycine max
  Coding DNA Sequence Number=SeqID_80598
MGIGESGSEGDLSFSSSSMSNSERKEEVAVRGNVRVEVSERMGKKDKGVVDEGPGEVKVHKRDDVAMGGGKVRKGKEGKFSLITILGYERVFAEVNSYLTQFQTHESVKRLKKGINMTISHDAELLIVESCGTNKCVFMRMAKEVMKGYDYKKLKSLVVDDQNDLEKTKKRKHVVDRGVEENNANKGSACEIENEKEVEERNQAEVVRSLTMTEKETGTEAVQKSTEKEKWVEV

SEQ ID NO: 197377 - protein, 76 aa, Glycine max
  Coding DNA Sequence Number=SeqID_80599
  Gene Ontology: Mol. function=ADP-ribose diphosphatase activity; Cellular component=cytosol
  Homolog annotation: Hit_ID=Q94B74; Match level="QueryCoverage=77%, HitCoverage=21%, E-value=8e-13, Identity=58%"; Hit description=Nudix hydrolase 2
MDLSIKILPATNDVHGGVIVDLKEPMDSEDFATLLRSSLLHWKQQGKDGVWIKLPIELVNLAETAVKKIIQFKKFK

SEQ ID NO: 197378 - protein, 289 aa, Glycine max
  Coding DNA Sequence Number=SeqID_80600
  Gene Ontology: Mol. function=nucleoside-triphosphatase activity; Cellular component=nucleus; Biological process=transcription from RNA polymerase II promoter
  Homolog annotation: Hit_ID=Q8H1F9; Match level="QueryCoverage=73%, HitCoverage=45%, E-value=2e-93, Identity=78%"; Hit description =Putative binding protein
MSVPMETELSTDQNGASSQHSLSVPEDKVLVPVEVTLKLSSTAKIDDVRSAVEGMLEKRSLSYNDGPIPVPLDDAFLADNVQRICVCGCDTDEGMHNDNVLLFWQVKPVVHVFQLSEEGPCEDISSDGQSSSFNEWILPAKEFDGMWESLIYESGLKQRLLRYAASALLFTEKGVDPFLVSWNRIILLHGPPGTGKTSLCKALAQKLSIRFNSRYPQAQLVEVNAHSLFSKWFSESGKLSGFESQSGLWSIDCGLLRHRVCKMKASRRLLALLEDDAGCGWFLLVQESG

SEQ ID NO: 197379 - protein, 294 aa, Glycine max
  Coding DNA Sequence Number=SeqID_80601
  Gene Ontology: Mol. function=protein serine/threonine kinase activity; Cellular component=integral to membrane; Biological process=protein amino acid phosphorylation
  Homolog annotation: Hit_ID=P47735; Match level="QueryCoverage=42%, HitCoverage=13%, E-value=3e-15, Identity=39%"; Hit description =Receptor-like protein kinase 5 precursor
MEYYNRVSELNTTTTNDEQTTTPMPTVSSTRRVKVVEYEQVPERRVVYEEKVAMTTIVTTLQSIEIAQTMEQDLQHYRTHVSEVERESSTTEFPNAYVSLNKKVVYEESEHEGSHHHHLFHRHHHPETRESVKVVEYEQVPQRRVGEVVYEENSRTVAEGRGYCSGEEVADKLEGFEAGEGSEARRNVVGEVLAGEVEVLERDHSGEGVPNGAHEVVLGEVEDDEVASRRSNDGGEGGVDEGDDAAENGGKGAGEGGEGEAHGGNRGGERVAGDAAPPAWVDNRRDRDPMSSRN

SEQ ID NO: 197380 - protein, 236 aa, Glycine max
  Coding DNA Sequence Number=SeqID_80602
  Pfam annotation: Domain name=Di19; Domain location=45-235; Score= -6.4; E_value=1.4e-08; Accession=PF05605.3; Description=Drought induced 19 protein (Di19)
MTKECNSPKEQQPQVLAIRKNLEKLKLELHNINRGIQSYILRQRVNGTWGAPRYVIGEEDDTESNGDDDDDARSLLQCPSCDFEIDFSSAHTHLEEMHCYDPKNLLCPVCDETLGEEAIWVAQNSSAQKRAWKSDKSSISISSGDSVVVLEKKLPARGSKHEPVPDPVLSPFVGNVSVPNSSGIHPGEGSSRNATYISNAKGSGTDAPQDSGDEQDIEERRLRASFVQELLSSALI

SEQ ID NO: 197381 - protein, 134 aa, Glycine max
  Coding DNA Sequence Number=SeqID_80603
MVMSAVVVTVAVEVEISMVVAVTTWWCDTNNGGIVGSGGGHDNDSNIDGGDGNNVGDDGDENVSDSNASGVGGGCNKVGGGDHDDNIDGGGGSYASIEGDVGDNGGSNGGSGVGVCGNDSDGDKKKSHCQKWKM

SEQ ID NO: 197382 - protein, 70 aa, Glycine max
  Coding DNA Sequence Number=SeqID_80604
MGTTSRAVRLLFALLPMASQTGAEAMSKMSRPSLDAVPNQFRTVAEYCRDLRGLEGTLGDLKGLIAFFVR

SEQ ID NO: 197383 - protein, 57 aa, Glycine max
  Coding DNA Sequence Number=SeqID_80605
  Homolog annotation: Hit_ID=Q2QLI7; Match level="QueryCoverage=89%, HitCoverage=5%, E-value=7e-14, Identity=69%"; Hit description =Protein kinase domain containing protein, expressed
MDFPCYRIGEILDGRYEVTTAHGRGVFSTVVRTKNLNMGNGELEEVAIKIIHSNDTM

SEQ ID NO: 197384 - protein, 241 aa, Glycine max
  Coding DNA Sequence Number=SeqID_80606
  Gene Ontology: Mol. function=hydrogen-translocating pyrophosphatase activity; Cellular component=integral to membrane; Biological process=proton transport
  Homolog annotation: Hit_ID=Q8PH20; Match level="QueryCoverage=99%, HitCoverage=35%, E-value=6e-81, Identity=66%"; Hit description =Pyrophosphate-energized proton pump
  Pfam annotation: Domain name=H_PPase; Domain location=1-238; Score= -168.7; E_value=1.2e-17; Accession=PF03030.7; Description=Inorganic H+ pyrophosphatase
MAELPSEIRDITDPLDAVGNTTKAVTKGYAIGSAALAALVLFADYTHNLQAAHPGQEFRFDLSDHTVIIGLLIGGLIPYLFGAMAMEAVGRAAGAVVEEVRRQFREIPGIMQGTGKPQYDKAVDMLTRSAIREMIVPSLLPVAVPVVVGLLLGPRALGGLLIGTIVTGLFVAISMTTGGGAWDNAKKYIEDGHFGGKGSEAHKAAVTGDTVGDPYKDTAGPAINPLIKIINIVALLLVPLL

SEQ ID NO: 197385 - protein, 164 aa, Glycine max
  Coding DNA Sequence Number=SeqID_80607
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=100%, E-value=6e-26, Identity=32%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=1-162; Score= -43.3; E_value=0.032; Accession=PF02389.6; Description=Cornifin (SPRR) family
MSSPSEDFAPSLSWGYTPFPLEDYTSSPSEGYTLLPSEEYTLSPSEDYMSSPSEDYTCSLSEDYTFSPSEGYTPSPSADYTSSPLEGYTPSPLEDYTSSPSEGYTSLPSEGYTHSPSKDYTSSPSEGYTSLPSEGYTSSPSMDFPCSPSEDYTASPSEGYTPSP

SEQ ID NO: 197386 - protein, 101 aa, Glycine max
  Coding DNA Sequence Number=SeqID_80608
  Gene Ontology: Mol. function=transporter activity; Cellular component= intracellular; Biological process=transport
  Homolog annotation: Hit_ID=Q9FKT2; Match level="QueryCoverage=79%, HitCoverage=13%, E-value=1e-31, Identity=73%"; Hit description =Similarity to phosphatidylinositol/phosphatidylcholine transfer protein
MDGKVDDEDIQEDFEFEEQEEVLQHYPQGYHGVDKEGRPVYIERLGKAHPSRLMRITTIDGYLKYHVQEFEKALEEKFPACSIAAKRQISSTTTILNVQGL

SEQ ID NO: 197387 - protein, 151 aa, Glycine max
  Coding DNA Sequence Number=SeqID_80609
  Gene Ontology: Mol. function=solute:hydrogen antiporter activity; Cellular component=integral to membrane; Biological process =regulation of pH
  Homolog annotation: Hit_ID=Q75L14; Match level="QueryCoverage=86%, HitCoverage=18%, E-value=1e-17, Identity=43%"; Hit description =Putative Na+/H+ antiporter
MLELDLVTNRQSEKRALSIIVDEMSLPFISGIDLSLILRKTVVGTDEVSFAWFLVFMGVVISITAFLVLTRILIELKLLTHHVSSIAMVVATLFNGVDAWILLALAIMLASDDVNGHVHKSPLVSLQVLLSGMAFIAFMMIIIWLGDLTKR

SEQ ID NO: 197388 - protein, 142 aa, Glycine max
  Coding DNA Sequence Number=SeqID_80610
  Gene Ontology: Mol. function=transporter activity; Cellular component= intracellular; Biological process=transport
  Homolog annotation: Hit_ID=Q9FKT2; Match level="QueryCoverage=42%, HitCoverage=13%, E-value=4e-09, Identity=56%"; Hit description =Similarity to phosphatidylinositol/phosphatidylcholine transfer protein
MLVLALRGCFGLLHRSFLMPKLLQRYSQLPDFLGGTCTCPGQGGCLRSSKGPWNDPDIMKLQLYPFLISQGQCSDTSTAESGSEYQITTIVVIIVLLQPRKCLKVMNFTSLGEQSSHNNDTGNIACVENSTGTAVSNWFSFV

SEQ ID NO: 197389 - protein, 532 aa, Glycine max
  Coding DNA Sequence Number=SeqID_80611
  Homolog annotation: Hit_ID=Q49L63; Match level="QueryCoverage=74%, HitCoverage=68%, E-value=1e-102, Identity=47%"; Hit description=GEX1
  Pfam annotation: Domain name=DUF1056; Domain location=249-301; Score=- 6.0; E_value=0.034; Accession=PF06341.2; Description=Protein of unknown function (DUF1056)
QYVEDKLDSIEEKSEHLLHGSRQIHDSLDSIGSHTKQVAQTAKNLEGHIDSVLTHSRSVYDQTTKIALSQTQIKEGQENMKRSLKDGVAMLKDSYNYLGKEIEKIRNEAIEIENEVIKVGNAMSSRMDNLQSKAGDIGNMTGISLDKQQQLLDGQSTALEGLNSLTEFQAKALEESRKTLQYFAEYGHRQHEELIQRQQQIKGFHDRLMENSREILSSQESFESKQASMFVVLDRIFALQNTLLLESRMIKAFFVYSILIFVIFMLTSTKQTYNIRPFLYIELCATLVVEVLIIRLTSDNIEHQTWIISMVRLFFMVAALVQLLHAIFTYKNYETLNHQMLLTLINKVNSMQKEKELSWDLDSDYGDWSEWVDADLPDDVNCLDDPDYILPQEVAENSMTGLDPQSLIPATKTLAPLEPLVGAHWTHELPLHTSLAVWDYEVPEMQRAIGTTYGQVHGSVRKKGAVNGCKCLVGLIPQQRSCDGQDDAGVVSCGIRKSSDRGCPQGSTNAVPGQATKCTKTIQLWLYFNVTL

SEQ ID NO: 197390 - protein, 186 aa, Glycine max
  Coding DNA Sequence Number=SeqID_80612
  Gene Ontology: Mol. function=oxidoreductase activity; Biological process=electron transport
  Homolog annotation: Hit_ID=Q1S594; Match level="QueryCoverage=85%, HitCoverage=42%, E-value=2e-57, Identity=71%"; Hit description =Oxidoreductase family, NAD-binding Rossmann fold, putative
  Pfam annotation: Domain name=GFO_IDH_MocA; Domain location=8-130; Score=134.2; E_value=3.5e-37; Accession=PF01408.12; Description =Oxidoreductase family, NAD-binding Rossmann fold
MGENSKTVRLGILGCANIARKVARAIGLSPNATLCAIANRSKEKAEKFAAENGFPASVRVYGSYDQVLEDPGVDAVYFPLPTSLHVRWAVMAANKKKHVLVEKPVALEVAELDRILEAVESNGVQFMDCSMWLHHPRTAHIQDLLFSVPLSANNSIGPVRFRDATDATVIAIARQQFKTMIIIIVV

SEQ ID NO: 197391 - protein, 744 aa, Glycine max
  Coding DNA Sequence Number=SeqID_80613
  Gene Ontology: Mol. function=binding; Cellular component=nuclear pore; Biological process=protein import into nucleus, docking
  Homolog annotation: Hit_ID=Q1S595; Match level="QueryCoverage=64%, HitCoverage=99%, E-value=1e-161, Identity=61%"; Hit description=IMP dehydrogenase/GMP reductase
  Pfam annotation: Domain name=HEAT; Domain location=104-141; Score =2.0; E_value=25; Accession=PF02985.12; Description=HEAT repeat
  Pfam annotation: Domain name=HEAT; Domain location=145-181; Score =8.7; E_value=3.7; Accession=PF02985.12; Description=HEAT repeat
  Pfam annotation: Domain name=HEAT; Domain location=190-226; Score =12.4; E_value=1.3; Accession=PF02985.12; Description=HEAT repeat
  Pfam annotation: Domain name=HEAT; Domain location=421-457; Score =5.8; E_value=8.5; Accession=PF02985.12; Description=HEAT repeat
  Pfam annotation: Domain name=HEAT; Domain location=462-499; Score =6.9; E_value=6.1; Accession=PF02985.12; Description=HEAT repeat
  Pfam annotation: Domain name=HEAT; Domain location=507-544; Score =16.5; E_value=0.093; Accession=PF02985.12; Description=HEAT repeat
  Pfam annotation: Domain name=HEAT; Domain location=549-585; Score =12.2; E_value=1.4; Accession=PF02985.12; Description=HEAT repeat
  Pfam annotation: Domain name=HEAT; Domain location=590-629; Score =7.2; E_value=5.7; Accession=PF02985.12; Description=HEAT repeat
  Pfam module annotation: Pfam domain module=HEAT::HEAT::HEAT::HEAT::HEA T::HEAT::HEAT::HEAT; Domain location=104-141::145-181::190-226::421 -457::462-499::507-544::549-585::590-629
MDPETEQGSEFSIELQSKAFQVLSSNDNTAMETLFSHLFYSPHSEQLRSQALEFFQCCKHHHPDLLFIKLFFLLRSTPLPETRANAARALHLLNPSHLWPNLKPIAQAHLKAHFLNFLSDEPSLHVLRLASYLLAQTVSVIFKTHQTWPELLNFLLSSISSDENKRREVAALVFARLPNDCRFLVHNALRDNKRLLHASFLRCLASSSPDVQVAAFGAVVSLIPLFSETKLFHELLRALMVGVFTLLHGYEGSYFKIAFAELINLVSRQPQLLKPYMNDMVLDVLQIAESGGLSDETHRLAFELVMAMAEEKEYENVFANLPYRIVSKLFLVPMKMLQRLAEDDGERELKNEKVFDVYEFGMKSLKKLCVVLGASKAVPVAFEVFRLHLDDDAAYWKERHAGITMLSVIAEEFSDEMVLMENFLVGVVTKILKSMQDSHTQVRLATFKFMETPTNFVQVVQILYHHRLVHAFCTALDNEQVVKVKEQAASAMQFFLKNTLPESLTLNKTAETVLGKLLPLIQDKDSSEIRGIALSTLNIVAQRCHEVANKYCAIYLPILLEACKDYNYYIREEAARGIRICAELGTQQLKPFINRILSELGVLMNNPSPLNEKAHDIAVSALGRICEFHRECIDGSQMVPAWLSFLPLRNDLIEAKLMHEQLCLMAERFDKDLLGADSQNFIKIIVVLLEIIDKGDKLATAQTIQQVENLLRQLGRCIPRSAFDTIFSSLNAQQRALLLSLLYS

SEQ ID NO: 197392 - protein, 271 aa, Glycine max
  Coding DNA Sequence Number=SeqID_80614
  Homolog annotation: Hit_ID=Q49L63; Match level="QueryCoverage=85%, HitCoverage=46%, E-value=4e-47, Identity=38%"; Hit description=GEX1
MVDHRSHLLVFILLLFLLRGESWGWFSSSQETPSSDKAHANEGNFRVPSAEFSIESFNDHKGVKLIENAKKKMISSNSCWQNAYQHLFAGCSEILAIDEKRSRLAWHLSDCFQRDSGRAHAFKYETERLVTELKTSAQYVEDKLDSIEEKSEHLLQGSRQIHDSLNSLDSHTKQVAQTAKNLEGHIDSVLTHSRSVYEQTTKIALSQIQLKEGQENMKRSLEDGVAMLKDSYNYLGKEIEKLRNEAIEIENEVIKVWRCYVIKDGQPAKQS

SEQ ID NO: 197393 - protein, 249 aa, Glycine max
  Coding DNA Sequence Number=SeqID_80615
  Gene Ontology: Mol. function=nucleic acid binding; Cellular component= intracellular
  Homolog annotation: Hit_ID=Q39263; Match level="QueryCoverage=72%, HitCoverage=82%, E-value=4e-29, Identity=41%"; Hit description=Zinc finger protein 4
  Pfam annotation: Domain name=zf-C2H2; Domain location=107-129; Score =19.3; E_value=0.014; Accession=PF00096.16; Description=Zinc finger, C2H2 type
MKQHFDLEVVASEEYESEVSSLVTSNISIQETYAGPCSDNLTKFFNVTNPIELHLHSDSISLDLTLKFNNNDLVVRNSAGISFSSTSESSINDPPSQTNPANNPRVFSCNYCKRKFFSSQALGGHQNAHKRERTIAKRAMRMGIFSERYESLASLPFNGSFRSLGIKAHSSLHHGFVPTTKSSARFEQGYVGLPIFLEEDEEELLWQGSYHQVPSEGGHTHQNFSLSGSSILSFVGENANHPPELTLKL

SEQ ID NO: 197394 - protein, 91 aa, Glycine max
  Coding DNA Sequence Number=SeqID_80616
MTQPNNPEISILIETHRAHGLSSNCYIKLQTHAGGLRPISDVSSDLTIEVGASTFALDKTKLYDGCPRTIVVMHQHYVGFATKTDFDQGIF

SEQ ID NO: 197395 - protein, 521 aa, Glycine max
  Coding DNA Sequence Number=SeqID_80617
  Gene Ontology: Mol. function=protein serine/threonine kinase activity; Cellular component=integral to membrane; Biological process=protein amino acid phosphorylation
  Homolog annotation: Hit_ID=P43298; Match level="QueryCoverage=99%, HitCoverage=58%, E-value=1e-177, Identity=61%"; Hit description =Putative receptor protein kinase TMK1 precursor
  Pfam annotation: Domain name=APH; Domain location=215-401; Score= -1.9; E_value=0.0076; Accession=PF01636.13; Description =Phosphotransferase enzyme family
  Pfam annotation: Domain name=LRR_1; Domain location=16-38; Score =13.9; E_value=0.57; Accession=PF00560.23; Description=Leucine Rich Repeat
  Pfam annotation: Domain name=LRR_1; Domain location=40-61; Score=5.9; E_value=22; Accession=PF00560.23; Description=Leucine Rich Repeat
  Pfam annotation: Domain name=Pkinase; Domain location=214-467; Score =88.1; E_value=2.7e-23; Accession=PF00069.15; Description=Protein kinase domain
  Pfam annotation: Domain name=Pkinase_Tyr; Domain location=214-467; Score=11.6; E_value=3.5e-13; Accession=PF07714.7; Description =Protein tyrosine kinase
  Pfam module annotation: Pfam domain module=APH::LRR_1::LRR _1::Pkinase::Pkinase_Tyr; Domain location=215-401::16-38::40-61::214 -467::214-467
MGLEGTIAPEFGLLKSLQRLVLADNNLIGPIPKELAFLPGLVELNVANNRLYGKITSFKSHVVLTTNGNKDIGKDKPSLGPRSSPLGPLNSTAPNRSEENDGKRSLHVVVIVFVVIGGVVLVLVIGFLVFCLFRMKQKRLSKVQSPNAMVIHPRHSGLDNENVKITIAASSLSVDVSGIGMRTMAGSEAGDIQMGEAGNMIISIQVLRNVTDNFSEKNILGQRGFGTVYKGELHDDPKIVVKRMESGAISGKGATKFKSEIVVLTKVRHRHLVSLLGYCLDGNEKLLVYEYMPQGTLSKHLFNWMEEGLKPLEWNRRLTIALDLARVVEYLHSLAHQSFIHRDLKPSNILLGDDVRAKVSDFGLVRLAPEGKATIETRIAGTFGYLAPEYADIGLVWMLAIHFKSMAKYLSKKMYVNKDSFQKAIDHTIELNEETFASIHTVAELAGHCCAREPYQRPDAGHVVNVLSSLVELWKPSDQSSEDVYGIDLAMSLPQALKKWQAYEGRSQMESSSSILLPPMI

SEQ ID NO: 197396 - protein, 574 aa, Glycine max
  Coding DNA Sequence Number=SeqID_80618
  Gene Ontology: Mol. function=RNA-directed DNA polymerase activity; Cellular component=chromatin; Biological process=chromatin assembly or disassembly
  Pfam annotation: Domain name=rve; Domain location=234-390; Score =113.6; E_value=5.6e-31; Accession=PF00665.16; Description=Integrase core domain
MTTAPVLALPNFTLPFIIETDASNTAMGAVLHQHGHPIAYFSKSFCQQLQHASAYVRELHAIIATQFYLAKLLGYDYDIQYKAGTSNIVANLLSRRDEPSSGQYLVLSVPHPEFLTQLKATLMASSKFQKQREAIQSQPEAHPEFSISDDFIIFKGAIWLDSQNPFIPSLLHEYHATPVGGHFGIKKTLHRLQSNFQWHNMIKDIKTFVRECAVCQQIKHITRKSAGLLQSIPMLARVWEDLSMDFVTHLPNSQGFTTIIVVVDRFSKGFHFGALPTQFTAFIVATLFMDTICKLHGFPRSIISDRDPIFISLFWKELFKMSDTTLRMSTAYHPQTDGQTEVMNRTLEQYLHSFVHHQPLSWFRFLALAEWSYNTSQHASTGLTPYEVIYGKAPSTFSSYLRGSSRNDVVDSVLGTREEVHALLKRKLLKAQENMKFFANQSRREVVYEVDQMVYVKLRPHQQSSLRSQPSNKFTKRYFGPFRVLERIGKVAYRLQLPEGSKLHPVFHCSLLRPHYGPLELPQAPLPPDASHNSPILEPLTILDSRVDLSTQPPTRMVLVQWVGVPLEDSTWER

SEQ ID NO: 197397 - protein, 242 aa, Glycine max
  Coding DNA Sequence Number=SeqID_80619
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=86%, HitCoverage=79%, E-value=1e-56, Identity=47%"; Hit description =Similarity to MADS-box DNA-binding protein
  Pfam annotation: Domain name=SRF-TF; Domain location=9-60; Score =58.0; E_value=3e-14; Accession=PF00319.9; Description=SRF-type transcription factor (DNA-binding and dimerisation domain)
MTRKKVKLAFIANDSARKATFKKRKKGLMKKVSELSTLCGIDACAIVYSSYDPQPEVWPSPMGVQRVLSKFRRMPELEQSKKMVNQESFLRQRIMKAKDQLKKQRKDNREKEMTQLMFQYLSAGKIMHNISMVDLNDLAWLIDQNLKDINRRIEVLTKNVQSQPQIAAPVVTDVVAKVEDNGQGSQHGQQGFDINVDLMQKQNWFMNLMNNGSGDGGAGNEAMPFVGDVNQQNGFWPNPFFH

SEQ ID NO: 197398 - protein, 89 aa, Glycine max
  Coding DNA Sequence Number=SeqID_80620
MVAEACWAALYWRQATAVDLSGKPINSWHLSPAPQPPRAPRPPLLPVLSAMRVNEQYQQHTNSSRGPREVKQYVNSSSDINLNIRLGMI

SEQ ID NO: 197399 - protein, 52 aa, Glycine max
  Coding DNA Sequence Number=SeqID_80621
MGGNLNVDRSKVEDVEGKSTARVLASQHCSVYACTCVSLFAFAFATLAAYAQ

SEQ ID NO: 197400 - protein, 562 aa, Glycine max
  Coding DNA Sequence Number=SeqID_80622
  Gene Ontology: Mol. function=RNA-directed DNA polymerase activity; Cellular component=chromatin; Biological process=chromatin assembly or disassembly
  Pfam annotation: Domain name=RVP_2; Domain location=327-460; Score= -35.0; E_value=0.00054; Accession=PF08284.2; Description=Retroviral aspartyl protease
  Pfam module annotation: Pfam domain module=RVP_2::Retrotrans_gag; Domain location=327-460::95-185
MAEHGTHRTTTDRLEEAITALSERHSDLANKVEAMCECLSHLSHPTPPSTQPSFPSRPPVKLDVPRFDGHDPLGWIFKISQFFEYQGTPEEERITVASFYLDGPALSWFQWMFRNGFIMSWSALLQAIEARFAPSFYDDPRGTLFKLTQRSSVTEYLTEFERLANRITGLSPSVLLSCFISDLSPEIRREVQAFQPISLPQATSLARLQEDKINDRKKHYSRPSPSSSFPPPQPPSSHPNSNLHTKPKTPFIQRTQEDMAYKREKGLCYNCDEKWSSSHRCKGRVLLLIADSDESSPTGSSFDEQTPTLPHEPNPDPLEPHSTFDPTPFQPHISLYAMAGVLATNTFRLYGSINNTHVIILINSGSTHNFIQPRIAKFLNLPFEDTIPLRVMVGNDSVMDCKQLCAATKLIVQEHEFTVTLRVLPVSGAEVVLGVEWLRTLGPVVTNYTSFTMQFSHEGKPINLHADVQSNSFLASATQVRRMLSTSSTSGLFHLALLPTPPIDQPPHPSHTIPAINNILLKYQALFQQPSSLPPSRHHNHHINILPAANPINVRPYRYPHF

SEQ ID NO: 197401 - protein, 463 aa, Glycine max
  Coding DNA Sequence Number=SeqID_80623
  Gene Ontology: Mol. function=protein serine/threonine kinase activity; Cellular component=cytoplasm; Biological process=protein amino acid phosphorylation
  Homolog annotation: Hit_ID=Q84RS1; Match level="QueryCoverage=96%, HitCoverage=77%, E-value=0.0, Identity=76%"; Hit description=ZIK1 protein
  Pfam annotation: Domain name=Pkinase; Domain location=15-262; Score =150.7; E_value=4e-42; Accession=PF00069.15; Description=Protein kinase domain
  Pfam annotation: Domain name=Pkinase_Tyr; Domain location=11-260; Score=18.0; E_value=1.4e-13; Accession=PF07714.7; Description =Protein tyrosine kinase
  Pfam module annotation: Pfam domain module=Pkinase::Pkinase_Tyr; Domain location=15-262::11-260
MDSFWDSCLPLTVKWECRYRAFDELEGIEVAWNQVKVADLLRNSEDLERLYSEVHLLKTLKHKNIIKFYNSWVDTKNENINFITEIFTSGTLRQYRKKHKHVDLRAVKKWSRQILEGLLYLHSHNPPVIHRDLKCDNIFVNGNQGEVKIGDLGLAAILQQANSAHSVIGTPEFMAPELYEEEYNELVDIYAFGMCLLELVTVEYPYIECTNAAQIYKKVTSGIKPASLAKVADLEVKAFIEKCIADVSERLSAKDLLMDPFLQSDNDNDSVGQSSRSQTHHSGNSSHIAVEPSREFTVEGNIRNIHFPFDIEADTSISVAGEMVEELELTDQDVTTIARMIDSEIRYHIPSWNFSETPLDINHQDSSCTSETRPETSPMKNDSIASPGSLALEILPSGRRYWSDSPRGVGGNSPSQHFTSILSNETGVNAEEGNLITNGDISANDCVDGTAERECDEIADSPS

SEQ ID NO: 197402 - protein, 53 aa, Glycine max
  Coding DNA Sequence Number=SeqID_80624
MVLGAGTVKVVIVVVVGRVKAENQMAFIKTTLPFRCGFDFFVATKMKTTRMCR

SEQ ID NO: 197403 - protein, 55 aa, Glycine max
  Coding DNA Sequence Number=SeqID_80625
MSHHHLFPTAMLPGSSLWFHKGERRATGGDGVRERKPKSKATTRKAWLMVKEGRL

SEQ ID NO: 197404 - protein, 77 aa, Glycine max
  Coding DNA Sequence Number=SeqID_80626
MLPSLLHCMVVEYSFSVVVHGHAGNVLIGATLCLVAVFNGCERRMKVAGIFMVVAGGDALIPVIQRRDERENWDFLY

SEQ ID NO: 197405 - protein, 342 aa, Glycine max
  Coding DNA Sequence Number=SeqID_80627
  Gene Ontology: Mol. function=DNA binding; Biological process =regulation of transcription
  Homolog annotation: Hit_ID=Q1S588; Match level="QueryCoverage=99%, HitCoverage=64%, E-value=1e-53, Identity=46%"; Hit description=Myb -like DNA-binding domain, SHAQKYF class, putative
  Subcellular localization annotation: CTP_CleavageSite=35; ConfidenceScore=5.29e-01
MPLEGIFIEPTSTSIPDLSLHISPPSTSSFSSLICSNNNNNNNTSGGGGGINYEAHNSRSTNFPSQAHTELSLGRNFSVGGGGRGGGALEEPPPHNNNINNNPYYQTQKAHLQHLHQHHSNASRATTSTTTSSSNHMSHINYGVSLLDVSSEGMRPIKGIPVYHNRSFPFLPLEHSRSDKDHHAKMCLYHHMPTYPSLSSSCSPLCPSSSSSSPAAPYFVATAATAGGLDPMSYLSCSGGTTNPAAHRAATATRFNGFSGEAFKSHHPLHHHHHSSSSSSSPQYGVGPGPSHHEVSSGLMRSRFLPKLPAKRSMRAPRMRWTSTLHARFVHAVELLGGHESN

SEQ ID NO: 197406 - protein, 91 aa, Glycine max
  Coding DNA Sequence Number=SeqID_80628
  Gene Ontology: Mol. function=DNA binding; Biological process =regulation of transcription
  Homolog annotation: Hit_ID=Q1S588; Match level="QueryCoverage=77%, HitCoverage=15%, E-value=4e-23, Identity=71%"; Hit description=Myb -like DNA-binding domain, SHAQKYF class, putative
MLKEKFVMKINQAYYKVHIYSREPWQQNNSNDIDGFRPPIFQSQQISGGHQIQECDSTQLKNSLSGSNLECKNPSLEFTLGRPDWNGKGQA

SEQ ID NO: 197407 - protein, 95 aa, Glycine max
  Coding DNA Sequence Number=SeqID_80629
MRFSTVVAAAKDSSIVPYTILEEISRKDNVAKSRHWWWCQRWVMTEQRVDLAGGGVVGSGCLRRRFRMEHENHVQKQALKGAKIMEASFQEFQKR

SEQ ID NO: 197408 - protein, 47 aa, Glycine max
  Coding DNA Sequence Number=SeqID_80630
MDFENGCILSGGGDATEALASVVDGHDWETGWDFGVSPESHIKAFKS

SEQ ID NO: 197409 - protein, 389 aa, Glycine max
  Coding DNA Sequence Number=SeqID_80631
  Gene Ontology: Mol. function=RNA-directed DNA polymerase activity; Biological process=RNA-dependent DNA replication
  Homolog annotation: Hit_ID=Q1S7B8; Match level="QueryCoverage=74%, HitCoverage=34%, E-value=2e-25, Identity=29%"; Hit description=RNA -directed DNA polymerase
MEVFCSINNKLKQIEIDLNELGIIDESHGLSEDDLKKKNLIKGLLVEETWVEEPTMVKEEGDILRFLVEFHRHGIMPRGTNSSFISLIDKCENPQGLGLNGLMREAKKKNLYVGYKVGKRECEISLLQFFDEALFVGEVNVRNVFTIKVILRLFELVWDLELTFIKVALEPLVLEVKVETWQPIIMKFQKRMYVKARSVKDIGVFNEALLGKWRWNLFHNSRGVWVDVLLSKYGGLEGFVSEQKSPLESLWWRNLRKVCGVGAKIHGFIEGSIGKGGVGILCGGDICLSGRVLHDENDCWFWEYSPSGVYTSNSAYTSRFLAAEEDSCIFEELWQLKIPSKVAFCLWRALRDRLPSKDNLRKRNIIEEADLRWPFCNNCRETINHLCIM

SEQ ID NO: 197410 - protein, 235 aa, Glycine max
  Coding DNA Sequence Number=SeqID_80632
  Gene Ontology: Mol. function=protein serine/threonine kinase activity; Cellular component=cytoplasm; Biological process=protein amino acid phosphorylation
  Homolog annotation: Hit_ID=Q6ZLP5; Match level="QueryCoverage=84%, HitCoverage=43%, E-value=9e-71, Identity=67%"; Hit description =Putative CBL-interacting protein kinase 23
  Pfam annotation: Domain name=NAF; Domain location=118-179; Score =122.4; E_value=1.3e-33; Accession=PF03822.5; Description=NAF domain
MIPYSLRRGVKLHVSVEISKLKPDMTKIEIFKAEFMSPPWFSSSAKKLINKILDPNPATRITFAEVIENDWFKKGYKPPVFEQANISLDDVDSIFSNSTDSQNLVIERREEGPMAPVAPVTMNAFELISKSQGLNLSSLFEKQMGLVKRETRFTSKCSADEIISKIEKAAGPLGFDVKKNNCKLKIEGEKTGRKGHLSVATEILEVAPSLYMVELRKSEGDTLEFHKSSQPWTPS

SEQ ID NO: 197411 - protein, 140 aa, Glycine max
  Coding DNA Sequence Number=SeqID_80633
MSTGCYLDKDESGQPIDGNNIEDCHHQKGGDYGSNAFQDYFDGAKESRVKQVSRIKIKIQDSRIIKIKIQDSRTNRLRILCLNTLERTSFVVQVERTSTWVVILRTREGTSLVDQFKWSVHPLGCSKRTRKGTSLVDLCL

SEQ ID NO: 197412 - protein, 135 aa, Glycine max
  Coding DNA Sequence Number=SeqID_80634
MAICKALSSKAKGKEKEEKDSSKKIVMKENHFATKVDIKIALLLKQSFYLLLSKEKSLSTAIPLELEVIPQVKELLDEGLVHKRLTPCALLAPKIGIMRHIIPMIGGMMNVLSGATLFCKIAQHLHDSQTWGLIR

SEQ ID NO: 197413 - protein, 114 aa, Glycine max
  Coding DNA Sequence Number=SeqID_80635
MYIDHIQSLKIKLTDGRTKNTEQENDAKSHLGTVTACPSELKLNPATVSSPRRAGSLTMKLFGGPSEPNAGLGELGPGKNKEKTFLPSFLGIFCLPGRNTEWFLALHCNWRSTP

SEQ ID NO: 197414 - protein, 81 aa, Glycine max
  Coding DNA Sequence Number=SeqID_80636
  Subcellular localization annotation: CTP_CleavageSite=63; ConfidenceScore=5.04e-01
MAETARQWWTRPKRRQWKLWTTTTQPRAHQEGRQRSFVTSLKLLGAQVMVLGAPSNTLTKGVTAQGNVYVRSRRRWRTSNA

SEQ ID NO: 197415 - protein, 119 aa, Glycine max
  Coding DNA Sequence Number=SeqID_80637
MGSKIYPEFHKNPSAFFSSSRPILLEPLTYGSGDWSLPREYYITCKDCETIKEKESKLHIEIETKANEKDTLLKNFQELENKLKDLQKILKELNELTIIKRKKERYDIWRECAQAHKLL

SEQ ID NO: 197416 - protein, 106 aa, Glycine max
  Coding DNA Sequence Number=SeqID_80638
MDVYNFSYDFTGIGLIFVKRPTELLMSMGDVIMVMGYVICPLSEFCCTWQLKLTSQTVATYQHCLIKDHYPPTIALSISSALNISSRTECFQAFNTSHTMIEMGII

SEQ ID NO: 197417 - protein, 68 aa, Glycine max
  Coding DNA Sequence Number=SeqID_80639
  Subcellular localization annotation: CTP_CleavageSite=35; ConfidenceScore=5.29e-01
MAIANAPMYIAVTKAKKRARNPPAAAKDISSDMTMAFMVAARKKSINTSSAVKATKVQYQEKKQPCML

SEQ ID NO: 197418 - protein, 316 aa, Glycine max
  Coding DNA Sequence Number=SeqID_80640
  Gene Ontology: Mol. function=galactonolactone dehydrogenase activity; Cellular component=mitochondrion; Biological process=electron transport
  Homolog annotation: Hit_ID=Q0ZHB8; Match level="QueryCoverage=76%, HitCoverage=40%, E-value=1e-120, Identity=86%"; Hit description =Mitochondrial L-galactono-1,4-lactone dehydrogenase
  Pfam annotation: Domain name=FAD_binding_4; Domain location=133-265; Score=114.3; E_value=3.4e-31; Accession=PF01565.13; Description=FAD binding domain
MVNYPFVRKFSKFRFRHTHSLTLYNSLVCELSEAEDMLRTLVLKRSLGLHSHFHHLLLRRCSSSAAPNSSADAETRKYAGYAALLLFCGGATYYTFPLPDDAKHKKAQIFRYAPLPEDLHTVSNWSGTHEVQTRNFLQPENAEQLERALREARSRIRPVGSGLSPNGIGLSRTGMVNLALMDGILDVDKQSKTVRVQAGIRVQQLVDGLKDHGLTLQNFASIREQQIGGIIQVGAHGTGARLPPIDEQVIAMKLVTPAKGTIEISKDKDPELFYLARCGLGGLGVVAEVTLQCVDRQELVEHTVVSTMNEIKKNHK

SEQ ID NO: 197419 - protein, 150 aa, Glycine max
  Coding DNA Sequence Number=SeqID_80641
TNDLEKYLGVLIIHNKASRHTFQFIFDKLNQRLNSWKSRKLSLVVHITFTKSALAVVHDDLDKMQRTEFWLDPWIPHKVPLVSKAFLFIPEPELTKYVVDYCKPDWSWDLSSFVLYLPQDILDIVVALPTLAKAPDPNILAWNHSINGLF

SEQ ID NO: 197420 - protein, 106 aa, Glycine max
  Coding DNA Sequence Number=SeqID_80642
  Homolog annotation: Hit_ID=Q1S420; Match level="QueryCoverage=44%, HitCoverage=7%, E-value=3e-10, Identity=66%"; Hit description=HCO3 -transporter
MVIRAKVTSLIPSEEIAEGEIVCRVVISIIPWQRPGWINFLSNPNLQLIRKKVVKSVKQQGSNSELYGKMQVVFVEMDTTPTTKELENLKEPVMKSNEKNAAKGKF

SEQ ID NO: 197421 - protein, 433 aa, Glycine max
  Coding DNA Sequence Number=SeqID_80643
  Gene Ontology: Mol. function=inorganic anion exchanger activity; Cellular component=integral to membrane; Biological process=anion transport
  Homolog annotation: Hit_ID=Q1S420; Match level="QueryCoverage=89%, HitCoverage=56%, E-value=1e-174, Identity=77%"; Hit description=HCO3- transporter
  Pfam annotation: Domain name=HCO3_cotransp; Domain location=3-401; Score=-100.7; E_value=1e-12; Accession=PF00955.11; Description=HCO3- transporter family
MGPFGGIIQDVKGRVECYKHDWASAICSGIRILAPTFYIFFASALPVIAFGEQLNRDTGGSLSTLETLASTAICGIIHSIFGGQPLLILGVAEPTVIMYTILYEFCTKTPELGAKMFLPWAGWVCVWTSFLLIILAIFNACTIITRFTRIAEELFGMLITVLFFQEAIKGIIGEFNTPKDGNLLLEENQFHWRYANGLLAIILSFGLLITATMSRKARTWKYGSGWLRGFIADYGVPMMLVIWTGLSYTLPGKIPSAVPRRLVCPLPWESTYHWTVVKDMGKVPLGYIFGAFIPAVMIAGLYFFDHSVASKMAQQKEFNLQKPSAYHYDILLLGIMTLICGILGLPPSNGVLPQSPMHTKSLTVLRKQRNWLMCQALNGKDIIRSADNTMCFLTFLKATFLGIFHEGLLVSYILSFFLNSNVSYSNVIETNGI

SEQ ID NO: 197422 - protein, 350 aa, Glycine max
  Coding DNA Sequence Number=SeqID_80644
MGFKIEKLKNIIISLEKAVMAEVGKLVGRMEVVVVSEPRVVVEVQERQDNIKVENFVVMAFFIDRRICSFSCVRPELVEYTITTSWSPLSRELASLEVVDCLDARSRMSGSTSLAIAALDASSFLSMTLVFVRSIRTPHTMVLSIAVAEGLARTVVPHGAESMGYHLSFCNLLQVVGSLILNGGKLEKTLDEGLTVIISCEADTSIIKVILPSRSEHLDNIVVHNSITSIIARGGGFRWSVLIVKMRPDGCFNRYGFLYHSFSEKDFREGRKRCRITVDEGQRETLGIHQWLPCSFPSEPIKEEDRSSLFTVKKTALSLSSIFGLALVALVFTCRGMFEGRMNAHDTAKG

SEQ ID NO: 197423 - protein, 199 aa, Glycine max
  Coding DNA Sequence Number=SeqID_80645
MCEKAKIWANILNKSVLHKVGSKTTLSDLQKFVLLHLMENLPFDFPHIIYINILRNLKSLGGLDDNYYHVFYKMDENSKHTLIVKETPKVDAEAINKRKQKRLAKSIADEDLGLDNFGITWKIKKIMVEQQKKKKTRKQFQRDEEEEMLANEHQTKRRYKSISSALAHPPAVNPIAQRLKDLSETDDDGEGLVRVAFQK

SEQ ID NO: 197424 - protein, 108 aa, Glycine max
  Coding DNA Sequence Number=SeqID_80646
  Gene Ontology: Mol. function=inorganic anion exchanger activity; Cellular component=integral to membrane; Biological process=anion transport
  Homolog annotation: Hit_ID=Q1S420; Match level="QueryCoverage=82%, HitCoverage=13%, E-value=1e-15, Identity=53%"; Hit description=HCO3 -transporter
GILFPLPFFLLITIREHLLPKIFKPNHLQELDASGYEEIVGAPHITHNIPPREKESNDPDSDDMSSEDYYDAEILDKMTTNRGELKLRTVSRNNSKSFSYSSSEDMQH

SEQ ID NO: 197425 - protein, 84 aa, Glycine max
  Coding DNA Sequence Number=SeqID_80647
MPPKKIENKVTPLKTEVLHGEETSSPGRAHYCRVKLQLSVDEKPKAKGHFGAVAARPGKLKLDRAAVSSPRRARAHPSKLFSSP

SEQ ID NO: 197426 - protein, 309 aa, Glycine max
  Coding DNA Sequence Number=SeqID_80648
  Gene Ontology: Mol. function=nucleoside-triphosphatase activity; Cellular component=chloroplast; Biological process=DNA metabolic process
  Homolog annotation: Hit_ID=Q10G85; Match level="QueryCoverage=94%, HitCoverage=56%, E-value=2e-93, Identity=90%"; Hit description=DNA repair protein recA, chloroplast, putative, expressed
  Pfam annotation: Domain name=RecA; Domain location=1-309; Score =303.0; E_value=5.5e-88; Accession=PF00154.11; Description=recA bacterial DNA recombination protein
MNDINNNFGKGSVTRLGSAGGALVETFPSGCLTLDCALGGGLPKGRIIEEKMSWLPNSPNVSPFPRQATFATFMIYIALMSANVNFFETCPFFSSILECMMTFLIIYGPESSGKTTLALHAIAEVQKLGGNAMLVDAEHAFDPAYSKALGVDVENLIVCQPDHGEMALENRMCRSGAIDLICVDSVSALTPRAEIEGEIGMQQIGLQARLMSQALRKMSGNASKAGCTLIFLNQIRYKIGVYYGNPEVTSGGIALKFFASLRLEVRPTGKIKSAKGDEEIGLKVRLRVQKSKCITVKLRELAHNIERTI

SEQ ID NO: 197427 - protein, 302 aa, Glycine max
  Coding DNA Sequence Number=SeqID_80649
MDGWDLLWEMKGAPKKLGGALVENGMRNVQPCGGGGDDVNIRCVPGHGEHFYMHGYENRKRDLREDKELAGIGCGVDELVEQNGDNTNGCTEVDNGDTDKFVANNGDVVGQFREHDNIDGGGCLAVNFFSMGGCVDCTVAIGRVEILSGVVKRRFETVVGVGVWMEGVESQWLDGEEVGVCDGGGEKTQVGDVGGCCRFEPCSYGNTRKLGWGGHGGRVERAGKSGIGTVRISKGVAEVAVVQKDSINVDVDVGCPWTTVVAVLTVMVVVVLATAVKRWGSVKGSIVEALSALCYTTPKFYK

SEQ ID NO: 197428 - protein, 89 aa, Glycine max
  Coding DNA Sequence Number=SeqID_80650
MDPEDPFWVDMTDELLEKLTLDPSLFFLKKINYYKLHVHESKIDDLNKDAIPGAKDAVRIDLVGGYAIKKVTSERSAIWINSFIIFFLQ

SEQ ID NO: 197429 - protein, 330 aa, Glycine max
  Coding DNA Sequence Number=SeqID_80651
  Gene Ontology: Mol. function=RNA-directed DNA polymerase activity; Biological process=RNA-dependent DNA replication
  Homolog annotation: Hit_ID=Q1T5Q8; Match level="QueryCoverage=81%, HitCoverage=41%, E-value=2e-22, Identity=27%"; Hit description=RNA -directed DNA polymerase
MKKIRNSIPPVIPTACSMGECGAALPSLLPKENSKMQKQTSQNQPLPPYKEETKCERKLAKVPKSVVDKLLKLQHRFLWGGGPEQNKIAWIKWEVVCLPKEKGGLGLKDINRFNLALLGKWKWQLLQQQWELWAKVRESEYGSWRSIEEPGRVHYESIWWRDPKKALHHSDKGSILHNRLRWKVGGGDKIKFWEDRWICQEETLAAKYPRLYLISSQQNQTIRQMGTHKDTGWEWNFIWRRPMFDNEIDAAVSFLREVGGKSIQQQGLDVWEWSGDPSGTGCQQRKIYSGDRCWLRICHVLSAEVTRRRHPTYSSIAPKSNLFGGKLCHG

SEQ ID NO: 197430 - protein, 122 aa, Glycine max
  Coding DNA Sequence Number=SeqID_80652
  Subcellular localization annotation: CTP_CleavageSite=42; ConfidenceScore=5.07e-01
MDLMFPLKPHCVILKAPLSSSLLFPFPLRFRAVTAFKHANIQCELEGRPNGALSGDFDPRFIDRDLSLPPPWGSVLHHPSSVSSYPTFMHSSLASSLPSLSLDAMDTVNLVIAAVAGVVGCS

SEQ ID NO: 197431 - protein, 200 aa, Glycine max
  Coding DNA Sequence Number=SeqID_80653
  Gene Ontology: Mol. function=serine-type endopeptidase activity; Biological process=proteolysis
  Homolog annotation: Hit_ID=Q658B2; Match level="QueryCoverage=39%, HitCoverage=10%, E-value=3e-16, Identity=51%"; Hit description =Putative prolyl endopeptidase
MVIGEGECREEMYIRLHIAEGCDPVNKLYYYDLSKLPNALEDFRNGNSLLLLAKLIDNFDAQYEAIANDDTVFTFLTNKDAPSIPSSTTNGGAVQDFDCLVSLFGASRVSGRPLNPTKLKSEGRCVGVSTDVVSDATKPDYPIMYASVGFFKMTRYTSKEVIGRNWSKKFRSKWKTGISSRKFQSQNMIVFYLVSFHDPC

SEQ ID NO: 197432 - protein, 85 aa, Glycine max
  Coding DNA Sequence Number=SeqID_80654
MPEPPAPEPACAPVAADVDMPRHADACQQIAQTLEHMINMRMVTARTKADTLTEQCLRLTRGHRIWRMPLPEMEDQSGQTSQGLP

SEQ ID NO: 197433 - protein, 209 aa, Glycine max
  Coding DNA Sequence Number=SeqID_80655
  Homolog annotation: Hit_ID=Q2HRX8; Match level="QueryCoverage=54%, HitCoverage=16%, E-value=9e-12, Identity=36%"; Hit description=IMP dehydrogenase/GMP reductase
  Pfam annotation: Domain name=DUF1723; Domain location=154-203; Score =47.3; E_value=5.3e-11; Accession=PF08330.1; Description=Protein of unknown function (DUF1723)
MVRTRGLHRALGRVLGRALGRQVRDNVEEATKAPQHRWPTSSTCRQWAATPVVKDVHHVDHDVDKVHQDPQNPVTDDVGANTEGFSGGPQDIPMLQDYVYHVAASVWTGEIEHHELKLASHRRKVEKFERLAPEIEGMVVASRLSSLITCSLDTSDRGLLPSFAERWHKETSNFHLPVREVTITLYDVASLLHLPITGAFHTFNPLDVD

SEQ ID NO: 197434 - protein, 119 aa, Glycine max
  Coding DNA Sequence Number=SeqID_80656
MVWHLQSYFFLLHSAAIDLQEAKDFIDEQDPRPRSSTWSYITNPYNPHTFTIVDILTYAIDVTLAACCFNHSCETQFGPASRTGPIETRWPNWTGSTIQLVMKLARDEPAKPGRLSTGS

SEQ ID NO: 197435 - protein, 370 aa, Glycine max
  Coding DNA Sequence Number=SeqID_80657
  Homolog annotation: Hit_ID=Q9LRN2; Match level="QueryCoverage=79%, HitCoverage=62%, E-value=2e-41, Identity=39%"; Hit description =Arabidopsis thaliana genomic DNA, chromosome 3, P1 clone:MUJ8
MPRPGPRPYECMRRAWHSERHQPMRGSIIRQIFRVVAEAHSAATKSNKEWQEKLPIVVLRAEEIIYSKANSEAEYLNPDTLLDRLNDAINTIIRRDETTETGQLLPPCVEAALNIGCKPVRTSRSDRHNPRAYLTSRHQLHPCSISPKTVANNALNFLPVSDSDDHTNKNNYSSLDTLASVVLHHQPLAVETNPSLSLGSVYPLYYGFEVKEPQLRTSIRRSTCSDTIFVGRPVISPALEPCRMDLLENLSCGRVYHAPKRIMKENAVSVAGESQDGECDLSLRLGICLKSNKASSAYGSEDIGLRVSEEGRKFGHSSRQKNEGYCFYPRGTAEPNMQLFHDVEDDQNAGNFSEVQCASSIFAFAIEVGP

SEQ ID NO: 197436 - protein, 143 aa, Glycine max
  Coding DNA Sequence Number=SeqID_80658
LERIDGDPVLRETRIWATWEYVSSVGGGQQGMVGLCAICGCGKNLLCTIARPPPSTTCDGVVPGDMSRGSGDLGDVRRAPGSQQIKGTKTTKQGGLWWLASCEFCVIYGLWPLVIDYQGFENEVRKLGELLVIDYQRGVIDYQ

SEQ ID NO: 197437 - protein, 339 aa, Glycine max
  Coding DNA Sequence Number=SeqID_80659
  Gene Ontology: Mol. function=hydrolase activity; Cellular component =integral to membrane
  Homolog annotation: Hit_ID=UPI00006B7750; Match level="QueryCoverage =99%, HitCoverage=70%, E-value=2e-24, Identity=32%"; Hit description =transmembrane protein, putative
MNWLFHYLDFFNQPIGNWNTSKVTTMIHMLHECYAFNQDLSSWDTSKVTDMRAILGKTTNFNHSLGNWNLNSLVLASGMLTGSGLSCEKYNNTLMGWANNPATPNNLIIGDVSPMAYSSQPALNARNNLINTKGWTITGDYYNTECSGKAQNEFITVWKPSLPRYATQYTGISVASTDTQIWLPAVGTDFQVYWEEIGFPAHHATLTNLNSTYQVLIDFGTPLNPNPADATYRLKITNGTGNFHRIRFSNWDMFNGDGLIGDVHKIVRLEQWGNIHWSSMGQAFQGCRDFDVTATDTPDLSAVTDMSNMFLGCFLFNQPVGNWDTSNVTMMGITFSSAL

SEQ ID NO: 197438 - protein, 94 aa, Glycine max
  Coding DNA Sequence Number=SeqID_80660
MASDLGHIPVRPIHSIYLPKQAYGISWYLFTNAIETMHSVSFLAIGSNYQSKPMALVGMNLTNSTHMSYSQICRYLFTNAVQAMHLVEKDDGTQ

SEQ ID NO: 197439 - protein, 99 aa, Glycine max
  Coding DNA Sequence Number=SeqID_80661
MCGAIFALSKNGRMYNAVKILGRYCMSFTQPRIERLYPLATSYSTGGHCSSYPIGDSIASTRAYHFRAGPDILSARAICTSAGLAYFSGSTICTSTGPE

SEQ ID NO: 197440 - protein, 183 aa, Glycine max
  Coding DNA Sequence Number=SeqID_80662
  Gene Ontology: Mol. function=RNA-directed DNA polymerase activity; Biological process=RNA-dependent DNA replication
  Homolog annotation: Hit_ID=Q1RV13; Match level="QueryCoverage=58%, HitCoverage=25%, E-value=2e-19, Identity=45%"; Hit description=IMP dehydrogenase/GMP reductase
METETPVVDKLVRLQRNFLWGGTPEQNKIAWIRWDTVCKPKEEGGLGVKDITAFNTSLLGKWKWDLFQNKEETWARVLQSKYGSWRNPKGAPRAWRLLKDRLPTRDNLRRKRGNKWKWWWLALTWTIWKHRNSIIFSNATFNAHKVMDDAVFLIWTWLRHLKKDFTYHYNQWSSNLKEGFLRT

SEQ ID NO: 197441 - protein, 47 aa, Glycine max
  Coding DNA Sequence Number=SeqID_80663
MCGSRHQRLFEENVRKTETRFANIENKGSGVVYAWGRVDKGVALAPT

SEQ ID NO: 197442 - protein, 774 aa, Glycine max
  Coding DNA Sequence Number=SeqID_80664
  Gene Ontology: Mol. function=voltage-gated potassium channel activity; Cellular component=integral to membrane; Biological process=potassium ion transport
  Homolog annotation: Hit_ID=Q6ZXS4; Match level="QueryCoverage=95%, HitCoverage=86%, E-value=0.0, Identity=62%"; Hit description =Inwardly rectifying potassium channel subunit
  Pfam annotation: Domain name=Ank; Domain location=519-551; Score=6.7; E_value=3.4; Accession=PF00023.20; Description=Ankyrin repeat
  Pfam annotation: Domain name=Ank; Domain location=552-584; Score =45.2; E_value=2.2e-10; Accession=PF00023.20; Description=Ankyrin repeat
  Pfam annotation: Domain name=Ank; Domain location=585-617; Score =30.9; E_value=4.5e-06; Accession=PF00023.20; Description=Ankyrin repeat
  Pfam annotation: Domain name=Ank; Domain location=649-681; Score =51.8; E_value=2.3e-12; Accession=PF00023.20; Description=Ankyrin repeat
  Pfam annotation: Domain name=Ion_trans; Domain location=103-301; Score=106.3; E_value=9.2e-29; Accession=PF00520.21; Description=Ion transport protein
  Pfam annotation: Domain name=Ion_trans_2; Domain location=212-307; Score=45.6; E_value=1.7e-10; Accession=PF07885.6; Description=Ion channel
  Pfam annotation: Domain name=cNMP_binding; Domain location=403-481; Score=34.0; E_value=5.2e-07; Accession=PF00027.19; Description =Cyclic nucleotide-binding domain
  Pfam module annotation: Pfam domain module=Ank::Ank::Ank::Ank::Ion _trans::Ion_trans_2::cNMP_binding; Domain location=519-551::552 -584::585-617::649-681::103-301::212-307::403-481
MKMFGMCGGSDDDNHRDDEDKSPIGAREDGSQYSLTGVLLPSLGATAIRNGSGRPKFRQYIVSPYNRHYKLWNTFLLILVFYTAWMCPFEFGFLEKSNIAVAITDNVVNVFFAIDIVLTFFVAYLDKSTYLLVDDHKLIALRYAKSWLILDVIATIPYEVVILILPPSLQIYSYFNFLRLWRLHRVSAMFARLEKDRNYNYFLVRCCKLTCVTLFSVHAAACFFYFLAARDNPESTWLGLVPDAIDQNLWGKYVVAIYWSIVTLVSVGYGDLHPVNTKEMVFDIFYMLFNLGLTSYLIGNMTNMVVHWTERTKRYRDTVQSASNFAHRNHLPNRLQEQIFAHLLMKYRTDLEGLQQQEIIDSLPKAIHSSISHYLFFSLVDKVYLFHGVSNDLLFQLVTEMKAEYFPPKDDVILQNEAPTDFYIFVTGAAVVGEAKSGDVVGEIGVLCYRPQLFTVRTKRLSQILRLSRTSFLNLSHSNVEDGTMIMNNFLQNLHESEDPLMKEILAETEAMLARGKMDLPISLLFAASRGDDILLHQLLKKGSDPNEPDKDGKTALHIAASKGKDHCVALLLEHGANPNIKDLDGNVPLWEAIKGGHDSVMKLLIDNGADISSGDVGSLACISVAQNNLELLKDIVQCGGDVTRSASNGSTALHAAVCEGNAEIVKFLLEHGADIDKQDDSGLTPRILADQQCHEEIINIFKKVGQNKAPHGIPTTSFVARCQSKPTILGIHQGSKPPNEEVTWFDNHQRRKMSPFHNSFFGIMSTENYGAKT

SEQ ID NO: 197443 - protein, 131 aa, Glycine max
  Coding DNA Sequence Number=SeqID_80665
  Gene Ontology: Mol. function=transition metal ion binding; Biological process=cytoskeleton organization and biogenesis
MSQNRVLKEHNKTFLDWFKDTIFVNDNASETLRKLADGPKSNVITWQGYDIHKYFFYTKAQDDKTSIPYFGFIKEIWELNYVKFTVYCRSKLHDESRLIQRSFDDDKGDDYKLKDQEQFMITKMMISRIKE

SEQ ID NO: 197444 - protein, 398 aa, Glycine max
  Coding DNA Sequence Number=SeqID_80666
  Gene Ontology: Mol. function=RNA-directed DNA polymerase activity; Biological process=RNA-dependent DNA replication
  Homolog annotation: Hit_ID=Q1S4N5; Match level="QueryCoverage=88%, HitCoverage=83%, E-value=3e-39, Identity=35%"; Hit description =Peptidase M, neutral zinc metallopeptidases, zinc-binding site
  Subcellular localization annotation: CTP_CleavageSite=61; ConfidenceScore=5.33e-01
MAQVMTMIWKFYLQWKIPMTRANQTPSTRPLEGSVGLHPFFFTRFMMSGFNDFSIFSWNVREASIFNTWRKLRDVIKGYHPSMFVIYETKDNVLGFAPWYMPLLSPSSRNSLHLIQIGESFDGTWIALGDLNEVLSVSKTMGSSFSYSRATTFSNCINVFDLMDINTMGGCFTWRRHTNNGSRIRKKLDCCLANSGWSIMFPHVLGEIFPTHGSYHNSILVSFLKPKSKKFKVFHYQTTWVSHLDYAPLVANTWVNIACSTLNKLGVVKDESIKFNVDIFGNIFRWKCHIETRLSGVHKILDNAYFSDLVMLEKELQKESDLKNFQDASKYQPHALPISNLPFIDQHMLQALLKSVSMIKAISKVMVHRVRPFLNSTIGPYQNSFILGRGTTDNALIA

SEQ ID NO: 197445 - protein, 123 aa, Glycine max
  Coding DNA Sequence Number=SeqID_80667
  Gene Ontology: Mol. function=ubiquinol-cytochrome-c reductase activity; Cellular component=mitochondrion; Biological process =mitochondrial electron transport, ubiquinol to cytochrome c
  Homolog annotation: Hit_ID=Q9SUU5; Match level="QueryCoverage=70%, HitCoverage=71%, E-value=4e-20, Identity=55%"; Hit description =Ubiquinol-cytochrome c reductase-like protein
  Pfam annotation: Domain name=UCR_14kD; Domain location=6-114; Score =72.6; E_value=1.3e-18; Accession=PF02271.6; Description=Ubiquinol -cytochrome C reductase complex 14kD subunit
MASFLQSFLDPKKNWFAAQHMKSLSKRLRKYGLRYDDLYDPYYDLDVKEALNRLPKEVVDARHARLKRAIDLSMKHEYLPDNLQVLRDDGCVCEFVGYNELVLVAFYCVVKLQERWMKKKTVC

SEQ ID NO: 197446 - protein, 1232 aa, Glycine max
  Coding DNA Sequence Number=SeqID_80668
  Gene Ontology: Mol. function=RNA-directed DNA polymerase activity; Cellular component=chromatin; Biological process=chromatin assembly or disassembly
  Pfam annotation: Domain name=Chromo; Domain location=1132-1180; Score= 14.4; E_value=0.019; Accession=PF00385.14; Description='chromo' (CHRromatin Organisation MOdifier
  Pfam annotation: Domain name=rve; Domain location=863-1015; Score =24.7; E_value=5.1e-05; Accession=PF00665.16; Description=Integrase core domain
  Pfam module annotation: Pfam domain module=Chromo::RVT_1::rve; Domain location=1132-1180::442-611::863-1015
MGGTDRKQGEKKNHKTHIPEGLRVGEQIVAELAQNLVVLSDPRSQYFVFQHHSIGALVALLPWLSTQNLLSLNLKFDTLLQRLPQVPSAYSPLPPLTLVLQPPPATNHRMKLDVLRFDGTDPFGWIFKINQFFEYHATLEHERLTIASFYMEGKALAWFQWMTSNEKAQWHNTCSNSRIWRTAPSIFLLIFSSVAADLAKLQEEKFLDARISPWPRPSLPPLVPPLRAPSPSVPLLPSPPRSPTPSFKRLSPEEITSRRERDLCFSCDEKYHRGHRCASRVFLFVADEDEAPIPNIASFDPGLDLLEPVDLPQAQISFNSLVGHLAPETLRLLGSLFGHQIQNTTFSVDLYVLPISGANIVLGVQWLKSLGPVLTDYNSLCMKFFHNGHLVELKDTIAHHPGDYFPEVRELIAKFSSLFQPPSTLPPVESMLQKGLIQPSTSPFSSPVLLVRKHNGSWRFCVDYRALNAITVSDGFLIPTIDELLDELGGAWWFAKLDLLQGYHQIRMHSANIAKTVFRTHYKHYEFKVMPFGLCNAPSSFQATMNLIFWPFLRRFIIVFFDHILIFNDSFENQLHHLEKTFQVLSKNQFVLKLSKCSFAQLQVEYLDHVVSHGQVAPVPAKVNAISQWLRPQSTRSLRSFLGLTGFSRRFIHGYATIAAPLVKATTKEPFQWTDNEQGAFDQLKQVLVTSLVLALPDFQAPFTVETDASGVGIGTMLSQNGHPIAFFRKPFSVKLLRASTYVRELFVITAAHMYLARLMGYDYQIQYHSGASNKVADALSRLPESNASTFLEVMNHPDSHQNFKLLPNLILHKGRIWLPQGFPIIPTLLTEYHSTPTRGHMGVAMTIARLSKNFHWPGMRTDVTQFVANLSLDFIVGLPPYRGHTIILVVVDRFSKGILLGMLPSSHTAHMVASLFMDIVAKLHGPPRSLVSNRDPLFLSHFWQELFHLSGTQLRMSSTYHPQSDGQTEVLNKWFHNSAWNTATGTTPYEITFGRKPFNFPEYLTGASTIDAANDLLINREFTFTFICKKLLKAQEAMKKQADSKHREAYYQIGDWVMLKLRPHRQSSARGSQAHAVLDQVGTVAYRLSLPEGARIHPVFHCSLLKPFKGPLPLEETTQLPPDFINAQSIITPLAILDQRQTSTTGDSWWEVLVQWQGISPYETSWEDWSTLCTDYHLEDKVVLQGRWGHKGGADRKQGEKTNHKTHIPDGLTVGEQIVVELAQNLAVYGC

SEQ ID NO: 197447 - protein, 237 aa, Glycine max
  Coding DNA Sequence Number=SeqID_80669
  Gene Ontology: Mol. function=nucleic acid binding; Biological process= DNA integration
  Homolog annotation: Hit_ID=Q0KIN0; Match level="QueryCoverage=71%, HitCoverage=10%, E-value=3e-33, Identity=42%"; Hit description =Integrase core domain containing protein
MASDSWKTDGPVFSISGTPTITSEKLNGKNYLAWSASVELWFLGQGYHEHLEQSSKKISEDKCEQWKKLDYQLCALLWQSVEPAILTNFRAFKTCYSFCKKAQSVFANDIQQLYDAAQKLTTLKQTDHDMVAYVSKAQSAMEELKLSLEADNLEDIKTKLDNLFMVLVLRGMHPDFDHIRDQVLTGQEGDKVVVETEEDELEEALNVLTADYQEYLQLKAVKESQTSSAISGHNSTT

SEQ ID NO: 197448 - protein, 130 aa, Glycine max
  Coding DNA Sequence Number=SeqID_80670
MFPQADCWNFENNNFGSLTKREWRTKRNSNREGMALSAQRCAKPNSYQEEVALSAQSVKNMIFHSILQNVTQTLKSHFSSPKTTGGRRELPLRAVEPPHQEEHFNQSGILRILLKDSVEKILQSSVSKLL

SEQ ID NO: 197449 - protein, 60 aa, Glycine max
  Coding DNA Sequence Number=SeqID_80671
  Gene Ontology: Cellular component=microtubule; Biological process =microtubule cytoskeleton organization and biogenesis
  Homolog annotation: Hit_ID=Q45NK4; Match level="QueryCoverage=92%, HitCoverage=31%, E-value=2e-18, Identity=82%"; Hit description =Putative ABI3-interacting protein
VIEVLVNSGRQIDAVNLAFAFDLTEQFSPIPLLKSYLKDARKISSPVRSVNSSPTAQEFG

SEQ ID NO: 197450 - protein, 40 aa, Glycine max
  Coding DNA Sequence Number=SeqID_80672
MGTTGCIRFSLGRYHDSRASSLTFLATKVARFRQSDERKS

SEQ ID NO: 197451 - protein, 98 aa, Glycine max
  Coding DNA Sequence Number=SeqID_80673
  Gene Ontology: Mol. function=protein domain specific binding; Cellular component=nucleus; Biological process=negative regulation of ubiquitin ligase activity during mitotic cell cycle
  Homolog annotation: Hit_ID=Q39558; Match level="QueryCoverage=99%, HitCoverage=49%, E-value=2e-24, Identity=48%"; Hit description=14-3 -3 protein 32kDa endonuclease
MASAPTPCEEFVYMAKLVEQVKHYEEMVEFMEKVFASTESEELTEDHLVVIRNYRSKIKVELSNIYDKILKLLDTHLVPSLTSGDSKVFYLKMKGAYH

SEQ ID NO: 197452 - protein, 100 aa, Glycine max
  Coding DNA Sequence Number=SeqID_80674
  Gene Ontology: Mol. function=catalytic activity; Biological process =metabolic process
  Homolog annotation: Hit_ID=Q386L9; Match level="QueryCoverage=98%, HitCoverage=31%, E-value=1e-12, Identity=38%"; Hit description =Glycerolphosphate mutase, putative
MLPKRITLMRHGESQGNRDMAMYTIIPDHNIQSMAQGIAQVFRVGEHLHRVIGSDTYSPDWRVQFYVSPYTRTRSTFYELRRYFLKKMIIDVTEKSQVRE

SEQ ID NO: 197453 - protein, 166 aa, Glycine max
  Coding DNA Sequence Number=SeqID_80675
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process =flavonoid biosynthetic process
  Homolog annotation: Hit_ID=Q9LHN8; Match level="QueryCoverage=97%, HitCoverage=47%, E-value=4e-55, Identity=61%"; Hit description =Leucoanthocyanidin dioxygenase-like protein
MATTLIPSDLTEFVMLQGNGVKGLSEMGLKSLPSQYIQPLEEIMINVLPQESIPIIDMSNWDDPKVQDSICDAAEKWGFFQIINHGVPPQVLDNVKDATYRFYGLPPEEKVKYTKENSSTKHVRYGSSFSPEAEKALEWKDYLSLFYVSEDEAATTWPPACRLLCN

SEQ ID NO: 197454 - protein, 46 aa, Glycine max
  Coding DNA Sequence Number=SeqID_80676
MGTSMGLWEFYGSIMGVPEAPESNFLPKQGRWLPPSSPRRARLLPP

SEQ ID NO: 197455 - protein, 184 aa, Glycine max
  Coding DNA Sequence Number=SeqID_80677
MASNPARAKKKAKSSLRKQGECSQVAFNRLDTWFTNENKRNDFKIIYIVKNMIIDAAVWKAVVGLDMGGVRKFEEFADGYSKKHTYKGMLLDQTRNLRNRLGVYGLIVEDKMLVYLITYILAPRSSNDAQVTDDDLQIIYGLKLVDFTKASNQITERHLKKLGMRYVDHEWIMAREPPAIANIN

SEQ ID NO: 197456 - protein, 211 aa, Glycine max
  Coding DNA Sequence Number=SeqID_80678
  Subcellular localization annotation: CTP_CleavageSite=53; ConfidenceScore=5.23e-01
MRGGGCIAACLGKLLASSRKQPSLPRRAGCFILSFLVGQLARQRTKHSGGRFSANTETNPKDHYKALTTRSGRIIGKDVDDNLAIDEQVVRGKLSESKKNKSKSESEEETNRKKMYKQEKNKNGGEKENGECESRRTKNQRQTEQDITQIIKQENQAQEHNYASSSSGFRRLPRDSLVSMFSILVVIFSKELELQLGSLDGDEEWHPSFES

SEQ ID NO: 197457 - protein, 219 aa, Glycine max
  Coding DNA Sequence Number=SeqID_80679
  Pfam annotation: Domain name=DNA_RNApol_7kD; Domain location=21-49; Score=11.7; E_value=0.011; Accession=PF03604.4; Description=DNA directed RNA polymerase, 7 kDa subunit
  Pfam annotation: Domain name=zf-CCHC; Domain location=21-38; Score =22.2; E_value=0.00021; Accession=PF00098.13; Description=Zinc knuckle
  Pfam module annotation: Pfam domain module=DNA_RNApol_7kD::zf-CCHC; Domain location=21-49::21-38
EIQGKKISKSSKKIENNNNNYICFECGKQGHIKSECPIYCRKHVCLKARDSLWYLDSGYSRHMTGDESKLSDFVSKDGGYVKTMSLGGNYYVLVIVEDYSRFTWTLFLKTKNEAFDAFHKLAKGVATYPSAGGQREAHGCVFQGRKVHRVSTNVYSSKTSEKPERRGLRTLIVKGSGVVFTHGEGISTPRVRHKGRQPLIEVFPLLLRILNCDEEIRPT

SEQ ID NO: 197458 - protein, 73 aa, Glycine max
  Coding DNA Sequence Number=SeqID_80680
MLLQSILEVEVFNCWGIDFVGPLPSSYDTNSPLAVSDGVWKDMPPSGGTGTQSQKALKFLNFDPIASGDKRKF

SEQ ID NO: 197459 - protein, 138 aa, Glycine max
  Coding DNA Sequence Number=SeqID_80681
  Gene Ontology: Mol. function=RNA-directed DNA polymerase activity; Cellular component=intracellular; Biological process=RNA-dependent DNA replication
MVIGGIVLGHKISTQGIEVDKEKIDVLERLPPPWDVKEKIFHAIYYASKVLNGSQLNYTTTEKEMLAVFYALEKVQVLSCGRKVLNGVQLNYATMEKEMLAVVYALENFRSYRVGLKIVINTNHLAIQFVLTRADLKP

SEQ ID NO: 197460 - protein, 93 aa, Glycine max
  Coding DNA Sequence Number=SeqID_80682
MEGMMEGKRKVRSYKASPQLRYVHLSMSISSLKQRGATVEATVLPHSSKKGAMLKYGQPGKPLLATSLPCPSGQGAILKQGQLRNSLMVTCLA

SEQ ID NO: 197461 - protein, 200 aa, Glycine max
  Coding DNA Sequence Number=SeqID_80683
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=2e-29, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGPLKESTSFFLVRLKSFGTCTYWLAFRGLHVLTFRGLHALAIRGLHVLTFRGLHVLTFVGLHALTFRGPHVLTFRGLHALAIRGLHVLTFRGLHALAIRGLHVLTFRGLHTLAIRGLHVLTFRGLHALAIRGLHVLTFVGLHALTFRGSHVLTFRGLHALAIRGLHVLTFRGLHALAIRGLHVVTFVGLHALTFGGLH

SEQ ID NO: 197462 - protein, 311 aa, Glycine max
  Coding DNA Sequence Number=SeqID_80684
  Gene Ontology: Mol. function=sequence-specific DNA binding; Cellular component=intracellular; Biological process=transposition, DNA -mediated
  Homolog annotation: Hit_ID=Q973P4; Match level="QueryCoverage=97%, HitCoverage=79%, E-value=1e-123, Identity=75%"; Hit description =386aa long hypothetical transposase
  Pfam annotation: Domain name=Transposase_20; Domain location=238-311; Score=33.2; E_value=8.9e-07; Accession=PF02371.7; Description =Transposase IS116IS110IS902 family
  Pfam annotation: Domain name=Transposase_9; Domain location=79-170; Score=22.2; E_value=0.00062; Accession=PF01548.8; Description =Transposase
  Pfam module annotation: Pfam domain module=Transposase_20::Transposase _9; Domain location=238-311::79-170
MELKVTNKAFAIDISQSKLTAAKGELVVEQEKSAVYVKEVKEFNHDNEGIEELIKFLGEYKEGIIEATGIYYFYLHEKLTEKGYKVTVINPLHLTEILGKKTDKLDAQRLLVAHMTGVIKGSYIPTGEIMELRELTRYRESLVEKTTQVKNEIRKILEFAGYKIQPFDKKGRKLLEKLVKGEGLSKEEKEELKEKLGRNLNDAEKLALKQLVELLKNLEKMIKEVEDMIISKIPKPVIELSKIPGIGLISAATIYAEFGDVSRFSSSKAARAYASFAPKTKQSGDSESHSGMIRGNKYLRRALYLVAKVAR

SEQ ID NO: 197463 - protein, 149 aa, Glycine max
  Coding DNA Sequence Number=SeqID_80685
  Gene Ontology: Mol. function=nucleic acid binding; Biological process= DNA integration
MAEAAKPVNNVDASNPTLLIATFAKPLPDVSKIEVFIGQNFRRWQECVHTLLDMHGVVFALSTPKPDVVDDASQLQQWIQANKIEIHHRQLLPLDYERGKRHQDTNHKYHKLLEDLKIENISLPDEFISELLIEKLSESWTNYKQQLKH

SEQ ID NO: 197464 - protein, 126 aa, Glycine max
  Coding DNA Sequence Number=SeqID_80686
  Subcellular localization annotation: CTP_CleavageSite=53; ConfidenceScore=5.77e-01
MALKAVNYNKLPSPIMSSPSVPLCFSQRSLSFMLVSPNASMQILAQCNFLCTMARLAGQFSLSAIPSQVGIALSAPFALSKTSKVVIFKILMLKLWRNVLGSSRQNLKMIQRLTNLGSRFYWNRFR

SEQ ID NO: 197465 - protein, 78 aa, Glycine max
  Coding DNA Sequence Number=SeqID_80687
  Gene Ontology: Mol. function=hydrolase activity; Cellular component =nucleus; Biological process=carbohydrate metabolic process
  Homolog annotation: Hit_ID=Q1T5K1; Match level="QueryCoverage=63%, HitCoverage=15%, E-value=3e-16, Identity=80%"; Hit description =Serine/threonine-specific protein phosphatase and bis(5-nucleosyl)- tetraphosphatase
MEIVVRKDQCMRIDGANPAELSAMGREIVVEDGYEFFVNMQLVHIFSVPKYCGEFDNVGAVMIVDETLVCFFQILKPV

SEQ ID NO: 197466 - protein, 966 aa, Glycine max
  Coding DNA Sequence Number=SeqID_80688
  Gene Ontology: Mol. function=protein kinase activity; Cellular component=integral to membrane; Biological process=protein amino acid phosphorylation
  Homolog annotation: Hit_ID=Q1SEN0; Match level="QueryCoverage=98%, HitCoverage=94%, E-value=0.0, Identity=42%"; Hit description=Protein kinase
  Pfam annotation: Domain name=LRR_1; Domain location=106-128; Score =16.0; E_value=0.14; Accession=PF00560.23; Description=Leucine Rich Repeat
  Pfam annotation: Domain name=LRR_1; Domain location=130-152; Score =10.3; E_value=3.4; Accession=PF00560.23; Description=Leucine Rich Repeat
  Pfam annotation: Domain name=LRR_1; Domain location=154-176; Score =10.0; E_value=3.8; Accession=PF00560.23; Description=Leucine Rich Repeat
  Pfam annotation: Domain name=LRR_1; Domain location=178-200; Score =11.4; E_value=2.1; Accession=PF00560.23; Description=Leucine Rich Repeat
  Pfam annotation: Domain name=LRR_1; Domain location=202-225; Score =9.4; E_value=5; Accession=PF00560.23; Description=Leucine Rich Repeat
  Pfam annotation: Domain name=LRR_1; Domain location=227-249; Score =17.6; E_value=0.044; Accession=PF00560.23; Description=Leucine Rich Repeat
  Pfam annotation: Domain name=LRR_1; Domain location=251-272; Score =6.5; E_value=17; Accession=PF00560.23; Description=Leucine Rich Repeat
  Pfam annotation: Domain name=LRR_1; Domain location=274-296; Score =9.3; E_value=5.1; Accession=PF00560.23; Description=Leucine Rich Repeat
  Pfam annotation: Domain name=LRR_1; Domain location=304-326; Score =14.2; E_value=0.46; Accession=PF00560.23; Description=Leucine Rich Repeat
  Pfam annotation: Domain name=LRR_1; Domain location=329-351; Score =18.8; E_value=0.019; Accession=PF00560.23; Description=Leucine Rich Repeat
  Pfam annotation: Domain name=LRR_1; Domain location=354-376; Score =5.3; E_value=29; Accession=PF00560.23; Description=Leucine Rich Repeat
  Pfam annotation: Domain name=LRR_1; Domain location=378-400; Score =6.1; E_value=21; Accession=PF00560.23; Description=Leucine Rich Repeat
  Pfam annotation: Domain name=LRR_1; Domain location=402-424; Score =4.4; E_value=43; Accession=PF00560.23; Description=Leucine Rich Repeat
  Pfam annotation: Domain name=LRR_1; Domain location=426-448; Score =14.5; E_value=0.38; Accession=PF00560.23; Description=Leucine Rich Repeat
  Pfam annotation: Domain name=LRR_1; Domain location=451-473; Score =5.6; E_value=26; Accession=PF00560.23; Description=Leucine Rich Repeat
  Pfam annotation: Domain name=LRR_1; Domain location=475-497; Score =8.0; E_value=9.1; Accession=PF00560.23; Description=Leucine Rich Repeat
  Pfam annotation: Domain name=LRR_1; Domain location=499-521; Score =16.6; E_value=0.091; Accession=PF00560.23; Description=Leucine Rich Repeat
  Pfam annotation: Domain name=LRR_1; Domain location=523-545; Score =19.6; E_value=0.012; Accession=PF00560.23; Description=Leucine Rich Repeat
  Pfam annotation: Domain name=LRR_1; Domain location=547-570; Score =3.3; E_value=69; Accession=PF00560.23; Description=Leucine Rich Repeat
  Pfam annotation: Domain name=LRR_1; Domain location=58-80; Score =10.6; E_value=2.9; Accession=PF00560.23; Description=Leucine Rich Repeat
  Pfam annotation: Domain name=LRR_1; Domain location=82-104; Score =11.4; E_value=2.1; Accession=PF00560.23; Description=Leucine Rich Repeat
  Pfam annotation: Domain name=Pkinase; Domain location=664-962; Score =132.7; E_value=1e-36; Accession=PF00069.15; Description=Protein kinase domain
  Pfam annotation: Domain name=Pkinase_Tyr; Domain location=664-955; Score=79.6; E_value=1e-20; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain ...
  Pfam module annotation: Pfam domain module=location=106-128::130 -152::154-176::178-200::202-225::227-249::251-272::274-296::304 -326::329-351::354-376::378-400::402-424::426-448::451-473::475 -497::499-521::523-545::...
  Pfam module annotation: =547-570::58-80::82-104::664-962::664-955
ESISTDPYGIFLSWNNSAHFCNWHGIICNPTLQRVTELNLLGYKLKGTISPHVGNLSYMRSLDLGNNSFYGKIPQELGQLSRLQILYVDNNTLVGKIPTNLASCTRLKVLDLGGNNLIGKIPMKFGSLQKLQQLVLSKNRLIGGIPSFIGNFSSLTDLWVGDNNLEGHIPQEMCSLKSLTNVYVSNNKLSGTFPSCLYNMSSLSLISATNNQFNGSLPPNMFYTLPNLQELYIGGNQISGPIPPSITNASILTELDIGGNHFMGQVPRLGKLQDLQYLSLTFNNLGDNSSNDLEFLESLTNCSKLQILVISYNNFGGHLPNSLGNLSTQLSELYLGGNQISGEIPEELGNLLIGLILLTMENNNIGGIIPTTFGMFQKMQLLDLSANKLLGEIGAFVGNLSQLFYLAMGANMFERNIPPSIGNCQMLQYLNLSQNNLIGTIPIEIFNLSSLTNSLDLSQNSLSGSILEEVGNLKNLNWLGMYENHLSGDIPGTIGECIMLEYLYLDGNSLQGNIPSSLASLKSLRYLDLSRNRLSGSIPNVLQNIFVLEYLNVSFNMLDGDVPTEGVFRNASTFVVTGNNKLCGGISELHLPPCPVIQGKKLAKHHKFRLIAVMVSVVAFLLILLIILTIYWMRRSKKASLDSPTFDLLAKVSYQSLHNGTDGFSTANLIGSGNFSSVYKGTLELENNVVAIKVLNLKRKGAHKSFIAECNALKNIKHRNLVQILTCCSSTDYKGQEFKALIFEYMKNGSLEQWLHPRALSQEHLRALNLDQRLNIMIDIASALNYLHHECEQSVVHCDLKPSNVLLDDDMIAHVSDFGIARLISTINGTTSKKTSTIGIKGTVGYAPPEYGVGSEVSTYGDVYSFGIILLEMLTGRRPTDEMFEDGQNIHNFVAISFPDNLLQILDPRLIPTNEATLEGNNWKKCLISLFRIGLACSMESPKERMDMVDLTRELNQIRKAFLVGE

SEQ ID NO: 197467 - protein, 47 aa, Glycine max
  Coding DNA Sequence Number=SeqID_80689
MEHASREPRVSLPPKVKLLKTIEALAQALKDCTRARKEARIWSLIGD

SEQ ID NO: 197468 - protein, 200 aa, Glycine max
  Coding DNA Sequence Number=SeqID_80690
  Homolog annotation: Hit_ID=Q2HTE3; Match level="QueryCoverage=20%, HitCoverage=4%, E-value=3e-09, Identity=76%"; Hit description =Kinesin, motor region
MTLVYNRQLFCGICNSHTDCQSPKPKATQPSPLAAIHHFSDAIALASTSHVLYSNRSAAYTSLKNYIEKKGIYKKSGGAKGVSIVDEKGEEENQKKNIEKGQKYKVVFYAKADGAINLDVSFVGSEKGEKLASNGELPPGAGVIPRAVKQIFDTFESQNAEYSVKEHTVCLEGFLEYSNHPYFGLSPQIELLHQRDYVLE

SEQ ID NO: 197469 - protein, 80 aa, Glycine max
  Coding DNA Sequence Number=SeqID_80691
MVPKNCFRMSGDDNFVNNKRYLKSHPLTFFPSHGIATISRDSNEDELLHSGSEMSTTTDDSEIEMLNISSGNEVHVSIPV

SEQ ID NO: 197470 - protein, 219 aa, Glycine max
  Coding DNA Sequence Number=SeqID_80692
MSKANSEMQSLEHELHDSPKEEKENELRKEIHVLDKGDNLSSPNVFQNLKDKQSVVTKERDKLMIEMEDQHKRMEFLQKNCQDEPKRDNPAELKENGDREGRAAREREMGKGKSGERRESEERGERELSKAKVHIEELNWKLSDMEAKMPVGGLKNNKEMVKLRMRLRGTQAKLDSFRCRYKEAIDESVLTNKKYKDQLASKGLEVLNLMKQLAAAKGQ

SEQ ID NO: 197471 - protein, 212 aa, Glycine max
  Coding DNA Sequence Number=SeqID_80693
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=81%, HitCoverage=10%, E-value=2e-44, Identity=50%"; Hit description=Chromo
  Pfam annotation: Domain name=Chromo; Domain location=103-157; Score =16.2; E_value=0.012; Accession=PF00385.14; Description='chromo' (CHRromatin Organisation MOdifier
MKHNAYKKRRDCQLEIRDLALVKLQPYMQHSMALRKSQKLGMKHFGPFEVLDRIGGVTYKLKLPETTRIHPVFHISILKKFVGSSKQPYLPLPLTLSDNGLVVEPKAVLDSRVVLRDSSQVQQVLIQWELASPKKAMWEDITWVKATYLQFNLEDKVVVKGKGNVTCEMEGGILARNSVSKEVHMAADPHSMGVRKSTRTRRENIRLQGYTL

SEQ ID NO: 197472 - protein, 137 aa, Glycine max
  Coding DNA Sequence Number=SeqID_80694
  Subcellular localization annotation: CTP_CleavageSite=28; ConfidenceScore=5.07e-01
MPAFDDGHSNISSKPMLKLLQNRYNFVVGFLVWAFVVVGRCCHFLLLSWCFCFALPSDAVEDLQYGVGCETLEVKGTRESVFEEETLEVEGGLDDKERGGVDAEEEDGYGDDPKRVEGGKEGGGDQEEEGQLGESRM

SEQ ID NO: 197473 - protein, 152 aa, Glycine max
  Coding DNA Sequence Number=SeqID_80695
MKMMVQLMTAMVSSRGIEPTKLLPQVQQHKVNGQEELIASKRITPMPPKPANPQAPGPDARCEYHRGIRHWTNDCYHLRHRIQDLLDHPLLTFYLRGRNAYYALKNPCPSLQDESESSSICKKRKTSQIQPLISLKDRLVRPKVKDAVIFFY

SEQ ID NO: 197474 - protein, 585 aa, Glycine max
  Coding DNA Sequence Number=SeqID_80696
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=57%, E-value=7e-78, Identity=43%"; Hit description=Chromo
  Pfam annotation: Domain name=RnaseH; Domain location=466-585; Score= -34.7; E_value=0.099; Accession=PF00075.14; Description=RNase H
  Pfam module annotation: Pfam domain module=Retrotrans_gag::RnaseH; Domain location=23-116::466-585
MEWIFKVEKFFNYHHTLDQDCVDIASIHFEKDVIPWFQMLQRLQTVNMWVKLRRALESQFGPSLFECPMDELFKLQQVGTIADYYLKFMGLAHRSEDIHRGVVAQAPADLLRAVSLTKLYKEKYFSLPSPRSTPFTPRNSTLSALNNHNTQNTAQKYPIKNNLPPLLPTPNVPPIQNNNVKKISPAEMQLRMEKGLCYFCDEKFSFNHKCPNRQLLLLQYKTDDAELECHDSEDKFDSMADNSNVVIEDHHLSLNALKGGMGVSTIRFMAYIGKLPVKALPRVVKFLMLPIEPAPFFKVMVRNGNYMDAEGMDGRFSTLQGDTDLTLGTTHLHYIRRMLQTNVVAEVFTLQLIETNSIQFPLLELPTDMEPELALLLHSYSTVFYTPTSSPPPRFHDHSITLIEGFQPVKVKPYRRFVKGYASIVAPLTDLLKKDSVKWYVSAITAFNKLKEVMTSALVLAIPNFKKPFVLETDASGTGIGVVLSQDEHPIAYFSKKLSSRMQKQSAYIREFHAITEALAKFRHYLLSHKFIIRTNQKSLKELLEQRLQTPEQQQWLPKFLGYDFVIQYKPDRENIHVDALSRSF

SEQ ID NO: 197475 - protein, 140 aa, Glycine max
  Coding DNA Sequence Number=SeqID_80697
MNLGHDQEEGSWEGDHTWVIGPRSQVLACYHPRAITIWCSRCSSSMEEPTQSKVNSDRLEDSITKLITHQLSLRETLHTMTLKLDELIHKLATAESSGHSPSSSTAIPPPFSPSSSHGMKLEVPRFDGTNPLELLLGSSG

SEQ ID NO: 197476 - protein, 207 aa, Glycine max
  Coding DNA Sequence Number=SeqID_80698
MRVMIGASVHRFGVWKEVYMVIGKSRRRQGMELCRYNANMKAGTGSIIANQRTKLRWSDEMKRGVSVALQLNNDVEVNGESDVLDMYRNSFTEKKTLIIFCNQKKSLRGAFVAAMELLIAIETEVAKGKRMTPEKTKEETTCWKMELGQGLNFKANLQGQAGNEAAQEELRCETDDSVCQDLELRKGPHTGKGQSKSKELGEISVKT

SEQ ID NO: 197477 - protein, 163 aa, Glycine max
  Coding DNA Sequence Number=SeqID_80699
  Homolog annotation: Hit_ID=O21999; Match level="QueryCoverage=31%, HitCoverage=33%, E-value=3e-22, Identity=100%"; Hit description=LacZ- alpha
MTKSTPATSYLHCFFFSSNYYCYDSLTSPSSLWLEKTLFAGKPTATFAVRDSASEHMGKTSWLIILVTCLCLLAFSDGRELKVRHKKPHYQYNHTLATILVEYASASRPAGMQAWHWPSFYNVVTGKTLALPNLIALQHIPLSPAGVIAKRPAPIALPNSCAA

SEQ ID NO: 197478 - protein, 99 aa, Glycine max
  Coding DNA Sequence Number=SeqID_80700
MVLEGSSLCEGPPNTSSKAAKKRSWVNESGNCNTPIESHQNKKDPEVVQVWDCTTKDSLKEFIGTTYTNKMHLLFDSPSLKNFIVKRAWLGIVVGWVTF

SEQ ID NO: 197479 - protein, 1144 aa, Glycine max
  Coding DNA Sequence Number=SeqID_80701
  Gene Ontology: Mol. function=nucleic acid binding; Cellular component= nucleus; Biological process=chromatin modification
  Homolog annotation: Hit_ID=Q7G8Y3; Match level="QueryCoverage=85%, HitCoverage=88%, E-value=0.0, Identity=82%"; Hit description =Probable chromatin remodelling complex ATPase chain
  Pfam annotation: Domain name=DEAD; Domain location=198-364; Score= -33.1; E_value=0.0035; Accession=PF00270.19; Description=DEADDEAH box helicase
  Pfam annotation: Domain name=HAND; Domain location=758-848; Score =25.0; E_value=1.9e-08; Accession=PF09110.1; Description=HAND
  Pfam annotation: Domain name=Helicase_C; Domain location=533-612; Score=101.3; E_value=2.8e-27; Accession=PF00271.21; Description =Helicase conserved C-terminal domain
  Pfam annotation: Domain name=Myb_DNA-binding; Domain location=849 -895; Score=22.1; E_value=0.002; Accession=PF00249.21; Description =Myb-like DNA-binding domain
  Pfam annotation: Domain name=ResIII; Domain location=194-358; Score =0.9; E_value=3.9e-05; Accession=PF04851.6; Description=Type III restriction enzyme, res subunit
  Pfam annotation: Domain name=SLIDE; Domain location=904-1017; Score =241.9; E_value=1.4e-69; Accession=PF09111.1; Description=SLIDE
  Pfam annotation: Domain name=SNF2_N; Domain location=200-478; Score =476.4; E_value=3.4e-140; Accession=PF00176.13; Description=SNF2 family N-terminal domain
  Pfam module annotation: Pfam domain module=DEAD::HAND::Helicase _C::Myb_DNA-binding::ResIII::SLIDE::SNF2_N; Domain location=198 -364::758-848::533-612::849-895::194-358::904-1017::200-478
MARPSKLHSSSDEALSNASSSSDEEEQVNEQINEEEDEEELEAVARPASSADDDDEVAGDNPPDSDEDPAADDADDDQDGDNVDPEISKREKARLKEMQKMKKQKIQEILDVQNAAIDADMNNRGKGRLKYLLQQTELFAHFAKGDQSSSQKKSRGRGRHASNFTEEEEDEEYLKGEEDGLANTRLVTQPSCIQGKMRDYQLAGLNWLIRLYENGINGILADEMGLGKTLQTISLLGYLHEFRGIKGPHMVVAPKSTLGNWMNEIRRFCPVLRAIKFLGNPDERRHIRDELLVAGKFDVCVTSFEMAIKEKSALRRFSWRYIIIDEAHRIKNENSLLSKTMRLYSTNYRLLITGTPLQNNLHELWSLLNFLLPEIFSSAETFDEWFQISGENDQQEVVQQLHKVLRPFLLRRLKSDVEKGLPPKKETILKVGMSQMQKQYYRALLQKDLEVVNAGGERKRLLNIAMQLRKCCNHPYLFQGAEPGPPFTTGDHLIENAGKMVLLDKLLPKLKERDSRVLIFSQMTRLLDILEDYLMFRGYQYCRIDGNTGGDDRDASIDAFNKPGSEKFVFLLSTRAGGLGINLATADVVILYDSDWNPQVDLQAQDRAHRIGQKKEVQVFRFCTEYTIEEKVIERAYKKLALDALVIQQGRLAEQKTVNKDELLQMVRFGAEMVFSSKDSTITDEDIDRIIAKGEEATAELDAKMKKFTEDAIKFKMDDTAELYDFDDEKDESRFDIKKIVSENWIEPPKRERKRNYSESEYFKQTMRQGGPTKPKEPRIPRMPQLHDFQFFNTQRLSELYEKEVRYLMQTHQRNQIKDSIDVDEPEEVGDPLTAEELEEKERLLEEGFSSWSRRDFNTFIRACEKYGRNDIQSIASEMEGKTEEEVERYAKVFKERYKELNDYDRIIKNIERGEARISRKDEIMKAIGKKLDRYKNPWLELKIQYGQNKGKLYNEECDRFMICMVHKLGYGNWDELKAAFRTSPLFRFDWFVKSRTTQELARRCDTLIRLVEKENQEYDERERQARKEKKLAKSMTPSKRALARQTESPSSLKKRKQLTMDDYASTVCTLTKCVIFLVDYIVSCCVFIKAVHAIVAGEEKKIMNICSILRRISKGLLGFKVLGDLDVAQTWQLMARLAFQKPC

SEQ ID NO: 197480 - protein, 890 aa, Glycine max
  Coding DNA Sequence Number=SeqID_80702
  Homolog annotation: Hit_ID=Q9ZS22; Match level="QueryCoverage=94%, HitCoverage=95%, E-value=0.0, Identity=89%"; Hit description =Cysteine-rich polycomb-like protein
  Pfam annotation: Domain name=CXC; Domain location=483-524; Score =87.2; E_value=4.9e-23; Accession=PF03638.5; Description=TesminTSO1 -like CXC domain
  Pfam annotation: Domain name=CXC; Domain location=570-592; Score=4.0; E_value=0.0091; Accession=PF03638.5; Description=TesminTSO1-like CXC domain
  Pfam annotation: Domain name=Metallothio_2; Domain location=500-588; Score=-15.4; E_value=0.024; Accession=PF01439.8; Description =Metallothionein
  Pfam module annotation: Pfam domain module=CXC::CXC::Metallothio_2; Domain location=483-524::570-592::500-588
  Subcellular localization annotation: CTP_CleavageSite=61; ConfidenceScore=5.36e-01
MDSPEPSKNNNGSSSSASTLNNNNNNDDAPSSESPQVQTLLVYKESPFLRFVKTLSPIPTKASHMTQGCVGLSSPPLVFKSPRISHRETQLTKRPQGTQSFGGVIPQSVNEGNRLGEAPGDSRTSNSHQSLPERFINDTQQVFDFKNDENTQYYSSPSCIDKYLVDPGDIDQMYSADQDVQQQSTDAAETSLSDQTHSKNNILNFDRKDGPGDKVEESLPLSEDFNKVHLEKAAYGEEPEKMEGEKNDVEWSSQEPAKLESILAADGFDKRYSHGPLPQWMPNPLQDVKGCEDYNEMVPTSHVTAENILQDGSEATLKHHGIRRRCLQFGEAASNALGRNVKLNAASNTMITVKPSELVTSLCPRRGSGNFPSTSPKPSGIGLHLNSIINAIPIDQAATTGVRLSDSSQGMKSTSSIRLQRMENVKRSILSSNVDGRSLVDTRTESHEIDDTVATDTGNSEDLNQPPSPCKKKKKTSVTADDNGCKRCNCKKSKCLKLYCDCFAAGTYCTDPCACQGCLNRPEYVETVVETKQQIESRNPIAFAPKIVQPTTDISSHMDDENLTTPSSARHKRGCNCKSGCRCEGCKNVHGKKEDYVAFGHTSSKERVSSIVEEGSDCTFHNKLEMGASKTVYDLHCLSPITPSLQCSDQGKEDAKSRVISGNYLPSPESDVNMLASCTNYTKSSENLHGSEALLDTNEMLGNTPYDSQIECSDAALLQLTPLPNPEQSGTSSFSSVPNECAKITHSRLSHGCIRQLPGGSLRWRSSPLTPSTRVGEAQYLQCSESDSKLFDILENETPDILKEASTPMTSVKVNSPTQKRVSPPQSCHIGIGSSSSGGLRSGRKFILKAVPTFPSLSPCINSKSNGDEDSCNSPSKSPLKANECPQRES

SEQ ID NO: 197481 - protein, 204 aa, Glycine max
  Coding DNA Sequence Number=SeqID_80703
  Gene Ontology: Mol. function=helicase activity; Biological process =viral genome replication
  Homolog annotation: Hit_ID=Q9ZQ61; Match level="QueryCoverage=99%, HitCoverage=20%, E-value=1e-38, Identity=34%"; Hit description =Putative helicase
MMLSSTKGLQSYKDIRTVANVVYGTFKEACFAKGFLGNDRDFIGALREAKTWGSTHFLRKLFVKLLFMNTMDRPQYVWEQTWQWMTNDIIFNHRRQDEQGAIFYKIMCVVASQSGGVYFLYGYGGTEKTFIWKTLSSVIRSNGGIVVTIVSSGIASLPLPRGRTTHSKFAIPMLATQNSTCNIHQGSDLAELLTITQLIIWDEA

SEQ ID NO: 197482 - protein, 190 aa, Glycine max
  Coding DNA Sequence Number=SeqID_80704
  Homolog annotation: Hit_ID=Q1RSC8; Match level="QueryCoverage=30%, HitCoverage=39%, E-value=1e-13, Identity=61%"; Hit description =Putative receptor kinase, related
MASSSIDNNVPHYVLFLDELLSHIPPRVFGSICCVHYLTRGLDKLIARAIKCIFLGYSRNKKRLEFAVAVDKHAVVALELAWCCWLRWSSLVAVCARAPRLLLHAKIGLGLGRVLPIPSIIPHVSSPPVTFCFLIYHRCPQPQPVEAPPTVETDASSPASIVHPIVVDFDLPIAIRKGSTFTSRMATSDD

SEQ ID NO: 197483 - protein, 365 aa, Glycine max
  Coding DNA Sequence Number=SeqID_80705
  Gene Ontology: Mol. function=microtubule motor activity; Cellular component=microtubule associated complex; Biological process =microtubule-based movement
  Homolog annotation: Hit_ID=Q9SS30; Match level="QueryCoverage=95%, HitCoverage=75%, E-value=1e-133, Identity=72%"; Hit description =Putative kinesin-like centromere protein
  Pfam annotation: Domain name=Kinesin; Domain location=2-223; Score =247.1; E_value=3.7e-71; Accession=PF00225.13; Description=Kinesin motor domain
MDPGLSEDVDREFLLRMSYMEIYNEEINDLLAPEHRKLQIHENLERGIYVAGLREEIVASPEQILDLMEFGESHRHIGETNMNVYSSRSHTIFRMIIESRDRSEDGGSGSSCDAVRVSVLNLVDLAGSERAAKTGAEGVRLKEGSHINKSLMTLGTVIKKLSEGAESQGSHVPYRDSKLTRILQPSLGGNARTAIICNITLAQIHTDETKSSLQFASRALRVTNCAQVNEILTDAALLKRQKKEIEDLRAKLMGSHSEHLEQEILNLRNTLLQTELERERIALELEEEKKAQVEWEKRVQEQAKKIENLSSMVLFSNRDESREHIKKVVKANFTMFWIHPRNKNIKLYDCIFWCTIERILLLTDS

SEQ ID NO: 197484 - protein, 194 aa, Glycine max
  Coding DNA Sequence Number=SeqID_80706
MTSSTLSRLTKRLLKTHPIIIDIGTSNFEHKGVLTAPSFLSGSVETQKEILTINLSCQTKSLAHYQDEYSIIDCFECCVTITYAALEKDWIFNLHFMPPLDNQTCGRPLATQRTHVWTVELTQAMISAPHPLVLPMHALTYVDVAKKNMTVMVNHGHLLLWKLTLHDAEKGLQCVAEPWYQYLRDNDFSAGDEI

SEQ ID NO: 197485 - protein, 76 aa, Glycine max
  Coding DNA Sequence Number=SeqID_80707
MDSIIKILLVQKHSIGVEHKPMQKLLHERLSNKKQNYKKESYSEVGKAIMISSPSLKNSKETPLLVKKEPATNSRR

SEQ ID NO: 197486 - protein, 118 aa, Glycine max
  Coding DNA Sequence Number=SeqID_80708
MQSQGLALPLEPEVGPSGPRVSTKESCVNPSRIDLGTGDSDKCGLYIEENPSRLVALGRLYEGSTTVHNIPLLHGQVKVVLRRLKMQRLSFLYPLTRKLCLQQNLQKARMKRSMIPCT

SEQ ID NO: 197487 - protein, 294 aa, Glycine max
  Coding DNA Sequence Number=SeqID_80709
  Gene Ontology: Mol. function=oxidoreductase activity, acting on single donors with incorporation of molecular oxygen, incorporation of two atoms of oxygen; Biological process=L-phenylalanine catabolic process
  Homolog annotation: Hit_ID=Q9M6U1; Match level="QueryCoverage=97%, HitCoverage=66%, E-value=1e-136, Identity=72%"; Hit description =Homogentisate 1,2-dioxygenase
  Pfam annotation: Domain name=HgmA; Domain location=2-278; Score =470.0; E_value=2.9e-138; Accession=PF04209.4; Description =homogentisate 1,2-dioxygenase
MGKCYTTYRYTANKSMDNCAFCNADGDFLIVPQQGRLLVTTECGRLKVSPGEIAILPQGFRFSVNLPDGPSRGYVAEIFGTHFQLPDLGPIGANGLASPRDFLVPTAWFEDKSYPGYTIVQKFGGELFDAVQDFSPFNVVAWHVLTAPTDKPGVALLDFVIFPPRWLVAEHTFRPPYYHRNCMSEFMGLIHGGYEAKADGFLPGGASLHSCMTPHGPDTKSYEATIARGNDVGPCKITDTMAFMFESSLIPRISQWASESPFLDQDYYQCWIGLKSHFAVTKTSPENPSLGNGD

SEQ ID NO: 197488 - protein, 99 aa, Glycine max
  Coding DNA Sequence Number=SeqID_80710
MYEIYNYQISQPKHFLEWKQVRSSSTVPPHTNTISNTNTWTPPQQHFLKYNIDAAVFIDSKSFGLGMCLRDCNGDFVKAKTNTVSGIPIPKETEAWALH

SEQ ID NO: 197489 - protein, 84 aa, Glycine max
  Coding DNA Sequence Number=SeqID_80711
  Gene Ontology: Mol. function=nucleic acid binding; Biological process= DNA integration
MIQNEPIVEEPQEVALRRSQRERRLDISKEKKEIPEGCKRIGCKWAFKTKDSHGNLEGYKVRLVTKGFTQRDDVDHKETFSLVT

SEQ ID NO: 197490 - protein, 124 aa, Glycine max
  Coding DNA Sequence Number=SeqID_80712
MQNSNRDVYMGAYLNGAHWQMVLILPKENVVIWFCSLHKRPDNYLKGIINSALKGLDDTPQSKSKVAARWIVVKCNRQKGSTEYGYYVMHWMSTIILGSFKNNWEMYFYDARPLEPERLKALRI

SEQ ID NO: 197491 - protein, 61 aa, Glycine max
  Coding DNA Sequence Number=SeqID_80713
MPIKRILNAFRIFELVHTGKEKDKHAKTWAQSVVLEKKEKGGPQDAVYSNNFTNHKRVLVK

SEQ ID NO: 197492 - protein, 57 aa, Glycine max
  Coding DNA Sequence Number=SeqID_80714
WNGVEVLKQWKRYFAGYISEKKRQQLNESELWHMPTLISSGEAFSTIFSITLRVLPR

SEQ ID NO: 197493 - protein, 172 aa, Glycine max
  Coding DNA Sequence Number=SeqID_80715
MASSKHHRQSLCFYNKKTLLKRQLAFRVKARRTLHHLRGAVKFEALIQDHMAREQTSRIQDQIKARRLYMIAEAMIKQKKLEKQLKLEAKIHELQDVEAKLHGESRVIQRCFDDNKDDDKGDDKKLKRQSKNEFKIFKIESRTLQDSKGKLISRIKNQDSRDQDFKNQDSRD

SEQ ID NO: 197494 - protein, 220 aa, Glycine max
  Coding DNA Sequence Number=SeqID_80716
  Gene Ontology: Mol. function=zinc ion binding
  Homolog annotation: Hit_ID=Q6H591; Match level="QueryCoverage=94%, HitCoverage=96%, E-value=6e-99, Identity=77%"; Hit description =Putative zinc-finger motif
  Pfam annotation: Domain name=BAH; Domain location=21-136; Score =146.9; E_value=5.3e-41; Accession=PF01426.8; Description=BAH domain
  Pfam annotation: Domain name=PHD; Domain location=140-189; Score =60.0; E_value=7.9e-15; Accession=PF00628.19; Description=PHD-finger
  Pfam module annotation: Pfam domain module=BAH::PHD; Domain location =21-136::140-189
MAKTRPGRKDVDSYTIRGTSKIVRAGDCVLMRPSDTSKPPYVARVEKIEQDNRSNVKVRVRWYYRPEESIGGRRQFHGAKELFLSDHYDVQSAHTIEGKCVVHSFKNYTKLENVGAEDYYCRFEYKAATGAFTPDRVAVYCKCEMPYNPDDLMVQCEGCKDWYHPACMGMTIEEAKKLDHFVCSECSSDDDMKKPQATFSASLGADGKGGEWGHTSMKKN

SEQ ID NO: 197495 - protein, 97 aa, Glycine max
  Coding DNA Sequence Number=SeqID_80717
MPIYNNHNRIERCKMVKETYQAEKQKQTLSNKWLLGDERKPRHMKAKCPQPKKKQCSSDMKKKSLMVTWDDSYNEESNNSDEDQTNIYLIADADKQS

SEQ ID NO: 197496 - protein, 210 aa, Glycine max
  Coding DNA Sequence Number=SeqID_80718
  Gene Ontology: Mol. function=ligase activity
  Homolog annotation: Hit_ID=Q1GYA6; Match level="QueryCoverage=99%, HitCoverage=46%, E-value=1e-85, Identity=74%"; Hit description =Glutamate--cysteine ligase GshA
  Pfam annotation: Domain name=GshA; Domain location=18-210; Score =114.0; E_value=4.2e-31; Accession=PF08886.1; Description=Glutamate -cysteine ligase
MMVPHLTTALSGPLVPLEKRMLDAMPDIEHWFRTQWQEVAAPFYASVDLRNAGFKLAPVDTNLFPGGFNNLNPEFLSLSVQAAQVAVEKICPDARRLLLIPENHTRNTYYLRNVVELCNILKAAGMEVRVGSLSPEITEVTRLETHDGLPLILEPLVREKNRLQLKAVSFEGVDYPAFDSCAILLNNDLSGGVPDMLQNLEQTLIPPLHA

SEQ ID NO: 197497 - protein, 266 aa, Glycine max
  Coding DNA Sequence Number=SeqID_80719
  Gene Ontology: Mol. function=transferase activity, transferring glycosyl groups; Cellular component=integral to membrane; Biological process=peptidoglycan-based cell wall biogenesis
  Homolog annotation: Hit_ID=Q1GYC8; Match level="QueryCoverage=100%, HitCoverage=41%, E-value=1e-107, Identity=70%"; Hit description =Peptidoglycan glycosyltransferase
MATIFYNHRDGNFRIFCGRVGNKPGVVAMAFSNQFFVVFFVLLDTDHLRRPGFGRNVIAGIGADGSSRASRARHIHHAQFHDFQIFWVQVELVGNCVWQHFYLVRFGIHNGVHQMWPDRFTTIGQCGGGVGKLHGRDQRVTLTNTNNHGFTHVPRLFVTLLLPGRGRQQAREFTLNINVGFFTKAKMADKICQAFNAEFNGQAVKKRITRNGDRFSHIDGAMAGRLPIAVTMAAVGQGEVTGVADGEGRLAFARLQTSQSHKWLEC

SEQ ID NO: 197498 - protein, 142 aa, Glycine max
  Coding DNA Sequence Number=SeqID_80720
MVECVWTSWWCHVLRRQWGEGMIGEGEKKKGSGSGGKAMAMTTKEGSCKEWLGSRGRSVESKKEEEPNSGAKSSIVGVQVRSDVLHHVGMRRLNVIQILGLRIPCIKSLPGSGSRWRIMWVERQCKYAEHVGYSEYHKNTYG

SEQ ID NO: 197499 - protein, 97 aa, Glycine max
  Coding DNA Sequence Number=SeqID_80721
  Gene Ontology: Mol. function=zinc ion binding
  Homolog annotation: Hit_ID=Q9FJ71; Match level="QueryCoverage=95%, HitCoverage=7%, E-value=5e-17, Identity=52%"; Hit description =Arabidopsis thaliana genomic DNA, chromosome 5, P1 clone:MTE17
MASSDDEGEAQALSVSNYYFVDDKDDEPVCFSVLPIQWSESESPVGKKMQLFLHGFVDNGLQKFFGQVVAWRFDFSYVRPEISVLSKDGRWIILEKP

SEQ ID NO: 197500 - protein, 107 aa, Glycine max
  Coding DNA Sequence Number=SeqID_80722
  Gene Ontology: Mol. function=transferase activity, transferring hexosyl groups; Biological process=metabolic process
  Homolog annotation: Hit_ID=Q53UH2; Match level="QueryCoverage=94%, HitCoverage=21%, E-value=3e-23, Identity=55%"; Hit description =Glucosyltransferase
MPFLAALEPPKGLECVEAAFPQGFKERVQGRGIVCGGCVPNKKFILEHPSVGCFFTRCGSLSLPEAVVNKCQLELLPNHGEMVINGRGVCYCLKVRIEVEKLKAFKM

SEQ ID NO: 197501 - protein, 174 aa, Glycine max
  Coding DNA Sequence Number=SeqID_80723
  Gene Ontology: Mol. function=zinc ion binding
  Homolog annotation: Hit_ID=Q9FJ71; Match level="QueryCoverage=71%, HitCoverage=9%, E-value=2e-32, Identity=51%"; Hit description =Arabidopsis thaliana genomic DNA, chromosome 5, P1 clone:MTE17
  Pfam annotation: Domain name=PHD; Domain location=51-108; Score=25.3; E_value=0.00017; Accession=PF00628.19; Description=PHD-finger
MVLEDKDMLKIKKLSDEEVKDLARPGFIIDDIDNGMIDEDSDGEDELFDSVCAICDNGGQLLCCDGKCMRSFHANEEDGEESTCASLGFSRKEVDEIQNFYCKNCEYNQHQCFACGTLGCSDKFSGAEAVPQVVSSQMLAKDKLKVYLAPVLYGNRERERENSTPVRTLSYVRT

SEQ ID NO: 197502 - protein, 75 aa, Glycine max
  Coding DNA Sequence Number=SeqID_80724
MVVVTTIIVVVAMVVMVAKVVAVDDNGGDDSGGGCNDGHGGDNDIHGGDGIEYGIRGFSTLTHPAQPIELDPLVN

SEQ ID NO: 197503 - protein, 142 aa, Glycine max
  Coding DNA Sequence Number=SeqID_80725
MTLLFPEEQKVQKTVSAPACYQAFCLTDSKRMGANNHKVSPRIMGISAYHGCIMTKLGLCVSSDPTASEWQQGVRITIRYLRVSWVQNDQTWSLLVIGPAASGQQKGANNHKGQYDYGAADKSKALAPTYPPMRNSDLRSSG

SEQ ID NO: 197504 - protein, 164 aa, Glycine max
  Coding DNA Sequence Number=SeqID_80726
  Homolog annotation: Hit_ID=Q9FJ71; Match level="QueryCoverage=39%, HitCoverage=4%, E-value=1e-17, Identity=60%"; Hit description =Arabidopsis thaliana genomic DNA, chromosome 5, P1 clone:MTE17
MSGELKAVARKHTEKRPRKGKEAGKMNGDIAGGGSVPAKASIHARERSVDGYVDGGVSGWSGGRRSGGGGRKRKVGKGGQYVPGGGWFLLFSQPDSDSTLDEKRSPYDLVWDDKSFLLGKSFYLLGSVDANDRQIEQWNVKPPPLYLWSRPDWTDKHKVIAQEH

SEQ ID NO: 197505 - protein, 210 aa, Glycine max
  Coding DNA Sequence Number=SeqID_80727
  Pfam annotation: Domain name=PMEI; Domain location=35-179; Score =92.7; E_value=1.1e-24; Accession=PF04043.6; Description=Plant invertasepectin methylesterase inhibitor
MDHHSTSKTSLILFISLSSLLFLATATRNIHIGRPDIHSDITEFCKKTTNPAVCAQTIQPHFLKNNLDPLKALDVEVDATLASAKKTLIDIQTLESKKGITKSIKDSFDTCKDQYGSMLDAIKETKAAIAKKDIITAKFKFSAVLSYQGACKDAFESGKIPFSEDSDAVYNLGGNCLDIIADMEKAAGPQKMPPVQQTPSAFSNVIGTIN

SEQ ID NO: 197506 - protein, 79 aa, Glycine max
  Coding DNA Sequence Number=SeqID_80728
MEWRFHHRTEVSTSASATQRYVEVPGEAEDSIKIKTFWWKVLHNFLPTKGNLLHKKLYTLSSFATPFHMQEANSIIVGI

SEQ ID NO: 197507 - protein, 379 aa, Glycine max
  Coding DNA Sequence Number=SeqID_80729
  Gene Ontology: Mol. function=tyrosine decarboxylase activity; Cellular component=cellular_component; Biological process=amino acid and derivative metabolic process
  Homolog annotation: Hit_ID=Q9AXN7; Match level="QueryCoverage=99%, HitCoverage=72%, E-value=1e-165, Identity=73%"; Hit description =Tyrosine/dopa decarboxylase
  Pfam annotation: Domain name=Pyridoxal_deC; Domain location=38-379; Score=540.0; E_value=2.4e-159; Accession=PF00282.9; Description =Pyridoxal-dependent decarboxylase con
MNPLDPQEFRRQGHMIIDFLADYYQNIANYPVLSQVEPGYLRELMPYFAPLNPEPIETILQDLQQHIVPGITHWQSPNYFAYFPSSGSTAGFLGEMLSTGFNLVGFNWVSSPAATELESTVMDWLGQVLKLPKAFLFSGSGGGVLLGTTCEAILVTLVAARDKVLGQIGRENICKLVVYVSDQTHCAVQKAAHIIGIHHKNIRAVKTMKSTSFTLLPESLLSAIHTDVQNGLVPCYLCATVGTTSTTAVDPLGPLCKVAKEYGMWVHVDAAYAGSACICPEFRHLIDGVEGANSFSLNAHKWFLTNLDCCCLWLKDPASVIESLSTNSVYLDNSASDSNQVVDYKDWQITLSRRFRALKVWLVLRSYGVANLRNFLRSH

SEQ ID NO: 197508 - protein, 236 aa, Glycine max
  Coding DNA Sequence Number=SeqID_80730
  Gene Ontology: Mol. function=hydrolase activity, acting on glycosyl bonds; Cellular component=cellular_component; Biological process =carbohydrate metabolic process
  Homolog annotation: Hit_ID=P48979; Match level="QueryCoverage=87%, HitCoverage=52%, E-value=1e-80, Identity=65%"; Hit description =Polygalacturonase precursor
  Pfam annotation: Domain name=Glyco_hydro_28; Domain location=2-211; Score=97.7; E_value=3.6e-26; Accession=PF00295.8; Description =Glycosyl hydrolases family 28
MHGVKLMADGNSPNTDGIHVKFSTDVTILAPRIRTGDDCISVGPGCRNLWVEDVACGPGHGISIGSLGWDLDEPGVKNVTVRKATFSKTQNGFRIKSWGRPSSGFVEDVHFEHATMSDVQNPIIIDQHYCPFRNGCPSQASGVKISDISYKDIHGTSATQVAVKFDCSSEQPCERITLEDIRFTYKINKAPQALCNHAGGTTLGIVQPIIHMISNDQRKGTAWGTQRYTQQFTDIR

SEQ ID NO: 197509 - protein, 426 aa, Glycine max
  Coding DNA Sequence Number=SeqID_80731
  Homolog annotation: Hit_ID=Q2QLS0; Match level="QueryCoverage=80%, HitCoverage=78%, E-value=3e-93, Identity=54%"; Hit description=CbbY protein, putative, expressed
  Subcellular localization annotation: CTP_CleavageSite=57; ConfidenceScore=5.97e-01
MATLTQRTVASSIFHSHTLPRKPCFFLRFRFPSTFCNFTFSLSNFAVKSSSRLAVISASSSSEYHHNSSSSPDIAVLLEVDGVLMDSHRVGNRLAFNKAFEKLGLDCANWTEPVYSDLSKRSAGDEEKMPYSVVIVSNKQIGWPSSLPTNEQGLFAKRVLQQKEKALEEFVMSKSLPLRPGLEQFIDDAYNEGVPVVILTAYGKSGDNITGDVLDHSEAQHTDLLTKSFFRCCKGSIMEKLGDDRSIKVIIVGNKEVEQSLYGQLVLGKVIASGLDEELANEAKRAVSAEKQRLAKEVASMLKLSVEIDTSSSERGEGKTRNQRKKCEKGWEENWVLNLAKIVAALRAGAEYAGIPVCNCVLVAGSQSGVAGGTQVGMPCVVLRSSLTSRAEFPLANATMDGFGGADLTISKLRSLRPKNNQRTEW

SEQ ID NO: 197510 - protein, 1082 aa, Glycine max
  Coding DNA Sequence Number=SeqID_80732
  Gene Ontology: Mol. function=protein binding; Cellular component =membrane; Biological process=defense response
  Homolog annotation: Hit_ID=Q84XG0; Match level="QueryCoverage=97%, HitCoverage=94%, E-value=1e-111, Identity=30%"; Hit description=NBS -LRR resistance protein RGH1
  Pfam annotation: Domain name=LRR_1; Domain location=529-550; Score =4.4; E_value=43; Accession=PF00560.23; Description=Leucine Rich Repeat
  Pfam annotation: Domain name=LRR_1; Domain location=552-573; Score =20.6; E_value=0.0056; Accession=PF00560.23; Description=Leucine Rich Repeat
  Pfam annotation: Domain name=LRR_1; Domain location=575-597; Score =13.7; E_value=0.68; Accession=PF00560.23; Description=Leucine Rich Repeat
  Pfam annotation: Domain name=LRR_1; Domain location=599-621; Score =7.0; E_value=14; Accession=PF00560.23; Description=Leucine Rich Repeat
  Pfam annotation: Domain name=LRR_1; Domain location=742-763; Score =4.8; E_value=36; Accession=PF00560.23; Description=Leucine Rich Repeat
  Pfam annotation: Domain name=LRR_1; Domain location=795-825; Score =5.8; E_value=24; Accession=PF00560.23; Description=Leucine Rich Repeat
  Pfam annotation: Domain name=LRR_1; Domain location=901-923; Score =13.8; E_value=0.61; Accession=PF00560.23; Description=Leucine Rich Repeat
  Pfam annotation: Domain name=LRR_1; Domain location=925-952; Score =5.1; E_value=32; Accession=PF00560.23; Description=Leucine Rich Repeat
  Pfam annotation: Domain name=LRR_1; Domain location=975-997; Score =8.9; E_value=6.2; Accession=PF00560.23; Description=Leucine Rich Repeat
  Pfam annotation: Domain name=LRR_1; Domain location=999-1021; Score =14.1; E_value=0.5; Accession=PF00560.23; Description=Leucine Rich Repeat
  Pfam annotation: Domain name=NACHT; Domain location=174-304; Score= -23.3; E_value=0.0038; Accession=PF05729.3; Description=NACHT domain
  Pfam annotation: Domain name=NB-ARC; Domain location=128-403; Score =25.4; E_value=6.5e-12; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::NACHT::NB-ARC; Domain location=529-550::552-573::575-597::599-621::742-763::795-825::901 -923::925-952::...
  Pfam module annotation: Domain location=975-997::999-1021::174 -304::128-403
MDVTILADAISDILGRTGSSLALPKENVKEFEDVLRKINDVVHKAKQNNSLDPNVLLWLKEVKDKVNDLNDLMDDLPHKQGNAAIISLIKTGQSMVHRHKVTQQLKKATGLLKSFATEGEKLSFTQEAKKNERKLKDISGDKFVAVGRENAKKEIVDQLKLFVKNSGNGAVSFPVVTIVGVAGIGKTKLARLVCEDEEVKALFGSPTWVQGNHETFDVESVATCVTKIVDQGNRFLLVVDGLKDEESLQKLQRKLACVSGVVLVTTRNNFVANNIAVSGAVKPYALQGLNQDESWLLFQQIRGQGSSNIKEDVERQIVWEYCGGVPMKIATAAKLIKCSESSFFRDKLEEEFLQELKFTYYHQLSMHQKLCFVYCSLFPQDHVIEAEKLIHLWMAEGFLSRNLCSDPQEFGWACFNDFVPFVFEETGRDEFGVVKSYKMNRLMHELARIVAWDENIVVDSDGKRVHERVVRASFDFALDVQSGIPEALFEKAKKLRTILLLGKTNKSRLPHEVKMATSTCDKIFDTFKCFRVLDLHDLGIKMVPSSIGELKHLRYLDLSHNNIEKLPSSITKLVHLQTLKLSQCHVLKELPKDLEDLSCLMHLYLEGCLDLTHMPRGIGKLSSLQTLSLFVPSKNHHMGGLKDLNKLRGNLEILHLEQLKLSASNATDKYVRDKKHLDCLTLRWDHEEEEEEEKEKEKGNVVVDDKDKKSLDSLEPNQSLRVLCVVGYYGNRFSDWLSSMQCLVKFSLNDCPKCVFIPPLDHLPLLRVLELRRLDSLEFISADAEGSSSSTFFPSLKELTISDCPNLKSWWETPKREDDRPFFNCISKLHVQCCPNLHCMPLYPFLDEELVLVDSSVRSMRDTVHAKTSSEDFIPLSKLKSMLIARITETPPPRWLKSFISLENLQIRDCHKLKCLPEGFKSLSSLQSLTIERCPELDLDKSKTEWEGLKHLRVLTIKEIPKLNSLPWGLEDVTSLQELGLYECSYLSFLPQSIAKLTSLRKLVISNCKSLDSLPKELEMLKYLNTLIITDCPRLMPRCQPETGDDWPQIERIENIVLKQSSQDLRDLWSHGRTGLGKDFYF

SEQ ID NO: 197511 - protein, 336 aa, Glycine max
  Coding DNA Sequence Number=SeqID_80733
  Gene Ontology: Mol. function=metalloendopeptidase activity; Cellular component=proteinaceous extracellular matrix; Biological process =peptidoglycan metabolic process
  Homolog annotation: Hit_ID=Q9SHE9; Match level="QueryCoverage=19%, HitCoverage=38%, E-value=3e-24, Identity=86%"; Hit description=LOB domain-containing protein 4
  Pfam annotation: Domain name=DUF260; Domain location=1-51; Score =32.1; E_value=6.1e-09; Accession=PF03195.5; Description=Protein of unknown function DUF260
  Pfam annotation: Domain name=Peptidase_M10; Domain location=204-335; Score=39.3; E_value=8.7e-10; Accession=PF00413.14; Description =Matrixin
  Pfam module annotation: Pfam domain module=DUF260::Peptidase_M10; Domain location=1-51::204-335
MHQRGDAVSSMVYEANARVRDPVYGCVGAISSLQQQIDVLQTQLALAQAEVAHLRARQNRCFSHHGLRPTSPTTSGFPSSKTLDSHAKPIFDIDMVDQYFPSLSRGATFECSLQNPYISYTLPSKLNPENTQKGQITSARKYLKAFGYQEDKKPNLNNTDTSNTRILQPKRVGKTGFRDHETNVVGSPKLTASTRFAFIQGKPQWPSSKRHLTYVFESGVEGGAPLGLLRRVFREAFRQWSCTSSFTFEEARSGITDWVLQWRPPSGDGFPFDMFGPVSAHAFQPPDGRLHVDADKPRNNEVSIQRGYYDLVWVAMHEIGHLLGLGHSPMRMCMLE

SEQ ID NO: 197512 - protein, 220 aa, Glycine max
  Coding DNA Sequence Number=SeqID_80734
  Gene Ontology: Mol. function=cysteine desulfurase activity; Cellular component=chloroplast; Biological process=cysteine metabolic process
  Homolog annotation: Hit_ID=Q1SA25; Match level="QueryCoverage=92%, HitCoverage=43%, E-value=6e-99, Identity=84%"; Hit description =Aminotransferase, class V
  Pfam annotation: Domain name=Aminotran_5; Domain location=1-191; Score=77.0; E_value=5.7e-20; Accession=PF00266.9; Description =Aminotransferase class-V
MIDVQSLNVDFLVASSHKMCGPTGIGFLYGKIDLLSSMPPFLGGGEMISDVYLDHSTYAEPPSRFEAGTPAIGEAIGLGAAIDYLSGIGMQTIHDYEVELGRYLYERLLSVPNIRIYGPAPSEKVERAALCSFNVENLHPTDLATLLDQQHGVAIRSGHHCAQPLHRYLGVSSSARASLYFYNTKEDVDNFIHALNDTVSFFSSLIIKFKPLNMGCRMHV

SEQ ID NO: 197513 - protein, 149 aa, Glycine max
  Coding DNA Sequence Number=SeqID_80735
  Pfam annotation: Domain name=IWS1_C; Domain location=2-112; Score= -108.2; E_value=0.002; Accession=PF05909.5; Description=IWS1 C -terminus
  Subcellular localization annotation: CTP_CleavageSite=36; ConfidenceScore=5.53e-01
MVRSYTGTISSTNLRTGTKLLLLSLKCSQSRRSWPRSGQSSSRQHASRPEATPLDFVVRPQSKIDPEEIRARAKQAAQDQQRMKMNKKLQQLRAPKKKQLQATKLSVEGRGGDPVSSINGNLKERDVMKIHPYTAFVYSFSAAGNPKYI

SEQ ID NO: 197514 - protein, 208 aa, Glycine max
  Coding DNA Sequence Number=SeqID_80736
  Gene Ontology: Cellular component=chloroplast thylakoid membrane
  Homolog annotation: Hit_ID=Q656E2; Match level="QueryCoverage=77%, HitCoverage=30%, E-value=8e-16, Identity=37%"; Hit description =Endoribonuclease E-like protein
  Pfam annotation: Domain name=Ribosomal_L2_C; Domain location=79-165; Score=-64.6; E_value=0.1; Accession=PF03947.8; Description=Ribosomal Proteins L2, C-terminal domain
MNGSVTGNWQRLGMHAWPLYKPKMLQLKALKKKIDNLAEKKELDSTLVLMITKAWSAAKELNMMKDEVLIDQKEESTSTNMSLDTAIHNIEITLGKSGQLTKGVGAVTKLIAKEGKLATLLLPSGEDPEEQLSALKDAFTPGEEVEGTMWITCTRTTPEKLHTWIKSVLDAYHLSGEGTLIREARDLLNPEVIQKLEVLKKVVEKNFM

SEQ ID NO: 197515 - protein, 60 aa, Glycine max
  Coding DNA Sequence Number=SeqID_80737
MTRSNWMDWINKIAMGWDGTDMSIVSPIPYPDSPTLPDTRRIPYPLDIEYPRPRPIHDLN

SEQ ID NO: 197516 - protein, 206 aa, Glycine max
  Coding DNA Sequence Number=SeqID_80738
  Homolog annotation: Hit_ID=Q6K765; Match level="QueryCoverage=31%, HitCoverage=5%, E-value=1e-12, Identity=59%"; Hit description =Putative phragmoplast-associated kinesin-related protein 1
  Pfam annotation: Domain name=Kinesin; Domain location=31-205; Score= -194.4; E_value=0.036; Accession=PF00225.13; Description=Kinesin motor domain
  Subcellular localization annotation: CTP_CleavageSite=13; ConfidenceScore=5.34e-01
MKRFMLPRNPFSDAAELPSSPSPTPTTSFAKLRPSSHKHKPSKENDLPSDPNLVTPSPAKLKSPLPPRPPSSNPLKRKLTIVDALTDNSLRFRHQGYCQDEAIVFGQGRRRSHSSEDCGKTYTMWGPANCLSHENDQQGLAPRVFQQLFARISEIYNEPIMDLLDPNQKNLQEWSKELILLGHMVPVMWSQLISRGRCPRNSDITI

SEQ ID NO: 197517 - protein, 50 aa, Glycine max
  Coding DNA Sequence Number=SeqID_80739
MAERFIALSAIIPGLKVSAEMNKITTPATARIATSIRKRGPKGIYQDPTT

SEQ ID NO: 197518 - protein, 515 aa, Glycine max
  Coding DNA Sequence Number=SeqID_80740
  Gene Ontology: Mol. function=protein binding; Biological process =hypersensitive response
  Homolog annotation: Hit_ID=Q1HIU5; Match level="QueryCoverage=94%, HitCoverage=73%, E-value=0.0, Identity=73%"; Hit description=Ankyrin repeat BTB/POZ domain-containing protein
  Pfam annotation: Domain name=Ank; Domain location=309-342; Score =19.1; E_value=0.016; Accession=PF00023.20; Description=Ankyrin repeat
  Pfam annotation: Domain name=Ank; Domain location=343-375; Score =23.5; E_value=0.00076; Accession=PF00023.20; Description=Ankyrin repeat
  Pfam annotation: Domain name=BTB; Domain location=56-171; Score=23.4; E_value=3.1e-05; Accession=PF00651.21; Description=BTBPOZ domain
  Pfam module annotation: Pfam domain module=Ank::Ank::BTB; Domain location=309-342::343-375::56-171
  Subcellular localization annotation: CTP_CleavageSite=29; ConfidenceScore=5.34e-01
MAYSAEPSSSLSFTSSSHLSNGSVSHNICSSYGSDPGPNLEALSLSKLSSNFEQLLIETDCDYSDADIVVEGISVSVHRCILASRSKFFHELFKREKGSSEKEGKLKYNMSDLLPYGKVGYEAFLIFLGYVYTGKLKPSPMEVSTCVDSVCAHDACRPAINFAVELMYASYIFQIPEFVSLFQYMNFTCANAWELHLIRLKDQGKALVEDVIPILTVAFHCQLSQLVNQCIDRVARSDLDQISIDQELPNELSQKVKLLRRNPQRDVENDASIVDALSLKRITRIHKALDSDDVELVKLLLNESDITLDEANALHYAAAYCDPKVVSEVLGLGLANVNLRNSRGYTVLHIAAMRKEPSIIVSLLTKGACASDLTFDGQSAVSICRRLTRPKDYHAKTEQGKETNKDRICIDVLEREMWRNPLAGDACMSSHTMADDLHMKLLYLENRVAFARLFFPSEAKLAMDIAHAETTSEFAGLSASNSKGSNGNLREVDLNETPIVQSKRLFSRMEALMKT

SEQ ID NO: 197519 - protein, 150 aa, Glycine max
  Coding DNA Sequence Number=SeqID_80741
  Gene Ontology: Mol. function=zinc ion binding; Cellular component =intracellular; Biological process=transcription
  Homolog annotation: Hit_ID=UPI000065DBF5; Match level="QueryCoverage =95%, HitCoverage=96%, E-value=1e-37, Identity=52%"; Hit description =UPI000065DBF5 related cluster
  Pfam annotation: Domain name=DUF59; Domain location=28-107; Score =37.5; E_value=4.6e-08; Accession=PF01883.9; Description=Domain of unknown function DUF59
MVTELINANPIIYEKKERRAPSAPSAPHDEYAVEPIDQQEDPEHPYSLEELKVITEEAVEVDDQRNYVRVTFTPTVEHCSMATVIGLCLRVKLMRSLPSRYKVDIRVAPGSHATEAAVNKQLNDKERVAAALENPNLLNMVDDCLASSYD

SEQ ID NO: 197520 - protein, 1009 aa, Glycine max
  Coding DNA Sequence Number=SeqID_80742
  Gene Ontology: Mol. function=protein binding; Cellular component =membrane; Biological process=defense response
  Homolog annotation: Hit_ID=Q1SWU6; Match level="QueryCoverage=98%, HitCoverage=97%, E-value=0.0, Identity=57%"; Hit description=Disease resistance protein
  Pfam annotation: Domain name=LRR_1; Domain location=594-615; Score =12.1; E_value=1.5; Accession=PF00560.23; Description=Leucine Rich Repeat
  Pfam annotation: Domain name=LRR_1; Domain location=617-639; Score =11.6; E_value=1.9; Accession=PF00560.23; Description=Leucine Rich Repeat
  Pfam annotation: Domain name=LRR_1; Domain location=641-663; Score =8.1; E_value=8.6; Accession=PF00560.23; Description=Leucine Rich Repeat
  Pfam annotation: Domain name=LRR_1; Domain location=852-877; Score =0.3; E_value=2.5e+02; Accession=PF00560.23; Description=Leucine Rich Repeat
  Pfam annotation: Domain name=LRR_1; Domain location=893-914; Score =3.7; E_value=57; Accession=PF00560.23; Description=Leucine Rich Repeat
  Pfam annotation: Domain name=LRR_1; Domain location=916-938; Score =9.0; E_value=6; Accession=PF00560.23; Description=Leucine Rich Repeat
  Pfam annotation: Domain name=LRR_1; Domain location=940-962; Score =2.8; E_value=84; Accession=PF00560.23; Description=Leucine Rich Repeat
  Pfam annotation: Domain name=NB-ARC; Domain location=151-453; Score =281.0; E_value=2.4e-81; Accession=PF00931.13; Description=NB-ARC domain
  Pfam module annotation: Pfam domain module=LRR_1::LRR_1::LRR_1::LRR _1::LRR_1::LRR_1::LRR_1::NB-ARC; Domain location=594-615::617 -639::641-663::852-877::893-914::916-938::940-962::151-453
MAEFVLETLLGNLKSLVQKELLLFLGFDQDLERLSSLFTAIKATLEDAEEKQFSNRAIKDWLEKLKHEAHILDDIIDECAYEVFGLENQGVKCGPSNKVQGSCLSSFHPKRVVFRYKIAKKLKRISERLMEIAEERNKFHLVEMVREIRSGVLEWRQTTSLVIEPKVYGREEDKDKILDFLIGDASHFEDLFVYPITGLGGLGKTTLAQFIFNDEKVVNHFELRIWVCVSEDFSLERMTKAIIEATSGVACKDLDIGSKQKRLQTMLQRKRYLLVLDDVWDDKQENWQRLKSVLACGAKGASILVTTRQSKVAAIMGTIAPHELSVLPNKYCWELFKHQAFGPNEEEQVELEDIGKEIVKKCRGMPLAAKALGGLLRFKRNKNEWLNVKESNLLELSQNENSIIPVLRLSYMNLPIEHRQCFAYCSIFPKDESIGKQYLIELWMANGFISSDERLDVEDVGDRVWNELYHRSFFQDIEIDEFGKVTSFKMHDLVHDLALSIAQDVCCITEDNRVTNLSGRILHLSDHRSMRNVHEESIDALQLYLVKSLRTYILPDHYGDQLSPHPDVLKCHSLRVLDFVKRENLSSSIGLLKHLRYLNLSGGGFETLPGSLFKLWNLQILKLDRCRRLKMLPNSLICLKALQQLSFNGCQELSRLPPQIGKLTSLRILTKFFVGKERGFCLEELGSQKLKGDLDIKHLGNVKSVMDAKEANMSSKQLKKLRLSWDRNEDSELQENVEEILEVLQPDTQQLWRLEVEEYKGFHFPQWMSSQSLKYLTILYWMDRKNCLGLPLLGKLPSLKTIRIQNMIHVEYFYQESYDGEVVFRALEDLSLRQLPNLKMLSRQYGENMFPRFSILEIDGCPKFLGEEVLLHRLHSLSVISCGKFNLSAGFKCLQKLWISECKGVKNLQALQYMTSLKEIRLRNLHELESLPDCFGNLSLLHTLSIFHCSKLTCLPMSLSLSGLQQLTIFGCHSELEKRCEKETGKDWPNIAHIRHISVGSTLYDHISD

SEQ ID NO: 197521 - protein, 375 aa, Glycine max
  Coding DNA Sequence Number=SeqID_80743
  Gene Ontology: Biological process=response to UV-B
  Homolog annotation: Hit_ID=Q10DW0; Match level="QueryCoverage=90%, HitCoverage=78%, E-value=8e-82, Identity=47%"; Hit description =Expressed protein
  Pfam annotation: Domain name=DUF760; Domain location=1-374; Score =581.9; E_value=6.2e-172; Accession=PF05542.2; Description=Protein of unknown function (DUF760)
MQDACCNHTRVADGDSCPSSYNPKHYNELYNFRARGLVARASADPRDNLVPFAPLQFESPVGQLLEQISNTHPHLLPAAIDQQLENLQTARDAQNESSDSSLDSLYKRIAEVKEKEKRTTLEEILYCSIVHKFLENNISMIPKISATSDPTGRVDLWPNQELKLEGVHSPEAFEMIQSHLSLVLGDRLVGPLQTVVQISKIKLGKLYAASIMYGYFLKRIDERFQLERSMGTLPKDFGKAKSFDEPSPGIKLWDPDSLIIVHDYDNDSDHMDTDEGRSFRLRAYVMQLDAETLQRLATVRSKEAISLIEKQTQALFGRPDIRVSEDGSIETSNDELLSLTFSGLTMLVLEALAFGSFLWDKENYVESKYPFLDID

SEQ ID NO: 197522 - protein, 76 aa, Glycine max
  Coding DNA Sequence Number=SeqID_80744
MEVVARKQGKSFAKAYRVEKTTKNVENLGAKATNNWGGIDKDYNAYFFLYVKFVNYGPKFKVLHIALRVFMSDTTM

SEQ ID NO: 197523 - protein, 191 aa, Glycine max
  Coding DNA Sequence Number=SeqID_80745
  Gene Ontology: Mol. function=protein binding; Biological process =defense response
  Homolog annotation: Hit_ID=Q1SWU6; Match level="QueryCoverage=94%, HitCoverage=23%, E-value=1e-27, Identity=37%"; Hit description =Disease resistance protein
  Pfam annotation: Domain name=LRR_1; Domain location=122-144; Score =6.5; E_value=17; Accession=PF00560.23; Description=Leucine Rich Repeat
  Pfam annotation: Domain name=LRR_1; Domain location=20-43; Score=4.3; E_value=45; Accession=PF00560.23; Description=Leucine Rich Repeat
  Pfam annotation: Domain name=LRR_1; Domain location=75-96; Score =10.2; E_value=3.6; Accession=PF00560.23; Description=Leucine Rich Repeat
  Pfam annotation: Domain name=LRR_1; Domain location=98-120; Score =8.2; E_value=8.4; Accession=PF00560.23; Description=Leucine Rich Repeat
  Pfam module annotation: Pfam domain module=LRR_1::LRR_1::LRR_1::LRR _1; Domain location=122-144::20-43::75-96::98-120
MSHVEYLYEESYEGEVVFRALEELTLRWLPNLKRLSREDVENMFPRCSTLEIDDCPQFLVEEVLLQGLHSLSYECLEKLWLSNCREVESLQALQDMTSLQELKLKHLPKLESLPDCFGCLPSLHTLSIFYCSKLTCLPTSLSLSNVQQLTIFCCHSELEKRCEKETGEDWPNIAHIPHISVGSKHYDHISN

SEQ ID NO: 197524 - protein, 348 aa, Glycine max
  Coding DNA Sequence Number=SeqID_80746
  Gene Ontology: Mol. function=long-chain-alcohol O-fatty -acyltransferase activity
  Homolog annotation: Hit_ID=Q84XY9; Match level="QueryCoverage=99%, HitCoverage=99%, E-value=3e-94, Identity=52%"; Hit description=Wax synthase isoform 1
  Pfam annotation: Domain name=MBOAT; Domain location=52-321; Score= -8.5; E_value=1.5e-05; Accession=PF03062.9; Description=MBOAT family
MDIGEVERFIKVWLTTISCLCYCYYITSRIPKGFLRLLSLFPILYLFLILPLNLSSFHLAGPTTFFLVWLGTFKLILFSFNQGPLALSPPNILHFISIASLPINPKQLPPPTNKNHTNNTTQKPKWLFLLKVLIFAMIIRAYDYRENLHPHFILVLYCCHMYLGIELVLALSAAPVRTVLGFEIEPQFNEPYLSTSLQDFWGRRWNLMVTRILRPTVYHPVYRIFIHFVGPSCAKSSAVLATFLVSGLMHELIYYYLSRAPPTWEVTCFFVLHGVCTAAEVVAKKVMLRHGWRLHRVVSGPLVVAFLAVTGRWLFFPQLLRSGLDRKAIGEYAILVDFVKSMVPLYLF

SEQ ID NO: 197525 - protein, 102 aa, Glycine max
  Coding DNA Sequence Number=SeqID_80747
MALLNIVPPHLDMGVGCQVLQLVLTMCLHARIPQTDSMGSLNVHFFVFLVYFSIKMLVHYLKREAFTLSHYSIGHLNILFKWSKAFTQKCILHYFHNYSKSI

SEQ ID NO: 197526 - protein, 158 aa, Glycine max
  Coding DNA Sequence Number=SeqID_80748
  Gene Ontology: Mol. function=ATP-dependent DNA helicase activity; Cellular component=nucleus; Biological process=regulation of transcription, DNA-dependent
  Homolog annotation: Hit_ID=Q38861; Match level="QueryCoverage=85%, HitCoverage=43%, E-value=2e-19, Identity=57%"; Hit description=DNA repair helicase XPB1
MTLIFSTKSKVWTVEIAATLVREDERITDLNFLIGPKLYEANWLDPVKGGFIANVQCKEEEMYYSTKRQQFLVDQGYSFKVFQLVELEHLEEDADEKALHIARRSEGSISTMSGAKGMAYMEYNTGNKKAKHRSRANQEIHRRDTSCLKEDIEQPKLP

SEQ ID NO: 197527 - protein, 201 aa, Glycine max
  Coding DNA Sequence Number=SeqID_80749
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=Q9SZ30; Match level="QueryCoverage=72%, HitCoverage=21%, E-value=3e-56, Identity=72%"; Hit description =Imidazole glycerol phosphate synthase hisHF, chloroplast precursor (IGP synthase) (ImGP ...
  Homolog annotation: Hit description=synthase) (IGPS) [Includes: Glutamine amidotransferase (EC 2.4.2.-); Cyclase (EC 4.1.3.-)]
  Pfam annotation: Domain name=GATase; Domain location=9-180; Score =31.6; E_value=4.9e-10; Accession=PF00117.18; Description=Glutamine amidotransferase class-I
MDWSLKLLLLISSDAILLCRMDEALCSYIEKDRPFLGICLGLQLLFESSEENGPGFLIINSGGNSAQCTSSSIKGLGLIPGTVGRFDSSNGFRVPHIGWNALQITKDLGILDDVGNYHVYFVHSYRAMPSDDNNEWISSTCDYGDKFIASIRRGNVHAVQFHPEKSGGKFYFPFQSFSSLSLLYRILIMEAAIFVEISILH

SEQ ID NO: 197528 - protein, 76 aa, Glycine max
  Coding DNA Sequence Number=SeqID_80750
  Gene Ontology: Mol. function=DNA binding; Biological process=DNA integration
MRRSLQLVQGQVANRYQTKEIVLLKYYQIAKTLIDNFKCLKMYYIPRENNTRKDLLSKLAITKKARHLKTIIQEML

SEQ ID NO: 197529 - protein, 115 aa, Glycine max
  Coding DNA Sequence Number=SeqID_80751
MANKEFAKPYDQEPSAPIALPITHAKPFLGTVKSSFSMAKTSICGRMHLHNFRHQGVASIVTDTARLMMFVLDWKYNTKEGQCSTIKSEYTLMQNQGHNAQNDLFLGSLAYTCSI

SEQ ID NO: 197530 - protein, 991 aa, Glycine max
  Coding DNA Sequence Number=SeqID_80752
  Gene Ontology: Mol. function=protein binding; Cellular component =membrane; Biological process=defense response
  Homolog annotation: Hit_ID=Q1SWU6; Match level="QueryCoverage=99%, HitCoverage=97%, E-value=0.0, Identity=54%"; Hit description=Disease resistance protein
  Pfam annotation: Domain name=LRR_1; Domain location=592-613; Score =12.8; E_value=1.2; Accession=PF00560.23; Description=Leucine Rich Repeat
  Pfam annotation: Domain name=LRR_1; Domain location=615-637; Score =10.6; E_value=2.9; Accession=PF00560.23; Description=Leucine Rich Repeat
  Pfam annotation: Domain name=LRR_1; Domain location=639-661; Score =8.2; E_value=8.5; Accession=PF00560.23; Description=Leucine Rich Repeat
  Pfam annotation: Domain name=LRR_1; Domain location=824-847; Score =1.4; E_value=1.6e+02; Accession=PF00560.23; Description=Leucine Rich Repeat
  Pfam annotation: Domain name=LRR_1; Domain location=850-872; Score =1.2; E_value=1.7e+02; Accession=PF00560.23; Description=Leucine Rich Repeat
  Pfam annotation: Domain name=NB-ARC; Domain location=151-451; Score =284.9; E_value=1.6e-82; Accession=PF00931.13; Description=NB-ARC domain
  Pfam module annotation: Pfam domain module=LRR_1::LRR_1::LRR_1::LRR _1::LRR_1::NB-ARC; Domain location=592-613::615-637::639-661::824 -847::850-872::151-451
MAEFVLETVLRNLNSLVQKELALFLGFDQDLERLTTLFTTIKATLEDAEEKQFSDRAMKNWLGKLKDAALILDDIIDECAYEGLAFENQGIKSGPSDKVQGSCLSSFHPKRVVFRYKIAKKMKTISERLTEIAEERKMFHLTEMVRKRRSGVLELRQTGSSITETQVFGREEDKNKILDFLIGDATHSEELSVYPIAGVGGLGKTTLGQLIFNHERVFNHFELRMWVCVSYFSLKRVTKAIIEAAGNTCEDLDLQSQQRRLHDLLQRKRYLLVLDDVWDDNQENWQRLKSVLACGAKGTSILVTTRLSKVAAIMGTLTPHELPVLSDNDCWELFKHQAFGLNEEEHVELEDTGKEIVKKCRGMPLAAKALGGLLRFKRNKNEWLNVKESNLLELSHNENSIIPVLRLSYLNLPIQHKQCFAYCAIFPKDESIRKQYLIELWMANGFISSDERLDVEDVGDGVWNELYHRSFFQDIEMDEFGKVTSFKMHDLIHDLAQSIAEDACCVTEDNRVTTWSERIHHLSNHRSMWNVYGESINSVPLHLVKSLRTYILPDHYGDQLSPLPDVLKCLSLRVLDFVKRETLSSSIGLLKHLRYLNLSGGGFETLPESLCKLWNLQILKLDRCSRLKMLPNSLICLKALRQLSFNDCQELSSLPPQIGMLTSLRILTKFFVGKERGFRLEELGPLKLKGDLDIKHLGNVKSVRDSKEANMPSKQLNKLRLSWDKNEDSELQENVEEILEVLQPDTQQLWRLDVEEYKGTHFPKWMSSPSLKYLILLNLLNCENCFQLPPLGKLPSLKILGIINNNHVEYLYEESCDGEVVFRALKVLTIRHLPNFKRLSREDGENMFPRLSNLEIDECPKFLGDEELLKGLEFSTPLEIVDFQLQRGGRFAGFTRYDFPQGVKVKESSRELESLPDCFGNLPLLCELSIFFCSKLACLPTSLSLISLQQLTIFGCHLDLEKRCEKETGEDWSKIAHVPYISVGSKHYSPD

SEQ ID NO: 197531 - protein, 979 aa, Glycine max
  Coding DNA Sequence Number=SeqID_80753
  Gene Ontology: Mol. function=peroxidase activity; Cellular component =ubiquitin ligase complex; Biological process=protein ubiquitination
  Homolog annotation: Hit_ID=Q6H6D6; Match level="QueryCoverage=89%, HitCoverage=92%, E-value=1e-172, Identity=40%"; Hit description =Transducin-like
MTSFGEHSTQYPTPERPKHKLSQHEKKPLAAYICHDPRSLGSSKHKAEKGTAQSVSSSQFKRGGSASERSNSKSLSSADSRRVGHLMDDVAIKAVIAILSGYIGRYVKDDNFREKIREKSSSLLERRRRRKDSGDEVFVNMELGTKKIDRLAENQGTIEQVRMIKRLRNSIELLTIVASLNSKTSRDASTCGVPNSHLSACAQLYLAIAYKLQKNDRVSSKHLLQVFCDSPSLARTYLLPDLWEHLFLPHLLHVKIWYNTELEFLSNEAHGEKEKKMKVLSKVYNEKMDTGTNLFAQYYKQWLKVGASEPPLPNVSLPSRPSYRSSRRSSDSFVSNSSINPNLYKTVFGSKLEQQPTGLGDQNGVLAITTGLEIDEKLYLDEYKCSPVQKDDRVFVGRSSQVGKSQAQLWPASQRLDYFQCLSCRFIPKESLENSNYRYKNASTLSRDFVGAITTICSSDVLSECEFAIRVVIKAWLNSPGDPLIEEALTQPNVVEAMLEVLFSSTEDEILELIISILAELIGKNDAIRQIILNSDPQLEIFVRLLKSTSLFLKAAVLLYLSKPKAKQMLSSEWVPLILRVLEFGDKLQTLFTVQCSPQVTAFYVLDQLLTGFDEDKNLENARQVLSLGGLTLLMRRIEGEAHERNNAAMIISCCIRAEGTCRSFLADNINKTSLLELIVIESKQNSSGYALSVLAELLYLDRRTKTLNFLRGLKDGWGGFNVMHIFFIYLQKSPPEERPIVAVIILLLDLMDDPFKGSLYRSEAIEALVEALNCQTCNDRVQQQSARALVLLGGHFSDSGDSLMEKSLLQKAGFREICLEDSYPGKEIVVYDPIHKNVEEEEAEIWQKRAACVLFKSGKKNLLSALADSIANGIPCLARASLITISWMSSYLNIVEDRKLPPMVFSILRPQLLRSLNYDKDVEERVLASYSLLYLVKYSGMRTYTISQAIPNFNFCPERINCLHFFLKLYTFHDGVSQ

SEQ ID NO: 197532 - protein, 69 aa, Glycine max
  Coding DNA Sequence Number=SeqID_80754
  Homolog annotation: Hit_ID=Q6R8G0; Match level="QueryCoverage=99%, HitCoverage=8%, E-value=2e-18, Identity=69%"; Hit description=PHO1 -like protein
KEELRKVKEQLRLVFVEFYQKLLHLKDYSFMNLSTFSKIMKKYEKHTSRAASAAYMTVVDKSYVGSSDE

SEQ ID NO: 197533 - protein, 120 aa, Glycine max
  Coding DNA Sequence Number=SeqID_80755
METGAGGGGKGQQGGKTGIGIPQKPPEEPNLRPEWRRPTRTEQDVVLQPEWRRPRPSAPLSEPSNRVVEEELLFQPEWRRSKPSASAIANANASVWEPERRRSRPTATAFPWNQNYGVRE

SEQ ID NO: 197534 - protein, 443 aa, Glycine max
  Coding DNA Sequence Number=SeqID_80756
  Gene Ontology: Mol. function=transferase activity, transferring glycosyl groups
  Homolog annotation: Hit_ID=Q7XAG2; Match level="QueryCoverage=86%, HitCoverage=84%, E-value=1e-113, Identity=56%"; Hit description=GDP -fucose protein-O-fucosyltransferase 1
  Pfam annotation: Domain name=DUF246; Domain location=73-408; Score= -158.0; E_value=1.9e-05; Accession=PF03138.5; Description=Plant protein family
MEVLSKFLVGPLHSITSKCMVLLVTVLILRALLFPSFPGFDGIEWGNLVCIRTPLLNSDFGIQQDKFLEVPQLVWGLNNQKIAFARACLTARMLNRTLLMPSLSASLFYKEIDLLQPISFDKVFQFEKFNALCRGFVRLGCYSDVLNRTEVLKMEKGSGRRWTVERDLAQLKEHSKGSFDDYEVIRIVGKNPFLWHDHWPVKDYARVFECLDLTEEIAKEADRIVSRIRAVGREVTGNTEAVEVENNIITSDGSSFQPLPFVAVHMRIEIDWMIHCKNLEQRLNTNQICSGKKEIVERVGNIAGLKTPVVVYLAVADKLLNNSSSILDDWEEGFLPFEKKRLGVDGIYKKYPYLIQSAIDYEVCLRADIFVGNSFSTFSSLIALERTQKMIRINVTNMCGENVRWPSYAYNIPGESNGPMRWVTNMSESSLQAISYGTNHISC

SEQ ID NO: 197535 - protein, 430 aa, Glycine max
  Coding DNA Sequence Number=SeqID_80757
  Gene Ontology: Mol. function=translation initiation factor activity; Cellular component=cytoplasm; Biological process=stem cell maintenance
  Homolog annotation: Hit_ID=Q69VD5; Match level="QueryCoverage=81%, HitCoverage=35%, E-value=6e-42, Identity=34%"; Hit description =ZLL/PNH homologous protein
  Pfam annotation: Domain name=DUF1785; Domain location=217-270; Score =62.9; E_value=1e-15; Accession=PF08699.1; Description=Domain of unknown function (DUF1785)
  Pfam annotation: Domain name=PAZ; Domain location=271-409; Score =114.8; E_value=2.4e-31; Accession=PF02170.12; Description=PAZ domain
  Pfam module annotation: Pfam domain module=DUF1785::PAZ; Domain location=217-270::271-409
SSSGGGGGVERRGDPNDLWRRPAPPATDSVVPKLEKLQISKQLPASTCTLEKKDKISPIQRPDNGGTLAILTSRLRVNHFPVKFDPESIIMHYSVGVKPKVSSKFGQPQKLSNSDLSMIREKLFSDDPERLPLEMTAHDGAKNIYSAVQLPEETFTVEISEGENEKAISYSVTLTLVNKLRLCKLMDYLSGHNLSIPRDILQGMDVVVKENPARRAVSVGRHFYPTNPPVIMKDLHHGIIAIGGFQHSLKPTSQGLSLCVDYSVLAFRKQMSVLDFLHERIDNFKLDEFEKFRKFIEEALIGLKVNVTHRKCNRKYIISRLTPMITRYVTFPIDNTGGWNSNDVSLITFFKEKYGKDIVYKDIPCLDLGKDRKKNYVPMEFCVLVEGQRYPKERLDGISANTLKAMSLAHPNERECAIQKMVQSSDGPCR

SEQ ID NO: 197536 - protein, 121 aa, Glycine max
  Coding DNA Sequence Number=SeqID_80758
  Gene Ontology: Mol. function=zinc ion binding
  Homolog annotation: Hit_ID=Q2QLR6; Match level="QueryCoverage=92%, HitCoverage=21%, E-value=6e-22, Identity=51%"; Hit description=Zinc finger family protein, putative, expressed
CCGDEDEEAWKETEEIVVEGLKDELDEFSVKMFFKGLSMAGVENSSSGFSGIGVFMERSSGFPAIRVQKKLDFYAEESMVDYLALLDGLLEATQNKIRRVFAFTDSELLHDQVGISVFHAK

SEQ ID NO: 197537 - protein, 94 aa, Glycine max
  Coding DNA Sequence Number=SeqID_80759
MDELKDLIKQVVPYGISPYGIHETQTKLWLIRALPTSRPHIHNVVFCDTPGNPGALFHDLMGLCAWRDYPWVEMTLQPLSDRMTSLLLNRKQTN

SEQ ID NO: 197538 - protein, 263 aa, Glycine max
  Coding DNA Sequence Number=SeqID_80760
  Gene Ontology: Mol. function=metal ion binding
  Homolog annotation: Hit_ID=Q9FHE4; Match level="QueryCoverage=92%, HitCoverage=78%, E-value=2e-46, Identity=48%"; Hit description =Arabidopsis thaliana genomic DNA, chromosome 5, TAC clone:K17O22
MAVEASYMNLLPSQLLTNRETIKSNQQLQHQLNSDYMYNTTQMDSSSALPLPAATMPESLLSFYQSNFCDPNKADSGLTYHIPLQRKRSRDFTTELTSLPAHQKNKISSESSFLNQEILYQFQNQQSEIDRVLAHHTEKVRMELEEQRMRQSRMLVSAIQEAMVNKLKEKDEEIQRMEKLNWALQERVKSMCMENQIWRELAQTNEATANYLRSNLEQVLAHVGEERATAAEVADDAQSSCGSNDAADAGRRHGGIHGGDRSW

SEQ ID NO: 197539 - protein, 113 aa, Glycine max
  Coding DNA Sequence Number=SeqID_80761
  Gene Ontology: Cellular component=integral to membrane; Biological process=vesicle-mediated transport
  Homolog annotation: Hit_ID=Q67YV9; Match level="QueryCoverage=60%, HitCoverage=38%, E-value=5e-16, Identity=60%"; Hit description =Putative vesicle-associated membrane protein, synaptobrevin 7B
  Pfam annotation: Domain name=Synaptobrevin; Domain location=22-107; Score=65.7; E_value=1.5e-16; Accession=PF00957.11; Description =Synaptobrevin
MGEMSIHTSMATYARYVNCEILVLNFMFFVVCISMPMSIGSNKVLDRGDKIELLVDKTENLHNQAQDFRTSGTRIRRKMWLQNMKIKLIVLGILIALILIIVLSVCRGFNCGK

SEQ ID NO: 197540 - protein, 614 aa, Glycine max
  Coding DNA Sequence Number=SeqID_80762
  Homolog annotation: Hit_ID=Q1SW35; Match level="QueryCoverage=99%, HitCoverage=100%, E-value=0.0, Identity=65%"; Hit description=IMP dehydrogenase/GMP reductase
MSDTEGKSHSSGITRKLDSHKTYHGRDPNHGNNLWKDGLICAFEYIKGQNRSVKSSSSSKITDRLHVNGQHSKMHVPSDDKKKLSDPSSVNVSRDSLFGGSDDDKEGQAHKAGQSKKYEGGHWVPIGWARISELVQAVQVDADWSSHQLEFEDSEDDFTVADLAAPYWEHPAGPIWWCHVFAGHPTVEAWLSNAQWLHPAVSLALRDESRLISERMKHLLYEVPVRVAGGLLFELLGQSAGDPLVEEDDIPIVLRSWQSQNFLVTVMHIKGSVSRINVLGITEVQELLSAGGYNMPRTVHEVIALLACRLSRWDDRLFRKSIFGAADEIELKFMNRRNHEDLNLFILILNQEIRKLSTQKCDYFNSVIGVKMRVEVFKWLDVCSLQVDLSVAEMCMCSWSKVIKLQKAGNEPNKLESSVIRVKWSLHARDEIVFELLQHLKGNGARTLLEGIKKSTREMIEEQEAVRGRLFTIQDVMQSTVRAWLQDRSLRVTHNLAVFGGVGVVLTIITGLFGINVDGIPGAEQTPYAFGVFTAILVVLGVVLIAVGMVYLGLKNPVVEEQVEVRKLELQELVKMFQHEAETHAQMRKNISPKNLPPTAGDAFRSDADYLVIQ

SEQ ID NO: 197541 - protein, 839 aa, Glycine max
  Coding DNA Sequence Number=SeqID_80763
  Gene Ontology: Mol. function=protein binding; Cellular component=cell surface; Biological process=homophilic cell adhesion
  Homolog annotation: Hit_ID=Q1SJW0; Match level="QueryCoverage=97%, HitCoverage=98%, E-value=0.0, Identity=59%"; Hit description =Ubiquitin-associated
  Pfam annotation: Domain name=DUF1296; Domain location=21-80; Score =140.6; E_value=4.1e-39; Accession=PF06972.2; Description=Protein of unknown function (DUF1296)
  Pfam annotation: Domain name=UBA; Domain location=24-65; Score=21.8; E_value=0.0025; Accession=PF00627.21; Description=UBATS-N domain
  Pfam module annotation: Pfam domain module=DUF1296::UBA; Domain location=21-80::24-65
MSGKGGGSHNNGGGKALSATIPASSRKMVQSLKEIVSNFPDHEIYATLKDCNMDPNEAVSRLLSQDPFHEVKSKREKKKEIKDPTDSRSRGSGTNNTSSRGGGRAGTDRYGGRGGANQFGSSDYGLQGKPVYKKENGAPTFGGSTSSAPSVLGNNTNTRLPSYSDSVVTEKTYAFGIGDGPSSSSQRAGLQSAWTGNTGQVSMADIVKMGRPQARPSMHNSSIQSCNHQNVFMPPAASDNNLHSLQGYASKVSETNTNQGHVISDNVPQNDEWPCIENQHDVIVYADVDAHANSEYYANSSSFAEADWQQKTHLDEHVAEDGSVENADNVESASISAKSTSEDNTGAEDDVSSVAANIEQLNIQRDDQGTEQEHENPSVVIPNHLLLHTPECMNLSFGSFGSGNPLSGSGSFTSRPLKSSLEDTSGATDVSTIENSDTRNPDYYGDEHLSTTATTTSDGNLVQGTGVSAGTYEHTSISQQEALKPDPPEIAQENQYSFTSQSHGFNYENAQQPEVTFPLSQTSSQMQNLAPFSGVMVHTNSLPSALLSLPVQTAREDIPYLPFPATQSMPTKYSNIGSSTITVSEALRASGITTPQPNAQTLSGAGVATGPALPQHLAVHPYSQPTLPLGHFANMISYPFLPQSYTYMPSAFQQTFAGNNTYPQSLAAVLPQYKNNVSASSLPQSAAIPPGYGFGSSTSIPGGNFSLNPPAAPTGTTIGYEDLINSQFKDNNHMMSLQQNENSPMWVQGPGSRTMSAVPPSNYYNLQGQNQQQPGGFRQRQQQQQQPSQHFGPLGYPNFYQSQTGISLEHQPQNPREASLGGPQSQPSKQSQQIWQNSY

SEQ ID NO: 197542 - protein, 267 aa, Glycine max
  Coding DNA Sequence Number=SeqID_80764
  Gene Ontology: Mol. function=RNA-directed DNA polymerase activity; Biological process=RNA-dependent DNA replication
MPTIDELLDELANASYFSKLDLRQWFHQIPVVVADMPKIAFRTHQGHYEYNVMRFIRNYASIARPLPKLLRKDQFHWSDDAQQAFLQLKKMMMLALVMVPPNFTLPYSSSKSMLSTPQWELCSNNNSTPIAFFNKHPSGCPFYHLKSGPTTRLSILPPGIDNNNNLDNNMPTKDAQRDQHTYMTTLDFTLSEETLARQALYAFHFSVLLAILLADILLSSSFLLEAINTYHTIRLRFNNFMRFDNFDMGLEKSRDTEKLIMEDGVGI

SEQ ID NO: 197543 - protein, 559 aa, Glycine max
  Coding DNA Sequence Number=SeqID_80765
  Gene Ontology: Mol. function=protein binding; Biological process=red or far red light signaling pathway
  Homolog annotation: Hit_ID=Q1RZ38; Match level="QueryCoverage=61%, HitCoverage=78%, E-value=1e-138, Identity=71%"; Hit description =Cyclin-like F-box; Serine/threonine protein phosphatase, BSU1
  Pfam annotation: Domain name=Clat_adaptor_s; Domain location=373-519; Score=23.8; E_value=3.3e-09; Accession=PF01217.10; Description =Clathrin adaptor complex small chain
  Pfam annotation: Domain name=F-box; Domain location=15-62; Score =31.8; E_value=2.4e-06; Accession=PF00646.23; Description=F-box domain
  Pfam annotation: Domain name=Kelch_1; Domain location=106-153; Score =31.9; E_value=2.2e-06; Accession=PF01344.15; Description=Kelch motif
  Pfam annotation: Domain name=Kelch_1; Domain location=155-201; Score =42.6; E_value=1.3e-09; Accession=PF01344.15; Description=Kelch motif
  Pfam annotation: Domain name=Kelch_2; Domain location=106-153; Score =7.6; E_value=3.8; Accession=PF07646.5; Description=Kelch motif
  Pfam annotation: Domain name=Kelch_2; Domain location=155-201; Score =22.5; E_value=0.0015; Accession=PF07646.5; Description=Kelch motif
  Pfam module annotation: Pfam domain module=Clat_adaptor_s::F -box::Kelch_1::Kelch_1::Kelch_2::Kelch_2; Domain location=373-519::15- 62::106-153::155-201::106-153::155-201
KRENSPREMTRVQLPLLPGLPDDLAVTCLIRVPRIEHRKLHLVCKRWRRLLSEDFFYSLRKSLGMAEEWLYVIKADRAGRISVHAFDPIYQLWQPLPPVPGDFPEAMWFGSAVLSGFHLYLFGGVDLEGSRSIRCVIFYNACTNKWHRAPDMLQKRNLFRSCVINNCLYVSGGELEGIQMTRSAEVYDPSQNRWNLISEMSTSMVPLFGVVHNGTWFFKGNAIGSGNSMCEAYSPETDTWTVVTNGMVNGWDKDCISLNGQLYALGCPDGCKLTVYDRATDSWRKFIDSKLHVGKFPTLVAAAPVSLNGKLCIIRHNMNISLVDVSSPNNQVESNPRDLWENIAGKGHHIRRCYKPEKKIPPDNISYAETCPSVKNVLLLDSDGKRVAVKYFSEDWPTNSAKENFEKVVFNKTQKTNARTEAEIAMFENNIVLYKFVQDLHFFVTGGDYENELILATVLQAFFDSVGLLLRGNVDKKEALENLDLILLCIDEIVDGGGNSVPLPLSVVINEIIILETDPNVIAGKVASNSIDSGAPLSEQTLSQALATAREHLARSLLK

SEQ ID NO: 197544 - protein, 306 aa, Glycine max
  Coding DNA Sequence Number=SeqID_80766
MNCSSIELSLFATCLQPDARAQLSNYGDNDMDECLRVERRCMRGGGVSGGIKGEVSWTGSGSQADAGWRGMSAVNWSWGADLMAKESAAIANHNLEWVDCDGGQSEELCHSSLHKVMGRPDKALRLSCGVSKIKGEGKLDSGSSEFDVDGGSELSSAMRSSSDESHFTDNLGGGGTLVAEGDCEIADGSGDKNRGRRRPEMKQPRRKGAYNITSHDVRSLLRLIHWYQQRAGPSMHGTSNFICGQGNGEEGSDGGGEFFGGRRWKGEGLLALGKAEHNLFESLHGSLPSIVFRHDGSDRASWTKLV

SEQ ID NO: 197545 - protein, 70 aa, Glycine max
  Coding DNA Sequence Number=SeqID_80767
MEAAEAVAGDGEGCKALSSNNECRRAFCKTHKSLQFSAICPANSAVTSVLGAIRGHSAPLPRDHSAIMCD

SEQ ID NO: 197546 - protein, 736 aa, Glycine max
  Coding DNA Sequence Number=SeqID_80768
  Gene Ontology: Mol. function=zinc ion binding; Cellular component =nucleus; Biological process=transcription
  Homolog annotation: Hit_ID=Q1SW42; Match level="QueryCoverage=85%, HitCoverage=91%, E-value=1e-177, Identity=50%"; Hit description =Heavy metal transport/detoxification protein
  Pfam annotation: Domain name=FAR1; Domain location=128-334; Score =281.9; E_value=1.2e-81; Accession=PF03101.5; Description=FAR1 family
  Pfam annotation: Domain name=SWIM; Domain location=618-654; Score =21.0; E_value=0.0018; Accession=PF04434.8; Description=SWIM zinc finger
  Pfam module annotation: Pfam domain module=FAR1::SWIM; Domain location=128-334::618-654
MDNRTTEGRDAVGSAENRTASHSLLLVSSLLCTSVPFSSAEPVTGFVSNYHVVIDDGSPNNEQLLEVEDEGNELENECGQLFEIDGSEPENGRDETTIVDSHSGESQGKDCPPPVVRMEFDTYDDAYNYYNTYAKDIGFAIRVKSSWTKRNSKEKRGAVLCCNCEGFKTTKEANSHRKETRTGCLAMIRLRLVDSNRWRVDEVKLDHNHSFDPERAQNSKSHKRMDSRAKRKVEPTLDVEVRTIKLYRMPVVDASGYGSSNSTEGGTSNISCSRRLKLKKGDPELISNYFCRIQLMNPNFFYVMDLNDDGQLRNVFWIDSRSRAAYSYFGDVVAFDSTCLSNNYEIPLVAFVGVNHHGKSVLLGCGLLADETFETYIWLFRAWLTCMTGRPPQTIITNQCKAMQSAIAEVFPRAHHRICLSQIMQSILGCFVQFQEYEAFQMALTKVIYDSKTVDEFERAWDDLTQHFGIRNHEKLQTLHEEREHWAPVYSKDTFFAGISDYEKGESVIPFFKGHVHQQTSLKEFFEIYELVQQKKHKTEVLDDFESRDLSSLLKTRCYYELQLSKLYTNAVFRKFQDEVVMMSSCFSITQTQTSGSIVTYMVKEREGEEPARDARNFEVMYDNAGAEVRCICSCFNFKGYLCRHALYILNYNCVEEIPCQYILSRWRRDFKRLYVPHLSADNVDISNPVQCFDHLYKRAMQVVEEGMISQDHYMLSWQTFKESLNKIRLVADKIE

SEQ ID NO: 197547 - protein, 638 aa, Glycine max
  Coding DNA Sequence Number=SeqID_80769
  Gene Ontology: Mol. function=zinc ion binding; Cellular component =nucleus; Biological process=transcription
  Homolog annotation: Hit_ID=Q1SW42; Match level="QueryCoverage=98%, HitCoverage=94%, E-value=0.0, Identity=73%"; Hit description=Heavy metal transport/detoxification protein
  Pfam annotation: Domain name=FAR1; Domain location=61-265; Score =258.5; E_value=1.3e-74; Accession=PF03101.5; Description=FAR1 family
MEESSLCCEQLPDGECIEVQKDEEDDGLIELDCQNGFPEGRKEFVAPAVGMEFESYDDAYNYYICYAKEVGFRVRVKNSWFKRNSREKYGAVLCCSSQGFKRIKDVNHLRKETRTGCPAMIRMRLVESQRWRVLEVMLEHNHMLGAKILRSVKKMGNGTKRKPLPSSDAEGQTIKLYRALVIDAGGNGNSNSCAREDITFSEFSNKWNLRKGDTQAIYNFLCRMQLTNPNFFYLMDFNDDGHLRNAFWVDARSRAACGYFGDVIYFDNTNLSNKFEIPLVTFVGINHHGQSVLLGCGLLASETTESYLWLLRTWVKCMSGCSPQTIITDRCKALQSAIVEIFPRSHHCFGLSLIMKKVPEKLGGLHNYDAIRKALIKAVYDTLKVIEFEAAWGFMIQCFGVSDHEWLRSLYEDRVRWAPVYLKGTFFAGMSAARPGESISPFFDRYVHKQTPLKEFLDKYELALHRKHKEESFSDIESRSSSPLLKTRCSFELQLSRMYTREMFMKFQLEVEEVYSCFGTTQLHVDGPIIIFLVKERVLIEGNRREIRDFEVLYSRTAEIPHKYILSRWKKDFKRLYVPDHSSGGVNDTDRIQWSNQLFRSALQVVEEGILSLDHYNVALQSLEESLSKVHDVEQRQE

SEQ ID NO: 197548 - protein, 298 aa, Glycine max
  Coding DNA Sequence Number=SeqID_80770
  Homolog annotation: Hit_ID=Q1SW45; Match level="QueryCoverage=68%, HitCoverage=91%, E-value=2e-70, Identity=80%"; Hit description=Sec20
  Pfam annotation: Domain name=Sec20; Domain location=130-241; Score =109.2; E_value=1.2e-29; Accession=PF03908.4; Description=Sec20
MDKVVEEAEKVKKEWDETYKKTQEHIEAIAEYGKPGRAKEEKNSLARLNGIAQDGLALLSSFLFTLDLLAPQLPSEPEVQSTRALLQSWKTLTQKENYFWVAEKSPQFADAIYSMTFMSHLAGTKAGMTSAAESITESLRRTRQLMVQEVERNTSTLMTLGRLSMQVVLMRIIICFLISQDESTGVLKKAESEYKGHRSLLMRTRNLLSTMQRQDVIDRVIIGVGFLLFSLAVLYVVYKRIGLLTLQRKVTEAIKAGMVGQAELRPQAVADDLNLHQVRGDCVHNAEAPLEQRIHDEL

SEQ ID NO: 197549 - protein, 437 aa, Glycine max
  Coding DNA Sequence Number=SeqID_80771
  Gene Ontology: Mol. function=methyltransferase activity; Biological process=metabolic process
  Homolog annotation: Hit_ID=Q1SW51; Match level="QueryCoverage=99%, HitCoverage=99%, E-value=0.0, Identity=71%"; Hit description=Generic methyltransferase
  Pfam annotation: Domain name=Methyltransf_11; Domain location=291 -386; Score=21.4; E_value=0.00043; Accession=PF08241.2; Description =Methyltransferase domain
  Pfam annotation: Domain name=Methyltransf_12; Domain location=291 -384; Score=18.2; E_value=0.012; Accession=PF08242.2; Description =Methyltransferase domain
  Pfam module annotation: Pfam domain module=Methyltransf _11::Methyltransf_12; Domain location=291-386::291-384
MGNEAHDQQYSNKLQAYGHSQKHKLKSILLVILTNLVTIYIFTGPISFLYHSSTSPRDSNSILMELNSTKAQLVATHSLLSELHHRLNSSNLLVQALLIDLTRQQEKQSNSADQNQVSLKVGSDELSFALGPHKLPFGYSPRIGSDEIHLPAGASCMRLHEELTQYMAYEIGGECPMDDVLAQRLMLKGCEPFPRRRCRPKSPTNYVEPTPLPESLWTTPPDTSIVWDAYACKSYQCLIDRKNKPGSYDCKNCFDLQGEEKSKWIFDDGGLDFGIDQVLATKAMGTVRVGLDIGGETGTFAARMRERNVIIITSTLNLDGPFNNIIASRGLVPMHISISQRFPFFDNTLDIVHSMDVLSNWIPDTMLEFVLYDVYRVLRPGGLFWLDHFFCFGSQLNKTYVPMLDRIGFNRLRWHVGTKLDRKNVLYISALMEKPMT

SEQ ID NO: 197550 - protein, 806 aa, Glycine max
  Coding DNA Sequence Number=SeqID_80772
  Gene Ontology: Mol. function=protein serine/threonine kinase activity; Cellular component=integral to membrane; Biological process=protein amino acid phosphorylation
  Homolog annotation: Hit_ID=Q1SW54; Match level="QueryCoverage=99%, HitCoverage=89%, E-value=0.0, Identity=68%"; Hit description=Protein kinase
  Pfam annotation: Domain name=LRR_1; Domain location=123-145; Score =6.0; E_value=21; Accession=PF00560.23; Description=Leucine Rich Repeat
  Pfam annotation: Domain name=LRR_1; Domain location=147-168; Score =16.7; E_value=0.082; Accession=PF00560.23; Description=Leucine Rich Repeat
  Pfam annotation: Domain name=LRR_1; Domain location=170-193; Score =13.4; E_value=0.86; Accession=PF00560.23; Description=Leucine Rich Repeat
  Pfam annotation: Domain name=LRR_1; Domain location=21-43; Score=9.9; E_value=3.9; Accession=PF00560.23; Description=Leucine Rich Repeat
  Pfam annotation: Domain name=LRR_1; Domain location=219-240; Score =5.3; E_value=30; Accession=PF00560.23; Description=Leucine Rich Repeat
  Pfam annotation: Domain name=LRR_1; Domain location=45-67; Score =14.0; E_value=0.56; Accession=PF00560.23; Description=Leucine Rich Repeat
  Pfam annotation: Domain name=LRR_1; Domain location=69-92; Score=6.8; E_value=15; Accession=PF00560.23; Description=Leucine Rich Repeat
  Pfam annotation: Domain name=LRR_1; Domain location=99-118; Score =4.1; E_value=50; Accession=PF00560.23; Description=Leucine Rich Repeat
  Pfam annotation: Domain name=Pkinase; Domain location=496-765; Score =123.5; E_value=5.9e-34; Accession=PF00069.15; Description=Protein kinase domain
  Pfam annotation: Domain name=Pkinase_Tyr; Domain location=496-765; Score=135.3; E_value=1.6e-37; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::Pkinase::Pkinase_Tyr; Domain location= 123-145::147-168::170-193::21-43::219-240::45-67::69-92::99-118::496 -765::496-765
DLSYNKKLTGPLPSNIGNLRKLRNLLLINCGFTGPIPVTIGNLERLVFLSLNSNGFTGTIPAAIGNLSNVYWLDLAENQLEGPIPISNGTTPGLDMMHHTKHLLFESNRFTGGIPSTLGLVKTLEVVRFDKNFLSEPLPLNINNLTSVRELFLSNNRLSGSLPNLTGMNSLSYLDMSNNSFDQSDFPPWLPTLPALTTMVLKKNQLNGTLDIGTSISNQLDLLDLQINFIEDFDPQIDVSKVEIILVNNPYCQESGVPQPYCTITKSNDSYSTPPDNCVPVPCSLDQTLSPKCKCAYPYTGTLFLRAPSFSDLENETVFVTLEYSLMESFQLHMKPVNSVSLSNPRKNIYQYLELTLKIFPFGQGRFNRTGVSGIGFLLSNQTYKPPAMFGPYYFIADEYEHYVDNSVLEGLVPSSSKSSNTGIIAGAAGGGAALLVLVVLACVYAISRKKKSKKSTGNSNPFEQWDPHDSNSSIPQLKGARRFSFEEIQNCTKNFSQVNNIGSGGYGKVYRGTLPNGQLIAVKRAQKESMQGGLEFKTEIELLSRVHHKNLVSLVGFCFEQGEQMLIYEYVANGTLKDTLSGKSGIRLDWIRRLKIALGAARGLDYLHELANPPIIHRDIKSTNILLDERLNAKVSDFGLSKPLGEGAKGYITTQVKGTMGYLDPEYYMTQQLTEKSDVYSFGVLMLELVTARRPIERGKYIVKVVKDAIDKTKGFYGLEEILDPTIELGTALSGFEKFVDLAMQCVEESSSDRPTMNYVVKEIENMLQLAGSSPILSASASTSSSYNNATKGSSLHPYNNEYFD

SEQ ID NO: 197551 - protein, 105 aa, Glycine max
  Coding DNA Sequence Number=SeqID_80773
  Homolog annotation: Hit_ID=Q1SW50; Match level="QueryCoverage=49%, HitCoverage=15%, E-value=3e-15, Identity=78%"; Hit description =Lipocalin
MACECENTIVIDLGSFDFFIDDMNFSLPIHHSWVYFEVKAAKVSEQKRTTCRFPEETQPGLTACKDAAKRLMDLGLVLTPIQDAVREAVESLIAKGFLQCTPSQS

SEQ ID NO: 197552 - protein, 115 aa, Glycine max
  Coding DNA Sequence Number=SeqID_80774
MLYLFWKETSHSFSYILSSTKQCGYPLTLRSCLGSKPPIYAGNHRGKSKLTLALMNDDRARHLRQHRTVTAKHMWKYVFFGKGRVCFSRKEYGREKDEGSLGGKKIKNNGKGVYK

SEQ ID NO: 197553 - protein, 171 aa, Glycine max
  Coding DNA Sequence Number=SeqID_80775
MPSQPAPQGSEPTQLGGVFCHSFTSASIAAAASEIKKPIKYILNLHTKIVTEEYIIELAQAILEGKIQLGQLQELSKDASLSNYKQLDDKLKQIRGYVPFTRANVLMCLGYYHVIPTDSETVTHLKQMLTTCFSSFIMSMVHSRDTTSKTIQRDLEEIYGKYEPYQFLAFW

SEQ ID NO: 197554 - protein, 245 aa, Glycine max
  Coding DNA Sequence Number=SeqID_80776
  Subcellular localization annotation: CTP_CleavageSite=56; ConfidenceScore=5.73e-01
MSSFPSSVERTVASSLLLLNTTSLSSPSLSKFQSGYNSSVVVPERRSGSKRLREISVSYGSSKSSSSSLTNDDDDDDGDSSEKEIKSRSVSFSAVTRYHQMKLEIARKIRSKVAWTTSCSGDRKPNAGELAKVLSPASLSGEVSSCLSSSSSGISSERSLRYAKRCRGAIVSVAGVNCETAAPSRCRAGSPNLRRRGEAILKLLSCCGGSSEVKIRQMLGDSPDTSKALRIENNKRELALYLKVN

SEQ ID NO: 197555 - protein, 479 aa, Glycine max
  Coding DNA Sequence Number=SeqID_80777
  Gene Ontology: Mol. function=calmodulin binding; Cellular component =integral to membrane; Biological process=cell death
  Homolog annotation: Hit_ID=Q2HSS4; Match level="QueryCoverage=96%, HitCoverage=99%, E-value=1e-163, Identity=59%"; Hit description=Mlo -related protein
  Pfam annotation: Domain name=Mlo; Domain location=5-469; Score=698.8; E_value=4e-207; Accession=PF03094.6; Description=Mlo family
MAEELNQSLEYTPTWIVAVVCSIIVFISLCVERALHKLGKYLKSKGQTALYEALTKLEEELMLLGFISLLLTVFQGLISDICISPNLATQMLPCKRPHRSPEGSEHYQIYYDAIINRRRLFSTDTGSDHCRQKGKVPLLSLESVHHLHIFIFVLAVVHAIFCVTTMLLGGAKLFSNAEKDYREFFKVHADGYWRRAAVISWLRSFFKQFHGSVTKSDYLALRYGFVKEHHPQNPEYNFHDYMLRTLEVDFKTVVGISWYLWLFVVLFLLMDLEGWHTYFWLAFLPLILLLLVGAKLEHIIARLAQESIDMMGKEDSRSVKPSDEYFWFTRPSLVLHLLHFILFQNSFEIAFLFWIWTTYGLDSCIMEKIAYVIPRLIMGVIVQVLCSYSTLPLYTIVTQMGSKSKAEKAEPSSLIGTKGGSPNNTRQSNHMIKESTQIDEQAIIMMEDATTSTIELPHIVHAPFERPNASNSYSSTNIH

SEQ ID NO: 197556 - protein, 525 aa, Glycine max
  Coding DNA Sequence Number=SeqID_80778
  Homolog annotation: Hit_ID=Q8U831; Match level="QueryCoverage=40%, HitCoverage=93%, E-value=2e-47, Identity=48%"; Hit description=RhtB family transporter
  Pfam annotation: Domain name=HTH_6; Domain location=381-500; Score =2.5; E_value=0.00056; Accession=PF01418.8; Description=Helix-turn -helix domain, rpiR family
  Pfam annotation: Domain name=LysE; Domain location=178-371; Score =83.7; E_value=5.6e-22; Accession=PF01810.9; Description=LysE type translocator
  Pfam module annotation: Pfam domain module=HTH_6::LysE; Domain location=381-500::178-371
ATSRIQSFATDGIDLAVRHGNGFCEGCVSEKLIDDDYLAVCIPAVAQQLGEPPALAALGRVTLLHDMHREDWQRWLAEAGVGHIDSGKGPLYSDGSGAWLAMLAGMGVALMRRRFVQANLASGEVVAPFPNTLNTGHAYWLITPHEALLRSAVVQDISPAEDIMALSHELMLIYTTYFVATASPGPSNMAIMGTAMNKGRGAALALAGGVIGGSMLWALLAACGVLTVLATFAQLLLVLKIGGGLYLLWLSYKAGKSALTRTAADKTVISDHRVAYGALFRQGILMHVGNPKAILTWVAIMSVALKPDAAASTLPLIIPGCAAICVAVFCGYALIFSTAAMNAFYRRIRRGLDALLACCFAIAGLKLPDCRGATHRALLQAVTPETIVREFSELSPELQRAAEFSLQNANQLVVQSMRTFAQQAGVKPATLLRLAKRLGYNGWSELKDAFIDDIGLRNDTYVSKAEKLVAAGTQPQLYDAMFQAHQTNLAFTQNENRQAMEQAVTLLDAADNVYICGFRASFPIA

SEQ ID NO: 197557 - protein, 56 aa, Glycine max
  Coding DNA Sequence Number=SeqID_80779
MALRSIKSSLGHKKVSLATMIGAQLHEPQFWPGMNQPKMQGLSTKRSRLAAKRMSN

SEQ ID NO: 197558 - protein, 75 aa, Glycine max
  Coding DNA Sequence Number=SeqID_80780
MELPIPNTTEQQHTSEEPQTEPELGFLREKIASLTEPEKFSEPEERPREMSEDALALERGVSTHRETGGTDTGRN

SEQ ID NO: 197559 - protein, 355 aa, Glycine max
  Coding DNA Sequence Number=SeqID_80781
  Gene Ontology: Mol. function=GTP binding; Cellular component =membrane; Biological process=protein transport
  Homolog annotation: Hit_ID=Q00W68; Match level="QueryCoverage=96%, HitCoverage=57%, E-value=9e-75, Identity=45%"; Hit description=[U] KOG2180 Late Golgi protein sorting complex
MEFNFRGIVSSCFEPHLTVYVELEEKTLMESLEKLVQEETWDIEDGSQSNVLSSSMQLFLIIKRSLKRCSALTKNQTLYNLLKVFERVLKAYATKLFARLPKGGTGIVAAATGMDGQIKTSDRDERVICYIVNSAEYCHKTAGELAESVSKIIDPQYSDRVDMSEVQDEFSAVITKSLVTLVHGLETKFDMEMAAMTRVPWGSLESVGDQSEYVNAINLILTTSIPALGSLLSPVYFQFFLDKLASSLGPRFYSNIFKCKQISETGAQQMLLDTQAVKTILLEVPSLGRQTSGAASYTKFVSREMSKAEALLKVILSPVDSVADTYRALLPEGTPMEFQRILELKVIISYFYQNL

SEQ ID NO: 197560 - protein, 79 aa, Glycine max
  Coding DNA Sequence Number=SeqID_80782
MFELGGLSTEEVGPEGFAAAGVVVGASDPTAVAAAAATRRLTQTWPMHVTLEEEALLLRNLISGGGNLSVQPELEMGLA

SEQ ID NO: 197561 - protein, 389 aa, Glycine max
  Coding DNA Sequence Number=SeqID_80783
  Gene Ontology: Mol. function=protein binding; Cellular component =membrane; Biological process=protein transport
  Homolog annotation: Hit_ID=UPI000034F47D; Match level="QueryCoverage =83%, HitCoverage=56%, E-value=1e-122, Identity=70%"; Hit description= transporter
  Pfam annotation: Domain name=Vps53_N; Domain location=1-389; Score =643.5; E_value=1.7e-190; Accession=PF04100.3; Description=Vps53-like, N-terminal
MDKSSALEYINQMFPNEVSLSGVEPLMQKIQNEIRTVDAGILAAVRQQSNSGTKAKEDLAAATRAVEELMYKIREIKTKAVQSETMVQEICRDIKKLDFAKKHITTTITALHRLTMLVSAVEQLQVMASKRQYREAAAQLEAVNQLCSHFEAYRDIPKIIELREKFKNIKQILKSHVFSDFSSLGTGKETEETNLLQQLSDACLVVDALEPSVREELVNNFCNRELTSYEQIFEGAELAKLDKTERRYAWIKRRMRSNEEIWKIFPSSWHVSYRLCILFCKKTRKQLEDILANLKEKPDVGTLLLALQRTLEFEDELAEKFGGGTQNREIGNEIEEIGKGNNSSSSALDIRKKYEKKLAAHQGGDSEEKDGSKDLAVPGAGVWSHLTIF

SEQ ID NO: 197562 - protein, 94 aa, Glycine max
  Coding DNA Sequence Number=SeqID_80784
MIQWKSAAEGVLGNHLGNEIFSFVANIGYCSVLQAEIWAIYVGVNIAWSWGLKKFLVESDSQTTINLLKVTTRVLALSRISRVVCCLRRCLGVD

SEQ ID NO: 197563 - protein, 293 aa, Glycine max
  Coding DNA Sequence Number=SeqID_80785
  Gene Ontology: Mol. function=sodium:hydrogen antiporter activity; Cellular component=integral to membrane; Biological process=sodium ion transport
  Homolog annotation: Hit_ID=Q0IJY4; Match level="QueryCoverage=78%, HitCoverage=49%, E-value=2e-78, Identity=59%"; Hit description =Na+/H+ antiporter
MQDWILTSNTDFMNFMVLYSLQNLESCLFVLFPYFSYMLAEGLGLSGIVSILFTGIVMKHYTYSNLSQSSQRFASAFFELISSLAETFVAANVFSCAYLVNLVRPTHRKIPSKHQKALWYSGLRGAMAFALALQSIHDLPEGHGQTIFTATTAIVVLTVLLIGGSTGSMLEALDVVGGDNDSPLASVGTITNFDGNNGYIAPHYNEESSSGNKIKMKLKEFHKTAASFTALDKNYLTPFFTSQNGDEDDEGYGYEPMKQQNYYLEVFPSLLLPQDRDFMARTTIHHDSFQTTY

SEQ ID NO: 197564 - protein, 384 aa, Glycine max
  Coding DNA Sequence Number=SeqID_80786
  Homolog annotation: Hit_ID=Q69P50; Match level="QueryCoverage=26%, HitCoverage=15%, E-value=3e-07, Identity=35%"; Hit description =Streptococcal hemagglutinin-like protein
  Pfam annotation: Domain name=DUF566; Domain location=82-379; Score= -108.2; E_value=0.0025; Accession=PF04484.3; Description=Family of unknown function (DUF566)
  Subcellular localization annotation: CTP_CleavageSite=32; ConfidenceScore=5.41e-01
MVQVQVQIMPEHNSDPAAPPPPPPPPHNRRPRVREVSSRFMSPSVPRRPRTTEPDPDENSETPFPLGCSISQRKQTQTPQQQRSMKLFKENNNNEHVPPHPHPSKSCSGRIGTPCVSRPGTPTPSVYVSSRYRQTQQHHHHHNNNHHHHRFVNGMASAAEKLMQASGLNQAKSSAACSSDNSGVNCSIQSLPELGEREMLLQSNLSAGEKIGSGNGGGGDLKFRHPSPLSRSVTLPSSGGENKPPASVSKQHGSGNQLAKSGGLSLPPVPPQCGKPAVDVRKGKKGSSHQEDVHSLRLLYNRYLQWRFANAKAHSVMKAQQTESQKVLNCVRCYLAVVVTGCGWMLPLQWQQSRCDVAVAPKLRLHSEFKTLPLDFLIGRVFGS

SEQ ID NO: 197565 - protein, 331 aa, Glycine max
  Coding DNA Sequence Number=SeqID_80787
MAKSVEKPFSIIGLLAISGGDKKKTLPTSKPKPFNKGRSSTVETHYKSTHDLLPPHKRKMVVNIEDNVEPVGSSLVNFSNFGGSLIWMSLSQEIDHVILSKDWESIQKKGLADLESTMSILAGHYLGDVNPLKLVEEENVTLKKAQDQADALSEEFNQLKEITRLKEESSQGEVTQLKEESSLGEEENFKKATRGSFNNVLKQVEYLHPKETNDLGTLDDVMVDGFIKTQRFIEASDVDAGLEGPQMPPFPSISHSSHIDAYVCCFQNARVVNATLECLEIIIRALLRAYWNGLNDMNDDVGSLVLACSHLESSCGLWDALRTNFLLNVIS

SEQ ID NO: 197566 - protein, 73 aa, Glycine max
  Coding DNA Sequence Number=SeqID_80788
VPLGVGFQWRTMAVCGGYWWLWVVKKKLGTLGSGFGRKKEKGMEDAFTETASGSFLEKLSREASLRNFLERLL

SEQ ID NO: 197567 - protein, 111 aa, Glycine max
  Coding DNA Sequence Number=SeqID_80789
MKVFQDCVCHHWYVVNQIHNMVALINKTNPRSDENDSNLMVQWFPPHQHIVKINVYKSSLGSTLEIHQGHDRYIKVVIIHQGLDGLILAHVDLHSKNHHDPNQFIRAMINS

SEQ ID NO: 197568 - protein, 105 aa, Glycine max
  Coding DNA Sequence Number=SeqID_80790
  Homolog annotation: Hit_ID=Q1SD80; Match level="QueryCoverage=81%, HitCoverage=28%, E-value=1e-12, Identity=45%"; Hit description =Cellular retinaldehyde-binding/triple function, N-terminal
MVMEEHLDMDKLESYFGGKNTVGFNYQAYAQKMKDDRSIFLSSEFHESLQSGTNDSVDEASIDGEVFSSLEEDDDSTHGKMPCVQHESNMIDESKKTRRAESEEN

SEQ ID NO: 197569 - protein, 100 aa, Glycine max
  Coding DNA Sequence Number=SeqID_80791
  Subcellular localization annotation: CTP_CleavageSite=67; ConfidenceScore=5.04e-01
MNVIDRQTHIKHNNIAKSPVESPTITTCSSTGVRKGLSYGPRVRLPLKENAWSRHQRLFKENVGKTKMEKVEGLRILKMRVRELFTHGKGISTPCARHKR

SEQ ID NO: 197570 - protein, 92 aa, Glycine max
  Coding DNA Sequence Number=SeqID_80792
MANKNISSNETYPPTLIPKTIPKLQNSLRVGKGNIGSKGLSKEIIQGRLIWLEAYKNKMPKSSPNMHVKQEVSTRVKPRLLCKQSIGQNTPN

SEQ ID NO: 197571 - protein, 154 aa, Glycine max
  Coding DNA Sequence Number=SeqID_80793
  Pfam annotation: Domain name=Transposase_23; Domain location=69-139; Score=-14.0; E_value=0.039; Accession=PF03017.5; Description =TNP1ENSPM transposase
YGQHLLKSFLGFPCSSPCHWSSKSFKWILALALGHVLITLPPEPEVGPLVSCVNTKESCVDPSGNDPDTGDLEKCGLYVEENPPRLVTLGRLYEGSTTVHNIPLGNNQVKIGVEEVRDADAHILVPTQHLHCLADTSCQAFLKAESCKTDETYR

SEQ ID NO: 197572 - protein, 359 aa, Glycine max
  Coding DNA Sequence Number=SeqID_80794
  Gene Ontology: Mol. function=oxidoreductase activity, acting on single donors with incorporation of molecular oxygen, incorporation of two atoms of oxygen; Biological process=aromatic amino acid family metabolic process
  Homolog annotation: Hit_ID=Q1YHA4; Match level="QueryCoverage=54%, HitCoverage=30%, E-value=2e-25, Identity=35%"; Hit description=4 -hydroxyphenylpyruvate dioxygenase
  Pfam annotation: Domain name=Abhydrolase_2; Domain location=1-161; Score=25.3; E_value=6.5e-10; Accession=PF02230.7; Description =PhospholipaseCarboxylesterase
MAKALVVFLHGVGSNGADLAVLGQHCLTGITLENRPARVRAARDAFDATLQQLMAQHAMAGAWQKVILVGFSQGSIMALDALASGRYPLAGVVAFSGRLAFDEALTPPPHASALLIHGKADEVIPFSETVSAAQRLQSAGVAVTAQPVALQRLPRLTRGRFRRLCFEAIVKHFDAHRTAIACTFQLIDKAFHFNDAVAGQQALMARIVAQRLLFLRWHLRHIAQLHFINAVGRNAVELRGIATACADVEQIDHQPDIGLIQPLQTLPRQRQRIVDAAPRHRFIHDAHVIARGFRGQPAQIFINALRNAVFARGRRRLNGIAAQRLRDANEITQFGALLQPFAVRRAGKVTQHLQIGKAQ

SEQ ID NO: 197573 - protein, 488 aa, Glycine max
  Coding DNA Sequence Number=SeqID_80795
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q8W0J2; Match level="QueryCoverage=98%, HitCoverage=27%, E-value=0.0, Identity=77%"; Hit description=1,3 -beta-glucan synthase component-like
  Pfam annotation: Domain name=Glucan_synthase; Domain location=2-488; Score=380.7; E_value=2.3e-111; Accession=PF02364.6; Description=1,3 -beta-glucan synthase component
  Subcellular localization annotation: CTP_CleavageSite=61; ConfidenceScore=5.55e-01
MDVRQGSEHGSTNQNSSLNGLPSNGPSSLQTNLRPTGSSVSMLFKGHEYGSALMKFSYVVACQIYGRHKADKNPRADEILYLMQHNEALRVAYVDEVSLGREGTEYYSVLVKYDQQLQSEVEIYRIRLPGPLKLGEGKPENQNHAIIFTRGDAVQTIDMNQDNYFEEALKMRNLLEEFNMSYGIKKPTILGVRENIFTGSVSSLAWFMSAQETSFVTLGQRVLANPLKVRMHYGHPDVFDRFWFLGRGGVSKASRVINISEDIFAGFNCTLRGGNVTHHEYIQVGKGRDVGLNQISMFEAKIASGNGEQVLSRDVYRLGHRLDFFRMLSVFYTTIGFYFNSMVIVLMVYAFLWGRLYMALSGIEHGIKHAAMNNATNNKALGAVLNQQFAIQVGIFTALPMVVENSLEHGFLPAVWDFLTMQLQLASLFYTFSLGTRTHFFGRTILHGGAKYRATGRGFVVAHKSFAENYRLYARSHFVKGIELGFHG

SEQ ID NO: 197574 - protein, 127 aa, Glycine max
  Coding DNA Sequence Number=SeqID_80796
MQNASSIGDFMGIGHVEAQPASAAGDFRWKRVPPALLATSTCAKIAALTGDFQGYQARVQGAQKPFPRELQSRESPSIQQERKRKLEERECCCCSCVLEHPAGKKKEARGSCWFLSLRSFLPKQIQL

SEQ ID NO: 197575 - protein, 141 aa, Glycine max
  Coding DNA Sequence Number=SeqID_80797
  Gene Ontology: Mol. function=DNA binding; Biological process=DNA integration
MSPYWVVFGKVCHLPIEIEHKAYWAIKTCNFSIDQAGEERKLQLSELDEICLETYENSKFYKEKTKKFHDSLIAKKDFVVGQKVLLYNSRLGLMSVEIKSESIDKSFKVNGHRLKPFLTNPSIVDVVVEETSLLHPTSLPP

SEQ ID NO: 197576 - protein, 139 aa, Glycine max
  Coding DNA Sequence Number=SeqID_80798
MSLSLKVLKGSVALSGPCSAHDWCQAQIHLLALSARATLSATSRFQSLFKPELSELGYDFERPELYIFAQTSRIVLWRQQRGAAVLKSLGFYIFRVIVRCQEEDEGSPFLCYQELFCTLYLIYVRVSVYGWLNTLVGNF

SEQ ID NO: 197577 - protein, 261 aa, Glycine max
  Coding DNA Sequence Number=SeqID_80799
  Homolog annotation: Hit_ID=Q47336; Match level="QueryCoverage=14%, HitCoverage=42%, E-value=4e-15, Identity=100%"; Hit description=LacZ- alpha peptide
MVKVGTSYVPINVSFSPKVGPGLPGINRDTRIYLFCEVIFRHSCPSCSATDGVVRNGKSTAGTSALASVAAAQLLGRAIGAGLFAITPAGERGMCCKAIKLGNARVFPEFDHISVKQSAHAFRHCLAVHSNTGLWSGLIVSIDSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 197578 - protein, 79 aa, Glycine max
  Coding DNA Sequence Number=SeqID_80800
MARSVFALCPYLEPIGQYLGLSSNYSQRFITHTLFSRGLTHKNSPQWSRQLSQCALLRASEGEAHGCAFQRRKDARSRH

SEQ ID NO: 197579 - protein, 135 aa, Glycine max
  Coding DNA Sequence Number=SeqID_80801
MVEDARKAIGNKFVGLRIRFDDEGCTNSAWQSIRGAPDSMAINSWGSRLNGGGCMNDNKFMGLRITFDDGGCMNSAWQSNRGASNKMVEDARRQALGNKMVEDAQKALGNQIVGLRTQWWRMHERQSMHGAPNKI

SEQ ID NO: 197580 - protein, 153 aa, Glycine max
  Coding DNA Sequence Number=SeqID_80802
PLVQHVEPPKCRQVLSGVERGGPNEFESCRSMWLVKPPSLDMRCPGCFCQVVHDGLVFCVSSKVLSSTIMSSFLSNSAIDLGSSDSGDIEQPIMDQEIISIDDLSFKDTHRGASHGESSSREPVSITVTLHPSAFRGVGWWRWRREVVSPRST

SEQ ID NO: 197581 - protein, 109 aa, Glycine max
  Coding DNA Sequence Number=SeqID_80803
MEGQSKGSFNVMEGSEGKGREFVVEKSASSIVGTCDLVLRILAFLLTLVAAVVIGTDKQTAIVPIKLVDSMPTLYVPVAAKWHYLSAFVKTDKKKQEILTRSIYKEVTV

SEQ ID NO: 197582 - protein, 262 aa, Glycine max
  Coding DNA Sequence Number=SeqID_80804
  Gene Ontology: Mol. function=metal ion binding; Cellular component =cytoplasm; Biological process=ubiquitin cycle
  Homolog annotation: Hit_ID=Q2QP88; Match level="QueryCoverage=79%, HitCoverage=68%, E-value=2e-66, Identity=55%"; Hit description=CHY zinc finger family protein, expressed
  Pfam annotation: Domain name=Rubredoxin; Domain location=87-116; Score=-2.4; E_value=0.061; Accession=PF00301.10; Description =Rubredoxin
  Pfam annotation: Domain name=zf-C3HC4; Domain location=184-226; Score= 37.8; E_value=3.8e-08; Accession=PF00097.15; Description=Zinc finger, C3HC4 type (RING finger)
  Pfam annotation: Domain name=zf-CHY; Domain location=42-124; Score =150.6; E_value=4.2e-42; Accession=PF05495.3; Description=CHY zinc finger
  Pfam module annotation: Pfam domain module=Rubredoxin::zf-C3HC4::zf -CHY; Domain location=87-116::184-226::42-124
  Subcellular localization annotation: CTP_CleavageSite=41; ConfidenceScore=5.50e-01
MACSSSFLFLCQYQHQQNLPISGNSSLSLPSRPFFSKTHGRCKHYRRRCRIRAPCCNELYFCRHCHNEATSMLSNPFDRHELIRQDVQHVVCTVCDTEQPVAQVCTNCGVRMGEYFCSICKFFDDDPVIVNLTVFYLILSIGYTLCRPGNNSFIVMIVGFVGSCYSTSLRDNHMCVENSMRHHCPICYEYLFDSLKDTAVMKCGHTMHSECYLEMLKRDKYCCPICSKSVMDMSRAWKRIDEEIEATVMPDDYRYRKVEFCS

SEQ ID NO: 197583 - protein, 110 aa, Glycine max
  Coding DNA Sequence Number=SeqID_80805
MAPSSLSVFLSIKAKYDVFASTSKYLMDVSGTALVEKGPGHHEVCYDDGDNHGFVLVDRIDALEVSIRKGFKRREISSALEENCCKTLKKKLKIGTSHLAYKTGSAQRLT

SEQ ID NO: 197584 - protein, 267 aa, Glycine max
  Coding DNA Sequence Number=SeqID_80806
  Homolog annotation: Hit_ID=Q7W084; Match level="QueryCoverage=55%, HitCoverage=100%, E-value=5e-57, Identity=77%"; Hit description =Stringent starvation protein B
MVCGGSWRAGRRMARRAGKGPRIRGKCESASAPDRRAERRGRGRSKPAPSLCGALLDDRQARALGFVVAAIVAGRGIGVGFGRGGVGRARRAGRRRFVGLHFEAHAGAGFARIDGADGAHRHVDVFGHAAEAGLEFDEFVAQHQTVGGQRADVQGDLSVAHVGDGHHGVLVDLHGDVRRVAVIGAPFVQRADQIRFGRSFTHHATALATHHFFRRRQRFDVGRAREDAFGVLLQRSRVLGQLDAVVVQAPQQRSHGHVEHGEFLAQH

SEQ ID NO: 197585 - protein, 103 aa, Glycine max
  Coding DNA Sequence Number=SeqID_80807
  Gene Ontology: Mol. function=methyltransferase activity; Cellular component=cytosol; Biological process=metabolic process
  Homolog annotation: Hit_ID=Q1RX27; Match level="QueryCoverage=84%, HitCoverage=38%, E-value=2e-16, Identity=54%"; Hit description=SAM (And some other nucleotide) binding motif
MDKTRNYAYIHAISHHVKLIRDKVVLDVGCCTGILSILCALTGAKRMYAVEAAHDIAHATTKAVEDKNLSDIITVVQGRIEIGYCDQYVLLFEKVLITSNFRL

SEQ ID NO: 197586 - protein, 114 aa, Glycine max
  Coding DNA Sequence Number=SeqID_80808
MAPLTASQVQVQLILGITTSATGAAGRGAYIGLKGNYRVDWIKVCNVYDKFCRHLAGSIAVALLYCDRPSHHRYALNSRFTLFTKSVNVSVNVHISTWIAFVVAECFFKGVDYV

SEQ ID NO: 197587 - protein, 226 aa, Glycine max
  Coding DNA Sequence Number=SeqID_80809
  Gene Ontology: Mol. function=methyltransferase activity; Cellular component=nucleus; Biological process=metabolic process
  Homolog annotation: Hit_ID=Q1RXR5; Match level="QueryCoverage=91%, HitCoverage=35%, E-value=9e-62, Identity=57%"; Hit description=SAM (And some other nucleotide) binding motif
  Pfam annotation: Domain name=Methyltransf_11; Domain location=71-190; Score=22.4; E_value=0.00034; Accession=PF08241.2; Description =Methyltransferase domain
  Pfam annotation: Domain name=Methyltransf_12; Domain location=71-188; Score=8.5; E_value=0.074; Accession=PF08242.2; Description =Methyltransferase domain
  Pfam module annotation: Pfam domain module=Methyltransf _11::Methyltransf_12; Domain location=71-190::71-188
MQQPKERQGIDGEEQVVPMRVTSSIDHDEAYFESYARISVHEQLLKDKARTDAYLHAIIRHEEFIRDKVVLDVGCGTGILAILCAQAGAKRVYAVEATHDIAHAGYGYRNVFLTIFLCVFWSFTSKVVEDNNLSNIITVLQGRIEDVEIKEQVDVIISEWMGYMLLHKNMLESVITARDRWLKPGGLMLPSKATLYMAPVTNTKRYEESINYWNSVYGINSEYSTT

SEQ ID NO: 197588 - protein, 84 aa, Glycine max
  Coding DNA Sequence Number=SeqID_80810
  Gene Ontology: Mol. function=methyltransferase activity; Biological process=metabolic process
  Homolog annotation: Hit_ID=Q1RXR5; Match level="QueryCoverage=97%, HitCoverage=16%, E-value=7e-11, Identity=46%"; Hit description=SAM (And some other nucleotide) binding motif
MVKCVNCDSVTIPELRSVTESFKFNSTVKAPLRGFAFWFDVEFGPSAIPRLFLASSSSYSVDDHPVDSQTWRDPNLLLSTAPDK

SEQ ID NO: 197589 - protein, 231 aa, Glycine max
  Coding DNA Sequence Number=SeqID_80811
  Gene Ontology: Mol. function=nucleotide binding; Biological process =translation
  Homolog annotation: Hit_ID=Q67YQ9; Match level="QueryCoverage=97%, HitCoverage=50%, E-value=8e-61, Identity=55%"; Hit description=MRNA, complete cds, clone: RAFL24-13-K22
LAASCWNGEGALLFTSSSAPYDCNDNGLCHEDSPVVPTGRSPRTDVLLKAEKIVLEFGGSVLRLSGLYISFSKFSLLGFQLFIHLGVSASNLDILNKVDKGAHAYWLEKGIVESRPDHILNLIHYEDAASLSVAILKKQFRGRIFLGCDNHPLSRQEVMDLVYKSGKFSKKFEKFTGCYHCVTHHCKSMPLYISLAGTDDPLGKRLNNSRTRQEVGWEPKYSSFAHFLETI

SEQ ID NO: 197590 - protein, 55 aa, Glycine max
  Coding DNA Sequence Number=SeqID_80812
MASNIISNRDSGELTLSTESAIKNLEVQVGQLTKQLAYQLSRSFGANTEKNPKEE

SEQ ID NO: 197591 - protein, 277 aa, Glycine max
  Coding DNA Sequence Number=SeqID_80813
  Gene Ontology: Biological process=cell wall catabolic process
  Homolog annotation: Hit_ID=Q26CA0; Match level="QueryCoverage=86%, HitCoverage=36%, E-value=1e-08, Identity=25%"; Hit description=LysM domain protein
MAMDFLTGAKLAIERNARNGQKLDIKVVDSGPFFKSNVIDVLDFTKSQKIPIVAPFANSPELYNYSNLVIIETNDQTYADKIVDEVKTVYSDQKIYIVADSKKENANYIKAGLEKAVKNPNVTIVSSPAEIKADQNMMTGQSAPVIAILASDNDSTGEAFSNRVIALTKEVQGIKAFSMYYAPSFEKKVDDLSQASLVYLMDRKINTDGSFEKEILAAYKGKYCKTPPKYAIIGFDVVNDMLTRENKKGEIFKQMNKVQTQLATKFEFVKSKANPLM

SEQ ID NO: 197592 - protein, 309 aa, Glycine max
  Coding DNA Sequence Number=SeqID_80814
  Gene Ontology: Mol. function=asparagine synthase (glutamine -hydrolyzing) activity; Cellular component=cytoplasm; Biological process=asparagine biosynthetic process
  Homolog annotation: Hit_ID=Q0EHA4; Match level="QueryCoverage=93%, HitCoverage=36%, E-value=6e-52, Identity=38%"; Hit description =Asparagine synthase, glutamine-hydrolyzing
  Pfam annotation: Domain name=GATase_2; Domain location=10-168; Score =15.4; E_value=3.6e-12; Accession=PF00310.11; Description=Glutamine amidotransferases class-II
MVMKKQNQMCGIAGIISNNARNYTEEIQKMTDAIAHRGPDSSHYEFYDHIALGHRRLSIIDLSENGIQPMYSNTKNECIVLNGEIYGYLDIKKRYAEYPYHGSSDTEVILAMYQRKQENLIHDLPGMFAFAIWDEQKQQLFCARDRFGEKPFFYAIGNNNEFIFASEIKAILASGLIQPKVNPDALGHYLQNGYVNTYQSIYANIFALPPAHQLIWKDGKIEVSRYYNLPAKDRVISLSDAKEEFLYLLKNAVKKQLIADVEVGSFLSGGLDSSSIVALVNEFLPKQTTISFGYDHKDSELKYAKEIAE

SEQ ID NO: 197593 - protein, 45 aa, Glycine max
  Coding DNA Sequence Number=SeqID_80815
MEAQSLHLSDLWEPYQSNQRKKLRNLINFLEMSLERHVSPLRDVY

SEQ ID NO: 197594 - protein, 46 aa, Glycine max
  Coding DNA Sequence Number=SeqID_80816
MEKQIEKIWPSLVNFYHDEDHIATGGVSKKIKIFDLNAISSDSVNI

SEQ ID NO: 197595 - protein, 135 aa, Glycine max
  Coding DNA Sequence Number=SeqID_80817
  Homolog annotation: Hit_ID=Q84U32; Match level="QueryCoverage=31%, HitCoverage=29%, E-value=9e-15, Identity=86%"; Hit description =Putative serine/threonine kinase
GVLVEDLEGITELPIEGFGFHVFGHYIKESGEVEGSREVLFCHDGCSYMSKEKKDNLKFFSTHAPASIANSLPLLPFTRGTMIGIQLRFHKPFSVECSWPVSLPLTANLALGGHSRKKYRLLEKGTMLVFTRIGC

SEQ ID NO: 197596 - protein, 85 aa, Glycine max
  Coding DNA Sequence Number=SeqID_80818
MNPKPYSAELMPKYFLLSHFIEQLQCDQHGVRISCPLNKETQQLKDNRATIPDIMPENDHLQPKDGNLLLREALQAINHALITGS

SEQ ID NO: 197597 - protein, 84 aa, Glycine max
  Coding DNA Sequence Number=SeqID_80819
MALSSYSEHSSVITARKREECTWKSVPCMREPPKRGKKARHALCTCWCGSEQKSGTQNAHRYTTQPFARKRLVWKNRECKIIVK

SEQ ID NO: 197598 - protein, 220 aa, Glycine max
  Coding DNA Sequence Number=SeqID_80820
  Gene Ontology: Mol. function=protein binding; Cellular component =membrane; Biological process=defense response
  Homolog annotation: Hit_ID=Q7G752; Match level="QueryCoverage=66%, HitCoverage=18%, E-value=1e-15, Identity=34%"; Hit description =Putative NBS-LRR type resistance protein
  Pfam annotation: Domain name=LRR_1; Domain location=140-162; Score =6.4; E_value=18; Accession=PF00560.23; Description=Leucine Rich Repeat
  Pfam annotation: Domain name=LRR_1; Domain location=164-186; Score =6.0; E_value=21; Accession=PF00560.23; Description=Leucine Rich Repeat
  Pfam annotation: Domain name=LRR_1; Domain location=43-65; Score=4.9; E_value=35; Accession=PF00560.23; Description=Leucine Rich Repeat
  Pfam annotation: Domain name=LRR_1; Domain location=66-88; Score=7.9; E_value=9.6; Accession=PF00560.23; Description=Leucine Rich Repeat
  Pfam module annotation: Pfam domain module=LRR_1::LRR_1::LRR_1::LRR _1; Domain location=140-162::164-186::43-65::66-88
MLEVLILSGYTPKGLRKLISFQHLEITTKLPVLPEDQIANLSSLQTLRIEFCNHVESLFGGIKLPTLKVLCIANCKSLKFLPLDIEHFPVLETLLVDNCDALEFSKEHKQSSNLRLKIVNFISLLKLVTMPHWLQGSVDTLHYLLISSCNNLVGLPQWPSAMNSLKTLCVTSCPNMLSLPNDIHHLITLERLEIDGYPEFFQHLTTDEPEEVEKEVEELE

SEQ ID NO: 197599 - protein, 325 aa, Glycine max
  Coding DNA Sequence Number=SeqID_80821
  Homolog annotation: Hit_ID=Q2HV40; Match level="QueryCoverage=33%, HitCoverage=30%, E-value=2e-31, Identity=65%"; Hit description=Zinc finger, RING-type
  Pfam annotation: Domain name=Spermine_synth; Domain location=1-140; Score=-34.7; E_value=1.4e-05; Accession=PF01564.7; Description =Sperminespermidine synthase
VLVIGGGDGGVLREVPRHASVEKIDICEIDKMVVEVFKQFFPYIAVGFEDPRVTLTVGDGVAFLKNVPEGTYDAVIVDSSDPIVDLPSSLQDGLSGQLLEIEGTDKSDWVLSLIKILPYSLGVKTCLKSGQNGEGCTLTPMKENVLPLMTVNFQQGLGQKFKQPAGTGIDFSTFEESELLKVGDMDVYPVAIKADASSSDHDESKSNETPSSGTSNSQITQAVFEKEKGQFVSCKTEVLDIDISSAVGKSSLSLFPFLTWVLEEMVDKKNGDGGRVCLCLFVLFCVCEWFGKLVGKGAVLAGNGVDPLGKKNIAVMVKYDETSMA

SEQ ID NO: 197600 - protein, 193 aa, Glycine max
  Coding DNA Sequence Number=SeqID_80822
MGEVDAVQEWIKADIEALKEQMATMMEAMMSMKKTMEVNVAAVAATSAVVEVDPTPPSGLNQINHPTSDMVGQGGKEWGSTGDSHFVQVQNKHAFPPYSLPPIYTPPNLVHTLDENVNNSNPTLIESQQPQSDHAHVIGMEKEEREEMPLQGEDESRRSSPQAKDKSLEVGEEEWREKERENTKFVPQKRSEL

SEQ ID NO: 197601 - protein, 37 aa, Glycine max
  Coding DNA Sequence Number=SeqID_80823
MDWPAELASKWSSGPTPPNLPTWRATSGMGQVDPPSH

SEQ ID NO: 197602 - protein, 68 aa, Glycine max
  Coding DNA Sequence Number=SeqID_80824
MVTSLGKVARRLSMSQMVCFGAKRMPTAYKAMFWKQRGGGISDLFSPPQVTICQDQYLFNLHLVSELV

SEQ ID NO: 197603 - protein, 391 aa, Glycine max
  Coding DNA Sequence Number=SeqID_80825
  Gene Ontology: Mol. function=nucleic acid binding; Cellular component= nuclear pore; Biological process=DNA integration
  Homolog annotation: Hit_ID=Q1SRP4; Match level="QueryCoverage=32%, HitCoverage=28%, E-value=5e-45, Identity=67%"; Hit description =Integrase, catalytic region
  Pfam annotation: Domain name=rve; Domain location=109-257; Score =77.4; E_value=4.6e-20; Accession=PF00665.16; Description=Integrase core domain
  Subcellular localization annotation: CTP_CleavageSite=71; ConfidenceScore=5.04e-01
MLMQISNKSSQQYDSDTFRRNFGHSGSFKRGDRHGGGCGSCGCGGGRFTNFQCQENHRKFSNSVLLKVHTKSTLVMDKGANEILLQGSLGSDGLYIFTNLRLQGSAAASSASCFVSNSVNNSSSDINNFKSDVHMDYLLKNKSETFTVFQQLKLMAELQFNSKIKSEQTDWGGEFRPLTNFLASHGIIHRLICPHTHHQNGVVERKHRHVVELGLALLKQASLRLKFWDFAFTAAVYFINRLRTTSLNFNVPYTVLFNKLPDYTFDDRRSTSGAAIYFGPNLISWWSKKQQIVARSSTEAEYRILAQAVFCDNQSAVAITHNPVLHSRTKHTEIDIFFVREKVLAKKLQIYHIPATDQWVNALTKSLSPTGFLFLRSKLNAIEPPSKTQHH

SEQ ID NO: 197604 - protein, 984 aa, Glycine max
  Coding DNA Sequence Number=SeqID_80826
  Gene Ontology: Mol. function=glutamate synthase (ferredoxin) activity; Cellular component=chloroplast; Biological process =nitrogen compound metabolic process
  Homolog annotation: Hit_ID=O49154; Match level="QueryCoverage=98%, HitCoverage=94%, E-value=0.0, Identity=91%"; Hit description =Ferredoxin-dependent glutamate synthase
  Pfam annotation: Domain name=GXGXG; Domain location=773-968; Score =342.7; E_value=6.3e-100; Accession=PF01493.9; Description=GXGXG motif
  Pfam annotation: Domain name=Glu_syn_central; Domain location=3-217; Score=318.8; E_value=9.8e-93; Accession=PF04898.4; Description =Glutamate synthase central domain
  Pfam annotation: Domain name=Glu_synthase; Domain location=274-659; Score=880.6; E_value=7.5e-262; Accession=PF01645.7; Description =Conserved region in glutamate synthase
  Pfam module annotation: Pfam domain module=GXGXG::Glu_syn _central::Glu_synthase; Domain location=773-968::3-217::274-659
MPLLQFSSSFEVQVTNPAIDPLREGLVMSLEVNIGKRRNILEIGPENASQGIEGSLEKALNKLCEAADEAVRNGSQLLILSDRSEALEPTHPAIPILLAVGTVHQHLIQNGLRMSASIIADTAQCFSTHHFACLIGYGASAVCPYLALETCRQWRLSNKTVNLMRNGKMPTVSIEQAQKNYCKAVKAGLLKILSKMGISLLSSYCGAQIFEVYGLGKEVVDLAFRGSVSKIGGLTFDEVARETLSFWVKAFSEDTAKRLENFGFIQFRPGGEYHANNPEMSKLLHKAVRQKSQSAFSVYQQYLANRPVNVLRDLLEFKSDRAPIPVGKVEPASSIVQRFCTGGMSLGAISRETHEAIAIAMNRIGGKSNSGEGGEDPIRWKPLTDVVDGYSPTLPHLKGLQNGDTATSAIKQVASGRFGVTPTFLANADQLEIKIAQGAKPGEGGQLPGKKVSMYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLTESHQTLIENGLRERVILRVDGGFRSGVDVMMAAIMGADEYGFGSVAMIATGCVMARICHTNNCPVGVASQREELRARFPGVPGDLVNYFVYVAEEVRGILAQLGYEKLDDVIGRTDLFQPRDISLAKTQHLDLSYILSNVGLPKWSSTEIRNQEPHTNGPVLDDVLLADPEPLCICKAKAAYNSPPPYFRITKSLLALGDINDIVFQIAYAIENEKVVNKTIKIYNIDRAACGRIAGVIAKKYGDTGFAGQLNITFTGSAGQSFACFLTPGMNIRLVGEANDYVGKGIAGGELVITPVDKTGFEPEDAAIVGNTCLYGATGGQVFVRGRAGERFAVRNSLAEAVVEGAGDHCCEYMTGGCVVVLGKVGRNVAAGMTGGLAYFLDEDNTFIPKVNGEIVKIQRVSAPVGQMQLKSLIEAHVEKTGSTKGGLF

SEQ ID NO: 197605 - protein, 1190 aa, Glycine max
  Coding DNA Sequence Number=SeqID_80827
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=82%, E-value=0.0, Identity=41%"; Hit description=Chromo
  Pfam annotation: Domain name=zf-H2C2; Domain location=914-955; Score =7.8; E_value=0.033; Accession=PF09337.1; Description=His(2)-Cys(2) zinc finger
  Pfam module annotation: Pfam domain module=RVT_1::Retrotrans_gag::zf -H2C2; Domain location=524-693::1-85::914-955
MTGDALGWYQWMHNNHLISTWKEFTRAMELRFGPFAYENHQQALFKLQQTATVLEYQHDFERLCNRVTGLPHHSILDCFISGLRPEIQNELAILQPVTISQAIGLAKLVESKLLASKPSFTYSPRPTQPKSILPLLPNPPPQPRLIQHPSQPLLALPAPPSPKPTTPQIRLLSKTEMDDHRAKGLCFNCDERYHRGHRCKNKGMLLLLSPSDPPDPHSDHILDDVPPLTNSETTPPTPSAFLLHSETPPTYTNPEQFHLSLQAVSGQPSPRTLRFYARINGHYVSVLVDTGSSHNIIQPRVATLLRLPTQNLPSFVVMVGNGAHLKCDGLCTDVPLTVVEHCFVVSLYVLPIQGADIVLGVQWLQTLGPFVSDYIIPSMQFYHNGVLVTLHGTTSPSLSLATLPQLNRMIHTESVATIHTITMLPADSLPPPSTPQTHSLSRDEQPTLDSFHPDITQLLHRYSPIFSIPHGLPPNRPHDHHIHLKPHSNPINIKPYRYPHFQKEAMTSMIADMLQQGIIRPSTSPYSSPILLVKKKDGSWRFCVDYRALNAITIRDRFPIPTIDELLDELQGAQFFSKIDLRSGYHQIRLAQEDIPKTGFRTFDGHYEFLVMPFGLTIAPSTFQAAMNDLLRPFLHKFVLVFFDDILIYSPTWSAHLTHLQQVLQLLLDNHFYAKLSKCNFGVCSVDYLGHIISGNGVQADLTKVQDILAWPTPKSLTALRAFLALCNYCRPLTDLLKAPTLMWTSKAEEAFTKLKHAMTNLPVLALLDFNLPFEVTTDASGVAVGVVLSQQGHPIAYFSRKMCPRLCSSSAYTPEQQKWLTKLIGYNFEIHFKPGKENFVADVLSRMPEASTGLCATQFYAAHPAGKQLLTKLCESSTMQRNFSYRAGILYFHERIFIPQEAAIIPSLLEEYHSSPLGGHSGIKATISRLSAVFYWPGMYADVKHFINSCSICHYNKYSTQPPYGLLQPLPVPQQVWEDISMDFVTNLHVSSNKTVIWVVVDRLTNEEPQQWTRFLSLAKFWYNTSHHSAIGMTPFEALYGRAPPSLTSYVAGSSKIAAIDENLAKRSDILQLLKNNLHRAQHRMIQQVNSKRRDKEFAEGDWVYLKLQPYRQVSVHRRSSQKLAKRFYRPFRILHRIGPVAYELELPSTARIHPVFHVSLLKPCIKTPDTQILPLPVTAVVAPSRTKP

SEQ ID NO: 197606 - protein, 117 aa, Glycine max
  Coding DNA Sequence Number=SeqID_80828
MSIDVGNALACACCVCSWGALCTDLPGSLALAFGNVHMLDVVYDRGGHCALTFQGGLSPGRDYLWAPRLITYGRGVFTCTTGWSRQTQHNSLSESVVWTRLGYFLRFGCCWYVPHCI

SEQ ID NO: 197607 - protein, 85 aa, Glycine max
  Coding DNA Sequence Number=SeqID_80829
MQWRFQSQKRCKDKMKLTRNKHRTMVTSKENERVSMENNDDLWWLMVAVGDGESAWDVRNGFGRKKGEEMAFFLSYTKAKAEMLK

SEQ ID NO: 197608 - protein, 293 aa, Glycine max
  Coding DNA Sequence Number=SeqID_80830
  Gene Ontology: Mol. function=transcription regulator activity; Cellular component=nucleus; Biological process=regulation of transcription
  Homolog annotation: Hit_ID=Q41101; Match level="QueryCoverage=77%, HitCoverage=36%, E-value=2e-67, Identity=59%"; Hit description =Phaseolin G-box binding protein PG1
MKNSRMILEEEHFSFIGLRIYEEETKGWAIFPWPFERVAFLILLSNDKYRLAEDNREACMSSPDLSSLWLSTPQSATPGPDTSRAPPPPPPQSQSPLQRRLQTLLEGARESWTYAIFWESSHDNFSGATLLRWGDGYYQGEEEDKAKGKAPKTTTSAEQARRKKVLLELNSLISGPSVSADDVDEEVTDTVWFFLLSMTQSFANGTTLPGQAFFNSTPVWVAGSDRLSELACERARQGRMYGLRTLVCIPSANGVVELASTEVIFQNPDLMNKVLDLFNFNAVDGHPTLPPRQ

SEQ ID NO: 197609 - protein, 590 aa, Glycine max
  Coding DNA Sequence Number=SeqID_80831
  Gene Ontology: Mol. function=monooxygenase activity; Cellular component=membrane; Biological process=electron transport
  Homolog annotation: Hit_ID=Q1SI93; Match level="QueryCoverage=85%, HitCoverage=99%, E-value=0.0, Identity=66%"; Hit description=E-class P450, group I
  Pfam annotation: Domain name=p450; Domain location=39-502; Score =349.5; E_value=5.6e-102; Accession=PF00067.12; Description =Cytochrome P450
MDSQILNSLALILPFFLFMIVVLKLGRKLKKTEPSLNIPPGPWKLPIVGNLHQLVTSSPHKKFRDLAKIYGPMMHLQLGEIFTIVVSSAEYAKEILKTHDVIFASRPHFLVSEIMSYESTNIAFSPYGNYWRQVRKICTLELLSQKRVNSFQPIREEELTNLVKMIGSQEGSSINLTEAVHSSMYHIITRAAFGIRCKDQDEFISAIKQAVLVAAGFNIGDLFPSAKWLQLVTGLRPTLEALFQRTDQILEDIINEHREAKSKAKEGHGEAEEEGLLDVLLKFEDGNDSNQSICLTINNIKAVIADIFGGGVEPIATTINWAMAEMIRNPRVMKTAQVEVREVFNIKGRVDETCINELKYLKSVVKETLRLHPPAPLILPRECQETCKINGYDIPVKTKVFINAWAIGRDPNYWSEPERFYPERFIDSSVDYKGGNFEYIPFGAGRRICPGITFGLVNVELTLAFLLYHLDWKLPNGMKNEDFDMTEKFGVTVARKDDIYLIPATSRPFLERNSHLVCAHGPKRLITTFMIFIFIKEKAVPICVPTKKLEMVQKAWKQCSQRRLSRIQCQDQEIPNLDIFVEKCPSVSDF

SEQ ID NO: 197610 - protein, 438 aa, Glycine max
  Coding DNA Sequence Number=SeqID_80832
VHIVATRWVVTPVFKCKWLNGNAGVSKDKMRFTLVDLEKVGYKDEPLTMAAQARQVFYVQDPSDPTWSLVLQGKTSGIPYDMCASTLDVNHIPTFSPQMSSINAENEEDDVHTNHNDHDEGPMATPPGGSLPPSDALSGTTSRKTRQSTRLKRLTSRSLDQPRPVVNMNPATDVSDSLKNLIWDDIRQFKSSLTSKYVYADNDGEDKVHPSVKYGLDVESWEKFAESRQTPNWQRKHQQTEFMENSAMLNDPPSPMARHVKWKMTRTKRYGQMTSTSAQQGSFIPEGHQDILNTALGRPEHPGRVCVAGHGLPKLTLVEAPDPQVLGARVSAKGSYAKVVANVLPKDPFAAHMTRMGLYIVVEDDDVPRVTVLIVYDADAQVPFSTSEIQYVKETHLVKPISNDSHNNVVKSVGRVERCNIGAAEDPFGELMKILYDV

SEQ ID NO: 197611 - protein, 254 aa, Glycine max
  Coding DNA Sequence Number=SeqID_80833
  Pfam annotation: Domain name=Transposase_23; Domain location=37-107; Score=11.0; E_value=7.2e-05; Accession=PF03017.5; Description =TNP1ENSPM transposase
MQSQGLAVPPEPLVGPSDPRVSTKGSCVDPSGNDPMTGDSDRCGLYIEADPARLVAMGRVYEGSTVVHNTPLLPGQVKVSVEEVTDADASVLVPTDEVSLVGQALHTFLAWPTHLVKSLSQQVVVSPPKPPPKPDPEVDDPLYLMTLIIPELFLRPYQVRWDVTMFGVVNPDFPLYIKHEDLSEIAHGGQCLSILVLQLWILHLTETCMRAGNSDIYGFLEPQSIQRSGKSQFESESSTAADIGRWWSSCPRNT

SEQ ID NO: 197612 - protein, 52 aa, Glycine max
  Coding DNA Sequence Number=SeqID_80834
MGLSDGSQSSLRQGLVMGHKVLFQHLVKTKGDVGVVFEHEMRRWLNSGKGQL

SEQ ID NO: 197613 - protein, 228 aa, Glycine max
  Coding DNA Sequence Number=SeqID_80835
  Homolog annotation: Hit_ID=Q1T1J7; Match level="QueryCoverage=21%, HitCoverage=7%, E-value=1e-13, Identity=76%"; Hit description =Phosphoesterase, DHHA1
MVFSMDESTNNVVLYAGVPEKRGKGKLDAVDWLSNALRPLEGRCGKGKCGSRMRPNVHLNRWFHRTALSLEVSNLRAVYVGQTRIILGVCGLSGVLFPLSALMHFMGRVLIALGASHASLQLVVVSLQLSKLLLVMSLHLRNMGLELLESIGGRGRNVFQDLTHWAESSLRIRRGTCKTKDYDAQFGSRLLRLMRMCSCTKAELTYIMGYDVHFVDLGQYRILKHIFT

SEQ ID NO: 197614 - protein, 129 aa, Glycine max
  Coding DNA Sequence Number=SeqID_80836
  Gene Ontology: Mol. function=protein binding; Cellular component =nucleus; Biological process=multicellular organismal development
  Homolog annotation: Hit_ID=Q1T413; Match level="QueryCoverage=61%, HitCoverage=52%, E-value=2e-19, Identity=72%"; Hit description=SKP1 component
  Pfam annotation: Domain name=Skp1_POZ; Domain location=25-68; Score =0.8; E_value=0.065; Accession=PF03931.5; Description=Skp1 family, tetramerisation domain
MIPVDDVGEAYPRIDHSPWNGCGGGGVSEVTDDQAHGQRQIPDNEIPLPNVTNKILGKVIEYCKKHIEANCADEKPNEDELRLGTLISSRLIRPLFSISFWGFTKFSRADYLKYKSESKIVPVGVNVKI

SEQ ID NO: 197615 - protein, 90 aa, Glycine max
  Coding DNA Sequence Number=SeqID_80837
MSIQRYLHKCPQDEDPCRVKGHPTTVPPYLASYMSQQQNRAKSTQHSVEVHSVEWCMAKEAARSMMVMQWSRDLGWLKEREGERIWLCHG

SEQ ID NO: 197616 - protein, 154 aa, Glycine max
  Coding DNA Sequence Number=SeqID_80838
MKADMEAMKEKMTMMMEEMMSTRKMMEDNTTTIVVASTTTKMDPIHPIASSENIDNFAPALIENQQPQSHHAHVSQPMRETHEVPQDHTLVGFGVYPGYNTEGKKFSSIPVLNALGISQCCPLSQPLDFVRGEGPSTVLEKERIEPYGGEATRH

SEQ ID NO: 197617 - protein, 165 aa, Glycine max
  Coding DNA Sequence Number=SeqID_80839
  Gene Ontology: Mol. function=oxidoreductase activity; Cellular component=cytosol; Biological process=flavonoid biosynthetic process
  Homolog annotation: Hit_ID=Q5Y381; Match level="QueryCoverage=98%, HitCoverage=52%, E-value=9e-57, Identity=58%"; Hit description =Aldo/keto reductase
  Pfam annotation: Domain name=Aldo_ket_red; Domain location=1-145; Score=12.8; E_value=5.4e-10; Accession=PF00248.11; Description =Aldoketo reductase family
MEECQKLGLTKCIGVSNFSCNKLENLLSFATIPPSINQVEMNPTWQQKKLKEYCQAKGIIITAYSPLGSTGCMWGSDNVVDNELLKEIAMAHGKSSAQVSLRWLYELGVTIAVKSYNKERMKQNLEIFDWSLNKYDNEKIDQVKQHQLSKIGPTKFIVDLWDGEN

SEQ ID NO: 197618 - protein, 51 aa, Glycine max
  Coding DNA Sequence Number=SeqID_80840
MAARGGQQWSWMVEKEISLSELVLLSGSPIFVLSATIHAESNSLCTNYRLA

SEQ ID NO: 197619 - protein, 88 aa, Glycine max
  Coding DNA Sequence Number=SeqID_80841
  Gene Ontology: Mol. function=oxidoreductase activity; Cellular component=apical plasma membrane; Biological process=flavonoid biosynthetic process
  Homolog annotation: Hit_ID=Q5Y381; Match level="QueryCoverage=99%, HitCoverage=27%, E-value=1e-25, Identity=69%"; Hit description =Aldo/keto reductase
  Subcellular localization annotation: CTP_CleavageSite=37; ConfidenceScore=5.25e-01
MSSSNIPHVVLQSSSNHHRMPVIGFGTASMSPPSTTRVAVLEAIKLGYRHFDTASIYGSEQPLGEAIAEALQLGLIGSRDELFITSKL

SEQ ID NO: 197620 - protein, 71 aa, Glycine max
  Coding DNA Sequence Number=SeqID_80842
  Gene Ontology: Mol. function=transition metal ion binding
GYDINNYSFYPESQDHKSTVQNSGITVDAHSDHFSSVVDNNPVRASMPYFGVIQEMWELDDGQFRVPVVTP

SEQ ID NO: 197621 - protein, 68 aa, Glycine max
  Coding DNA Sequence Number=SeqID_80843
MESESTGSVSTDLVSTNKAEDARKMEETTKRLPSQKVASSNSRKRKENPVASSNSNKRKGIPRRAPFY

SEQ ID NO: 197622 - protein, 99 aa, Glycine max
  Coding DNA Sequence Number=SeqID_80844
  Gene Ontology: Mol. function=gamma-glutamyltransferase activity; Cellular component=periplasmic space; Biological process=glutathione biosynthetic process
  Homolog annotation: Hit_ID=P18956; Match level="QueryCoverage=62%, HitCoverage=10%, E-value=1e-22, Identity=82%"; Hit description=Gamma- glutamyltranspeptidase precursor (EC 2.3.2.2) [Contains: Gamma- glutamyltransferase ...
  Homolog annotation: Hit description=large chain; Gamma-glutamyltransfe rase small chain]
WLPDQLRVEKGFSPDTLRLLEAKGQHVKVLPAMGSTQSIMIGPDGMRYGASDPRSVDDLSAGVSIHAHRHQIVQIPFNIREFARNVNGKKIGKGLYRRK

SEQ ID NO: 197623 - protein, 104 aa, Glycine max
  Coding DNA Sequence Number=SeqID_80845
  Gene Ontology: Mol. function=nucleoside-triphosphatase activity; Cellular component=protein complex; Biological process=protein catabolic process
  Homolog annotation: Hit_ID=P46466; Match level="QueryCoverage=79%, HitCoverage=18%, E-value=2e-36, Identity=91%"; Hit description=26S protease regulatory subunit 4 homolog
MVLYQVLSVVGLLQDEVDPMVFVMKVEKAPLESYVDIGGLDAQIQEIKEAVKLPLTHPELYEDIRIKPPKGVILYGEPGTGKTLLAKLDGFDSRGDVKEILATN

SEQ ID NO: 197624 - protein, 131 aa, Glycine max
  Coding DNA Sequence Number=SeqID_80846
  Homolog annotation: Hit_ID=Q1S9R4; Match level="QueryCoverage=56%, HitCoverage=9%, E-value=5e-07, Identity=50%"; Hit description =Forkhead-associated
MRLEQGSHSCIERAIDSHGAFAILYSRHSKHYIKKPEEFEHVNRFYWDGQLKVFLWTLTWASMEGMSMQYLDVTRLRFRDCNHIVEIVFVEIVFGTYPLSSCLSQTGLRFRDCNHIVEFAFVEFVSALPSK

SEQ ID NO: 197625 - protein, 210 aa, Glycine max
  Coding DNA Sequence Number=SeqID_80847
MMRIETIEKRQNLSMVLTMVISISYAMMVTNEIGSTFTSFSLFYHNTQRSRCYNYPARQFGLESNKGIRIRFFTQRVTNVDPAPTIYSASLRSRKGVDIAVKPTRLYNFLTRKSTGMRNIEAVYFFLKTFELGNQNHRIISSTTQGINCYKGKARNNKHLTYLGQQSSLGHSGACTTQCKTGNHDTGNHDGAGYDMVVRRGRQRHNECQL

SEQ ID NO: 197626 - protein, 82 aa, Glycine max
  Coding DNA Sequence Number=SeqID_80848
MDVLDTYMIEGQIQCSDQRRLLYEESGDELDRKKACYFRNPGIMFLIGELTWMKKGYYFGNGRSRTLKNMHCLELWLAILRT

SEQ ID NO: 197627 - protein, 82 aa, Glycine max
  Coding DNA Sequence Number=SeqID_80849
MKALKIKIKCWSRETFGGLDAKIEELVSEMDVLDTNMIEGQIQCSDKRRLLYEESGDELDRKKACYFRNPGSDGLNWETLIS

SEQ ID NO: 197628 - protein, 48 aa, Glycine max
  Coding DNA Sequence Number=SeqID_80850
MESTNVKNKSSGKRKMSSEDTRSYFPRNLEMERVLADVLRDKKILGNK

SEQ ID NO: 197629 - protein, 83 aa, Glycine max
  Coding DNA Sequence Number=SeqID_80851
  Gene Ontology: Mol. function=ATP binding; Cellular component =mitochondrion; Biological process=protein folding
  Homolog annotation: Hit_ID=P34893; Match level="QueryCoverage=82%, HitCoverage=63%, E-value=5e-19, Identity=82%"; Hit description=10 kDa chaperonin
  Pfam annotation: Domain name=Cpn10; Domain location=1-51; Score=4.6; E_value=0.00037; Accession=PF00166.12; Description=Chaperonin 10 Kd subunit
LNSGKVIAVGPGSRDKAGNLIPVSVKEGDHVLLPEYGGTQIKLDDKEYGFEIVFCSICLGMRTFWVFCMIDVVNVMRPTTCKL

SEQ ID NO: 197630 - protein, 156 aa, Glycine max
  Coding DNA Sequence Number=SeqID_80852
  Homolog annotation: Hit_ID=Q01FD0; Match level="QueryCoverage=82%, HitCoverage=42%, E-value=6e-20, Identity=45%"; Hit description =Chromosome 01 contig 1, DNA sequence
MFFGSRASKSNLRIPESALYLGKVSEASFSDFIDAISRHMDCFVDAAASARVGLCGELLDERGATEERTLLDMNRKRVREARAKIHELHETEDATRERLQRESTDVSSRVRDAVSYAERYEPSNKKARATPPAKNWDVLSLGQGSLSGESSSSDEE

SEQ ID NO: 197631 - protein, 83 aa, Glycine max
  Coding DNA Sequence Number=SeqID_80853
MDKVDIFVPHPLTNACLLIQLSPECGCKPLVCLLKQPALLSVDFQDRSIRDYSSCTLVGRSELSRIGCWTYGLSYLEKKRGLN

SEQ ID NO: 197632 - protein, 41 aa, Glycine max
  Coding DNA Sequence Number=SeqID_80854
IARDVLTIPISTIASESTFGIGGSRAIEESTFTDEIESDDE

SEQ ID NO: 197633 - protein, 149 aa, Glycine max
  Coding DNA Sequence Number=SeqID_80855
  Gene Ontology: Mol. function=protein serine/threonine kinase activity; Cellular component=integral to membrane; Biological process=protein amino acid phosphorylation
  Homolog annotation: Hit_ID=Q6K2G4; Match level="QueryCoverage=84%, HitCoverage=54%, E-value=6e-23, Identity=43%"; Hit description =Putative leucine rich repeat containing protein kinase
  Pfam annotation: Domain name=LRR_1; Domain location=27-49; Score =18.6; E_value=0.022; Accession=PF00560.23; Description=Leucine Rich Repeat
  Pfam annotation: Domain name=LRR_1; Domain location=51-73; Score =16.6; E_value=0.089; Accession=PF00560.23; Description=Leucine Rich Repeat
  Pfam annotation: Domain name=LRR_1; Domain location=75-97; Score =17.1; E_value=0.062; Accession=PF00560.23; Description=Leucine Rich Repeat
  Pfam annotation: Domain name=LRR_1; Domain location=99-121; Score =19.1; E_value=0.016; Accession=PF00560.23; Description=Leucine Rich Repeat
  Pfam module annotation: Pfam domain module=LRR_1::LRR_1::LRR_1::LRR _1; Domain location=27-49::51-73::75-97::99-121
MNHPCSTSHLCKLSIFPVLVIPLPLTSLVELDLSNNQLEGTIRTSLGNLTCLVELDLSANQLEGTIPTSLGNLTSLVKLQLSRNQLEGTIPTSLGNLTSLVRLDLSYNQLEGTIPTSLANLCNLMEIDFSYLKLNQQHLQFRVHDFQAI

SEQ ID NO: 197634 - protein, 95 aa, Glycine max
  Coding DNA Sequence Number=SeqID_80856
MEVMPLQLSLKLVQLSVVYFHLPLSWQEPAKPKISRKDMHLATHKLCLAALNRAKVSLSYGSLANRVAQLRKCRNKFRLAYRSSAYRTSINKIID

SEQ ID NO: 197635 - protein, 258 aa, Glycine max
  Coding DNA Sequence Number=SeqID_80857
  Gene Ontology: Mol. function=transporter activity; Cellular component= integral to membrane; Biological process=cell division
  Homolog annotation: Hit_ID=Q475I1; Match level="QueryCoverage=100%, HitCoverage=96%, E-value=1e-54, Identity=59%"; Hit description =Acriflavin resistance protein
  Subcellular localization annotation: CTP_CleavageSite=37; ConfidenceScore=5.02e-01
MMIDFALDAERAHGSQPSQAIYQASLLRFRPILMTTLAALLSALPLMFSHGTGSELRQPLGIVMVGGLLFSQAPSCECRRAGTVMNVLTTFIRRPVATSLLTLAIALPGLLAFKYLPRAALPQVDYPTINVAANLPGASPETMAATVATPLERAFGRIAGIEEMTSTSTQGSTRINLQFELDRNIDGAARDVQAAINAARALLPRNIPSNPSYRRINASAAPILAISLTSPTHTKEQLYDYAFSILGQKISQVRGVGQ

SEQ ID NO: 197636 - protein, 90 aa, Glycine max
  Coding DNA Sequence Number=SeqID_80858
  Subcellular localization annotation: CTP_CleavageSite=51; ConfidenceScore=5.50e-01
MAVTGYQAGTCVVFRCHSRMQAQPFRRGGRRSRTGLAPQRALRLSLLAVLVASGVAQAADTQNSEATLTVDASASAEAQQTQAAADYSVP

SEQ ID NO: 197637 - protein, 102 aa, Glycine max
  Coding DNA Sequence Number=SeqID_80859
  Gene Ontology: Mol. function=DNA binding; Cellular component =intracellular; Biological process=regulation of transcription, DNA -dependent
  Homolog annotation: Hit_ID=Q7X3W2; Match level="QueryCoverage=98%, HitCoverage=75%, E-value=5e-10, Identity=36%"; Hit description=Hns
  Pfam annotation: Domain name=Histone_HNS; Domain location=21-102; Score=31.2; E_value=3.5e-06; Accession=PF00816.11; Description=H-NS histone family
MSDALKALNNLRTLRAEARNIEVAVLNEMLEKFAVVVAERREETAAESAAQREKEEKLALYKEMLRKDGITINELAQLNQGETKSKAKRAPRPAKYKFTDEQ

SEQ ID NO: 197638 - protein, 431 aa, Glycine max
  Coding DNA Sequence Number=SeqID_80860
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=100%, HitCoverage=20%, E-value=0.0, Identity=80%"; Hit description=Protein ycf2
  Pfam annotation: Domain name=AAA; Domain location=200-420; Score=6.9; E_value=6.4e-05; Accession=PF00004.19; Description=ATPase family associated with various cellular activities (AAA)
MLWGGGPTYGVKSIRSKKKYLNLIDLISIIPNPINRIAFSRNTRHLSHPSKTIYSLIRKIKNVNGDWIDDKIESWVLNSNSIDDKEREFLVQFSTLTTEKRIDQILLSLTHSHHLSKNNSGYQMIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSNVRSVQDHGILFYQIGRAVSQN

SEQ ID NO: 197639 - protein, 402 aa, Glycine max
  Coding DNA Sequence Number=SeqID_80861
  Gene Ontology: Mol. function=metalloendopeptidase activity; Cellular component=cell outer membrane; Biological process=proteolysis
  Homolog annotation: Hit_ID=UPI00005F9451; Match level="QueryCoverage =98%, HitCoverage=64%, E-value=0.0, Identity=79%"; Hit description =COG1164: Oligoendopeptidase F
  Pfam annotation: Domain name=Peptidase_M3; Domain location=115-401; Score=-157.9; E_value=0.014; Accession=PF01432.10; Description =Peptidase family M3
MGTGGEEVSARFAAAESAYKRFIAEPRRLAEIRNLLAGLETLPQEAQRDALIHGLQGWLRFFDCNAIEDPQAQALLDRIIHAESDLYSRRKGYQVTHLNAEGQRVAASLGELLTNQATNPNEDYRRSSQQALRDLEQWLLHNGLPELIGLRNRFARQMGYRNYFDYKVNKTERMTPEQLFAILDRFERETREANARSLQQLAADKGSQALEPWNVRFASAGDVTRQLDPYFPFSRSLERWVDSFKRLHIGFGGAEMNLDLLVRKGKYENGFMHGPVPPFVRQGEWVPARINFTSLAQPGQVGSGAYGLNTLFHEGGHAAHFANIRQNAPCFSQEFPPTSMAYAETQSMFCDSLLDDADWLKRYAKNAAGEAVPDALIEAGIAARQPMRAFNERHILLVRGIL

SEQ ID NO: 197640 - protein, 81 aa, Glycine max
  Coding DNA Sequence Number=SeqID_80862
MSSFAPMSSRDNEFDDIWRYFMVLLSSSRDIQVQRRARFFSARQGQWSSIACGNVMVISFYRFQGTEVLLTLRMMFHWLGY

SEQ ID NO: 197641 - protein, 564 aa, Glycine max
  Coding DNA Sequence Number=SeqID_80863
  Gene Ontology: Mol. function=oxidoreductase activity; Cellular component=intracellular; Biological process=lignin catabolic process
  Homolog annotation: Hit_ID=Q8VZA1; Match level="QueryCoverage=95%, HitCoverage=96%, E-value=0.0, Identity=76%"; Hit description=Laccase (Diphenol oxidase)-like protein
  Pfam annotation: Domain name=Cu-oxidase; Domain location=164-315; Score=204.8; E_value=2e-58; Accession=PF00394.12; Description =Multicopper oxidase
  Pfam annotation: Domain name=Cu-oxidase_2; Domain location=413-548; Score=188.8; E_value=1.3e-53; Accession=PF07731.4; Description =Multicopper oxidase
  Pfam annotation: Domain name=Cu-oxidase_3; Domain location=38-154; Score=234.2; E_value=2.8e-67; Accession=PF07732.5; Description =Multicopper oxidase
  Pfam module annotation: Pfam domain module=Cu-oxidase::Cu-oxidase _2::Cu-oxidase_3; Domain location=164-315::413-548::38-154
MAAGMGFRSHKSLLTILFGFLGLFSFTVEAATKKYQFDIQVKNVSRLCHAKPIVTVNGRFPGPTIYVREGDRVLVNVTNHAKYNMTIHWHGIKQYRNGWADGPAYITQCPIQTGNSYTYDFNVTGQRGTLWWHAHIFWLRATVYGAIVIMPKPGTPFPFPQPAREFEILLGEWWHKDVEEIETQGNQMGLPPNMSDAHTINGKPGPLFPCSEKHTFAMEVEQGKTYLLRIINAALDDELFFAIGGHNLTVVEVDAVYTKPFTTQTILIAPGQTTNVLVKANQVAGRYFMATRTFMDAPIPVDSKAATAIFQYKGIPNTVLPSLPSLPAANDTRFALSYNKKLRSLNTPQYPANVPLKVDRNLFYTIGLAKNSCPTCVNGTRLLASLNNVSFVMPQTALLQAHYFNIKGVYRTDFPDKPLTAFNYTGAPLTANLGTSVGTRISKVPFNSTVELVLQDTNLLTVESHPFHLHGYNFFVVGTGIGNFDPAKDPAKYNLVDPIERNTVGVPTGGWTAIRFRADNPGVWFMHCHLELHTGWGLKTAFLVEDGPGQDQSVVPPPKDLPAC

SEQ ID NO: 197642 - protein, 680 aa, Glycine max
  Coding DNA Sequence Number=SeqID_80864
  Gene Ontology: Mol. function=ubiquitin-protein ligase activity; Cellular component=ubiquitin ligase complex; Biological process =protein ubiquitination
  Homolog annotation: Hit_ID=Q93XR9; Match level="QueryCoverage=90%, HitCoverage=85%, E-value=1e-140, Identity=44%"; Hit description=Bg55 protein
  Pfam annotation: Domain name=U-box; Domain location=228-299; Score =60.1; E_value=7.5e-15; Accession=PF04564.6; Description=U-box domain
MRVLTVMSLNNNDDTCNLSSLITLPQIWVLLYGGMEYRRWDTVLSRCLKATRSLEKSLIQIQDMVPVMLAVEVSRIIHDLECTRFVLDPNEEEAGRFVRELLTLTSDSVDDSEVKALQFAASRLNITSPKAIIIEQRSIRKLLEKLGPNDLKKKNILRYLLHLLKRHGKLMVGEHVEKLYSRSEEQAATENSSHGSLRSNHVESDSSMNYGQYKTHTNELSGVAPLEEYYKCPISSRLMYDPVIIESGVTYERIWIKKWFDEGNDICPKTRKKLVNMGLTPNMAMKDLISEWCKNNGVSIPDPSRHAEDIRTWETSNTSINSLASYFNDFTAPVDLSNMSIGSLDTSFSSDASHCKTTSGSNLMQTKSRDNSHKHQAHTEIHDTDLMLLPQLSDLQWDSQCKVIQDLKDHLKSNSQAFVSVSAENFIEPLVRFLSNAYDLRDVQVLRAGSQLLLENGKTNLSEDTFIMLASFLDSEVIGETLAIMEELSGYGFGKTKIAASSALSSILNMLDSENKGFQQQAIRIMYNLSFSGEVCHRMLSLRKSVSETKGCISSVAEILETGNNEEQEHALAVLVSLCSQHVDYCKLIMREHEEIMGSLFYISQNGNDKGKESALELFYLLKDVDIAVNKNCPEPNINNSCRDSNSHDREEKKPLKRSTFLKKLSQFSKSSSHATKSKR

SEQ ID NO: 197643 - protein, 397 aa, Glycine max
  Coding DNA Sequence Number=SeqID_80865
  Gene Ontology: Mol. function=protein binding; Cellular component =cytoplasm; Biological process=regulation of transcription
  Homolog annotation: Hit_ID=Q9M3H9; Match level="QueryCoverage=90%, HitCoverage=100%, E-value=1e-143, Identity=68%"; Hit description =Tubby-like protein
  Pfam annotation: Domain name=F-box; Domain location=53-108; Score =23.0; E_value=0.0011; Accession=PF00646.23; Description=F-box domain
  Pfam annotation: Domain name=Tub; Domain location=119-380; Score =205.5; E_value=1.2e-58; Accession=PF01167.8; Description=Tub family
  Pfam module annotation: Pfam domain module=F-box::Tub; Domain location=53-108::119-380
MSLKSIVRELKEMRDGIGSMSRRGVESRRWNGRTKSHVAPDVILTSLEPIQQGQWANLPPELLLDIIRRVEDSETTWPARAVVVYCGSVCKSWRAVTKEIVKTPEQCGRLTFPISLKQPGPRDSPIQCFIRRNRETSTYLLYIGLVPSENETDKLLLAAKKFTIYDSQPPQGAAIQPDNRSSRRFHSKQVSPRVPACNYVVSTIAYELNVLRARGPRRMHCTMNSISVSAVQEGGNAPTPTSFPQIIDEPFSPSPALKGKGPIRDLDNASLPELLPVQSQDSAEPLVLKNKAPRWHEQLQCWCLNFNGRVTVASVKNFQLVAAVDPSHNVSAAEQEKPVNETDGTGSSAGAALIPNQPVNETNDTGSSAGDSIYTRSARAKYHFYYFFNRYFLGSYS

SEQ ID NO: 197644 - protein, 432 aa, Glycine max
  Coding DNA Sequence Number=SeqID_80866
  Gene Ontology: Mol. function=ubiquitin-protein ligase activity; Cellular component=cell surface; Biological process=protein modification process
  Homolog annotation: Hit_ID=Q8GYL6; Match level="QueryCoverage=94%, HitCoverage=90%, E-value=1e-126, Identity=57%"; Hit description =Regulator of chromosome condensation like
  Pfam annotation: Domain name=RCC1; Domain location=127-178; Score =15.4; E_value=0.015; Accession=PF00415.9; Description=Regulator of chromosome condensation (RCC1)
  Pfam annotation: Domain name=RCC1; Domain location=273-318; Score =2.4; E_value=0.39; Accession=PF00415.9; Description=Regulator of chromosome condensation (RCC1)
  Pfam annotation: Domain name=RCC1; Domain location=380-429; Score =18.1; E_value=0.0078; Accession=PF00415.9; Description=Regulator of chromosome condensation (RCC1)
  Pfam annotation: Domain name=RCC1; Domain location=72-124; Score =22.9; E_value=0.0012; Accession=PF00415.9; Description=Regulator of chromosome condensation (RCC1)
  Pfam module annotation: Pfam domain module=RCC1::RCC1::RCC1::RCC1; Domain location=127-178::273-318::380-429::72-124
MLVRKLKLKAVSGVHLRWMSTVMCFGDGSQGAVGSPVGVGLDAYEPTPVTALPSDIVSVHAGHYHSLALTSHGHLWAWGRNNEAQLGRGPSSRESWHEPERVKGLLENVNVCGAFASGVVSAALGDDGSVWVWGKSKRGQLGLGQHITEAVVPTKLEALSRENVAKVVAFGWGHALARTSDGKLFGWGYSADGRIGKMGNNHFQTSPLESESPNNSQLSTSDLEAAEKRVLQGIEQENNMPIVWEPRLVEELRGVHVLDIACGLDHSLVLCRDGVLLSCGSNVYGQLGRAKIDLGVFPVEMSFSPVFIAAGLGHSLAICQFGESDVSVGTTNIASWGWNLSSQLGRPGDGKLPSLIDALDGENPVSVSAGRAHSLALTSKGELWVWGSGKSGRLGLGSSVNQVEPSCIDSLEAFQILQAVSGFDHNLVLVAG

SEQ ID NO: 197645 - protein, 127 aa, Glycine max
  Coding DNA Sequence Number=SeqID_80867
MRKESSRSRIHKTTRRTESEKARERSRRFERYDEEEGEGDGGGVGRYIPERSLRHPHRREKAISGTGMKAKRHLLERIQCLHPHCSLFLISGHVALVFLVILVITKSLIQDFNSGYPINVAVLSRWK

SEQ ID NO: 197646 - protein, 561 aa, Glycine max
  Coding DNA Sequence Number=SeqID_80868
  Gene Ontology: Mol. function=oxidoreductase activity; Cellular component=intracellular; Biological process=lignin catabolic process
  Homolog annotation: Hit_ID=Q8VZA1; Match level="QueryCoverage=98%, HitCoverage=99%, E-value=0.0, Identity=75%"; Hit description=Laccase (Diphenol oxidase)-like protein
  Pfam annotation: Domain name=Cu-oxidase; Domain location=161-312; Score=198.1; E_value=2.1e-56; Accession=PF00394.12; Description =Multicopper oxidase
  Pfam annotation: Domain name=Cu-oxidase_2; Domain location=410-545; Score=191.2; E_value=2.4e-54; Accession=PF07731.4; Description =Multicopper oxidase
  Pfam annotation: Domain name=Cu-oxidase_3; Domain location=35-151; Score=229.6; E_value=7e-66; Accession=PF07732.5; Description =Multicopper oxidase
  Pfam module annotation: Pfam domain module=Cu-oxidase::Cu-oxidase _2::Cu-oxidase_3; Domain location=161-312::410-545::35-151
MASLGGSMFVSTFLFVFVGLMSSSSEAAIKKYQFDIQVTNVSRLCHAKPIVTVNGRFPGPTIYVREGDRVLINVTNHVLYNMSIHWHGLKQFRNGWVDGPAYITQCPIQTGSSYTYDFNVTGQRGTLWWHAHILWLRATVYGAIVIMPKPGTPFPFPQPAREFEILLGEWWNNDVEEIENQGNKMGLPPNMSDAHSINGKPGPLFPCSEKHTFAMEVEQGKTYLLRIINAALNDELFFAIAGHSLTVVEVDAVYTKPFTTPAILIAPGQTTNVLVQANQVAGRYFMATKAFMDAPIPVDNKTATAILQYKGIPNTVLPVLPQLPASNDTRFALSYNKKLRSLNSAQYPANVPLKVDRNLFYTIGLGQNSCPTCLNGTQLVASLNNVSFVMPQTALLQAHYFNIKGVFRTDFPDRPPTPFNFTGAPLTANLATSTGTRVSKIAFNSTVELVLQDTNLLSVESHPFHLHGYNFFVVGTGVGNFDPAKDPAKYNLVDPIERNTVGVPTGGWTAIRFRADNPGVWFMHCHLEVHTGWGLKTAFVVENGPGQDQSVLPPPKDLPTC

SEQ ID NO: 197647 - protein, 73 aa, Glycine max
  Coding DNA Sequence Number=SeqID_80869
MPLVLGNIGYGSTSQVRKWNMNSTRPNPIGALSAHLALSEQLTAGAERGVKHEAHDLNALSARCGAERDYEGP

SEQ ID NO: 197648 - protein, 516 aa, Glycine max
  Coding DNA Sequence Number=SeqID_80870
  Gene Ontology: Mol. function=diacylglycerol kinase activity; Cellular component=nucleus; Biological process=protein kinase C activation
  Homolog annotation: Hit_ID=Q9FJY7; Match level="QueryCoverage=97%, HitCoverage=81%, E-value=1e-165, Identity=55%"; Hit description =Selenium-binding protein-like
  Pfam annotation: Domain name=PPR; Domain location=146-180; Score=9.4; E_value=0.58; Accession=PF01535.11; Description=PPR repeat
  Pfam annotation: Domain name=PPR; Domain location=208-242; Score =46.4; E_value=9.9e-11; Accession=PF01535.11; Description=PPR repeat
  Pfam annotation: Domain name=PPR; Domain location=309-343; Score =36.7; E_value=7.9e-08; Accession=PF01535.11; Description=PPR repeat
  Pfam annotation: Domain name=PPR; Domain location=344-378; Score =18.0; E_value=0.033; Accession=PF01535.11; Description=PPR repeat
  Pfam annotation: Domain name=PPR; Domain location=380-414; Score =13.2; E_value=0.21; Accession=PF01535.11; Description=PPR repeat
  Pfam annotation: Domain name=PPR; Domain location=76-110; Score=29.4; E_value=1.3e-05; Accession=PF01535.11; Description=PPR repeat
  Pfam module annotation: Pfam domain module=PPR::PPR::PPR::PPR::PPR::PP R; Domain location=146-180::208-242::309-343::344-378::380-414::76-110
MAVLLLPPNTEQTQALLERCSNMKELMQIHGQLLKKGTIRNQLTVSTLLVSYARIELVNLAYTRVVFDSISSPNTVIWNTMLRAYSNSNDPEAALLLYHQMLHNSVPHNSYTFPFLLKACSALSAFEETQQIHAHIIKRGFGLEVYATNSLLRVYAISGNIQSAHVLFNQLPTRDIVSWNIMIDGYIKFGNLDMAYKIFQAMPEKNVISWTTMIVGFVRIGMHKEALSLLQQMLVAGIKPDSITLSCSLSACAGLGALEQGKWIHTYIEKNEIKIDPVLGCVLTDMYVKCGEMEKALLVFSKLEKKCVCAWTAIIGGLAIHGKGREALDWFTQMQKAGINPNSITFTAILTACSHAGLTEEGKSLFESMSSVYNIKPSMEHYGCMVDLMGRAGLLKEAREFIESMPVKPNAAIWGALLNACQLHKHFELGKEIGKILIELDPDHSGRYIHLASIYAAAGEWNQVVRVRSQIKHRGLLNHPGCSSITLNGVVHEFFAGDGSHPHIQEIYGMPNLLAN

SEQ ID NO: 197649 - protein, 285 aa, Glycine max
  Coding DNA Sequence Number=SeqID_80871
  Gene Ontology: Mol. function=protein transporter activity; Cellular component=membrane; Biological process=intracellular protein transport
  Homolog annotation: Hit_ID=Q1PF48; Match level="QueryCoverage=99%, HitCoverage=99%, E-value=2e-78, Identity=57%"; Hit description =Syntaxin-like protein
  Pfam annotation: Domain name=SNARE; Domain location=210-265; Score =32.3; E_value=1.7e-06; Accession=PF05739.9; Description=SNARE domain
  Pfam annotation: Domain name=Syntaxin; Domain location=42-150; Score =77.5; E_value=4.2e-20; Accession=PF00804.15; Description=Syntaxin
  Pfam module annotation: Pfam domain module=SNARE::Syntaxin; Domain location=210-265::42-150
MNDLMTKSFLSYVELKKQARKDLEDDDLDLEAGKLNPTEDRNLSQFFQEVEAIKVEMEEISNLLFDLQQLNEEAKCTHGAKVLRGLRDRMESDMVAVLRKARTIKAMLEVLDQSNIANRSLSESYKEGSPIDRTRMSVTNGLRVKLRDMMNDFLSLRDKILSDHKEDLKRRYYTATGEVPTEEVMEKMVSGSLKVEFLAGKTDADLGTQVRHEAVMDIQRSLNKLHQVFLDMAILVETQGEKLDNIEDNVVNADEEEEQKMVVLGFCCGADYTTRMHHCNVVFLT

SEQ ID NO: 197650 - protein, 94 aa, Glycine max
  Coding DNA Sequence Number=SeqID_80872
  Gene Ontology: Mol. function=nucleotidyltransferase activity; Cellular component=cellular_component; Biological process =biosynthetic process
  Homolog annotation: Hit_ID=Q1RVE8; Match level="QueryCoverage=93%, HitCoverage=51%, E-value=4e-33, Identity=78%"; Hit description =Cytidylyltransferase
MAVHGDDDPEEMVVPNLSPPNTYEAVVNGGTFDRLHNGHRLFLTASAELARRRIVIGVCDGPMLAKKQFAELIQPIEERINNVKTFIKNMRDGL

SEQ ID NO: 197651 - protein, 66 aa, Glycine max
  Coding DNA Sequence Number=SeqID_80873
  Subcellular localization annotation: CTP_CleavageSite=60; ConfidenceScore=5.02e-01
MAFALSRKWWHGACVGASNRLLYSSVGKQLFSGKQLLAGSLSTPECHSIKIENVSVEFTRRMHNTY

SEQ ID NO: 197652 - protein, 78 aa, Glycine max
  Coding DNA Sequence Number=SeqID_80874
  Gene Ontology: Mol. function=nucleotidyltransferase activity; Biological process=biosynthetic process
  Homolog annotation: Hit_ID=Q1RVE8; Match level="QueryCoverage=93%, HitCoverage=36%, E-value=5e-21, Identity=75%"; Hit description =Cytidylyltransferase
MAVHGDDDTMVMVVPKLSPPNTYEAVVNGGTFDRLHDGHRLFLTIMPKLETCVQASAELARRRIVIGVCDGPMLAKKQ

SEQ ID NO: 197653 - protein, 357 aa, Glycine max
  Coding DNA Sequence Number=SeqID_80875
  Gene Ontology: Mol. function=protein binding
  Homolog annotation: Hit_ID=Q8S8G6; Match level="QueryCoverage=74%, HitCoverage=68%, E-value=1e-74, Identity=53%"; Hit description =Expressed protein
  Pfam annotation: Domain name=DUF829; Domain location=94-357; Score =183.0; E_value=7.5e-52; Accession=PF05705.5; Description=Eukaryotic protein of unknown function (DUF829)
  Subcellular localization annotation: CTP_CleavageSite=80; ConfidenceScore=5.70e-01
MEAQLKVLSLSPSTLGRHFLCKTTSHPSLPFPRATLTRPPIPSNWNPRRFLFSSLTSSPSLNPFLSHSQTAGGAFPWNPASETRNAAFCGGKDRVATVVLLGWLGARTKHLKRYVEWYNSRGINALTFVVDVKELLRFDLGHVLETRISLLADHLVSWVSREEHDGRERCLVFHTFSNTGCYGYILARMLGSEELMEKIKGCIVDSGGGEPFNPKVWAAGFSAAILKKRNSLGPVVEVEGKLKSETEVSLSKVQQNEPSTIETVVLSLLEKFFSFVLQLPDVNQRLTRIVNVLMKHQPCPQLYLYSTADKVVPCQSIETLIEEQRKMGKRVIHFHKMIISTNPPRVKTISFFFVHGF

SEQ ID NO: 197654 - protein, 103 aa, Glycine max
  Coding DNA Sequence Number=SeqID_80876
MELPFKMTPYFPKLDLKFKPFAENLKSELLGGIIALFVLGLTYLYYRMKTPKDLNTCTISVMYATVSEEGKVEVEFIYEPLKPASKPLRLAADDDELKDFSVD

SEQ ID NO: 197655 - protein, 65 aa, Glycine max
  Coding DNA Sequence Number=SeqID_80877
  Gene Ontology: Mol. function=transcriptional repressor activity; Biological process=regulation of nitrogen utilization
  Homolog annotation: Hit_ID=Q9SDZ1; Match level="QueryCoverage=95%, HitCoverage=20%, E-value=9e-25, Identity=90%"; Hit description =Isoflavone reductase homolog 1
MAAKSKILVLGGTGYIGKFIVKASAEAGHPTFALVRETTLSHPEKSKLIESFKSSGVTLLYVDSR

SEQ ID NO: 197656 - protein, 72 aa, Glycine max
  Coding DNA Sequence Number=SeqID_80878
  Gene Ontology: Mol. function=transcriptional repressor activity; Biological process=regulation of nitrogen utilization
  Homolog annotation: Hit_ID=Q9SDZ1; Match level="QueryCoverage=73%, HitCoverage=17%, E-value=2e-18, Identity=83%"; Hit description =Isoflavone reductase homolog 1
MTAKSKILVLGGTGYIGKAYSTKKVKIRRAIEAEGIPYTYISSNAFAGYFLPNLLHQNVTAPPRDKVVIPGD

SEQ ID NO: 197657 - protein, 352 aa, Glycine max
  Coding DNA Sequence Number=SeqID_80879
  Gene Ontology: Mol. function=transcriptional repressor activity; Cellular component=integral to membrane; Biological process =regulation of nitrogen utilization
  Homolog annotation: Hit_ID=Q9SDZ1; Match level="QueryCoverage=99%, HitCoverage=100%, E-value=1e-146, Identity=77%"; Hit description =Isoflavone reductase homolog 1
  Pfam annotation: Domain name=3Beta_HSD; Domain location=8-218; Score=- 120.9; E_value=0.00045; Accession=PF01073.9; Description=3-beta hydroxysteroid dehydrogenaseisomerase family
  Pfam annotation: Domain name=Epimerase; Domain location=7-261; Score=- 44.4; E_value=0.0029; Accession=PF01370.11; Description=NAD dependent epimerasedehydratase family
  Pfam annotation: Domain name=NmrA; Domain location=7-343; Score =474.5; E_value=1.3e-139; Accession=PF05368.3; Description=NmrA-like family
  Pfam annotation: Domain name=Semialdhyde_dh; Domain location=6-126; Score=-21.3; E_value=0.034; Accession=PF01118.15; Description =Semialdehyde dehydrogenase, NAD binding domain
  Pfam annotation: Domain name=TrkA_N; Domain location=7-117; Score= -1.5; E_value=0.02; Accession=PF02254.8; Description=TrkA-N domain
  Pfam module annotation: Pfam domain module=3Beta_HSD::Epimerase::NmrA: :Semialdhyde_dh::TrkA_N; Domain location=8-218::7-261::7-343::6 -126::7-117
MAAKSKILVIGGTGYIGKFIVKASAETGHPTFVLVRDNTLSHPEKSKLVESFKSFGVTLLYGDLTDHDSLVKAIKQVDVVISALGGQQIDDQVKIIAAIKEAGNIKILVHKVLKIAPKHHHHHRQENDTDIDRNLSMVANSSKSVNNCNGTRFLPSEFGLDVDHHNAVEPVSSFFEKKVKIRRAIEAERIPYTYITSNLFAGHFLPNLLQQNVTTPPRDKVVILGDGNVKGVYVIEEDVATYTIKAVEDPRTLNKTVYVRPPANILTFNELVSLWEYKINSTLDKIYIPDDQLLKSIQESPFPDNFMLALRHSFLVKGDCNYEIDPSFGVEASKLYSEVKYTTVDNYLNAFV

SEQ ID NO: 197658 - protein, 185 aa, Glycine max
  Coding DNA Sequence Number=SeqID_80880
  Gene Ontology: Mol. function=transcriptional repressor activity; Biological process=regulation of nitrogen utilization
  Homolog annotation: Hit_ID=Q9SDZ1; Match level="QueryCoverage=87%, HitCoverage=52%, E-value=1e-68, Identity=77%"; Hit description =Isoflavone reductase homolog 1
  Pfam annotation: Domain name=NmrA; Domain location=3-176; Score=77.7; E_value=3.7e-20; Accession=PF05368.3; Description=NmrA-like family
MWEPLLTFHYIRAAIRAIEAEGIPYTYVCSYAFAGYFLPTLGQENVTAPPRDKVVILGNGNVKGVYVTEEDVGTYTIKAVEDPRTLNKTLHQKPPANVLTFNELVSLWENKIKTTLHKIYVPEEQILKKIQESSFPANFLIALGHAMLVEEAFNNEVDPSVSVEASELYPEVKYTTVDNYLNAFV

SEQ ID NO: 197659 - protein, 48 aa, Glycine max
  Coding DNA Sequence Number=SeqID_80881
MEDDAEHLPLSPSHLFIAKQGEQVATQLAQESSARPGELVGPGAEECR

SEQ ID NO: 197660 - protein, 171 aa, Glycine max
  Coding DNA Sequence Number=SeqID_80882
MTTLAQTWSVLSFSNLIPTSHSSDVTLDRARLIYGIIMKMDMNVGKARGKRSEAPSIAPLEAPTPSSSTLPSSSSTDIPMIPPTPTQIPLPAPLSTGDQPSSSGGGGASTSQEPVTKEATAPAPSPAAVEEETTPAQTPQPSPPSAPAPEETQLSSALDLNEDQPQEEQDV

SEQ ID NO: 197661 - protein, 180 aa, Glycine max
  Coding DNA Sequence Number=SeqID_80883
EIPHGLPPSRGIEHQVDLLPGASLPNRPTYKSNPQETQRKDAHVKVEYVKRLYDQVKVQIAKKNGSYTKQANKKRKEVVLEPGDDPGQGGQMFSKKEGMMRIMKQAKYSLKAQVEKDEGPSGEGQSPRVEKDEGPSNPCGVYPDLSSFIGSGVYPDLSSFTGSGVIQTSVACIKRSTPTQ

SEQ ID NO: 197662 - protein, 309 aa, Glycine max
  Coding DNA Sequence Number=SeqID_80884
  Homolog annotation: Hit_ID=Q1SS26; Match level="QueryCoverage=78%, HitCoverage=28%, E-value=6e-08, Identity=20%"; Hit description =Unnamed protein product; no similarity, hypothetical start
MEFFSAETFDCIQAFQNLGLIPFMSLQLPVYPELIKVFYCNLEIQDITLISKVFGIKMVIDQSLFHDLTQLSSDGVPFEGTLNDDWKFDFSAHDARQLVCTNNADMTRRLLAGSLAFESRILHYLIVRILLPRSSNLAQVSEEDLVIMWAFHTGHQLDWAHLVRYRMHKALRLNALLPYPHLVTLFFRHFQIPLDSEPYVPIKRSFLIGAVVIASFGYRKDHDGSWVKKGAQPADEEGNLPVEDNSTLLRRLMDKFDGLQTFVGDKFDAMELQVDMRFDAMESRITKVEEDVSFIRTCFDPPPPPPSSS

SEQ ID NO: 197663 - protein, 66 aa, Glycine max
  Coding DNA Sequence Number=SeqID_80885
MGPKSTLRLMRTLGPSLVSLAQSSWRFLSNALGGTVGHDICQGVGLASGSGIKGMSHIISMTDMQQ

SEQ ID NO: 197664 - protein, 81 aa, Glycine max
  Coding DNA Sequence Number=SeqID_80886
MRSAKKAEPLLPFTPPPIYSKIGEELATQLAQASKVASSRSNSLLEEESGRPSFRRSYENSRIAKNTSFRFPSHHGIFTDR

SEQ ID NO: 197665 - protein, 191 aa, Glycine max
  Coding DNA Sequence Number=SeqID_80887
  Pfam annotation: Domain name=Transposase_23; Domain location=62-132; Score=10.0; E_value=9.1e-05; Accession=PF03017.5; Description =TNP1ENSPM transposase
GPARGVNHRKSDSVADVILQPDAIPVSVTDAITWTCTKVGPSAACVSTKESCVYPSGNDPDIGDSNKCRLYIEENPPRLVALGRVYEGSTIVHNIPLLHDQVKVGVEEVKDADAPVPVPTDEVNLVGQTLNTFLAWPTHLVKRLSEQVMWDATVFGVFNKDFPLYIKHEDLSEIAHGGQCLSIFVIQLWIL

SEQ ID NO: 197666 - protein, 79 aa, Glycine max
  Coding DNA Sequence Number=SeqID_80888
  Homolog annotation: Hit_ID=Q84XA6; Match level="QueryCoverage=44%, HitCoverage=8%, E-value=1e-07, Identity=71%"; Hit description =Cytochrome P450 71D2
YPATVQTRVRFPAGANKKSYDDNCVNCDRWVCHNVLGRKNMFGAGTDTSSAVIEWAMSEMMENPRVMTKAQDEVTINFA

SEQ ID NO: 197667 - protein, 89 aa, Glycine max
  Coding DNA Sequence Number=SeqID_80889
MISPTSRSEVAGEFRGLLSRLVVEKPRQWDPPPSCVIIADGLMSTVSMDVAKEFGVPLIAFRTYSATATWVSIHVSKIVQEGVMDLQNP

SEQ ID NO: 197668 - protein, 137 aa, Glycine max
  Coding DNA Sequence Number=SeqID_80890
MAPTRHPLDPEKSNRALGFPALITGLCQSYGVPVTPSKYYTPRQAQGDAHQATGAPPPPQQADLAGSLGVERYLQHLVRQQEANHRGQFGAGVAWPRDWPDAQAGEQPTGSPGEADEPNMDKDMTDLLGFLGGSGAT

SEQ ID NO: 197669 - protein, 281 aa, Glycine max
  Coding DNA Sequence Number=SeqID_80891
  Gene Ontology: Mol. function=protein tyrosine/serine/threonine phosphatase activity; Cellular component=mitochondrion; Biological process=protein amino acid dephosphorylation
  Homolog annotation: Hit_ID=Q1S1L6; Match level="QueryCoverage=93%, HitCoverage=93%, E-value=1e-124, Identity=85%"; Hit description=Dual specificity phosphatase, catalytic domain, putative
  Pfam annotation: Domain name=DSPc; Domain location=18-156; Score =37.3; E_value=5.4e-08; Accession=PF00782.11; Description=Dual specificity phosphatase, catalytic domain
MLFVGHKVAPKSDALNFQFILLGAVPFPIDVPRLKELGVRGVITLNESYETLVPTTLYYAHGIDHLVIPTRDYCFAPSLNDIFRAVDFIHENALSGRTTYVHCKAGRGRSTTIVICYLVHHKMMTPDAAYSYVKSIRPRVLLASSQWQAVQEYYYHLMVRRTVGCAPTANLFVKTSQVAAGSRDLVMFDDNSVVMVTESDLEGYNPSSQSGAMASEIWADLSVVYRVRVAGQAALARISCLWLRYGTTDQKISTEKLSSRESSCSIRANHLGEISVDIHVY

SEQ ID NO: 197670 - protein, 37 aa, Glycine max
  Coding DNA Sequence Number=SeqID_80892
MAVVDPWPGDSLRRVLWMEWWNKYLEHVGSNDHHEKH

SEQ ID NO: 197671 - protein, 54 aa, Glycine max
  Coding DNA Sequence Number=SeqID_80893
MMFIAAGLEAIRFGLLCVSKVSGKATVIAAIGVRHNFFGTDIVRWQCMGVIEKF

SEQ ID NO: 197672 - protein, 106 aa, Glycine max
  Coding DNA Sequence Number=SeqID_80894
MKRRLKHNSQGLIYDNPQQTNREDDSKQKAFSNDTVLSVTLGEISFFVFLSAKINIFIYMKRVPELFKPDKPFAFSTSNNKNLACEEIELRGEWIITRTALDTGSP

SEQ ID NO: 197673 - protein, 101 aa, Glycine max
  Coding DNA Sequence Number=SeqID_80895
MWFLNIPFLKQASYIRILGSENVPCAILFQVKIAVEVNKRKKRSAVRRFFKKDMADLLGSSLDYNAYGREPVADILGAHYYGFFNAKVKALLSMASDVAVK

SEQ ID NO: 197674 - protein, 95 aa, Glycine max
  Coding DNA Sequence Number=SeqID_80896
MCLRVLLGNVLGFVYNGVASVVATDEEHEAVDHRLESEELGEVVVGVENNAEVGSFAYYELSGWVAVQWWVWCGVEALSATMVTFGWRWSAVVMD

SEQ ID NO: 197675 - protein, 120 aa, Glycine max
  Coding DNA Sequence Number=SeqID_80897
  Homolog annotation: Hit_ID=Q8LCM1; Match level="QueryCoverage=66%, HitCoverage=19%, E-value=6e-10, Identity=45%"; Hit description =Glycoprotein homolog
DDDTEIEDQDVEGGRTVAKNNDSGKSPPVIGGESSKTDGDEGPDVDKKADEFIAKFREQIRLQRIESIKRSTRSARNASSCFEWEIVIRSRFWPFVVEKCQTEFPYTNIHLERERKNREK

SEQ ID NO: 197676 - protein, 127 aa, Glycine max
  Coding DNA Sequence Number=SeqID_80898
MEVDGMIPRIHQQIDSQDNFMLLAPFERSFKNVIFQILTSIQLLGFLGDEILNFSIDWLEQKDPGVFDQPFFMPYDRLKILIPSYEKAKFIHIILNPFNVREQEHLAVPSIIGMENTTIFNYFKDRI

SEQ ID NO: 197677 - protein, 58 aa, Glycine max
  Coding DNA Sequence Number=SeqID_80899
MVREKVVMGGAKESEKHGVSVTRAMASAVLGKSNLQCRAGQMDHGPWTTHETHNPYEI

SEQ ID NO: 197678 - protein, 112 aa, Glycine max
  Coding DNA Sequence Number=SeqID_80900
MRLPGKESLLMKSPITINEIFDVSISFLNDHLEETPGSTKIEEIHSKCINLAQVCRMARHDTCRGLVWLKDKRGAPHYFHDTNAKMMIWKLYAKLVMHAPMRTLKCQIFMVM

SEQ ID NO: 197679 - protein, 89 aa, Glycine max
  Coding DNA Sequence Number=SeqID_80901
MDTSVPYTGAIRGTVHKPQANLGADQKFSLAKGAEPNPRVERNKGTSNTFELLTQYNLKHSLRLSNPFFHNPLTPNHVTSPIKPMWITE

SEQ ID NO: 197680 - protein, 80 aa, Glycine max
  Coding DNA Sequence Number=SeqID_80902
  Homolog annotation: Hit_ID=Q6D9Q1; Match level="QueryCoverage=83%, HitCoverage=64%, E-value=9e-15, Identity=57%"; Hit description =Putative exported protein
MRSYDMSRYQVQLSLDRARTVAAQSDPNNSRHYLFDYKKANEDLNTIRAGIDRYTQPSRAQPLDYGKVSGDYTRGRPLWR

SEQ ID NO: 197681 - protein, 67 aa, Glycine max
  Coding DNA Sequence Number=SeqID_80903
  Subcellular localization annotation: CTP_CleavageSite=36; ConfidenceScore=5.33e-01
MSLPSAVHVSPLSSAKLLVTGKHIVLLFSRSVPSPKEKRRSGDESRHHRKGRTDEISVLSLLSSYLR

SEQ ID NO: 197682 - protein, 118 aa, Glycine max
  Coding DNA Sequence Number=SeqID_80904
MRGHPRLAKMCRPVLEWARARDPRRDLGTFFRCRLRLLGCRSLTSPCRKRLDPWPGPLDHEILYAKDGPMLSLALQHRHKNVCALSKGAGGRCSYWRGRRGAGASASAEVEVEASEGP

SEQ ID NO: 197683 - protein, 174 aa, Glycine max
  Coding DNA Sequence Number=SeqID_80905
MASRKRKTSTSRPQEPYDTTRFVSEELERQRWHKALTRQLDNCIDVALVMEFYPNLYDLEDKSPRQCRVRGKLIKFDAETLNTFLETPVVLEPGERYSAYSRARLVYELVMKMDMDLGSIISGQISQMDQSNSSRLGFRALIIALCIARGVVPDSLTFESLSPAINLAYIQKNC

SEQ ID NO: 197684 - protein, 56 aa, Glycine max
  Coding DNA Sequence Number=SeqID_80906
MDEIENEIAQIARAKRGWPKAFLKHWMRKELRKFFSHPLAQCILCAKRDIPHALSE

SEQ ID NO: 197685 - protein, 98 aa, Glycine max
  Coding DNA Sequence Number=SeqID_80907
  Gene Ontology: Mol. function=RNA-directed DNA polymerase activity
  Homolog annotation: Hit_ID=Q1SJ82; Match level="QueryCoverage=71%, HitCoverage=16%, E-value=2e-12, Identity=47%"; Hit description =Probable Ta11-like non-LTR retroelement protein [imported] -Arabidopsis thaliana
MCFMVGFFFQSAPHPSRLHIFGQSSWKSIGSWSRVPLGKGYYELVFSSAEDLNIIKLMYYIGLHIGFLRLLAWTPDFNPNLIKQTHAQCWFYHLGLLD

SEQ ID NO: 197686 - protein, 66 aa, Glycine max
  Coding DNA Sequence Number=SeqID_80908
  Subcellular localization annotation: CTP_CleavageSite=46; ConfidenceScore=5.52e-01
MQMHATFVVKFGKCGLHMKQCNVRACSPLKARTCSPLKVRACNPLMARTGSPLTARTCSPLNGEGN

SEQ ID NO: 197687 - protein, 109 aa, Glycine max
  Coding DNA Sequence Number=SeqID_80909
  Subcellular localization annotation: CTP_CleavageSite=32; ConfidenceScore=5.20e-01
MAPKKLSAKRSRRDTAAKGTSAAPEFDSHRISSALRPSKDGRSTERDASSSGTMNALSQFLGDPLVLEEGQECEFSQRRNRADGFDEEAIAQLICTSGQDFAQTAAGRQ

SEQ ID NO: 197688 - protein, 77 aa, Glycine max
  Coding DNA Sequence Number=SeqID_80910
MVSFFYVEDMQLAGAIGEFGQALTRIMGVASAVGELSVGCKKRCRKRGSFKQLKTPVLLAICATVGVASSTGELSFK

SEQ ID NO: 197689 - protein, 89 aa, Glycine max
  Coding DNA Sequence Number=SeqID_80911
MKPHCRKFSMRTSSFRRCSTGEFDLQENFDASSPVTGGHAYGAMLPVFLNELRSNHHKELVEITLELENDAVVLCNVAPAPSSAPNASP

SEQ ID NO: 197690 - protein, 79 aa, Glycine max
  Coding DNA Sequence Number=SeqID_80912
MVEREKFDHIQERLRAIEGGRDYAFADVAELCLVPDVIIPPKFKVPDFDKYKGTTCPKNHLNMYNRKMGANSKNVAFIR

SEQ ID NO: 197691 - protein, 89 aa, Glycine max
  Coding DNA Sequence Number=SeqID_80913
  Homolog annotation: Hit_ID=Q1SS80; Match level="QueryCoverage=43%, HitCoverage=7%, E-value=3e-11, Identity=84%"; Hit description=DNA -binding WRKY
  Subcellular localization annotation: CTP_CleavageSite=84; ConfidenceScore=5.19e-01
MDAGEALSDDPNRPNSAADAAPAPAGARYKLLSPAKLPISRSPCVTISPGLSPTSFLESPVLLSNMKGFSFLGLGSRFGFDPLNCSEKE

SEQ ID NO: 197692 - protein, 625 aa, Glycine max
  Coding DNA Sequence Number=SeqID_80914
  Gene Ontology: Cellular component=microtubule; Biological process =microtubule cytoskeleton organization and biogenesis
  Homolog annotation: Hit_ID=Q1SS78; Match level="QueryCoverage=96%, HitCoverage=87%, E-value=1e-81, Identity=36%"; Hit description=ABI3 -interacting protein 2
  Pfam annotation: Domain name=Frigida; Domain location=104-470; Score =79.1; E_value=1.4e-20; Accession=PF07899.2; Description=Frigida-like protein
  Pfam annotation: Domain name=PA28_alpha; Domain location=10-74; Score= -9.2; E_value=0.063; Accession=PF02251.8; Description=Proteasome activator pa28 alpha subunit
  Pfam module annotation: Pfam domain module=Frigida::PA28_alpha; Domain location=104-470::10-74
MATLKTISAALNLVDSKKENLKKAFDNLHSLLSPLPLSWLDLDSHFTTLHHSLTHRFNLLQSHSQTLTPIPDPPPHTPQDVNFSSNPTDPSSNHDESSPGVSLQNDVVPGPVTPRNELVALCEKMDGVGLMNYVNDNFQDRTRVQAELPGAFRHAPDAGTMVLGALEVFHGEGSELKEWELRRIRKACIVLLKQFRVAALSVSAEASVRARELALEWKERLVGDEDNMFGALGLLHLICAFGFVSEFSLDELVDFSVAAPTNEEDFPELCRTIGLTERVPGLLELLVLMNKDKKERREEMNGNESYALALYVQPKDITFIVCKVKFVKGLLVLEEICILQVLKKDKNFILLAGNNTSFTDIVQKLIDKDKHIPAVKYILEFNLADRISPVPILKACVEEAKKLGKRLFQEGKSLNESTSREINTLRMVIKTIESYKLESEYPLASLEQHIEQLKRQKTNNKHAAPTSAAKPPQHKQQQQQQQQKRNMQKQPQQTGIKRPRASAPVGSAAVLKNVNNVNSTIHHYQQHLVHPSGLFTEHPNPYMSLPAMPFGMVSPTPNVPPYAGPSAGPYGHDGVPMGPSGNPSLGGSHLSSSEPHVQAVGYYDRASTYGGIGLQHYYQASYYPQ

SEQ ID NO: 197693 - protein, 63 aa, Glycine max
  Coding DNA Sequence Number=SeqID_80915
MDLKLLVRTVVSTCLEALLCFFELRTRYLMGGFHGGCNRVQIFGLDSLKFKKELWGFGWDCEL

SEQ ID NO: 197694 - protein, 77 aa, Glycine max
  Coding DNA Sequence Number=SeqID_80916
MNAKRRENMVGVLPKKRILMWQGESQGNQDTTTYITIPNHNIQSMTQGMAQALCVSEHFHHVIVLCVPLPPNPINAQ

SEQ ID NO: 197695 - protein, 243 aa, Glycine max
  Coding DNA Sequence Number=SeqID_80917
  Gene Ontology: Mol. function=oxidoreductase activity; Cellular component=membrane; Biological process=electron transport
  Homolog annotation: Hit_ID=Q9SJH2; Match level="QueryCoverage=99%, HitCoverage=56%, E-value=2e-69, Identity=53%"; Hit description =Putative cytochrome P450
EMGFPLIGETMEFFNAQRRNQLFEEFVHPRILKHGKIFRTRIMGSPTVVVNGAEANKFLLSNEFKLVKSSWPSSSVELMGRDSIMEKDGERHRFLRGVIGTSLGYAGLELLVLKLCNSVQFHLATNWKGQHKISLYRSTKVLSFSVVFECLLGIKVEPGQGGDRKDVGQSGEREEKGNGRKHGKRTRWNAAVQIGIRDDPRGEKEVIDNVVLLVFAAHDTTFAVAMTFKMLAKHPDCFGKLLQ

SEQ ID NO: 197696 - protein, 104 aa, Glycine max
  Coding DNA Sequence Number=SeqID_80918
MGCVPRSLPERIINRSDNYLKGINNSALKGLDDTPQSKSKIAPRQKGSTECGYYVMHWMSFIILESFNNNWETFFNDARPLEPERLKALHIQWAKYYLKVKNEI

SEQ ID NO: 197697 - protein, 272 aa, Glycine max
  Coding DNA Sequence Number=SeqID_80919
  Gene Ontology: Mol. function=polyphosphate kinase activity; Biological process=tetrapyrrole biosynthetic process
  Homolog annotation: Hit_ID=UPI00006AB8FD; Match level="QueryCoverage =86%, HitCoverage=91%, E-value=1e-80, Identity=60%"; Hit description =conserved hypothetical protein
  Pfam annotation: Domain name=PPK2; Domain location=18-246; Score =443.5; E_value=2.8e-130; Accession=PF03976.4; Description =Polyphosphate kinase 2
MGSKKKTSVAVDVEVNTPLKNKEYEKELRRLHVELVKLQQWVVAKGLKVCIVFEGRDGAGKGGTIKAITERVSPRVFRVVALPAPTEKEKSQLYFQRYVPHLPSAGEIVIFDRSWYNRAGVERVMGFCTEEQVEKFLDGAPVMEKAMVDAGIILLKYWLEVTPKEQERRLRDRINDGRKIWKLSPMDIKSFNLWDEYTLARDAMFEATDTAWAPWFVARSEDKKRVRLNIISHLLSQIPYKELHVEKVDLPKRKIGKVKPTKYPFRYVEERF

SEQ ID NO: 197698 - protein, 129 aa, Glycine max
  Coding DNA Sequence Number=SeqID_80920
MSHHSSSVNGKGTSHKDPLSRILDELSSLKLWIEKLERKEKGNERALLLSYEKVKNRNNNLDKSKAEIKGAQRKSKERREEESKHKFYTGSTMTRAYIQSSSNLLRFPFLLKILYKQRATKDVPSLVLF

SEQ ID NO: 197699 - protein, 57 aa, Glycine max
  Coding DNA Sequence Number=SeqID_80921
MEVVVETELFCVGGGNAQIFVAFQDKIPSKQNLMVRGVLSNDELDYGSCGGMVETLK

SEQ ID NO: 197700 - protein, 48 aa, Glycine max
  Coding DNA Sequence Number=SeqID_80922
MDRIANGPRGFAFLRYATEEESQKAIEGMHRKESNLESPRFLQLPLAC

SEQ ID NO: 197701 - protein, 496 aa, Glycine max
  Coding DNA Sequence Number=SeqID_80923
  Gene Ontology: Mol. function=DNA binding; Cellular component=nucleus; Biological process=regulation of transcription, DNA-dependent
  Homolog annotation: Hit_ID=Q0PJB9; Match level="QueryCoverage=55%, HitCoverage=89%, E-value=1e-118, Identity=79%"; Hit description=MYB transcription factor MYB131
  Pfam annotation: Domain name=Myb_DNA-binding; Domain location=76-121; Score=60.2; E_value=6.9e-15; Accession=PF00249.21; Description=Myb -like DNA-binding domain
MEMQGDYEAWLHDLVIGYLLKEQWILDMDMTLINDQIESTRSTIFGSASNIHSNAEKQAENVAPKVRKPYTITKQREKWTEEEHQKFLEALKLYGRGWRQIEEHIGTKTAVQIRSHAQKFFSKVVRESEVSDEGSIQPINIPPPRPKRKPLHPYPRKSVNSFRGPTIPNETEISPSTNLLVAEKDTPSPTSVLSTVGSEAFGSQFSEQTNRCLSPNSCTTDIHSVSLSPVEKENDCMTSKESEEEEKASPASRPLSTVSNPKMCMKPEFSSKEIEDATDMPQTTSIKLFGRTVSMVGNQKSLKIDDDGKPITVKSDEVDDVENEKLGQSGESKQVDTQLSLGVVSGNWPITPDADGANVTSIEPPKENLCFSESAPDAFFPQWSLSQGLPPFYLRPCNQVLNPLPLRPSSLKVRTREEESCCTGSNTESVCDMENQGKNSDAVDSKFQKYHEEGAAPQKKPARGFVPYKRCLAERDGHSFIVAMEEREGQRARVCS

SEQ ID NO: 197702 - protein, 116 aa, Glycine max
  Coding DNA Sequence Number=SeqID_80924
  Subcellular localization annotation: CTP_CleavageSite=9; ConfidenceScore=5.70e-01
MANNVVFVVPKVAPGSLPSLPITNNALYLHLNFCQTKNRTASFPSSSSILRSKASCSVLACLPPASSESSTSSSTAKPSFPSPPTKLYVSEEVNVMVGTEKKMASVSSLLTSYYLF

SEQ ID NO: 197703 - protein, 129 aa, Glycine max
  Coding DNA Sequence Number=SeqID_80925
MFGFSLAELRCSTPVTTQDERSFYIMIKNAKGTKRRGKRVFLLSFLDPSLPRLASGSSGPPNYFSLKEPARLCEPCTSGVSLQLAWASYHGPKCPFFSINRNEGELRKGFQGSEVERIERREKKEEERR

SEQ ID NO: 197704 - protein, 78 aa, Glycine max
  Coding DNA Sequence Number=SeqID_80926
  Homolog annotation: Hit_ID=Q69VQ7; Match level="QueryCoverage=34%, HitCoverage=8%, E-value=2e-08, Identity=96%"; Hit description =Putative THO complex 3
MNSVEWNPKYNLLAYAGDDKNKHQADEEQGAAFTDMNSNIIVLLLFTPLSHQNGLVIDDIKGQQHKWYFGMLSLKCSR

SEQ ID NO: 197705 - protein, 232 aa, Glycine max
  Coding DNA Sequence Number=SeqID_80927
MGETKDTHIVEIPVDQEHNHHKNVLCSMTSNMIEAIEDHPLTEISESPGHLLLLKLWQREEELFSKRIAHKETRMDTIKAELFQLSSFFFIFHAFFLTLLFTSWAKAQQQAHHSVCHKWWLPSMVSLCTSFVFVVLVQMKVHRYWKVWGHLQRERNDGRAVTRCIQELRMKGASFDLSKEPNSSSSGKRMKSSSVEIKWRPLTWCSKNLLTISLVCFSGLVFPASKLVLCGL

SEQ ID NO: 197706 - protein, 94 aa, Glycine max
  Coding DNA Sequence Number=SeqID_80928
MDQAQHQAFRKAYGKIWDLAMIEVFVEAIASLTQYYDQLLRCFRRKEAVSVFQILPFHGKSSKSGQDLGTRVRLSETKQEWGGRDTKAELGGKG

SEQ ID NO: 197707 - protein, 275 aa, Glycine max
  Coding DNA Sequence Number=SeqID_80929
  Gene Ontology: Mol. function=protein transporter activity; Cellular component=integral to membrane; Biological process=protein transport
  Homolog annotation: Hit_ID=Q9LIH2; Match level="QueryCoverage=87%, HitCoverage=90%, E-value=2e-37, Identity=60%"; Hit description =Arabidopsis thaliana genomic DNA, chromosome 3, P1 clone:MFD22
  Subcellular localization annotation: CTP_CleavageSite=41; ConfidenceScore=5.02e-01
MKKSSGSAADKKRVRRSSAPDPTSDAPPRKQVVKKDVFQVFAEKVRDHKELVSRWAVLQETRVEYFRGKDFVSFLKNHPELKDVLESDRNLETEEIANILLAKNLLVRCDRVVKTVRPGKKKLSTWPAHLEIFPRIWFFPNILAEEATLRELFRFWPKKDEEEKPKWTTRLFYAGVAVLFILLLRHHAPDEAARARQKRVSNIIDDVLEWSPTLALSGMMDKQQNVANATGSADASKNGPEDAAPADGDDAKDFMEQDNNTEEVINDVDDDKHHD

SEQ ID NO: 197708 - protein, 159 aa, Glycine max
  Coding DNA Sequence Number=SeqID_80930
  Gene Ontology: Mol. function=transcription factor activity; Cellular component=nucleus; Biological process=regulation of transcription, DNA-dependent
  Homolog annotation: Hit_ID=Q945M9; Match level="QueryCoverage=78%, HitCoverage=29%, E-value=2e-15, Identity=44%"; Hit description =Nuclear transcription factor Y subunit A-9
  Pfam annotation: Domain name=CBFB_NFYA; Domain location=5-54; Score =27.4; E_value=5.1e-05; Accession=PF02045.6; Description=CCAAT -binding transcription factor (CBF-BNF-YA) subunit B
MADLISFLLIFSVLLNVLGSSIGLYADIWCTQPYLHESRHQHAMRRARGTGGRFAKKTDGEGSNHLGKEKDNGTDSVQSISSSGSEPLHSDSAETWNSPNMQQDARASKVHNSRFEAPSYQNGSGSYHNHNGLQSSVYHSSSGERVEERDCSGQQLNHN

SEQ ID NO: 197709 - protein, 67 aa, Glycine max
  Coding DNA Sequence Number=SeqID_80931
HKGESGRASTSKPRANREITALSTAAFAHLLGQRAEWPGHRIPEQPQAYLGKRALEAEKRSSLCIEA

SEQ ID NO: 197710 - protein, 118 aa, Glycine max
  Coding DNA Sequence Number=SeqID_80932
  Gene Ontology: Mol. function=translation elongation factor activity; Cellular component=cytoplasm; Biological process=translational elongation
  Homolog annotation: Hit_ID=P0A6N4; Match level="QueryCoverage=69%, HitCoverage=44%, E-value=5e-40, Identity=96%"; Hit description =Elongation factor P
  Pfam annotation: Domain name=EFP; Domain location=1-31; Score=18.7; E_ value=4.4e-05; Accession=PF01132.10; Description=Elongation factor P (EF-P)
  Pfam annotation: Domain name=Elong-fact-P_C; Domain location=39-89; Score=79.2; E_value=1.2e-20; Accession=PF09285.1; Description =Elongation factor P, C-terminal
  Pfam annotation: Domain name=Entericidin; Domain location=87-114; Score=14.1; E_value=0.002; Accession=PF08085.2; Description =Entericidin EcnAB family
  Pfam module annotation: Pfam domain module=EFP::Elong-fact-P _C::Entericidin; Domain location=1-31::39-89::87-114
LSADAKAIGDNAKWLLDQAECIVTLWNGQPIAVTPPNFVELEIVETDPGLKGDTAGTGGKPATLSTGAVVKVPLFVQTGEVIKAGMMKRTVKILLLLALSADISEGGSAISGAATKAQ

SEQ ID NO: 197711 - protein, 115 aa, Glycine max
  Coding DNA Sequence Number=SeqID_80933
  Gene Ontology: Cellular component=integral to membrane
  Homolog annotation: Hit_ID=P37147; Match level="QueryCoverage=91%, HitCoverage=74%, E-value=7e-17, Identity=52%"; Hit description =Protein fxsA
  Pfam annotation: Domain name=FxsA; Domain location=15-112; Score =12.5; E_value=4.1e-06; Accession=PF04186.3; Description=FxsA cytoplasmic membrane protein
MAPATQEMPVRWIPFIAFFLYVYIEISIFIQVAHVLGVLLTLILVIFTSVIGMSLVPEDGRRRKPGCGDDQKRIADYCWSAADPAGVLHRLPRPSAATAAGAKAPDHEAAAASAL

SEQ ID NO: 197712 - protein, 300 aa, Glycine max
  Coding DNA Sequence Number=SeqID_80934
  Gene Ontology: Mol. function=amino acid transporter activity; Cellular component=integral to membrane; Biological process=amino acid transport
  Homolog annotation: Hit_ID=P39277; Match level="QueryCoverage=86%, HitCoverage=62%, E-value=1e-101, Identity=72%"; Hit description =Inner membrane protein yjeH
HDEQLLLAELGTLAIVWWVGSRGAKSSANLQTLVAVLIVALVAAIWWAGDITVKEIPFPAVTDVNHSQLFAALSVMFWCFVGLEAFAHLASEFKQPERDFPRALMIGLLLAGTVYWACTVLVLHFNAFGADLAAAASLPGIVVELFGVKALWIACVIGYLACFASLNIYIQSFARLVWSQAREKPRSRLARLSKRQLPLNALNAVLGCCVVSTLCIYALKINLDALIVYANGIFIMIYLLCMLAGCRLLSGRYKALAAVGGPVSEAPPGNKINDRLCDLNGRVVHPYADTPLQRYPLARY

SEQ ID NO: 197713 - protein, 33 aa, Glycine max
  Coding DNA Sequence Number=SeqID_80935
  Gene Ontology: Mol. function=4 iron, 4 sulfur cluster binding; Biological process=electron transport
  Homolog annotation: Hit_ID=P46797; Match level="QueryCoverage=100%, HitCoverage=55%, E-value=1e-09, Identity=84%"; Hit description =Ferredoxin
  Pfam annotation: Domain name=Fer4; Domain location=3-26; Score=22.2; E_value=0.00011; Accession=PF00037.17; Description=4Fe-4S binding domain
MKVRVDEATCIGCGVCENLCPDVFKLGDDMKAK

SEQ ID NO: 197714 - protein, 188 aa, Glycine max
  Coding DNA Sequence Number=SeqID_80936
  Gene Ontology: Mol. function=structural constituent of ribosome; Cellular component=ribonucleoprotein complex; Biological process =ribosome biogenesis and assembly
  Homolog annotation: Hit_ID=P29394; Match level="QueryCoverage=95%, HitCoverage=100%, E-value=8e-48, Identity=54%"; Hit description=50S ribosomal protein L10
  Pfam annotation: Domain name=Ribosomal_L10; Domain location=9-113; Score=80.3; E_value=5.9e-21; Accession=PF00466.10; Description =Ribosomal protein L10
MQIGGEDVLRRPEKEQLVQELTSEFQNSSLVLFTDFKGLTVAQMTNLRRALREKLGSGARLTVVKNTLLKMALKNSGYDVDSHESSFFGPTAVLYVTEGDPVEAIKVFYNFVKENKGTPVCKGLFLERKFFAGEQLEDLSKLPSRDQLIAMVVGGIQAPIRGLVNSLAGVLRSVLYALNAIKEQKEKQ

SEQ ID NO: 197715 - protein, 352 aa, Glycine max
  Coding DNA Sequence Number=SeqID_80937
  Homolog annotation: Hit_ID=Q1RTB4; Match level="QueryCoverage=73%, HitCoverage=64%, E-value=2e-17, Identity=26%"; Hit description=IMP dehydrogenase/GMP reductase
MANQEDWVPFMDVLALLIFGVVLFPNVDGLVDLAAIDAFLAYHHSKESPVVAVLADLFDTFDRSHRSCAEKRGIDWDQLLTGIGGRTISWFPRWKEGREGVLFSCGGYPNIPLIGTRGCINYNPALAIRQLRYPMRGASIEESLSPFLESPLRKDKEIRGIRNGIIGGYHEWLKVRTRGLDWLSKLKIIDKESFEALEEDEEVRALKTELGKARLAKEKFKLVATDVRKECVGLQEENTANAKALQQETKRARKEEHGRDKFRGALWGSNSELKLRREERDQSRAHNMVLKEESAACSRSKRSLSQRLCETETNMLAIISKYQEELNLATAHEHKVADEYAQVYAEKEARGR

SEQ ID NO: 197716 - protein, 59 aa, Glycine max
  Coding DNA Sequence Number=SeqID_80938
IKWARLVKCRIYELAEPRHTLGEPSAKRTEESGRRMSCTKALSECQLAKRTAFNPLAKQ

SEQ ID NO: 197717 - protein, 153 aa, Glycine max
  Coding DNA Sequence Number=SeqID_80939
  Gene Ontology: Mol. function=protein serine/threonine kinase activity; Biological process=protein amino acid phosphorylation
  Homolog annotation: Hit_ID=Q9LY50; Match level="QueryCoverage=52%, HitCoverage=10%, E-value=2e-16, Identity=48%"; Hit description =Receptor kinase-like protein
  Subcellular localization annotation: CTP_CleavageSite=49; ConfidenceScore=5.78e-01
MKNNKSPFSAATFTLFNATLLILSSLSPTHALGSAATLAATSSAVCGVVASEPTRRIACYRHGEVVAVAPNVSFSAISGGRSYFCGLRSGNYSLLCWDTLSGFQSKRLYNNGTVLLEKLALGDSQDTPPRLIRLTEKIVTRTLLELQDTKLNN

SEQ ID NO: 197718 - protein, 82 aa, Glycine max
  Coding DNA Sequence Number=SeqID_80940
MRRKTRMSTYERMKLPVCVGGFHVVMQYATRVANLSGNVWYIWPTFVIRRICMNEGRLNFTLFTYAILDQLARKPEFSLARK

SEQ ID NO: 197719 - protein, 85 aa, Glycine max
  Coding DNA Sequence Number=SeqID_80941
MQFWSFYDAILPRKGPVTRVMSKRLQEDWARAAEESPRHHNGNPHSHYNDVHIGKLSTKVDKIDIITINKIHEFVVQGRGLVVKL

SEQ ID NO: 197720 - protein, 274 aa, Glycine max
  Coding DNA Sequence Number=SeqID_80942
  Homolog annotation: Hit_ID=Q9ZP87; Match level="QueryCoverage=45%, HitCoverage=41%, E-value=7e-38, Identity=58%"; Hit description =Epoxide hydrolase
MIAIAKAGYWAIAFDFRGYGLSQHPAEPQKANLLDLVDDVVGLLASLSITKGHHFEIRSRQCDRGSVKGSSRCGVPTEKNGNLWWLLVAVGDGEEAWHIGNGFGRKKEKEMAFFQSYLNYKAQKAQVTNALRNGNVVHTADVFSKIPMDFGAFPGYIVTSLHPDKVDSVIMLGVPFMLPGPSAIENLPKGSYVIKWQAGRAKTDFVRFDVKSVIRNIYTLFSGSEIPIAGDNQEIMDLYDPTTPLPPWFSEEDLTTYASLYEKSGFRFALQVPY

SEQ ID NO: 197721 - protein, 81 aa, Glycine max
  Coding DNA Sequence Number=SeqID_80943
MDIERDKQTQSTKQPQHMEINKNLKNEVPEEVDLMESRLEIAIGDYSETKVAREGTKTKKKMQTWIEPLSHKGEEEEAKQP

SEQ ID NO: 197722 - protein, 716 aa, Glycine max
  Coding DNA Sequence Number=SeqID_80944
  Gene Ontology: Mol. function=zinc ion binding; Cellular component =intracellular
MMFHSQGVSRHCSLLAVLSGKSRDIKQKQKQGNASEDQFPYPFPELSSSGRLEVKVLIEPTADELGLALEQLQPDFVYLQGQQLEDRGEIGPLGWEDFDLSVPEALCGLFSSKLPNTVYLETPKGEKLAEALRKHTANLNSIPTNYVYSHLSIVCKVMYRVPIPAPPESIANLGVPYTIYWKNDFSKYAASHFRHSLFSVAQSTSSHTWDAFQLALASFRLYCIHNNVLPSNCHKGAGKLGPQILGVPPNIDVSPCVADMKEEEEDSPETISAVKIYDDDVNMRFLICGVPCTLDACLLGSLEDGLNALLFAEIRGCKLHNRTSATPPPLQAGTFSRGVVTMRCDISTCSSAHISLLVSGSADTCFNDQAWLLENHIKKELIEKSQLVQAFPNHEQSKAPSSEPRRSASVACGSSVFEVCMQVPAWASQVLRQLAPNLSYRSLVMLGIASIQGLPVASFNKDDAERLLFFCTRQEKENCPNDHVFSGIPSWLKPPSTSRKRSEPCSSSKSINDSGRGVEAIGSHRQKFNLASMRPIPHSNRHKILPFSGLSEGTRYDGDHGKSNLPLAPIKHNVSGPTSVTNRKSVSNSFQAHQIISLNPLPMKKHGCDRAPIRACSEEEFLRDVMQFLILRGHNRLIPPGGLAEFPDAILNAKRLDLFNLYREVGDLYTYCILHSSVKRMNSNPFLIRHLALFVEMDAPNVVHFAHMKHSVVYLS

SEQ ID NO: 197723 - protein, 92 aa, Glycine max
  Coding DNA Sequence Number=SeqID_80945
RLYKGSTTVHNIPLRHDQVKVGVEEVTNADAHIHVPTKEVKLVEQALNTFLAWPTHLVKHLSEQGAVGPVKPIDRPDHDVDDPLYLMTLTIP

SEQ ID NO: 197724 - protein, 441 aa, Glycine max
  Coding DNA Sequence Number=SeqID_80946
  Gene Ontology: Mol. function=metal ion binding; Cellular component =integral to membrane; Biological process=protein modification process
  Homolog annotation: Hit_ID=Q6ERQ9; Match level="QueryCoverage=42%, HitCoverage=47%, E-value=4e-55, Identity=47%"; Hit description =Putative ubiquitin conjugating enzyme 7 interacting protein 4
  Pfam annotation: Domain name=IBR; Domain location=196-259; Score =41.3; E_value=3.4e-09; Accession=PF01485.11; Description=IBR domain
  Pfam annotation: Domain name=zf-C3HC4; Domain location=128-177; Score= 9.3; E_value=0.017; Accession=PF00097.15; Description=Zinc finger, C3HC4 type (RING finger)
  Pfam module annotation: Pfam domain module=IBR::zf-C3HC4; Domain location=196-259::128-177
  Subcellular localization annotation: CTP_CleavageSite=57; ConfidenceScore=5.55e-01
MLNPEPPPPPPPMMVPPATPMNRETTSLRKKNRLRTRTRIPPFDVDSSFFTTPISLQGTTKSNAISVEQYDGVSASASSPVHVINLSDTEDDDEVRILNFTPINTSFGKRSKKSSSKGECSNSASFVCEICTETKTARDSFSIIGCHHVYCNSCVAQYVESKLEENIVSIPCPVPGCRGLLEADDCREILAPRVFDRWGKALCEAVIAAEEKFYCPFADCSVMLIRGIEENNIREAECPNCRRLFCAQCRVPWHDNMPCEDFQKLNADERDKEDIMLMNLANQMQWKRCPRCRFYVAKSDGCMYMKCRTIHLLSMTNLRSKTCLGKDAEAAAFADPLSKGSQCLLNTHWSMRLMQPQMQTQLQRVKKPLQRGHTCVCGPQFKTMLNSSRLQCLLALQSSMAHSSSYNSHHPHNLPKCGNAFCYNCGAPNLTSSHSCSYCFR

SEQ ID NO: 197725 - protein, 685 aa, Glycine max
  Coding DNA Sequence Number=SeqID_80947
  Gene Ontology: Mol. function=nucleic acid binding; Cellular component= intracellular; Biological process=DNA integration
  Homolog annotation: Hit_ID=Q1S6N9; Match level="QueryCoverage=99%, HitCoverage=92%, E-value=1e-179, Identity=51%"; Hit description =Integrase, catalytic region; Zinc finger, CCHC-type; Peptidase aspartic, catalytic
  Pfam annotation: Domain name=rve; Domain location=347-497; Score =66.9; E_value=6.5e-17; Accession=PF00665.16; Description=Integrase core domain
MTMKTAHKIWNFLKEEYEGSEKIKGMQALNLIRELEMQRVKDSETIKDYADKLLGIANKIRLLGTEIPDSRIVQKILVTIPEKYEATLTSLENSKDLSTITLAELLTALQAPEQRRLMRQEGTTEGALVAKSLDKKKKGKSGSFNHKNGSKSSHDFPSCPFGHVEKICKSSQKQENVQAAVEEVDEEELFVVSCFVTARSTESWLIDSGCTNHMTYDQELFKDLDATYNTNIRIGNGEKIAVKGKGTIVIEGCTGLKLIPDVLYIPEINQNLLSVGQLLEKGYKVLFEDKSCMIKDSDNKELFRVQMKGKSFALNLIDEEQLVVHKVEDNTLVWHKRMGHFHHGALLYLRKNDLVQGLPELEDKSPICAACQYGKQTRLSFPKGKSWRATSKLQLVHTDVEGPQKTPSLNGKYTSDKFSKFCEDARIKHQLTTPYTPQQNGVVERKNRTILEMARCLLHDKDLPKKFWAKAASTSIFLLNRLPTKALSKSTPFEAWYGFKPKLMNLKVFGCLCFSYIPQVKRDKLDKKAEAEIFVGYSSTSKAYRIFLPQSNKVIVNKDVLFFEEEKWSKESEKLQVQEESEEDVDDQPVRGTRSLSDIYQRCNVAIMEPVDYNEAAISISKNPVFHGKTKHFKIKLYFLREVQKQGDVQLLYCKTENQLADFLTKSLPQARFEYLRQKLGVCCH

SEQ ID NO: 197726 - protein, 231 aa, Glycine max
  Coding DNA Sequence Number=SeqID_80948
  Gene Ontology: Mol. function=nucleic acid binding; Cellular component= intracellular; Biological process=DNA integration
MPGTPQQNGVAERWNHTLMDMVRSMLNYSIVPLSLWMHTLKYAAYVLNKDPVKVFNSHKKKLDARTISGFFIGYPEKPKGYIFYCLNHSMRIIESGNTWYIENGQFNESEKSQKVDIIKTHDPISFKQAMKSDISEKWLNPMKEELKSMDDNKVLDLVELPEGSKQVGCKWVFKTQCDSKDNIERYKARLVAKGFTKKDGIDYKETFSPVFNKDSLRIVLALVAHYDLELH

SEQ ID NO: 197727 - protein, 149 aa, Glycine max
  Coding DNA Sequence Number=SeqID_80949
  Gene Ontology: Mol. function=nucleic acid binding; Biological process= DNA integration
MKHIRCALVVGSLINPGTEHWKAAKKVLRNLQGTKDYILTYRRSDHLEVIDYSDLDYAFAWRSGIMESAKQSMIATSTMEVEFVACFVATIQALWLQNFTLGFGIVDNIVRPLRIYYVNFTVVFFSKNDKYSKGAKHMDLKYLSVKEEV

SEQ ID NO: 197728 - protein, 376 aa, Glycine max
  Coding DNA Sequence Number=SeqID_80950
  Gene Ontology: Mol. function=nucleotide binding; Cellular component =extracellular space; Biological process=cell-cell signaling
  Homolog annotation: Hit_ID=Q2RAL9; Match level="QueryCoverage=87%, HitCoverage=56%, E-value=1e-102, Identity=61%"; Hit description =Expressed protein
  Pfam annotation: Domain name=RED_N; Domain location=6-236; Score =329.7; E_value=5.2e-96; Accession=PF07808.3; Description=RED-like protein N-terminal region
MTASNKKNPKEKPIRRKEEKPEEPEVPKYRDRAKERREDQNPDYEQTELGFHAVAPPGTVDIRSSDAHKLSIEKSKYLGGDVEHTHLVKGLDYALLNKVRSEIDKKPEAGDDVEGKSRSAMEDQQVSIRTATAKSVYQWIVKPQTISKTNEMFLPGRMTFIYNMGTEFFSPPYRLAIEGGYHHDIPTTLHRSKADCPVPEEMVTVNVDGSVLDRIAKIMSYLRLGSSGKILKKKRKEKDAKGKILAVGNGFDKEDKPSKVEGGAKNQTEKEIILPPPPPIKKNPLHSIEKQGPAVARAEDDDIFVGEGVDYDIPGKDLSQSPVSEDMEESPRNKEKPSYFTEPTYGPVQPSMVPQGWQETVNMIRKRFLTPVSSLS

SEQ ID NO: 197729 - protein, 60 aa, Glycine max
  Coding DNA Sequence Number=SeqID_80951
MVVNVIDRESGFNVVGGGARRFGVGGAVFGPRFLAEEASSEKEMKRGGGVEKGNHMRGKG

SEQ ID NO: 197730 - protein, 117 aa, Glycine max
  Coding DNA Sequence Number=SeqID_80952
MATNDNDANSVNQGKGPHEHESTMSRMLAMGASEMRNPTNVASPSRQKVDDHSIIIALQREMDTLKEKNAQEMNEILIQRSDVVPDINQVNNTRELLTQFGATSPTSGGYQAREEIH

SEQ ID NO: 197731 - protein, 60 aa, Glycine max
  Coding DNA Sequence Number=SeqID_80953
MFVFNSALKGLDNTQQSKSKSPARWIVVKYFTDPRPLEPERLKTLRNQWAKYYLKVKNKT

SEQ ID NO: 197732 - protein, 61 aa, Glycine max
  Coding DNA Sequence Number=SeqID_80954
MACNLCLTVSRYFTPIVRPTWAFRGVPTEGGAFWWKQQLARASLAATTSLFSPINRVLRAE

SEQ ID NO: 197733 - protein, 72 aa, Glycine max; identical to SEQ ID NO: 124110
  Coding DNA Sequence Number=SeqID_80955

SEQ ID NO: 197734 - protein, 216 aa, Glycine max
  Coding DNA Sequence Number=SeqID_80956
  Gene Ontology: Mol. function=RNA-directed DNA polymerase activity; Cellular component=intracellular; Biological process=RNA-dependent DNA replication
MDNIFINQLGRNLEVYVDDMVLKSTNTTSQAKDLAEIFPEIRKHNMRLNPKKCAFDVQGGKFLGFMLTHRGIKANPEKCVIIIETRIPNTLKKVQRLADRSVVPSKFLPREANTTKPIFKLLEKQGGTKWNEDCEANFQKLKEFLASPLILTRPLRPYFTSHQIVVQTDHSIRKLYLDGSPNTKGIRAGVILESPNGIILVEATNNQAEYETLLAG

SEQ ID NO: 197735 - protein, 149 aa, Glycine max
  Coding DNA Sequence Number=SeqID_80957
MRGIYVPYDVDAIDAYLQAVVQPEEDKDEETHNGVEIPHLIIQSHLRSLPRVWMTFYFTNISPTLHVSDLHLDNAYTIFSILDEVPINVDPYFIPPYKSICSPISWNYIVTNYGVDIHNTDPNMEEVAREKEEMKQQQQAQQAPMSYEA

SEQ ID NO: 197736 - protein, 64 aa, Glycine max
  Coding DNA Sequence Number=SeqID_80958
MTMTEDSTKPLQEEVECLNKESTLFKPNATKVEEKLKSDLDEIEAEILKTHEVDQIAKLSMVYT

SEQ ID NO: 197737 - protein, 96 aa, Glycine max
  Coding DNA Sequence Number=SeqID_80959
MAPPDSIPSVEQFNETVPQHVEDESSEATIHEPFDIGEEAEETQVRQVAVATPERSIEATSEPSPPMVNLPSPQPAANPSTPLLQIPEDPTTPVLA

SEQ ID NO: 197738 - protein, 79 aa, Glycine max
  Coding DNA Sequence Number=SeqID_80960
DKQVTEGPTKPVAMLNPDIDPLYLMTLTIPQIFLKPLPVSWDASVFWVYNDNFSLYIKHEDLSEIVHGGQFQSIFVIQL

SEQ ID NO: 197739 - protein, 69 aa, Glycine max
  Coding DNA Sequence Number=SeqID_80961
MELNIRLSSFEIAKKLQDKLRERDARIEEIGKSLSEKQDSVSSLEKDLSNCRLELAEREKRINDILHNE

SEQ ID NO: 197740 - protein, 71 aa, Glycine max
  Coding DNA Sequence Number=SeqID_80962
MAWRLARGLGRRGTSRGTSRGSRRVKRKKDHKDRHVVVKKYESFVKSKRIFWKQGTDAKSLFSGMNRDKDG

SEQ ID NO: 197741 - protein, 68 aa, Glycine max
  Coding DNA Sequence Number=SeqID_80963
GQDHLELPSGVETKLEQQKPIKGRMQVGLGSRPTDRCPFPALNKQRTSLQDSPVSFAFAVSFTIVCFK

SEQ ID NO: 197742 - protein, 70 aa, Glycine max
  Coding DNA Sequence Number=SeqID_80964
MGVQIAPRPIWALQKIPPEGGCFWRKQPCSPGKSKPEALPKRFRNVFREEFRKGFNRSSTFFIRSSIFNG

SEQ ID NO: 197743 - protein, 213 aa, Glycine max
  Coding DNA Sequence Number=SeqID_80965
  Gene Ontology: Mol. function=GTP diphosphokinase activity; Biological process=guanosine tetraphosphate metabolic process
  Homolog annotation: Hit_ID=Q0XDA1; Match level="QueryCoverage=62%, HitCoverage=17%, E-value=4e-43, Identity=64%"; Hit description =RelA/SpoT family protein precursor
RARHAAAGRRAAGRRFFADGRGPGQAGGRHQPGPHALRGFAGPQDRAGLRPVAAAAGPGPGAMKKPRRSGARGLHLLVVVHRDHEAQVRGAHGGLVGHVHAQDVHLGAGQLGCHAGEHALAVVDGDDDAGLEKARGIDVICPFHDDEAVAVLFLQALCDLALRVVHDQAFAAAQIAHDGVARHGPAALRVVDGALVGAVQQHGALEGPVAGIE

SEQ ID NO: 197744 - protein, 239 aa, Glycine max
  Coding DNA Sequence Number=SeqID_80966
  Gene Ontology: Mol. function=sequence-specific DNA binding; Cellular component=intracellular; Biological process=regulation of transcription, DNA-dependent
  Homolog annotation: Hit_ID=Q399T6; Match level="QueryCoverage=93%, HitCoverage=68%, E-value=3e-59, Identity=54%"; Hit description =Transcriptional regulator, AraC family
  Pfam annotation: Domain name=HTH_AraC; Domain location=125-171; Score= 26.6; E_value=8.8e-05; Accession=PF00165.13; Description=Bacterial regulatory helix-turn-helix proteins, araC family
  Pfam annotation: Domain name=HTH_AraC; Domain location=177-221; Score= 35.3; E_value=2.1e-07; Accession=PF00165.13; Description=Bacterial regulatory helix-turn-helix proteins, araC family
  Pfam annotation: Domain name=TetR_N; Domain location=123-168; Score =5.1; E_value=0.056; Accession=PF00440.13; Description=Bacterial regulatory proteins, tetR family
  Pfam module annotation: Pfam domain module=HTH_AraC::HTH_AraC::TetR _N; Domain location=125-171::177-221::123-168
MTSEQPPAADALDSMPEMLAPGEVWQHDRQQPAEVRTLIGYCQFSAPDAGLIVSLLPQFIHVHGASRLTTRVQLVRDECHAQRPARQMVMERLLELLLIEALRAMPAANASPGVMRGLADERLAGAIRAIHARPAHGWTVPQLAKHAALSRSAFFVRFRDAVGMAPMAYLLTWRMALAKNLLRSSRLSVADVAERVGYRSASAFSIAFTRFTGQTPTGFAGAERRSGTAEAEPAIAQLS

SEQ ID NO: 197745 - protein, 120 aa, Glycine max
  Coding DNA Sequence Number=SeqID_80967
MTLLLSNILPSDRNANLPPAKVSVGLCRPDMGIAPTRHPVDPEKSNRALGFPALVTGLYQSYRVPVPPRQGYVIIGIAPARHPVDPKKPNRVLELSSSNYGSLSVLQSTCNLQQGHQAPY

SEQ ID NO: 197746 - protein, 92 aa, Glycine max
  Coding DNA Sequence Number=SeqID_80968
MKQLARLGEPEARLGELGSRKLNEKNFLPPPFGIFCIPDLNIELYFILCGNWCRTTQFSQQESMNDSPLTKLGYNTSDEHFSPIYESYGQKA

SEQ ID NO: 197747 - protein, 327 aa, Glycine max
  Coding DNA Sequence Number=SeqID_80969
  Gene Ontology: Mol. function=signal transducer activity; Cellular component=membrane; Biological process=signal transduction
  Homolog annotation: Hit_ID=Q8D1D8; Match level="QueryCoverage=29%, HitCoverage=25%, E-value=2e-44, Identity=92%"; Hit description =Fructose-bisphosphatase
  Pfam annotation: Domain name=MCPsignal; Domain location=30-239; Score= 116.2; E_value=9.5e-32; Accession=PF00015.11; Description=Methyl -accepting chemotaxis protein (MCP) signaling domain
MSEVRATATSLSVALSEMMQGNQQLDAHAGTQAESLARTAASMRDLAANVHDNAARAQQARQLTDQARQTVDAGSAVVAGVATMMGEIQQESKKISEIIGLIDSIAFQTNILALNAAVEAARAGEQGPRFCGSGRAQSAKEIKGLIEASQNRVQEGEQMVESAAQTMSGITGEVGRVTALMREISAATREQSSGGAAECGTGGRVGGGDALAGRSGSAAGAEHGGVQANALLVRVFGDEAFRVFYHRLGADEEWRALVQFHRRDVQNAVFAVAGLTAGLFGQERHRVAFVQQAQLALRVAGGAWVDVDAAFQQVAVEVRHQRTDVAR

SEQ ID NO: 197748 - protein, 289 aa, Glycine max
  Coding DNA Sequence Number=SeqID_80970
  Gene Ontology: Mol. function=transition metal ion binding; Cellular component=nucleus; Biological process=proteolysis
  Pfam annotation: Domain name=Transposase_21; Domain location=159-289; Score=139.7; E_value=8.1e-39; Accession=PF02992.5; Description =Transposase family tnp2
MGDRLEDMIRDLGQESFQQAHAPMYDTLQTDSKKPLYPGCNNSLTLLSVVLSLVNMKAKYGWSDKIFSSLLQVVHGMLPEKNTLPKSHYQANKILCPMGMEYQKIHACPNDCILYIREFQEMPKCPRCGVSHYKVKDDDEFSSDENSKKVPQQRCCGIFLSFKWKKIDRLYPDFSKEARNLRLGLATDGMNPYGSLSTKHSSWLVLLVIYNLPSWLCMKQKYMMLSMMIPGPRQPGNDIDVYLSPLIEDLTKLWDEGVSVFDGFRNETFDLCAMLFCTINDFPAHGNLS

SEQ ID NO: 197749 - protein, 183 aa, Glycine max
  Coding DNA Sequence Number=SeqID_80971
  Subcellular localization annotation: CTP_CleavageSite=38; ConfidenceScore=5.46e-01
MPTLPPFISPISPTKLMKSCYGGTSKTGVTYVKYTSLKGSTRMAGDTGSCGSRESRMQKDWRGGGCQGDKRADEAQTPTILINPDEGGEYWCNETWVGMLKKVMEVETLEDRITWELGYNVRTKFLGDDMVLLPGMSDDKAQLLIQSETESDDSLFYSLEKWTPKCRPNNRVVWLQLWGFLIQ

SEQ ID NO: 197750 - protein, 85 aa, Glycine max
  Coding DNA Sequence Number=SeqID_80972
MGSRWRKLKLALGLDSCVHIPRACDDSSTATTRFPGDVSPTVVSPAGDTSGYRPFTPTPSSFGLWLPKSPKEVMIKKKNQLEYMI

SEQ ID NO: 197751 - protein, 284 aa, Glycine max
  Coding DNA Sequence Number=SeqID_80973
  Homolog annotation: Hit_ID=Q47522; Match level="QueryCoverage=15%, HitCoverage=53%, E-value=8e-19, Identity=100%"; Hit description=LacZ protein
RVPFAIQAAQLLGRAIGAGLFAITPAGERGMCCKAIKLGNARVFPEFDASTISANISGQGSVIKSGDGRLTLSGDVSNQQGVEVQQGELEVSGKLHTPLNMAAGTLLSGGGVINHASLADNVTLAPDWNNAPDSWSTMRLGDLHHGRDTALVLNSAFRHDASDRLLIDGDLQQPDDAPLWLTVKPQASWIDSDRNHNGAADNNEGVSLVQVGGHQAYRYRRPRGGARYQLLFPLVRVNFELGVIMVIAVSFGKPVVPAALMNRPTRGERRFAYWALAECILAYY

SEQ ID NO: 197752 - protein, 98 aa, Glycine max
  Coding DNA Sequence Number=SeqID_80974
MKKTQGLQAPHGATSRHNHKGIDKPRIKITTRIIVLDKIRGEVALRKWMMDRDTLGYSGQRGSKNLGELASGAEDSPLQPPILGEDPGALVEDAHMDQ

SEQ ID NO: 197753 - protein, 69 aa, Glycine max
  Coding DNA Sequence Number=SeqID_80975
MKLRNFLRYQKKTFVNSFKYLCERNKVKVCLSCGIFQVSALVPSKLGMSKFIQGGEGLGEWEGEEASSA

SEQ ID NO: 197754 - protein, 211 aa, Glycine max
  Coding DNA Sequence Number=SeqID_80976
MAGMNQSNLEHGGDLLLKFNFLEIGVTGFVEDVRELNEDEDDLRGVCWSKGCSGEDEWEGANHTSTWKKYRNLACYHYLASPRARSSIRWQVEEHGHVGLNKVVRASTVDQYHDLVVSDRAKKVKGLRCRCGFHSVVVDMRNQRGDVKSRLATVVGNPFILTVVPRGEKVVAGVGKKVTVILANSTAWGKDNGQSAGLRDGALDSGQTQSP

SEQ ID NO: 197755 - protein, 277 aa, Glycine max
  Coding DNA Sequence Number=SeqID_80977
  Gene Ontology: Mol. function=3-dehydroquinate dehydratase activity; Cellular component=cytoplasm; Biological process=aromatic amino acid family biosynthetic process
  Homolog annotation: Hit_ID=Q65M66; Match level="QueryCoverage=77%, HitCoverage=85%, E-value=5e-61, Identity=59%"; Hit description=AroC
  Pfam annotation: Domain name=DHquinase_I; Domain location=23-236; Score=241.2; E_value=2.2e-69; Accession=PF01487.6; Description=Type I 3-dehydroquinase
MDTYMTTAVTVQNITFKEGETLICVPLIGKTLDELLTNAQGLVDAGADIIEWRVDHFTHVREIPQVLAALAEIRHPLKALPLLFTFRSKKEGGETEISDEAYFELNRQAALSGLVDVIDIELFNDEAQIRALVNDAHQAGVKVIMSNHDFHKTPTQEDIIYRLRRMQDLGADLPKIAVMPQTPQDVLTLLSATLTMKEKYATRPLITMSMGKSGGISRAARSQSPGACSVDSLAIVNDDNAHVIICQSGDPRHNRNAIVDANQPRHRSIFIDVAAIS

SEQ ID NO: 197756 - protein, 228 aa, Glycine max
  Coding DNA Sequence Number=SeqID_80978
  Gene Ontology: Mol. function=catalytic activity; Cellular component =integral to membrane; Biological process=metabolic process
  Homolog annotation: Hit_ID=Q8UET3; Match level="QueryCoverage=100%, HitCoverage=44%, E-value=1e-117, Identity=92%"; Hit description=Long- chain fatty acid-CoA ligase
MHENAGFTRFCPLSLSGDDEDFAFGNGLADGGRAAVDFIGRQEGGAEGLGEAIHQVDFRVRQLLAQCFYGFLRHASAGIGDVAQMRERRLCERRGRFRQDRPDRRHAGQTRDGVVAQIADDLIAQPEGGDNSGRALFHRRQQLVQAIIEAEGQEGKNAVPAGDVQIGAHDARAGQKIAVRQHHALRRASGAGGIKNCGQVFADRRRRPGGCAGAVPNLLRQQDRDVGK

SEQ ID NO: 197757 - protein, 112 aa, Glycine max
  Coding DNA Sequence Number=SeqID_80979
MLDLKCHPIPEASNEDDLDDVPVAGHEEDVNGGEKGINVDVGEERDVGGGDEEKVGNPDDEDDNDEDEWFTDFSCMRKEVEVEYEIDGYHSKELKNPISSDDEDEDVHKVYP

SEQ ID NO: 197758 - protein, 128 aa, Glycine max
  Coding DNA Sequence Number=SeqID_80980
  Gene Ontology: Mol. function=actin binding; Cellular component=actin cytoskeleton; Biological process=actin cytoskeleton organization and biogenesis
  Homolog annotation: Hit_ID=O49894; Match level="QueryCoverage=92%, HitCoverage=90%, E-value=6e-45, Identity=73%"; Hit description =Profilin
  Pfam annotation: Domain name=Profilin; Domain location=7-123; Score =191.3; E_value=2.4e-54; Accession=PF00235.9; Description=Profilin
MKENVNGWQDLNGGHHLSDAAIIGHDGSVWAQSSSFPQIKSQEITDIMKDFDEPGYLAPTGLHLAGTKYMVIQGESGAVIRGKKGSGGITIKKTGQALVFGIYEEPVTPGQCNMVVERLGDYLIEQGL

SEQ ID NO: 197759 - protein, 77 aa, Glycine max
  Coding DNA Sequence Number=SeqID_80981
MKKEEENELQNPHQTINNNSNISQLKNKKVRGGHCGAQQRWSVVVPHAAEEEIGGAVCRAEVEVEGGKGKGGEKMDS

SEQ ID NO: 197760 - protein, 513 aa, Glycine max
  Coding DNA Sequence Number=SeqID_80982
  Gene Ontology: Mol. function=hydrolase activity, hydrolyzing O -glycosyl compounds; Cellular component=membrane; Biological process =carbohydrate metabolic process
  Homolog annotation: Hit_ID=Q1WAK0; Match level="QueryCoverage=84%, HitCoverage=85%, E-value=0.0, Identity=86%"; Hit description=Beta-1 ,3-glucanase
  Pfam annotation: Domain name=Glyco_hydro_17; Domain location=26-344; Score=461.1; E_value=1.4e-135; Accession=PF00332.9; Description =Glycosyl hydrolases family 17
  Pfam annotation: Domain name=X8; Domain location=365-450; Score =164.3; E_value=3.2e-46; Accession=PF07983.3; Description=X8 domain
  Pfam module annotation: Pfam domain module=Glyco_hydro_17::X8; Domain location=26-344::365-450
MPTGFSLIFAASLFLLLLDCCSGSFVGVCYGRSADDLPTPDKVAQLVQLHKIKYVRIYDSNIQVLKAFANTGIELMIGVPNSDLLSFSQFQSNADSWLKNSVLPYYPATKIAYITVGAEVTESPNNASSFVVPAMTNVLTALKKLGLHKKIKVSSTHSLGVLSRSFPPSAGAFNSSHAHFLKPMLEFLAENQSPFMIDIYPYYAYRDSRSKVSLDYALFDASSEVIDPNTGLLYTNMFDAQIDAIYFALMALNFRTIKVMVTETGWPSKGSPKETAATPDNAQTYNTNLIRHVINNTGTPAKPGEELDVYIFSLFNENRKPGLESERNWGLFYPDQTSVYSLDFTGRGAVDMTTEANITKSNGTTWCIASSKASQIDLQNAIDWACGPGNVDCTAIQPSQPCFEPDNLASHASFAFNSYYQQNGASDVACSFGGTGVKVDKDPSYDKCIYMRAGSNKTVTSNTTAMSTSSSSLNGNSSSIFTFLLHDFALLTSMLRLKCMGKDGSPYSTLTYV

SEQ ID NO: 197761 - protein, 168 aa, Glycine max
  Coding DNA Sequence Number=SeqID_80983
IKFKDYIWVKLSHGSDQRRPTPASYLFLKVGVLIVPELDASLSVERPSFDGLETLLMFGAPEMVAIKLGSSAGPFSRGVPPRSLHRKFFRSHFLRGQTFGKHEYQENGGNVACPITSECTLGLRSSLTTPQFNKNKQQFKDKSLTFLSKYMQLRAPKYINGKLESPRM

SEQ ID NO: 197762 - protein, 136 aa, Glycine max
  Coding DNA Sequence Number=SeqID_80984
  Gene Ontology: Mol. function=nucleic acid binding
  Homolog annotation: Hit_ID=Q8S8M1; Match level="QueryCoverage=56%, HitCoverage=6%, E-value=4e-22, Identity=59%"; Hit description =Putative retroelement integrase
MGFGEPLVNSSKEMKRLMRRRFVPSHYHRDVHNKVQRLTQGNKSVDEYYKEMEVSLIRTNLNEDREATMTQFLHRLNSDIRDVVKLQHYVEISSESFSDSTPPSDEEKYAEEKGVEGASFIVQRLLGSQAKDLDES

SEQ ID NO: 197763 - protein, 92 aa, Glycine max
  Coding DNA Sequence Number=SeqID_80985
MVLVKEFFFSLTYHPQSLLPNGVVSDLGKNILQIVDALLAWAIYCDLQARPSNRCAISLEIPETIEFDILKDVHEGVLVSINDILKKTPLES

SEQ ID NO: 197764 - protein, 173 aa, Glycine max
  Coding DNA Sequence Number=SeqID_80986
MKVMFKPFPSSYKNFKVRFFKVIILPNLGDNHFFDVNKKPLFPFYWQRVLRRYDDYPEDYLTDQEHHNLTLMNKLSRRLSTKPLVSIFKELKCAFSFSLSLFVYLSNVINLACFIAILKFVGMDALNFANMCREVGVTVWNASMTWPFDPLPPPRPSPRDVVPLADKKEEEKE

SEQ ID NO: 197765 - protein, 67 aa, Glycine max
  Coding DNA Sequence Number=SeqID_80987
MGGICKFEESMDGYNKLETYKGMLLDPTRNLRNRVGVGGLTTEDRMLMYLITYIMAPRSSNHAQVTK

SEQ ID NO: 197766 - protein, 112 aa, Glycine max
  Coding DNA Sequence Number=SeqID_80988
  Subcellular localization annotation: CTP_CleavageSite=35; ConfidenceScore=5.21e-01
MPPMYSYPYDLQPGYSMAGIFGSSPPSRGTPSFTQSDELSTPNAPLGGPWNVPGNIPDMDDLLGVDLRHDFSAEADQVDERANRRRRNPDRAARNWDRPCGTSSRHHRHSDD

SEQ ID NO: 197767 - protein, 53 aa, Glycine max
  Coding DNA Sequence Number=SeqID_80989
GEIVETMHFMVSPLWRRVCTFDNLLPCIEKITLLSDEEDRILEAHEDAPRSQP

SEQ ID NO: 197768 - protein, 281 aa, Glycine max
  Coding DNA Sequence Number=SeqID_80990
MEAMKEKMATMMEAMMSMKKIMEVNAATVATTSTIVEVDPIPPSSLNQIRHPISNMVGQGGKKLGSMSGPHFVQIQNKHAFPPYGLPPNYTLPNVAHTHEENGDEFVPIPIGSQKPQFDHAHVSQPMGETHEVPHHNLADFEPRLGYATKGQAVGGVPLPNTLEGPRFPPQPQPLHFVVGRVPPTVVERGKLDHIEERLKAIEGGRDYVFANMEDLCLVPDMIIPPKFKVLDFDKYKGTTCPKNHLKGYCRKMGAYAKNEKLLMHFFQESLIGAAITLWPQ

SEQ ID NO: 197769 - protein, 157 aa, Glycine max
  Coding DNA Sequence Number=SeqID_80991
  Homolog annotation: Hit_ID=Q8S8M1; Match level="QueryCoverage=22%, HitCoverage=2%, E-value=7e-07, Identity=66%"; Hit description =Putative retroelement integrase
MERQRNKDYPVDTWEKRQPRCGEDLHLHSTIGSCTTNYKGLPKEVRVWMSTSKRWRWVGFFDAYEPIYPRLVRAFFAAIMVDSSKFTLKATLKNIEILILEELLATILSVTVDNKRLYDEWFDIMDLKKSKLKSKFLEEKDDEFKSKSLTSFWRILH

SEQ ID NO: 197770 - protein, 99 aa, Glycine max
  Coding DNA Sequence Number=SeqID_80992
MSKGTNATGTKKIWVPKSHIVPIIDILVVAPRHMKGERSIFLNLNTIEGGIDAFDGIGKGKITDMGHSIVLEDQGHQHLIRHSGSRLDELGGLHNMIDD

SEQ ID NO: 197771 - protein, 81 aa, Glycine max
  Coding DNA Sequence Number=SeqID_80993
MEHPMGAKAVKRKAKEKEKSSNVVDLTENYYLAVLLTMHSSKSSLEDEVIDDLLNDEYKEHYMMLVMERLSEIVKKGIHEK

SEQ ID NO: 197772 - protein, 147 aa, Glycine max
  Coding DNA Sequence Number=SeqID_80994
  Gene Ontology: Mol. function=transferase activity
  Homolog annotation: Hit_ID=Q1T6G9; Match level="QueryCoverage=52%, HitCoverage=29%, E-value=6e-11, Identity=46%"; Hit description =Terpenoid cylases/protein prenyltransferase alpha-alpha toroid; Bacterial adhesion
MAHQQSFLKSWSHKTYGVGKHIFELQATLMKTIPRPQGHKTKLFAQHQEAIRKDVDHTFGVLQSWFMIVHGLAYGWSILLIASAKCNTHGLSTRKTLEEDELYKGSLDWDSELCMSRVSRERKRPGLEVGADLRAWDEFVSDCEILE

SEQ ID NO: 197773 - protein, 142 aa, Glycine max
  Coding DNA Sequence Number=SeqID_80995
MTSSSVTAIVYYNGTITKTQHGPTLASSEPMIVQLNNMSLDALKQVIENKISLPYGKVNPLLCVSASRNPMFFVSMLRNQILYVSASGNPMLGVMVLGNSMLYVNVSGNPLLCVRVLGNPMLYVNVFGNPLFYVNVLGNLML

SEQ ID NO: 197774 - protein, 102 aa, Glycine max
  Coding DNA Sequence Number=SeqID_80996
MASRKKKSTASRPQAQYDTRRFHSLDAWNRYTDNILGRNILLERNVQIYHTEFDEFKVELERHNLHKRLANLQDGSIDVAVVKEFYANLYTTEEQSPKQARV

SEQ ID NO: 197775 - protein, 126 aa, Glycine max
  Coding DNA Sequence Number=SeqID_80997
  Gene Ontology: Mol. function=pectinesterase activity; Cellular component=cytoplasm; Biological process=cell wall modification
  Homolog annotation: Hit_ID=Q8VYZ3; Match level="QueryCoverage=75%, HitCoverage=25%, E-value=1e-29, Identity=67%"; Hit description =Putative pectin methylesterase
MSVEAPVNSLSVIDSLIQLHFPVPPINNATQCHTKGIRPKPGNGLSTNMTRVEFSEQQFMKWVKFVGGLKHSVFRTAKNKLFPSHTLHVSKKHGKGGFSSIQAAIDSLPFINVVRVVIKVHAGVYT

SEQ ID NO: 197776 - protein, 436 aa, Glycine max
  Coding DNA Sequence Number=SeqID_80998
  Homolog annotation: Hit_ID=Q9LK76; Match level="QueryCoverage=92%, HitCoverage=92%, E-value=1e-59, Identity=39%"; Hit description =Arabidopsis thaliana genomic DNA, chromosome 3, P1 clone: MDC8
  Pfam annotation: Domain name=IQ; Domain location=113-133; Score=29.2; E_value=1.4e-05; Accession=PF00612.17; Description=IQ calmodulin -binding motif
  Pfam annotation: Domain name=IQ; Domain location=135-155; Score=18.2; E_value=0.03; Accession=PF00612.17; Description=IQ calmodulin-binding motif
  Pfam annotation: Domain name=IQ; Domain location=161-181; Score=5.5; E_value=11; Accession=PF00612.17; Description=IQ calmodulin-binding motif
  Pfam module annotation: Pfam domain module=IQ::IQ::IQ; Domain location=113-133::135-155::161-181
MGRAIRWLKGLFGIRTDRERKENSNHSDRDSRGLCHNPTTIPPNISPAEAAWLQSFYSETEKEQNKHAIAVAAATAAAADAAVAAAQAAVAVVRLTSHGNSRDTTFGGAGQERLAVVKIQTVFRGYLARKALRALKGLVKLQALVRGYLVRKQAAATLHSMQALIRAQATVRSKKSRNEAHRFQTQARRSMERFDDIKSVYIAPIQSRRLSSSFDATMNNANSVDGSPKIVEVDTGRPKSRSRRSNTSMSDFGDDPSSFQALPSPLPFAHLSIPNLRNYHNSEWGLTGEECRFSTAQSTPRFTTNSCSCGGSVVVAAPTNMSMSMTPKSVCTENNFFYGQYHDNFPNYMASTQSFKAKLRSHSAPKQRPDPAGPKKRLTLNEMMESRCSLSGTRMQRSCSQIQEAISFKNAVMSKLQKSAEIGRDTELNFSNQRRW

SEQ ID NO: 197777 - protein, 39 aa, Glycine max
  Coding DNA Sequence Number=SeqID_80999
MTLDQSWFKGNMLHLSWGTSKLRCGKEQPHIMETLDIIN

SEQ ID NO: 197778 - protein, 472 aa, Glycine max
  Coding DNA Sequence Number=SeqID_81000
  Gene Ontology: Mol. function=drug transporter activity; Cellular component=membrane; Biological process=multidrug transport
  Homolog annotation: Hit_ID=Q4PSF4; Match level="QueryCoverage=94%, HitCoverage=88%, E-value=1e-150, Identity=59%"; Hit description=MATE efflux protein-related
  Pfam annotation: Domain name=MatE; Domain location=247-410; Score =129.5; E_value=9e-36; Accession=PF01554.9; Description=MatE
  Pfam annotation: Domain name=MatE; Domain location=28-189; Score =138.6; E_value=1.7e-38; Accession=PF01554.9; Description=MatE
  Pfam module annotation: Pfam domain module=MatE::MatE; Domain location=247-410::28-189
MEGAVEKEGQHCWSIRREVKAVGELAFPIALTALIFYARSMVSMLFLGHLGELELAAGSLGMAFANITGYSVLSGLALGMEPLCSQAFGAKRVNVLSLTLHRCVMFLLLCSIPISLLWLNMSNILVDLLHQDPNITLMAHTYLLFSLPDLLTHSFLHPIRIYLRAQGVTHPVTLASLAGTLLHLPFNYLLVTRLRLGLAGVAAASAASNLSILLFLGAAVFFSGLHCSAPSRECLSGWKPLLRLAAPSCVSVCLEWWWYEIMIILCGLLVDPTATVASMGILIQITSLIYVFPSSLGFAVSTRVGNALGANRPSRAKLSAVVSVFLAAIMGFSAMFFAVGMRRRWGTMFTADEDILRITSMALPILGICELGNCPQTVGCGVVRGTARPNTAANVNLGAFYLVGMPVAVGLGFWFDVGFCGLWLGLLSAQVCCAGLMLYVIGTTDWEFEAHRAQLLTLVEDGVMDGQKQPLT

SEQ ID NO: 197779 - protein, 41 aa, Glycine max
  Coding DNA Sequence Number=SeqID_81001
MSQKARVQEIYKGMSKQQGLQSQLLATHSQLIYGLKKKNIS

SEQ ID NO: 197780 - protein, 561 aa, Glycine max
  Coding DNA Sequence Number=SeqID_81002
  Gene Ontology: Mol. function=RNA methyltransferase activity; Cellular component=endoplasmic reticulum; Biological process=RNA modification
  Homolog annotation: Hit_ID=Q5JKV8; Match level="QueryCoverage=58%, HitCoverage=66%, E-value=1e-131, Identity=69%"; Hit description =Putative tRNA/rRNA methyltransferase
  Pfam annotation: Domain name=SpoU_methylase; Domain location=307-478; Score=122.3; E_value=1.3e-33; Accession=PF00588.9; Description=SpoU rRNA Methylase family
  Pfam annotation: Domain name=SpoU_sub_bind; Domain location=205-291; Score=42.2; E_value=1.8e-09; Accession=PF08032.2; Description=RNA 2'- O ribose methyltransferase subs
  Pfam module annotation: Pfam domain module=SpoU_methylase::SpoU_sub _bind; Domain location=307-478::205-291
MGKLANPHGLMLQIARRYCSARSTEKQLPWLEVANEVKEEGKVMQKAKTTRISGSFPEGSAKKMSSKSSWEQSIERLDKSHKTEVPESKLRSAAAKFSMKGGVSATASKERKGGLVEKVGQLRSDYGKRYVKFDDNDEEGVDDEMEEEMDDPRWYNIKNKFKGMVGAKVGMERPEVRRWNKQDNWGRKTLKEASESTVPKIVGEGIYGVGPVLAALSADRREFYALYVQEGLDLSGNNRKKKDKKGFERVLKIAEKLGLSVKEASKHDLNMVADNRPHQGLVLDASQLEMVKVNELDPVSIDEGKGSLWVALDEVTDPQNLGAIIRSAYFFGASGVVLCAKNSAPLSGVVSKASAGSLELMELRYCKNMMQFLVSSAENGWRVLGGSVSSKAIALDEVVPGPPTILVLGSEGTGLRPLVERSCTQLVRIPGNIHFDSSTSELDGESSGLNSQSSGKEFLSFLAVESLNVSVAAGVLIHHLIGKKLVDSFPEEHKQIDMSERLGPNSHLEFLTVSCGYLAQSPGIRVMWLQDLVWRLLGLRTVGKGFLTVSLVNGEVSEYGG

SEQ ID NO: 197781 - protein, 491 aa, Glycine max
  Coding DNA Sequence Number=SeqID_81003
  Gene Ontology: Mol. function=transferase activity
  Homolog annotation: Hit_ID=Q946Y1; Match level="QueryCoverage=99%, HitCoverage=89%, E-value=0.0, Identity=75%"; Hit description =Ceramide glucosyltransferase
MKDCMKNGNSFSFLCHDINELEHSYQVDLPRVTVIMPLKGFGEHNLHNWRSQITSLYGGPIEFLFVVESTEDPAYHAVSRLIAEFEDHVEAKVVVAGLSTTCSQKIHNQLIVFARGILPITLVLTPWQVGVETMHKDSKYVLFLDDDVRLHPGSIGALTREMEKTPEIFIQTGYPLDLPSGSLGSYCIYEYHMPCSMGFATGGKTFFLWGGCMMAIFLQMHADDFRQDRYGVVSGLKDGGYSDDMTLAAISGAHKRLITSPPVAVFPHPLASDLNFGRYWNYLRKQTFVLESYLTNVNWVMNRALFTTHCYLSWGFVAPYFMAMIHVAAALRFYYKGFSPEEIAYTSGGLSLVTFLAICTLVELLSMWNLTRIEVQLCNMLSPEAPQLSLASYNWCLVFIAMLVDNFLYPVSAFRSHFSQSINWSGIRYYLKDGKISKIERTPRSKDMGPVFTDLGGKHLYGKKGLPTRGSFLSSLSRSLAQWHQPKKFDN

SEQ ID NO: 197782 - protein, 123 aa, Glycine max
  Coding DNA Sequence Number=SeqID_81004
  Gene Ontology: Mol. function=zinc ion binding; Biological process =cell redox homeostasis
  Homolog annotation: Hit_ID=Q1SRX9; Match level="QueryCoverage=82%, HitCoverage=95%, E-value=8e-32, Identity=65%"; Hit description=Zinc finger, RING-type
  Pfam annotation: Domain name=zf-C3HC4; Domain location=72-116; Score =37.5; E_value=4.8e-08; Accession=PF00097.15; Description=Zinc finger, C3HC4 type (RING finger)
MDNDNVNLTISESNNIAQSTMSNNFIDLDVFDLDEALAVAVVDGEPRRLFATWKTFVSNLPTVNDVTRDDVCSVCMEGFITQRNTDGENKRVPCGHVYHSNCITLWLEHCNSCPLCRCHIPLF

SEQ ID NO: 197783 - protein, 104 aa, Glycine max
  Coding DNA Sequence Number=SeqID_81005
  Gene Ontology: Mol. function=sequence-specific DNA binding; Cellular component=nucleus; Biological process=regulation of transcription, DNA-dependent
  Homolog annotation: Hit_ID=Q1T5K9; Match level="QueryCoverage=98%, HitCoverage=45%, E-value=3e-27, Identity=63%"; Hit description =Transcription factor, MADS-box
  Pfam annotation: Domain name=SRF-TF; Domain location=9-59; Score =67.0; E_value=6.1e-17; Accession=PF00319.9; Description=SRF-type transcription factor (DNA-binding and dimerisation domain)
MGHRKIEIAIVKDPNMRQVTFSKRRTGPFKKANELSILCDVEIAIVVFSIGNKPYSFGHPCVDVVATKFLQLQQAANSSNAKQIDAQGRNNPSNELGGMDRLNQ

SEQ ID NO: 197784 - protein, 264 aa, Glycine max
  Coding DNA Sequence Number=SeqID_81006
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O82468; Match level="QueryCoverage=87%, HitCoverage=61%, E-value=9e-89, Identity=67%"; Hit description =Protein phosphatase-2C
  Pfam annotation: Domain name=PP2C; Domain location=2-243; Score =179.4; E_value=9e-51; Accession=PF00481.12; Description=Protein phosphatase 2C
MVIYATVNKCLYRLFVFVVYVQQNFKVAKFCAKRMHDVIAEEWDREIGGAAEWQRRWEAVFANSFERTDNEILSDAVAPEMVGSTASVVVLSGCQIITSNCGDSRVVLCRRTQTIPLTVDQKPDRQDELLRIEGGGGKVINWNGARVFGVLAMSRAIGDRYLRPWIIPVPEITFTARTDEDECLVLASDGLWDVMTNEEVGEVARRILRRRRRSLSMEETSPAQVVAESLTEIAYGRNSKDNISIIVVDLKSKRKRQQRPPLIS

SEQ ID NO: 197785 - protein, 355 aa, Glycine max
  Coding DNA Sequence Number=SeqID_81007
  Homolog annotation: Hit_ID=Q9LVE6; Match level="QueryCoverage=94%, HitCoverage=90%, E-value=3e-95, Identity=53%"; Hit description =Similarity to senescence-associated protein
  Pfam annotation: Domain name=Senescence; Domain location=14-345; Score=512.9; E_value=3.7e-151; Accession=PF06911.3; Description =Senescence-associated protein
MAALSVGEYSGLKQEVLMQIPACKVHLMDEGEALELSQGHFMIIKTFEENVSLATIIKVGDDLQWPLTKDMPVVKLDSLHYLFSLLVKNGEPLSYGVTFSEASLGSLSLLDSFLKDHSCFSGLNLSKKNNLDWREFAPKVDDYNHFLAKAIAGGTGQIVKGIFICSNAYSNKVQKGGETILNSSTREKNGVVARESMSYKTASASKKNKINKNLKRVRKLSKMTEKLSKSVLNGVGIVSGSVMAPVVKSQSGKAFLRMLPGEVLLASLDAVNKVLDAAEAAEKQTLSATSKAASRVVSNRFGESAGEATEHVFATAGHAANTAWNVFKIRKAFTPASSATNGVLKHAAKISSFKH

SEQ ID NO: 197786 - protein, 120 aa, Glycine max
  Coding DNA Sequence Number=SeqID_81008
  Gene Ontology: Mol. function=hydrolase activity, acting on ester bonds; Biological process=lipid metabolic process
  Homolog annotation: Hit_ID=Q682P3; Match level="QueryCoverage=85%, HitCoverage=29%, E-value=7e-44, Identity=79%"; Hit description =Putative GDSL-motif lipase/hydrolase
  Subcellular localization annotation: CTP_CleavageSite=61; ConfidenceScore=5.06e-01
MVGAKVPAMIAFGDSSVDAGNNNYIATVARSNFQPYGRDFVGGKPTGRFSNGRIATDFLSQAFGIKPYVPPYLDPNHNISHFATGVSFASAATGYDNATSDVLLVVDLSNPRKISLVAKK

SEQ ID NO: 197787 - protein, 60 aa, Glycine max
  Coding DNA Sequence Number=SeqID_81009
MEVFEGGAFDLGDMGPDAEDGNERKRKGRRKYLFMLAGGIQEKGKGRKRIGKQRMKRPRR

SEQ ID NO: 197788 - protein, 205 aa, Glycine max
  Coding DNA Sequence Number=SeqID_81010
  Gene Ontology: Mol. function=hydrolase activity, acting on ester bonds; Biological process=lipid metabolic process
  Homolog annotation: Hit_ID=Q682P3; Match level="QueryCoverage=93%, HitCoverage=64%, E-value=1e-56, Identity=49%"; Hit description =Putative GDSL-motif lipase/hydrolase
  Pfam annotation: Domain name=Lipase_GDSL; Domain location=14-195; Score=29.4; E_value=6.9e-06; Accession=PF00657.12; Description=GDSL -like LipaseAcylhydrolase
MSGLHSMNIQSKSVIPLWKQLEYYKGYQKKLSVYLGESRANETVAKALHIISLGTNDFLENYFAIPGRASQYTPREYQNFLAGIAENFIYKLYGLGARKISLGGLPPMGCLPLERTTNFVGGNECVSNYNNIALEFNDNLRFQVTSMACCATGMFEMGYACSRASSFSCIDASRYVFWDSFHPTEKTNGIIAKYLVKNALAQFLH

SEQ ID NO: 197789 - protein, 80 aa, Glycine max
  Coding DNA Sequence Number=SeqID_81011
MVEVVAVPMLVPLVMTLPMIDVVKSTLHHHVLMQSHIAFVPPDLRQRQREGERVGEKKNEKESGRGKGKGWVVLAGGRES

SEQ ID NO: 197790 - protein, 302 aa, Glycine max
  Coding DNA Sequence Number=SeqID_81012
  Homolog annotation: Hit_ID=Q6ZFC1; Match level="QueryCoverage=63%, HitCoverage=76%, E-value=4e-67, Identity=65%"; Hit description =Pentatricopeptide (PPR) repeat-containing protein-like protein
  Pfam annotation: Domain name=PPR; Domain location=200-234; Score =19.3; E_value=0.014; Accession=PF01535.11; Description=PPR repeat
  Subcellular localization annotation: CTP_CleavageSite=51; ConfidenceScore=5.09e-01
MMPITCESSIVSPLLLSRVCQAKTDPTRALLLGNKFSTMAVTALPKTSCIQCTIVRSKFSHKSGGPMEKKGKKTTGKKEHHLWKSRDSAQSGQKALALVRTVYKLPNEKEAVYGALDKWTAWETEFPVIAVSKALKILRKRGHWVRVIQVAKWMLSKGQGATMGTYDTLLLAFDMDKRVDEAESLWNMIIHAHMRSVSKRLFSRMISLYDHHNMPDKIIDVFADMEELRLKPDEDTVRRVARAFRELGDEEKRKLVIKQYGLKWKYIHFNGERRFILLRSPSGALVAHQFDSLSCIPVQHSY

SEQ ID NO: 197791 - protein, 109 aa, Glycine max
  Coding DNA Sequence Number=SeqID_81013
  Homolog annotation: Hit_ID=O80783; Match level="QueryCoverage=99%, HitCoverage=94%, E-value=5e-12, Identity=39%"; Hit description =Expressed protein
  Pfam annotation: Domain name=DUF584; Domain location=1-109; Score =82.5; E_value=1.3e-21; Accession=PF04520.4; Description=Protein of unknown function, DUF584
MAEEFVESEVVFPDHRAAHDWVVELAPPPRRERENCRRRAANSMPVSIPERTGRRHWGSAEEEAEEEEMTPPHEIVKRRVAAKMAFSVCTGNGRTLKGRDLSQVRNSIL

SEQ ID NO: 197792 - protein, 328 aa, Glycine max
  Coding DNA Sequence Number=SeqID_81014
  Gene Ontology: Mol. function=identical protein binding; Cellular component=cellulose and pectin-containing cell wall; Biological process=negative regulation of enzyme activity
  Homolog annotation: Hit_ID=Q9FK76; Match level="QueryCoverage=96%, HitCoverage=50%, E-value=3e-54, Identity=35%"; Hit description =Subtilisin-like protease
GRSITPLHMGNNFYPLVLARDVEHPGLPSNNSGFCPDYPSTQQGMGEDSSLHERARRKIEKRLRSSKGWWATGVSYENALKLIQYVHSTLNPMAQILPGTTVLEAKPAPSMASFSSRGPNIVDPNILKPDITSPGVDILATWTAEEGPTGMTFNDTSAVLLKAIHPTWSTAAIRSALMTTDNTDNPLTDETGNPATPFAMGSGHLNPKRAADAGLVFDASYMDYLLYTSNLGVTQNFNITYNCPKNVYKFSAVSPKEYSITAIPNILKFNHVEQKMNLTITVTANWSQILTKHGPDKYYFGWYAWTHQHHVETDRIQIIRVVVVGPYA

SEQ ID NO: 197793 - protein, 280 aa, Glycine max
  Coding DNA Sequence Number=SeqID_81015
  Gene Ontology: Mol. function=translation initiation factor activity; Cellular component=cytoplasm; Biological process=translational initiation
  Homolog annotation: Hit_ID=Q6TEC4; Match level="QueryCoverage=93%, HitCoverage=100%, E-value=7e-95, Identity=66%"; Hit description =Eukaryotic translation initiation factor 4E
  Pfam annotation: Domain name=IF4E; Domain location=22-280; Score =375.7; E_value=6.9e-110; Accession=PF01652.9; Description=Eukaryotic initiation factor 4E
EGGGEKNGGRGKEKGVITMVVEDAQKSAITEDQNPSRVANDNNDDEDLEEGEIPDDGDDGASATSKPPSALVRNPHPLENSWTFWFDNPSAKSKQAAWGSSIRPIYTFATVEEFWSIYNNIHHPSKLGVGADFHCFKHKIEPKWEDPICANGGKWTMTFQRGKSDTSWLYTLLAMIGEQFDHGDEICGAVVNVRSRQEKIAIWTKNASNEAAQVGGSEGDLSSLFNNVVRNIEECVLGIPHLVSIGKQWKEFLDYNDTIGFIFHEDAKKLDRGAKNKYVV

SEQ ID NO: 197794 - protein, 107 aa, Glycine max
  Coding DNA Sequence Number=SeqID_81016
  Subcellular localization annotation: CTP_CleavageSite=29; ConfidenceScore=5.42e-01
MKPPSSPQVATTANHTLSPQSPGNNNTISANNKPSTTKLQQTRQIITILGEECDSNGDEVHGDGGDVEEGEGLENRDDEPVLGLRVSFSSPIPTLFSSVFPTSKMAG

SEQ ID NO: 197795 - protein, 151 aa, Glycine max
  Coding DNA Sequence Number=SeqID_81017
  Gene Ontology: Mol. function=glycine hydroxymethyltransferase activity; Cellular component=mitochondrion; Biological process=L -serine metabolic process
  Homolog annotation: Hit_ID=Q00SC2; Match level="QueryCoverage=98%, HitCoverage=27%, E-value=1e-42, Identity=57%"; Hit description=[E] KOG2467 Glycine/serine hydroxymethyltransferase
  Pfam annotation: Domain name=SHMT; Domain location=1-95; Score= -199.4; E_value=4.6e-05; Accession=PF00464.10; Description=Serine hydroxymethyltransferase
VVANCKALAQQLIEHGYKLVSGGSDNHLVLVDLRPSGLDGARVEKILDMASITLNKNSVPDDKSALVPGGIRIGTPAMTTRGLGEKEFSLIADFLHEGVQICLEAKSLVSGTKLQDFLKFVSSSEFPLGEKISELRRKVEALTTQYPIPGV

SEQ ID NO: 197796 - protein, 257 aa, Glycine max
  Coding DNA Sequence Number=SeqID_81018
  Gene Ontology: Mol. function=glycine hydroxymethyltransferase activity; Cellular component=mitochondrion; Biological process=L -serine metabolic process
  Homolog annotation: Hit_ID=Q5IWY0; Match level="QueryCoverage=59%, HitCoverage=71%, E-value=2e-61, Identity=74%"; Hit description =Plastid glycine hydroxymethyltransferase
  Pfam annotation: Domain name=SHMT; Domain location=111-257; Score =12.5; E_value=4e-17; Accession=PF00464.10; Description=Serine hydroxymethyltransferase
MACLHDHSCEDHDCSSNWPLYKHIDLSKTKMQACTMMSSLQQQPIWTKGLNFPAKGYGSNNGFVTQLRFCNIKPSKASHVEASLVAGKPSSVSFSVPEIGGDGSSFLDYGLSEADPEVRAIIDKEKDRQFKSLELIASENFTSRAVMEAVGSCLTNKYSEGLPGRRYYGGNEYIDELETLCQQRALAAFHVDGNKWGVNVQTLSGSPANFAVFTAVLKPHDRIMGLDLPHGGHLSHGFMTPKKRVSATSIYFEPMPY

SEQ ID NO: 197797 - protein, 154 aa, Glycine max
  Coding DNA Sequence Number=SeqID_81019
  Gene Ontology: Mol. function=sequence-specific DNA binding; Cellular component=nucleus; Biological process=regulation of transcription, DNA-dependent
  Homolog annotation: Hit_ID=Q1T5K9; Match level="QueryCoverage=96%, HitCoverage=87%, E-value=3e-26, Identity=40%"; Hit description =Transcription factor, MADS-box
  Pfam annotation: Domain name=SRF-TF; Domain location=9-45; Score=6.4; E_value=0.079; Accession=PF00319.9; Description=SRF-type transcription factor (DNA-binding and dimerisation domain)
MVRRKIEITELKDSNTKQVTFSKRRTAEVAVVVFSPGNNPYSFGHPSVDVVADKFLKQEPKSNDVQGTSTEVADMDRLNQQLSDVQNEILEEQKKAAELNERMKQKGVTQLFQPKELQGSNLEIQKMKDCYDAIEVSEYMLLLAKEPVVGIPKQ

SEQ ID NO: 197798 - protein, 71 aa, Glycine max
  Coding DNA Sequence Number=SeqID_81020
MEEFEAQVAWPGDQPSSYGGSQEEETTPEQILEPSPAPVHAPDDATPVVEPEQTIQESLAAPALDLNEEQP

SEQ ID NO: 197799 - protein, 210 aa, Glycine max
  Coding DNA Sequence Number=SeqID_81021
  Homolog annotation: Hit_ID=Q51613; Match level="QueryCoverage=24%, HitCoverage=41%, E-value=6e-17, Identity=86%"; Hit description=, complete genome
GAFQGETPGILIVLSGFATSDLSVDFCDARQGGGAYGKTPATRPFYGSWPFAGLLLTCSVLRYPLILWITVLPPLSELIPLAAAERPSAASHWHDRFPDWKAGSERNAINGSFDVAPPPLQLRQEQKASLPGNVLVPNPTAPYPVHRVEIGRIAVAVEHNSCDLWGQEWRVVTRSCSTATAQLTAETGAPSRWWSSSRIEGLENGFGEGD

SEQ ID NO: 197800 - protein, 58 aa, Glycine max
  Coding DNA Sequence Number=SeqID_81022
  Gene Ontology: Mol. function=amino acid transporter activity; Cellular component=membrane; Biological process=amino acid transport
  Homolog annotation: Hit_ID=Q9LZ20; Match level="QueryCoverage=72%, HitCoverage=7%, E-value=2e-08, Identity=67%"; Hit description=Amino acid transport-like protein
MATATKSISLKPLGRDGTVRRHLAEEIPIVVPRYAIKPLATMALEKGGVEGAKAGNGN

SEQ ID NO: 197801 - protein, 164 aa, Glycine max
  Coding DNA Sequence Number=SeqID_81023
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q9TKI7; Match level="QueryCoverage=99%, HitCoverage=44%, E-value=6e-74, Identity=71%"; Hit description=ATP synthase subunit beta
  Pfam annotation: Domain name=ATP-synt_ab; Domain location=45-164; Score=6.9; E_value=2.9e-08; Accession=PF00006.15; Description=ATP synthase alphabeta family, nucleotide-binding domain
VAMSATEGLMRGMEVIDTGAALSVPVGGATLGRIFNVLGEPIDNLGIKVVDLLAPYRRGGKIGLFGGAGVGERTREGNDLYMEMKESGVINEQNIAESKVALVYGQMNEPPGARMRVGFPALTMAEYFRDVNEQDVLLFIDNIFRFVQAGSEVSALLGRMPSAV

SEQ ID NO: 197802 - protein, 43 aa, Glycine max
  Coding DNA Sequence Number=SeqID_81024
MFNPPENPSRGASVTLPRRFRGRFREDFPPFFIVLRRSSVFNR

SEQ ID NO: 197803 - protein, 309 aa, Glycine max
  Coding DNA Sequence Number=SeqID_81025
  Homolog annotation: Hit_ID=Q4K7W3; Match level="QueryCoverage=44%, HitCoverage=65%, E-value=2e-42, Identity=60%"; Hit description =Glutathione S-transferase
  Subcellular localization annotation: CTP_CleavageSite=82; ConfidenceScore=5.59e-01
MAAACVEPAPTAPQATPGQTGTPKSRRSSNEFQQPSAPHSLGPRDVRSTVGCMRPDPAGAQCARHCSHGNGRPEGARSACARCRAGRRIAGHLARRCSRPGDIPAVHAARRPQAALQLQAARRAQPPESCLAVHGRHDAGARRPLTPVLQQPKPAGNLAGFVTQGARPPSRHAVGAMQAKARPLAKPFVVGADCRQFRALHGRRHPAVRGQAQHDIGQAQLRASSKGAGARQLVLQNAHVAMPVRHAASQLRGVLMLRAVSHQSHEGIAPGIVQLGCLPIHPLLDKRAFGGCCRQQVLPVMAGRQVAAD

SEQ ID NO: 197804 - protein, 203 aa, Glycine max
  Coding DNA Sequence Number=SeqID_81026
  Gene Ontology: Mol. function=calpain activity; Cellular component =intracellular; Biological process=proteolysis
  Homolog annotation: Hit_ID=Q1S3Q9; Match level="QueryCoverage=97%, HitCoverage=39%, E-value=6e-27, Identity=35%"; Hit description =Cyclin-like F-box; F-box protein interaction domain
  Pfam annotation: Domain name=FBA_1; Domain location=60-195; Score= -45.1; E_value=0.017; Accession=PF07734.3; Description=F-box associated
MFGFGYDPSSDKYKVVAIALTMLSLDVSEKTEMKVYGAGDSSWRNLKGFPILCTLPKVGGVYLSGTLNWVVIKGKETIHSEIVIISIDLEKETCRSLFLPDDFCFVDTNIGVFRDSLCVWQDSNTHLGLWQMRKFGDDKSWIQLINFSYLHLNIRPYEEKSMILPLCMSNNGDFFMLKFTRIADDEYQIILYNQWDGKGRREI

SEQ ID NO: 197805 - protein, 163 aa, Glycine max
  Coding DNA Sequence Number=SeqID_81027
  Subcellular localization annotation: CTP_CleavageSite=54; ConfidenceScore=5.08e-01
MLCLWLISGRGSVRDFTKPAVGCLRGSVNLRRLQPLYGPLSFGCSTFDANRRIRDSSLLHGSWLKNFSASSSACYSAGAAHAVSFDGSPPDEQLANSSFSPDPLFVLQTAKKNVYTDNHSGISARQRDSNVSMTNLVSAKDDVNLCVTTGLSAAIDEGCRRRR

SEQ ID NO: 197806 - protein, 359 aa, Glycine max
  Coding DNA Sequence Number=SeqID_81028
  Gene Ontology: Mol. function=protein serine/threonine kinase activity; Cellular component=cytoplasm; Biological process=response to abscisic acid stimulus
  Homolog annotation: Hit_ID=Q940H6; Match level="QueryCoverage=89%, HitCoverage=88%, E-value=1e-171, Identity=92%"; Hit description =Protein kinase-like protein
  Pfam annotation: Domain name=Pkinase; Domain location=24-280; Score =317.1; E_value=3.1e-92; Accession=PF00069.15; Description=Protein kinase domain
  Pfam annotation: Domain name=Pkinase_Tyr; Domain location=24-281; Score=19.8; E_value=1.1e-13; Accession=PF07714.7; Description =Protein tyrosine kinase
  Pfam module annotation: Pfam domain module=Pkinase::Pkinase_Tyr; Domain location=24-280::24-281
KGSVSDMSVGPGMDLPIMHDSDRYEFVRDIGSGNFGVARLMRDKHTEELVAVKYIERGEKIDENVQREIINHRSLRHPNIVRFKEVILTPTHLAIVMEYASGGELFERICNAGRFSEDEARFFFQQLISGVSYCHAMQVCHRDLKLENTLLDGSPAPRLKICDFGYSKSSVLHSQPKSTVGTPAYIAPEVLLKKEYDGKIADVWSCGVTLYVMLVGAYPFEDPEEPKNFRKTIHRILNVQYSIPDYVHISSECRHLISRIFVADPAKRISIPEIRNHEWFLKNLQSDLMDGNTNNNQFEEPDQPMQSIEEIMQIIKEATIPAAGSQSLNHDLTGSLDIDDDMDSDPDLDLDSSGEIVYA

SEQ ID NO: 197807 - protein, 2497 aa, Glycine max
  Coding DNA Sequence Number=SeqID_81029
  Gene Ontology: Mol. function=microtubule motor activity; Cellular component=microtubule associated complex; Biological process =microtubule-based movement
  Homolog annotation: Hit_ID=Q27IK6; Match level="QueryCoverage=99%, HitCoverage=90%, E-value=0.0, Identity=45%"; Hit description=Kinesin POK2
  Pfam annotation: Domain name=Kinesin; Domain location=1-259; Score =337.2; E_value=2.8e-98; Accession=PF00225.13; Description=Kinesin motor domain
  Pfam annotation: Domain name=Kinesin-related; Domain location=140 -660; Score=-323.8; E_value=0.065; Accession=PF06548.2; Description =Kinesin-related
  Pfam annotation: Domain name=Pox_A_type_inc; Domain location=1035 -1057; Score=6.6; E_value=8.7; Accession=PF04508.3; Description=Viral A-type inclusion protein repeat
  Pfam annotation: Domain name=Pox_A_type_inc; Domain location=1658 -1680; Score=0.1; E_value=80; Accession=PF04508.3; Description=Viral A-type inclusion protein repeat
  Pfam annotation: Domain name=Pox_A_type_inc; Domain location=2032 -2054; Score=2.2; E_value=39; Accession=PF04508.3; Description=Viral A-type inclusion protein repeat
  Pfam annotation: Domain name=Pox_A_type_inc; Domain location=2185 -2206; Score=7.2; E_value=7.2; Accession=PF04508.3; Description=Viral A-type inclusion protein repeat
  Pfam annotation: Domain name=Pox_A_type_inc; Domain location=2454 -2476; Score=0.3; E_value=74; Accession=PF04508.3; Description=Viral A-type inclusion protein repeat
  Pfam annotation: Domain name=Pox_A_type_inc; Domain location=629-651; Score=0.5; E_value=69; Accession=PF04508.3; Description=Viral A-type inclusion protein repeat
  Pfam module annotation: Pfam domain module=Kinesin::Kinesin -related::Pox_A_type_inc::Pox_A_type_inc::Pox_A_type_inc::Pox_A_type _inc::Pox_A_type_inc::Pox_A_type_inc; Domain location=1-259::140 -660::1035-1057::1658-1680::...
  Pfam module annotation: Domain location=2032-2054::2185-2206::2454 -2476::629-651
EMIFRLAGLPMVENCLSGYNSCMFAYGQTGSGKTYTMLGDIEDLDVMPSPHRGMTPRIFEFLFARIQAEEESRRDESLKYNCKCSFLEIYNEQITDLLDPSSTNLLLREDVKKGVYVENLSEFEVQSVSDIIRLLIQGSANRKVAATNMNRESSRSHSVFTCVIESTWEKDSTTNYRFARLNLVDLAGSESHVIMILVDVANGKQRHIPYRDSRLTFLLQDSLGGNSKTMIIANVSPSICCAAETLNTLKFAQRAKLIQNNAVVNEDSTGDVIALQHQIRLLKVEELSILKRRQNVSRSLSFSLSSIRDIKQSLELEDCCLENATDMVDQHEDNMPDYESKGIRMSHKQLHSLETTLAGALRREQMAEISIKQLEAEIEQLNRLVRQREEDTRSCKMMLRFREDKIHRLESQLAGSIPTDTFLQEENKALSDEIQILQSRLDRNPEVTRFAVENIRLLDQLRRYQEFYEEGEREILLTEVSSLRDQLLQYHGRNSMQGNSNHDIQPQKAQCCNKENNLVDLELRNTLDELQECRRNLNYCLEENAKLNREVDSLHSMLSSTNSTKVSTKGPFIEAQAVPRMGVKHETHLSQHTDDILNLQLELDIINVILKEERSFRGILEEQKICLNKDFMMAKDKLEQTSKQLEDAKDELGEAKSVIEALELQQILSIKEIEEMRNKNSHFMELMGKQEHEIMTLKNQLASKEFRDNLLSNNPEFENKSPLQVKLRRMHDSLEKAKQLNMSYQSDHAFQISNEEERDEIRRQAEAETVEVIVCMQEELAQLQHQVNDSHLKETEMEESMLHLETELKELQKKMLTTIDDNRSLKEELGQKDIELTSLAEEWELLTSEIEEVLLDGCEAIVDASEELGNIRNSFPQKRIWISEQVGMIVRKISENELLIDELRRCLEDASNKRSDMECMLKSLRSAALVITESHQKECAENEKEILLLTSQLSEKTSTVAQLKEHLVMAEDHIRKASNCSTVAFVVVNRLSEVNLGYLDDLKHKDILLSELAETNNRKDVLLSDQSTSFVQAERQITELQERCNDLWQKLSEEQEHSRALEQKLEDIEKNAISKTREQLVTLQDGVSSIRSCMASFADHPGSLDNRNSLDACTSDYDDIGEQRHTSSETHQNSDSDPLSVEEHIVDLTDLQLVKSGYDTKDLKSRKVGKNVLERDATIRLLRKEIECALESLKEVQYEMARLHEEKKEMSVSEKKSRQSIECLTNQILFLQEAMYHFEEKSKVKIDVLSHKLRGLEKPLKEASSHWYQRKETLELEVGEAKIIQAQKAQEASCILAKFEEAQDTMREADIMINGLVIANESMKIDIERLKDREMTLLNEKGTLVSNIESLQTVVDLKHQEIENLVESSLVETRDLIVTLDDVIKDVQLTMAENFKSLACDLECLKSQCLYSTKLIQPWLEKIWSEIVFKDCAMSVLHLCHMGILLETVTGMHAENGLLSHGLCESNSVISDLKEHNYRTKQELDMCRILKGKLLADIKNSFDRINKKEVEAGEITIKLNNFAKSISDLQLQEEMMLQRSNEMGSQLAKLMRELDVSNTDIVTSLLDQEKLLKQKVVAIECEAEFFMADWYAKDFESLIHASELKNMSCNIANMEEHFVKYSILIEQLKKETIFSQVETEFAKQILMDKEVEVSLLEREVQQGKVERKDLVTELNRNVLRITEMGEVNKVLEQNIEFLKDVTCSNHALKGELVEANKAKKRLLDRILDLEADYDKVIGDVIGKDVASEFSFQQVYFLEHQNTELKKVNYMLENSSCRLKNELNLKDSDLTRMQNLLEVELSRKDDVVKGLLYDLSLLQESASNNKDQKDEVEKIVATMEALEVELAVKSGELADVVANCQLLEAQLQDKSDIIRALELDLSKEREALVLQVSENQELRTHIEGALTARKLADNELTERMKITESLEDEILEMNSVFSQMNDSFKNLSSDLDDVTNERDQLQGQVICLKNRLEKAEAQAEANEAIVQEAQKVAESRKIYAEDREEEVKLLARSVEELESTVNVLENQVDILKGEAERQRLQREDLELELHALKDQMQNVRNVDGDMRRFLDEKEKSLNEALNHIQVLKRELAGKDAEIRQIKAHISELNLHAEAQAMEYKQKFKALEAMAEQVKPEGLSSHSTSANSHNALSNKSEKNATKSRGSSSPFKCIGLGLAQQVKYEKVEELSAARLRIEELEAQAACRQREIFALNAKLASAESMTHDVIRDLLGVKLDMTSYASLIDDEQAEKITEKVKFLTLESQDKEVIKLKKQLNEFIEERQGWLQEMDRKQSELVAVQIALENLRQRDQLLKTENEMLKIENASKKNKVVELEEEIKKLSGQQNLQQRIHHHAKIKEENNKLKIQNEELSAKLRKSDIFHSRVKEDLARLRASTGAKKSINLDEEQRLMIKLKEIEEEKVQLAQQLLRLSTNVLKVAGIARPTSDVNPSMAEEALQDLKNRITTLEMEQEDLKFKRVKPKVWKVYERKNRRQKGSE

SEQ ID NO: 197808 - protein, 119 aa, Glycine max
  Coding DNA Sequence Number=SeqID_81030
MPISPCESIGWSVPSRHKDRAHKTPSGPGEVQQGPGVSSFGYGPLSVLQGARSPQQGIAPARHPVDPEKSNREYLSPPTRSLGPALTGFSSRSTAPPGRRKARHYSSIGMAGSGHRHHL

SEQ ID NO: 197809 - protein, 103 aa, Glycine max
  Coding DNA Sequence Number=SeqID_81031
  Homolog annotation: Hit_ID=Q1S0W0; Match level="QueryCoverage=45%, HitCoverage=4%, E-value=3e-09, Identity=59%"; Hit description=PHD -finger, putative
MKEMRRRQGRTRKGEKSKNYQCGCLRSKKTRRQVDEAEVLIGGVAENREGRQREARGKLEVDGVGEVDTSVVGGRHRGGAVGGRETHVFGHGKSMKARRNGEI

SEQ ID NO: 197810 - protein, 125 aa, Glycine max
  Coding DNA Sequence Number=SeqID_81032
  Subcellular localization annotation: CTP_CleavageSite=32; ConfidenceScore=5.08e-01
MPLVLGNIGSGSTSQVRKWNMNSTRKTMIFVSQAQYKPIKSLVIHLKVVRKLQTLNHTLVSRGKHQPCEENIDRCGKDHWKKEELRPLTVLKHSELAWKLFLFLIRKRRLHLAKVAQKGRKKKKF

SEQ ID NO: 197811 - protein, 270 aa, Glycine max
  Coding DNA Sequence Number=SeqID_81033
  Gene Ontology: Mol. function=protein binding; Cellular component =membrane; Biological process=defense response
  Homolog annotation: Hit_ID=Q6SQJ2; Match level="QueryCoverage=69%, HitCoverage=19%, E-value=2e-54, Identity=53%"; Hit description=NBS -LRR type disease resistance protein RPG1-B
  Pfam annotation: Domain name=NB-ARC; Domain location=58-268; Score= -16.3; E_value=3e-09; Accession=PF00931.13; Description=NB-ARC domain
MKKKQFRDARVRDWLLKAKDVVFEAEDLWEDMDNELQSDHLGLKKASGVVVGSGSGSKVSEKLSSTSLLSESIIYGRDDDKEIIFNWLISDIDNKLSILSIVGMGRLGMTMVAQHVYNDPRMDDKFDIKAWVCVSEDFDVFNVSRAILDTISGSTDRSRELEMVQTRLKEKLTIIRLLYHAVRRAPPGGITRRLLLALFAKHAFQSSNPQANIDFKEIDMKIVEKCKGLPLALKTMGSLLHNKSSVREWENIFKSEIWEFSEMIAIFSLL

SEQ ID NO: 197812 - protein, 310 aa, Glycine max
  Coding DNA Sequence Number=SeqID_81034
  Gene Ontology: Mol. function=transcription factor binding; Cellular component=Rb-E2F complex; Biological process=negative regulation of transcription from RNA polymerase II promoter
  Homolog annotation: Hit_ID=Q9SLZ4; Match level="QueryCoverage=99%, HitCoverage=34%, E-value=1e-141, Identity=74%"; Hit description =Retinoblastoma-related protein
  Pfam annotation: Domain name=RB_B; Domain location=60-156; Score =103.3; E_value=7.4e-28; Accession=PF01857.10; Description =Retinoblastoma-associated protein B domain
  Subcellular localization annotation: CTP_CleavageSite=57; ConfidenceScore=5.53e-01
DIRSPKRNVNGKKSFTSPVKDRLLPFNSLKSKLPPPPLQSAFASPTKPNPGGGGETCAETGINIFFGKIIKLGAVRISGMVERLQLSQQIRENISQLNLTFKEIVYNYRKQPHCKTQVFRSVFVDWSLARRNGRTGQDHVDIITFYNEIFIPSVKPLLVELGPAGPTPKSDRIPEVNNKNEGHLAQCPGSPKISPFPTLPDMSPKKVSATHNVYVSPLRSSKMEALISHSSKSYYACVGESTHAYQSPSKDLTAINNRLNGNRKVRGPLNFDDVDVGLVSDSMVANSLYLQNGSCASSSGAPLKSEQPDS

SEQ ID NO: 197813 - protein, 41 aa, Glycine max
  Coding DNA Sequence Number=SeqID_81035
MCFLPHAVPVSHKELVAIATLPIPKRELKSVCGIKTMLLDM

SEQ ID NO: 197814 - protein, 80 aa, Glycine max
  Coding DNA Sequence Number=SeqID_81036
MGSSLGLMLYMPRHGKIGDEFTLKKLKIGSHQKENKRGIKVEGCISRVWSQWPKAQYSLKANKCKLVGNGWHHGRGNFHC

SEQ ID NO: 197815 - protein, 246 aa, Glycine max
  Coding DNA Sequence Number=SeqID_81037
  Homolog annotation: Hit_ID=Q1S7C5; Match level="QueryCoverage=37%, HitCoverage=8%, E-value=6e-10, Identity=47%"; Hit description =Integrase, catalytic region
  Subcellular localization annotation: CTP_CleavageSite=23; ConfidenceScore=5.41e-01
MASALTPPSVSLSSSPPPQPSLSANASSKSLAHSVSQKLHAKNYLLWIQQVEPVIHSHHLEGYIVNPQIPQKYASIEYQDANQVTNEYGVCLPFLVTFFRLSLVVVRRGNSGITFNHIFSILRERRGGYVRTLPPPTSFATTQSTSVQTNSAQSGQTSQQVQFAQPIQHVFCPTSVFSASANPQQSLIMSFAQLLVSKLVLLKGFVGRDGLYQFPQLLAFMPKCNLSSNVCKSDRFCTKSCCKYSH

SEQ ID NO: 197816 - protein, 154 aa, Glycine max
  Coding DNA Sequence Number=SeqID_81038
MGHYFCFECGLSSTTRSTSRYCVFIEGYIISLRSPKQNILLLQRSSSLGSNNQLKELLQPSALDIDIDIDYHFLLRAALDIDIDYHFFREKKRFLHLRSLLVRSTPTITYIFTKSLRLRGAQVDFICRKVVTYMLQLRGIVLELNVRFKHMYHE

SEQ ID NO: 197817 - protein, 290 aa, Glycine max
  Coding DNA Sequence Number=SeqID_81039
  Gene Ontology: Mol. function=exonuclease activity; Cellular component= intracellular
  Homolog annotation: Hit_ID=Q2R3D7; Match level="QueryCoverage=66%, HitCoverage=65%, E-value=4e-40, Identity=47%"; Hit description =Exonuclease family protein, expressed
  Pfam annotation: Domain name=Exonuc_X-T; Domain location=44-200; Score=0.4; E_value=0.0012; Accession=PF00929.14; Description =Exonuclease
MGRLGSSQLGYSVVDLRLTTVIAAIGRWWQLEVGTPESGGRSAIVWTYGAVIASNAILHPFIFSVNCVHGCVRQESQPQSEPRGHFLVRKESAPLYSAVDRGVTLSEALLRHDKWLEKKGIKNSNFAVVTWSNWDCRVMLESECRFKKIRKPPYFNRIPFREVFGAVRCNLKEAVEIAGLAWQGRAHCGLDDAKNTAHLLALLMHRGFKFSITNSIMWQTADRPLMWKQSPEQPIVFPHSPYKAKDITIPVVQYHPFCFCGVKSSRGMVRKPCPKQGSLFFGCGNWTATR

SEQ ID NO: 197818 - protein, 97 aa, Glycine max
  Coding DNA Sequence Number=SeqID_81040
MIIDRGRQDEDDVVDVPQRCRPIASARRQRVHQMIKDVPHMIEDVPHMAEDAPEMTADVQATVAKDLGRDGAEGSHADDAEGFPERPELKLVSHGRK

SEQ ID NO: 197819 - protein, 111 aa, Glycine max
  Coding DNA Sequence Number=SeqID_81041
MPTDIREIEAALCIPGRGFILNAEGHPGKILKKDLTTLAQVWSVLSYSNLAPTSHTLDLTMDRARGARRPRARPVEAPSTLATPHPASTSAAPPPAHMTPAPSTLPPADFQ

SEQ ID NO: 197820 - protein, 100 aa, Glycine max
  Coding DNA Sequence Number=SeqID_81042
MVPRMSSSPSPLDDKGADDHNLSLRVNGLACLWLKKEVVCAEDDVNLRVSMGLLVAIDKRDSKRKFAGYRQVSPHAIGLLGHGNKGGVVDKSRAFAPTYP

SEQ ID NO: 197821 - protein, 188 aa, Glycine max
  Coding DNA Sequence Number=SeqID_81043
MSEIEEVQERMKADMEAMKEQMATMMKAMMSMEKRMEVNVAAVAATSIASEVDPTPPSGLNPINHPTSNMVGKELGSMGIPHFVQVQNKHSFPPYGLKHDYAPPNVVHTPDENVNNSTPILIESQQTQFDHAHVTQPMGETHEIPHHNLANFEPCLGYAPEGKQLVVYLCQTLWRALSFSHNHNPFIL

SEQ ID NO: 197822 - protein, 347 aa, Glycine max
  Coding DNA Sequence Number=SeqID_81044
  Homolog annotation: Hit_ID=Q10F28; Match level="QueryCoverage=100%, HitCoverage=31%, E-value=2e-89, Identity=52%"; Hit description =Expressed protein
MEEENAIELLQRYRRDRRVLLDFILSGSLIKKVVMPPGAVTLDDVDLDQVSVDYVLNCAKKSTLLELSEAIRDYHDHTGLPQMSDTGSVGEFYLVTDPESSGSPPRRPPPTVPIPAVPPVAVSTPPPVFPPSPIVSNVSRSESFDSTQEKELTVDDIEDFEDDDDVAVVEGFRAKRTLNDASDLAVKLPSFSTGISDDDLRETAYEIILGCAGATGGLIVPSKEKKKDKKSSLIRKLGRSKSGSVVSQSQNAPGLVGLLETMRVQMEISESMDIRTRQGLLNALVGKVGKRMDTLLIPLELLCCISRSEFSDKKAFIRWQKRQLKVLEEGLVNHPAVGFGESGRKTN

SEQ ID NO: 197823 - protein, 57 aa, Glycine max
  Coding DNA Sequence Number=SeqID_81045
MEQRGQQERLHLKSLRSKIFLECGFGSNSTPKASSWGKGCLPLYILHFGTISGRCET

SEQ ID NO: 197824 - protein, 202 aa, Glycine max
  Coding DNA Sequence Number=SeqID_81046
  Homolog annotation: Hit_ID=Q10F28; Match level="QueryCoverage=71%, HitCoverage=12%, E-value=2e-44, Identity=64%"; Hit description =Expressed protein
  Pfam annotation: Domain name=DUF810; Domain location=2-201; Score= -547.2; E_value=0.0086; Accession=PF05664.2; Description=Protein of unknown function (DUF810)
MAVASPGLVGQTKIHLLASGHCAGVLNKALSPTSFVALSKFSCVILLHHIPQAWGELSQLCDIVVEPLRDRIVTSLLQASLDGLLRVILDGGPSRVFFPGDVKLLEEDLEVLKEFFISGGDGLPRGVVENQVARVRNVINLHGYETRELIEDLKSASGMEMQGGKSKLGTDSKTLLRILCHRSDSEASQFLKKQYKIPSSSA

SEQ ID NO: 197825 - protein, 140 aa, Glycine max
  Coding DNA Sequence Number=SeqID_81047
  Gene Ontology: Mol. function=protein binding; Biological process =defense response
  Homolog annotation: Hit_ID=Q8GZF0; Match level="QueryCoverage=99%, HitCoverage=14%, E-value=5e-52, Identity=66%"; Hit description =Resistance protein KR4
MALECVGGAILSSFLGALFQKLASPQFGNVLVRDWLIKLKVAMLDVEDVLDEIQHSKLQVQPQSESQTGSGCTCKVPKFFQSSSFSSINKEINSSMKKILDDLDDLASRMDNLGLKKASDLVARSGSGGKVPQSTLLVVD

SEQ ID NO: 197826 - protein, 1167 aa, Glycine max
  Coding DNA Sequence Number=SeqID_81048
  Gene Ontology: Mol. function=protein binding; Cellular component =membrane; Biological process=defense response
  Homolog annotation: Hit_ID=Q8GZF0; Match level="QueryCoverage=99%, HitCoverage=99%, E-value=0.0, Identity=62%"; Hit description =Resistance protein KR4
  Pfam annotation: Domain name=LRR_1; Domain location=1007-1030; Score =12.8; E_value=1.2; Accession=PF00560.23; Description=Leucine Rich Repeat
  Pfam annotation: Domain name=LRR_1; Domain location=1056-1078; Score =2.2; E_value=1.1e+02; Accession=PF00560.23; Description=Leucine Rich Repeat
  Pfam annotation: Domain name=LRR_1; Domain location=1079-1102; Score =0.0; E_value=2.8e+02; Accession=PF00560.23; Description=Leucine Rich Repeat
  Pfam annotation: Domain name=LRR_1; Domain location=1104-1127; Score =13.1; E_value=1; Accession=PF00560.23; Description=Leucine Rich Repeat
  Pfam annotation: Domain name=LRR_1; Domain location=486-508; Score =10.6; E_value=3; Accession=PF00560.23; Description=Leucine Rich Repeat
  Pfam annotation: Domain name=LRR_1; Domain location=510-531; Score =10.9; E_value=2.6; Accession=PF00560.23; Description=Leucine Rich Repeat
  Pfam annotation: Domain name=LRR_1; Domain location=533-555; Score =14.3; E_value=0.43; Accession=PF00560.23; Description=Leucine Rich Repeat
  Pfam annotation: Domain name=LRR_1; Domain location=557-579; Score =12.4; E_value=1.3; Accession=PF00560.23; Description=Leucine Rich Repeat
  Pfam annotation: Domain name=LRR_1; Domain location=581-603; Score =14.4; E_value=0.4; Accession=PF00560.23; Description=Leucine Rich Repeat
  Pfam annotation: Domain name=LRR_1; Domain location=604-626; Score =13.4; E_value=0.81; Accession=PF00560.23; Description=Leucine Rich Repeat
  Pfam annotation: Domain name=LRR_1; Domain location=628-649; Score =3.9; E_value=53; Accession=PF00560.23; Description=Leucine Rich Repeat
  Pfam annotation: Domain name=LRR_1; Domain location=764-785; Score =6.0; E_value=21; Accession=PF00560.23; Description=Leucine Rich Repeat
  Pfam annotation: Domain name=LRR_1; Domain location=842-862; Score =4.7; E_value=38; Accession=PF00560.23; Description=Leucine Rich Repeat
  Pfam annotation: Domain name=LRR_1; Domain location=864-891; Score =4.0; E_value=51; Accession=PF00560.23; Description=Leucine Rich Repeat
  Pfam annotation: Domain name=LRR_1; Domain location=921-949; Score =1.1; E_value=1.8e+02; Accession=PF00560.23; Description=Leucine Rich Repeat
  Pfam annotation: Domain name=LRR_1; Domain location=982-1001; Score =8.1; E_value=8.6; Accession=PF00560.23; Description=Leucine Rich Repeat
  Pfam annotation: Domain name=NB-ARC; Domain location=170-433; Score =177.7; E_value=2.9e-50; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::NB-ARC; Domain location=1007-1030::1056 -1078::1079-1102::...
  Pfam module annotation: Domain location=1104-1127::486-508::510 -531::533-555::557-579::581-603::604-626::628-649::764-785::842 -862::864-891::921-949::982-1001::170-433
MALLECVGGAFLSSFLGTVFQKLASPQVLDFFRGTKIDQKLRKDLENKLFSIQAVLDDAEQKQFGNMQVRDWLIKLKVAMLDVEDVLDEIQHSRLQVQPQSESQTCTCKVPNFFKSSPVSSFNKEINSSMKNVLDDLDDLASRMDNLGLKKASGLVAGSGSGSGSGGKVPQSTSSVVEVIFVAEMVIKKSSLTGSLLTLITSCQYFLSWAWAGWEFDVFNVSRAILDTITDSTDHGRELEIVQRRLKEKLADKKFLLVLDDVWNESRSKWEAVQNALVCGAQGSRILVTTRSGKVSSTMGSKEHKLRLLQEDYCWKLFAKHAFRDDNLPRDPGCPEIGMKIVKKCKGLPLALKSMGSLLHSKPFAWEWEGVLQSEIWELKDSDIVPALALSYHQLPPHLKTCFAYCALFPKDYMFDRECLIQLWMAENFLNHHQCNKSPEEVGQQYFNDLLSRLRTFMPTSRIMNGYYYHWHCNMLIHELFSKFKFLRVLSLSCCSDIKELPDSVCNFKHLRSLDLSKTGIEKLPESTCSLYNLQILKLVNCRHLKELPSNLHKLANLCVLSLSQCSGLTEVPNSIGDLKHLRSLDLSHTRIKKLPDSTCSLSNLQILKLNYCRYLKELPSNLHQLTNFHRLEFVDTELIKVPPHLGKLKNLQVLMSLFDVGKSSEFTILQLGELNLHGSLSFRELQNIKSPSDALAADLKNKTRLVELKLEWNLDWNPDDSGKERDVVVIENLQPSKHLEKLSIINYGGKQFPNWLSGNSLSNVVSLELDNCQSCQHLPSLGLFPFLKNLEISSLDGIVSIGADFHGDSTSSFPSLETLKFSSMAAWEKWECEAVTDAFPCLQYLSIKKCPKLKGHLPEQLLPLKKLEISECNKLEASAPRALELSLKDFGKLQLDWATLKKLRMGGHSMKASLLEKSDTLKELEIYCCPKYEMFCDCEMSDDGCDSLKTFPLDFFPALRTLDLSGFRNLQMITQDHTHNHLEVLEFGKCPQLESLPGKMHILLPSLKELRIYDCPRVESFPEGGLPSNLKQMRLYKCSSGLVASLKGALGENPSLEWLLISNLDEESFPDEGLLPLSLTYLWIHDFPNLEKLEYKGLCQLSSLKGLNLDDCPNLQQLPEEGLPKSISHLKISGNCPLLKQRCQNSGGQDWSKIVHIQTVDIINTW

SEQ ID NO: 197827 - protein, 957 aa, Glycine max
  Coding DNA Sequence Number=SeqID_81049
  Gene Ontology: Mol. function=protein binding; Cellular component =membrane; Biological process=defense response
  Homolog annotation: Hit_ID=Q8GZF0; Match level="QueryCoverage=99%, HitCoverage=79%, E-value=0.0, Identity=77%"; Hit description =Resistance protein KR4
  Pfam annotation: Domain name=LRR_1; Domain location=397-419; Score =12.1; E_value=1.6; Accession=PF00560.23; Description=Leucine Rich Repeat
  Pfam annotation: Domain name=LRR_1; Domain location=421-443; Score =14.4; E_value=0.42; Accession=PF00560.23; Description=Leucine Rich Repeat
  Pfam annotation: Domain name=LRR_1; Domain location=444-466; Score =9.2; E_value=5.4; Accession=PF00560.23; Description=Leucine Rich Repeat
  Pfam annotation: Domain name=LRR_1; Domain location=468-489; Score =8.3; E_value=8.2; Accession=PF00560.23; Description=Leucine Rich Repeat
  Pfam annotation: Domain name=LRR_1; Domain location=604-625; Score =4.1; E_value=49; Accession=PF00560.23; Description=Leucine Rich Repeat
  Pfam annotation: Domain name=LRR_1; Domain location=627-649; Score =3.0; E_value=77; Accession=PF00560.23; Description=Leucine Rich Repeat
  Pfam annotation: Domain name=LRR_1; Domain location=682-702; Score =5.9; E_value=22; Accession=PF00560.23; Description=Leucine Rich Repeat
  Pfam annotation: Domain name=LRR_1; Domain location=704-731; Score =2.3; E_value=1.1e+02; Accession=PF00560.23; Description=Leucine Rich Repeat
  Pfam annotation: Domain name=LRR_1; Domain location=822-844; Score =10.3; E_value=3.4; Accession=PF00560.23; Description=Leucine Rich Repeat
  Pfam annotation: Domain name=LRR_1; Domain location=847-870; Score =12.3; E_value=1.4; Accession=PF00560.23; Description=Leucine Rich Repeat
  Pfam annotation: Domain name=LRR_1; Domain location=930-953; Score =1.6; E_value=1.4e+02; Accession=PF00560.23; Description=Leucine Rich Repeat
  Pfam annotation: Domain name=NB-ARC; Domain location=1-275; Score =270.1; E_value=4.4e-78; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NB-ARC; Domain location=397-419::421-443::444-466::468-489::604-625::627-649::682 -702::704-731::...
  Pfam module annotation: Domain location=822-844::847-870::930-953::1 -275
MIINWLTSDTDNMLSILSIVGMGGLGKTTLAQLVYNDPRIEGKFIVKAWVCVSEEFDVLNVSRAILDTFTKSTENSDWLEIVHTKLKDKLRGNRFLLVLDDVWNESRPKWEVVQNALVCGAQGSRILVTTRSQKVASTMRSEQHHLQQLQEDYCWKLFAKHAFHDDNPQPNPGYNEIGMKIVEKCGGLPLALKSIGSLLQNKSFVSDWENILKSEIWEIEDSDIVPALAVSYHHLPPHLKTCFAYYTLFPKDYEFDKECLIQLWMAENFLHCHQGSKSPEEVGQQYFNDLLSRSFFQQSSENKEVFVMHDVLNDLGKYVCGDIYFRLEVDQAKCTQKTARYFSVAMNNKQHFDEFGTLCDTKRLRTFMPTIRIMNEYYNSWHCNNMSIPELFSKFKFLRVLSLSHCSDINELPDSVCNLKHLRSLDLSHTSIKKLPDSTCSLSNLQILKLNYCRYLKEQPSNLHELTNLHRLEFVNTKIIKVPPHLGKLKNLQVSMSSFDVGKTSEFTIQQLGELNLHGRLSFWELQNIENPSDALAADLKNKTRLVELELEWNWNRNPDDSAKERDAIVIENLQPSKHLEKLSIRNYGGKQFPNWLSNNSLSNVVFLKLHNCQSCQHLPSLGLFPFLKNLEISSLDGIVSIGADFHGNGTSSFPSLETLKFSSMKAWEKWECEAVIGAFPCVQYLSISKCPKLKGDLPEQLLPLKKLQISECKQLEASAPRALELDLKDFGKLQLDWASLKKLRMGGHSAETSLLEKSDTLKELYIYCCLKYGILCNCEMSDNGFDSQKTFPLDLFPALRTLHLRGFHNLQMITQDHTHNHLEFLKIRECPQLESLPGSMHMLLPSLKELVIDDCPRVESFPEGGLPSNLKEMGLYKCSSGLMASLKGALGGNPSLESLGIVELDAESFPDEGLLPLSLTCLRIRDFRNLKKLDYKGLCQLSSLKKLILGNCPNLQ

SEQ ID NO: 197828 - protein, 294 aa, Glycine max
  Coding DNA Sequence Number=SeqID_81050
  Gene Ontology: Mol. function=protein binding; Cellular component =membrane; Biological process=defense response
  Homolog annotation: Hit_ID=Q8GZF0; Match level="QueryCoverage=91%, HitCoverage=23%, E-value=1e-101, Identity=67%"; Hit description =Resistance protein KR4
  Pfam annotation: Domain name=LRR_1; Domain location=114-137; Score =14.3; E_value=0.43; Accession=PF00560.23; Description=Leucine Rich Repeat
  Pfam annotation: Domain name=LRR_1; Domain location=212-235; Score =14.8; E_value=0.32; Accession=PF00560.23; Description=Leucine Rich Repeat
  Pfam annotation: Domain name=LRR_1; Domain location=89-108; Score =7.7; E_value=10; Accession=PF00560.23; Description=Leucine Rich Repeat
  Pfam module annotation: Pfam domain module=LRR_1::LRR_1::LRR_1; Domain location=114-137::212-235::89-108
MQLDWAYSKNLIMGGQSMEASSLEKSDTLKELYIYCCQEYGIYCNCEMSDNGFDSQKTFPLDFFPALRTLRLIDFRNLQMITQDHSHKHLEVLAFSNCPQLEPLPGSMHMQLPSLKELTISNCPRVESFPEGGLPSNLKEMELYKCSSGLMASLKGTLGDNPSLESLGIGKLDAESFPDEGLLPLSLTCLCIRHCLNLKKLDYKGRLCQLSSLKELFLDDCPNLQQLPEEGLPKSISYLEIQGCTDLKQRCQNPGGKDWPKIAHITTCIVRMIFMIIFDLNYHEPSTPFVLQAN

SEQ ID NO: 197829 - protein, 63 aa, Glycine max
  Coding DNA Sequence Number=SeqID_81051
MIPEHRCKQSYVRKKIMLVELGELVSENMIFGEESKIQVKGSLSFHPPLMRPHHENPEVQAGV

SEQ ID NO: 197830 - protein, 59 aa, Glycine max
  Coding DNA Sequence Number=SeqID_81052
MARQKNMIHAQRFESLTKSSTHGRYVLIVSVMGKKVPSEVPWQWGITISLYVGIDPEVY

SEQ ID NO: 197831 - protein, 118 aa, Glycine max
  Coding DNA Sequence Number=SeqID_81053
  Gene Ontology: Mol. function=RNA-directed DNA polymerase activity; Cellular component=chromatin; Biological process=RNA-dependent DNA replication
FYRRFIKDLSKVALPLSNLLQKEVEFDFEDRCKEAFDCLMRALTTTLIIQAPDWIAPFELMCDASCHTLISSGDHCLMACNLCLTASRYLAPIVAQYVKFHNVPEVKREHCCTIREVS

SEQ ID NO: 197832 - protein, 63 aa, Glycine max
  Coding DNA Sequence Number=SeqID_81054
MNSVSEIVEEVNAVEAQQTKLEENIILQTLDMALVLITTKLVGSSFASASLDRTIKVYMCSSC

SEQ ID NO: 197833 - protein, 88 aa, Glycine max
  Coding DNA Sequence Number=SeqID_81055
MMMLLDTHENQNQYCGIEQHTYDSVLKDHSMELLCMKAPADVSTILEPEKEEISFKTKSFWDVVVPSYSEIQLMEGESKHDGRSETPS

SEQ ID NO: 197834 - protein, 942 aa, Glycine max
  Coding DNA Sequence Number=SeqID_81056
  Gene Ontology: Mol. function=RNA-directed DNA polymerase activity; Cellular component=chromatin; Biological process=chromatin assembly or disassembly
  Pfam annotation: Domain name=Chromo; Domain location=811-860; Score =19.8; E_value=0.0046; Accession=PF00385.14; Description='chromo' (CHRromatin Organisation MOdifier
  Pfam annotation: Domain name=rve; Domain location=542-696; Score =57.0; E_value=6e-14; Accession=PF00665.16; Description=Integrase core domain
  Pfam module annotation: Pfam domain module=Chromo::RVT_1::rve; Domain location=811-860::116-285::542-696
MTSNQISLSSNRSSSPNSCNGSMNNENENCPYVLEAITDLVELGSTAKDIISLIAQGNQLFVDPTIANDLSLAQKDKGAGLEPSFLLNNFGALVESRTQVRNRIMLQKGLIQPSTSLFSSLILLVKKSGGSWRFFVDYRALNAITVWDRFPIPTIDELLDELEGARCFSKLDLLQGYHQIRMHPEDVPKTAFRTHHGHYEFCVMPFRLCNAPSSFQATMNNLFCPYLWQFIIVFFDDILIYSACLDDHLRHLELTFQVLSDNQFALKITKCFFAQNQVEYLGHLVSHKGVEPLASKVEAIQQWPTLRTAPVLALPDYEHPFIVETDASEIGMGAVLSQRNQPITFFSKPFPPKFLNASVYVRELFVITTVVKKWRQYLLGRCFTIITYHMSLKELLTQVIQTPKQHMYLARLMGYEYQIQYRTGIHNQAIDELSRCFDSEAIQSSPTTHPEYTLTHNLILRKGRLWLPKGLAMIPTLLVEYHTTPTGGHMGVTKIKTNRLLENFDCPGLRQDVIDFVSKCLDCQHVKYETKRTVGLLCPLPIPYRPWEDLSLDFITGLPPFRGNTIILVVVDRFSKGIHLGMLPTAHTAHSVAAPFMDIVGKIHGIPCSLVSDRDPLFLSKFWQELFRRSGTQLRMSSAYHPQSDGQIEVLNRVIECLCAFVHGRPKEWEYIKGASTLDVVDEMLTNREETFQVIRKKLLRAQERMKLVSDTKRREVHYQPGDWVMLKLRPYRQVSEKGTHAISGKLAKRFYGPFQVLERIGPVAYRLKLPEEARIHFVFHCSMLKPFKGSPHEAPRVELPTKIIQHQPLISLLALLDYRRTSEHALLEVLVQWEGLPPDDTSWELWEQLCEDFHLEDKVNLHGPMDDTKQGEAEGRSTHAGAQNTQSGGGANLSGHIASVLPFVFLPIRCNGWVRGGQGNQLFVDPKIANDLSLAQKDKGR

SEQ ID NO: 197835 - protein, 52 aa, Glycine max
  Coding DNA Sequence Number=SeqID_81057
MLNIYVRGRGCHMEDYDSEINTNEATMQPNETPMQPINAPGTKEARGTSRIH

SEQ ID NO: 197836 - protein, 190 aa, Glycine max
  Coding DNA Sequence Number=SeqID_81058
  Gene Ontology: Mol. function=oxidoreductase activity
  Homolog annotation: Hit_ID=Q53QW8; Match level="QueryCoverage=62%, HitCoverage=20%, E-value=6e-24, Identity=50%"; Hit description =Expressed protein, partial
MRFNNYTHVVESESYSSHGLHELELLLSFLNDSSIEDFFCKPCSQGDVVGILLFSGLIDSFAYLNSKEPISQAVTDIKGDIITSLQSRLYIICDEVDVDSGNKYDVQSQVSNEISAEKPVPQLVLHLLRKGCSLPFPRRVFAPWLAGMYLCDYLQPSETFENYIHFYIGGYDRTDVVNCALYIVLVEAPM

SEQ ID NO: 197837 - protein, 762 aa, Glycine max
  Coding DNA Sequence Number=SeqID_81059
  Gene Ontology: Mol. function=nucleic acid binding; Cellular component= beta-galactosidase complex; Biological process=DNA integration
  Homolog annotation: Hit_ID=Q1S0A6; Match level="QueryCoverage=88%, HitCoverage=54%, E-value=0.0, Identity=54%"; Hit description=Zinc finger, CCHC-type; Peptidase aspartic, catalytic; Polynucleotidyl transferase, Ribonuclease H fold
  Pfam annotation: Domain name=rve; Domain location=447-599; Score =112.6; E_value=1.1e-30; Accession=PF00665.16; Description=Integrase core domain
  Pfam annotation: Domain name=zf-CCHC; Domain location=264-281; Score =7.9; E_value=0.048; Accession=PF00098.13; Description=Zinc knuckle
  Pfam module annotation: Pfam domain module=Retrotrans_gag::rve::zf -CCHC; Domain location=83-197::447-599::264-281
MAENKKPHTDGTKKTPSPYDLNSNDNPGNLITQVQLRGENYEEWARAMKISLRARRKWGFIDGTYEQPDDGSPEMEDWWTVQSMLVSWILNAIKPTLRSTVTYAENAKDLWEDIQDRFSVVNGPRIQQLKAKLADCKQQGLTMVSYYGKLKTLWDELANYEQIPRCSCGGCKCDIASKLEKRREEERVHQFLMGLDDASYGTVRSNILAADPLPSLNRVYTILVQEERVRTISRTKEERGVVMGLAVQAEHKSKWRGEIKDKSMVCSICRKAGHDDKNCFQVVGYPDWWGDRPRSEGGSSGENQQRNGTSAGRGRGGIARANATHVEKSELPGLSNEQWQTLVEMLNNGKTDEIEKMTDTGASNHMTGYLKNLCQQRTIRGCPVPDGEKVIATKERTVILDGGLKLENDRTLKTLIGAGERKDGLYLYHGVRNSKGYHISTKYDLDILHKCMGHPSFKVVKLIPNVTSSDDYSRSVWIYLLSEKREVSQTMINFFALIERQFDKHVKVIRSDNGTEFTCLKQYFLEHGILHQKSCTGTQQQNGRVERKHRHILNVARALRFQGRLPICFWGECILTAGYLINLTPSPILDGKTPYELVHGTSPSYDHLRVFGLLCYAHNQDRKGDKFDSRSRKCIFVGYPYGQRGWKLYDLEREVFFVSRDVKFVETEFPFEESINNPSPTSLVPLINPCMDEECMIENSHDNDTNADVRVGASEASNEPQSFAPPLEKQNCIDAVQCSSEGPETRSNIPPTSPLGKGHRIK

SEQ ID NO: 197838 - protein, 148 aa, Glycine max
  Coding DNA Sequence Number=SeqID_81060
  Gene Ontology: Mol. function=ATP binding; Cellular component=cytosol; Biological process=protein folding
  Homolog annotation: Hit_ID=Q1SE51; Match level="QueryCoverage=77%, HitCoverage=17%, E-value=1e-40, Identity=70%"; Hit description=Heat shock protein Hsp70
MAREDQKFGIGIDLGDDIVIPFKRRCCVHLNVMRIINEPTAAAISYDLDKRTNCAGEGNIFIFDLGGGTFDVFDVSLLKVEDKIWQWIFQVKATAGNTHLGGRDFDNKMVNYFVEEFKNKNRVDISGNPKAIRKLRTACERAKRSPLL

SEQ ID NO: 197839 - protein, 140 aa, Glycine max
  Coding DNA Sequence Number=SeqID_81061
MVGQRRVRRRGRGATKVKGRHGGRATRLRVEWGGEAWRRVRQVKMGKPRKEKRGEVKKEDRRQRRSNIEGWSRFGFSCRNWELGIGEKNKEMEMQGISRGVNLDPQTRILAGTAPVWGPVDEDFFPSGMGTRINIPPWAW

SEQ ID NO: 197840 - protein, 521 aa, Glycine max
  Coding DNA Sequence Number=SeqID_81062
  Gene Ontology: Mol. function=signal transducer activity; Cellular component=membrane; Biological process=response to light stimulus
  Homolog annotation: Hit_ID=Q7XIJ3; Match level="QueryCoverage=86%, HitCoverage=100%, E-value=8e-89, Identity=40%"; Hit description =Putative phototropic response protein family
  Pfam annotation: Domain name=NPH3; Domain location=168-396; Score =163.4; E_value=5.8e-46; Accession=PF03000.5; Description=NPH3 family
TVITQYSNKFARLFGKSSGATGKLKVIFHDFPGGAEGFELMLKFCYNNGTADINPSNLFLARCAAEYMEMKEPMADVSNLLEQTEKSLQEISYWTWSDILIGLKQCQSLLVPDSSVMVERCLDTIVGRLVLASEASPCPSTSSTDSSWVRYSCDSKSTESVKTSFSRLTWWFEDLLFLSPLLVAMLVKSMLSRKMDHLVISKFLLYYQKAKFSTATTHEKCKIIEMVIDMHYDMDLSCVPCKTLFGILRVTLGLNISKCSRNKLETMIGSQLDQATLDNLLVPSPHGISYLYDVNLILRFLKAFLRRGNSLVTPIQMRKVASLIDLYIAEIAPDPCLKTSKFLALATAIPDSARDSYDELYHAMDMYLEVHTQLSQEERLKICCGLNFEKLSPQACLHLSQNKKFPSKSTVQALISQQSKLKNLLHVIPSTSSYNDSPCSSSGAAAQKGKKDKTSEQVVLYSGNFDLSTDNEKLKAHLQGMQWRVMELEKFCRKMQIQMAKITKSKASGHSYAKSLPKLCS

SEQ ID NO: 197841 - protein, 874 aa, Glycine max
  Coding DNA Sequence Number=SeqID_81063
  Gene Ontology: Mol. function=protein binding; Cellular component =membrane; Biological process=defense response
  Homolog annotation: Hit_ID=Q8GZF0; Match level="QueryCoverage=99%, HitCoverage=76%, E-value=0.0, Identity=74%"; Hit description =Resistance protein KR4
  Pfam annotation: Domain name=LRR_1; Domain location=281-303; Score =9.9; E_value=4; Accession=PF00560.23; Description=Leucine Rich Repeat
  Pfam annotation: Domain name=LRR_1; Domain location=305-327; Score =11.8; E_value=1.8; Accession=PF00560.23; Description=Leucine Rich Repeat
  Pfam annotation: Domain name=LRR_1; Domain location=328-350; Score =13.9; E_value=0.57; Accession=PF00560.23; Description=Leucine Rich Repeat
  Pfam annotation: Domain name=LRR_1; Domain location=352-373; Score =7.9; E_value=9.5; Accession=PF00560.23; Description=Leucine Rich Repeat
  Pfam annotation: Domain name=LRR_1; Domain location=486-507; Score =6.0; E_value=21; Accession=PF00560.23; Description=Leucine Rich Repeat
  Pfam annotation: Domain name=LRR_1; Domain location=509-531; Score =3.0; E_value=77; Accession=PF00560.23; Description=Leucine Rich Repeat
  Pfam annotation: Domain name=LRR_1; Domain location=564-584; Score =5.2; E_value=31; Accession=PF00560.23; Description=Leucine Rich Repeat
  Pfam annotation: Domain name=LRR_1; Domain location=586-613; Score =4.9; E_value=35; Accession=PF00560.23; Description=Leucine Rich Repeat
  Pfam annotation: Domain name=LRR_1; Domain location=693-712; Score =8.5; E_value=7.3; Accession=PF00560.23; Description=Leucine Rich Repeat
  Pfam annotation: Domain name=LRR_1; Domain location=718-741; Score =9.6; E_value=4.6; Accession=PF00560.23; Description=Leucine Rich Repeat
  Pfam annotation: Domain name=LRR_1; Domain location=815-838; Score =6.8; E_value=15; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =281-303::305-327::328-350::352-373::486-507::509-531::564-584::586 -613::693-712::718-741::815-838
MTFGTKAGLNGKLCRMLLFVELREVRSLSQHAVRKLLLPCGQKNTGWGNYKKIIAGNCLQNMHSEMIIFHEIQDAQRLSMGSLLHNKPFSGEWESLLQSEIWELKDSDIVPALALSYHHLPPHLKTCFAYCALFPKDYVFDKECLIQLWMAENFLNCHQCSKSPEEVGQLYFNDLLSRSFFQQSSKYKEGFVMHDLLNDLAKYVCGDIYFRLGVDQAKSTQKTTRHFSGSIITKPYFDQFVTSCNAKKLRTFMATRWRMNEYHYSWNCNMCIHELFSKFKFLRVLSLSHCSDIYEVPDSVCNLKHLRSLDLSHTCIFKLPDSTCSLSNLQILKLNGCRYLKELPSNLHELTNLHRLEFVNTEIIKVPPHLGKLKNLQVSMSSFDVGESSKFTIKQLGELNLRGSLSFWNLQNIKNPSDALAADLKNKTHLVELKFVWNPHRDDSAKERDVIVIENLQPSKHLEKLSIINYGGKQFPNWLSDNSLSNVVSLELDNCQSCQHLPSLGLFPFLKNLEISSLDGIVSIGADFHGNNTSSFPSLETLKFSSMKTWEKWECEAVIGAFPCLQYLSIKKCPKLKGDLPEQLLPLKKLEISDCKQLEASAPRAIELNLQDFGKLQLDWASLKKLSMGGHSMEALLLEKSDTLKELEIYCCPKHKMLCNCEMSDDGYDSLKTLPVDFFPALRTLHLRGLYNHLEVLAFRNCPQLESLPGNMHILLPSLKNLLIDSCPRVESFPEGGLPSNLKVMYLYKGSSRLMASLKGAWGDNPSLETLRIGKLDAESFPDEGLLPLSLTYLWICDFPNLKKLDYKGLCQLSSLKGLILLNCPNLQQLPEEGLPKSISHLFIDHCPNLKQRCQDPGGEDWPKIAHISTVDIR

SEQ ID NO: 197842 - protein, 555 aa, Glycine max
  Coding DNA Sequence Number=SeqID_81064
  Gene Ontology: Mol. function=RNA-directed DNA polymerase activity; Biological process=RNA-dependent DNA replication
IKQVGFFTKDLELGLFDPFKDVKNGVLLDEEEIVAENEAVDKGQGVTDQGNDACRHDDECGIFDSTGSKTLSMLRQVYGGLVKMDDIKSSQMELINRKGSPTVNLGFVEPWTGEDSPRVDLSFCEPFGGSTRELSDLGFGCHALAYMSLIMDGMLKGSWLNLCAVSPHYSEFGSFFPDPCHFWDLYARELLDTVRLVEYSTQGPKDDSVSCLCLTVGLRMFDRDEVFDCSWGLWQWSQYVRTPHGEGPSGAQTLEIVRRSMWHICKLLALFASLGKVEGVCPECWPVVVGSHHFGGKGASSSVETANPFMKLSYDIRFLVDSLEVSGLLGASQLGEQVCYGIAFLGDGDIVRVFEDDPCLTFFYVGCTVNVKVPPVWGGSYWMSNSKSSTNQVTNLPASSALLSVLEYAVGEINRELVLPFLMSRGTPGLGRLKTDGVAMVFLKARKACSQVSKNLDRDAGLPFNFWTSWTLAHPVKISVVDAHSSFAAGLFYHDTLYTILLPSSFSSVILVWPGDKWQHVSDALMLMAGEVPTKLHTLPGIRSKLHLDKLFDGF

SEQ ID NO: 197843 - protein, 308 aa, Glycine max
  Coding DNA Sequence Number=SeqID_81065
  Gene Ontology: Mol. function=RNA-directed DNA polymerase activity; Biological process=RNA-dependent DNA replication
MVSTQSSLRHETPLEDSHPHPAAMTDIDTLQQLQNHIVETERRHEEELRKLKADHDNLEACIRHPRMHHPTGQTTCRHPFVDRIVEDDIPLGWKPLTLNDEHRDAFLTHTNLYTNNDAILRCVFPTSLKGATLTWYDGLPPRSIDKFNTLIERFSAKYTTNRSHRMTLVALASLRQVDNKSLRKLMDRFGRIVVQIQNINPGVALHSMLLALRFDKFMNNLCKPPSPPVAWSSCARSTKTDLHKSNKRHKLDKHKSFPKGLKYERYTSLAVNCTTILEEAFNLETEQPPSRSKTQMTPREEPYEPQSK

SEQ ID NO: 197844 - protein, 110 aa, Glycine max
  Coding DNA Sequence Number=SeqID_81066
MPRAICEKLDQISWNFLWGDTFELKKVHWVSWEVICKPKDIGGLGVLATMVIQDLNEDDVMKKVRDVFVDGVGWCTVQGPQNTHDTLHGTLRHESTFHISFAKGARILGP

SEQ ID NO: 197845 - protein, 63 aa, Glycine max
  Coding DNA Sequence Number=SeqID_81067
ENARNWVVNMILKFNDDPTGYESEIVIFMRQVWWVTEKRKGSGEEERENEIEVISSRKSYCLT

SEQ ID NO: 197846 - protein, 407 aa, Glycine max
  Coding DNA Sequence Number=SeqID_81068
MKREFGQFSKLLHEASQIQRAINVALVKEFYANLYSSEGPSPKQPRVKGHLVKIDVDSLNTFLEILIVLEEGETLPIYSRYCRLPTDHREIEVALCIPGRGFILNAEGHLRRILKKDLTTLAQVWSVLSYSNLAPTSHTLDLTMDKARLIFGLVSHMDMNIGALILGQMTSIAQSNSFRLGLTFECLSPVINLVYIRKNCWNIDDLTVAFRGARRVRPADIPSSSTAPTPTPASTSAAPSVPAHVDLQRFEAMLQSIHQGQIILLQSLQVVAPPGSILSMEQFLERVAWLGAQPSLDREGEGPTVQVPQQVQDASSETTIPEPFTLHPEVGEEQARLETATTPERSLEGTSEPPTPVADLSSSQPASDPSTPVLDILEDQTTPVLALNTSPPATPVLHLTDKEDAQT

SEQ ID NO: 197847 - protein, 75 aa, Glycine max
  Coding DNA Sequence Number=SeqID_81069
MFRNPKTSYQAVVSLHFVPPWQCLVFLSIYGQQDPLKLLQEHSKGLDETYLGEVVKEKKHRVVTMLECDEHDARA

SEQ ID NO: 197848 - protein, 83 aa, Glycine max
  Coding DNA Sequence Number=SeqID_81070
MGGAEYNFKGCYGGSVDWHICFVEVTYQIWRLHFLGNTDCKGVMDTISDSKANVSELGSIVSECRFLQLAKFNAYKLHNSLLA

SEQ ID NO: 197849 - protein, 166 aa, Glycine max
  Coding DNA Sequence Number=SeqID_81071
  Gene Ontology: Mol. function=protein serine/threonine kinase activity; Cellular component=integral to membrane; Biological process=protein amino acid phosphorylation
  Homolog annotation: Hit_ID=Q9SHI2; Match level="QueryCoverage=94%, HitCoverage=56%, E-value=4e-46, Identity=38%"; Hit description =Similar to leucine-rich receptor-like protein kinase
  Pfam annotation: Domain name=LRR_1; Domain location=106-128; Score =14.9; E_value=0.3; Accession=PF00560.23; Description=Leucine Rich Repeat
  Pfam annotation: Domain name=LRR_1; Domain location=130-152; Score =8.1; E_value=8.7; Accession=PF00560.23; Description=Leucine Rich Repeat
  Pfam annotation: Domain name=LRR_1; Domain location=34-56; Score=9.3; E_value=5.1; Accession=PF00560.23; Description=Leucine Rich Repeat
  Pfam annotation: Domain name=LRR_1; Domain location=58-80; Score=6.6; E_value=16; Accession=PF00560.23; Description=Leucine Rich Repeat
  Pfam annotation: Domain name=LRR_1; Domain location=82-104; Score =6.0; E_value=22; Accession=PF00560.23; Description=Leucine Rich Repeat
  Pfam module annotation: Pfam domain module=LRR_1::LRR_1::LRR_1::LRR _1::LRR_1; Domain location=106-128::130-152::34-56::58-80::82-104
MKRVNWNSSSDLTPCNWTGMLHGPLLTPIWKITTLRKLYLCENYMFDEVPEELGNLVSLEELVTYSNNLTRRIPSSIGNLKQLRVIRAGLNALSGTIPAEISECESLEILGLAQNQLEGSIPRELQKLQNLTNIVLWQNTFSGKIPLEIGNISSLELLALHPLIYI

SEQ ID NO: 197850 - protein, 57 aa, Glycine max
  Coding DNA Sequence Number=SeqID_81072
MAARLNFSMAVTMGLTARQNDTNLSRKSSDVNGEEESTGEYTEKKRVPENTPGRRER

SEQ ID NO: 197851 - protein, 88 aa, Glycine max
  Coding DNA Sequence Number=SeqID_81073
MASTNFLFPEGNSMVAAIIESKNLSSMSLATLFEKLQEHEMELQRLNQNEENDKRKRGIALKVSSSIQEGSDNEDLDDEEDDSQEIKD

SEQ ID NO: 197852 - protein, 72 aa, Glycine max
  Coding DNA Sequence Number=SeqID_81074
MHETQCGPLRVHRMNRKAWFEQNRGGGCRPARPGELSSPRRARLLPPEATAFWRNILEGPSGPGCYLHPYFY

SEQ ID NO: 197853 - protein, 175 aa, Glycine max
  Coding DNA Sequence Number=SeqID_81075
  Gene Ontology: Mol. function=nucleic acid binding; Biological process= DNA integration
  Homolog annotation: Hit_ID=Q1T010; Match level="QueryCoverage=95%, HitCoverage=21%, E-value=1e-19, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MRRMPVRLKDYHMFPDGANIDEGEFVMNIALMAAIEPVKFQDAIKEKVRSNAMNEEIRAIERNKTWELVTLPIGKTPIVDEEVCIQQPPRYEVIGNEDKATKDGGVLLICLYMDDLLITGSNAIEIEKLKDNLKFEFEMSDLGLSYFLGIEFDETKDGIVMHQKKYIKEVLKRFR

SEQ ID NO: 197854 - protein, 365 aa, Glycine max
  Coding DNA Sequence Number=SeqID_81076
  Subcellular localization annotation: CTP_CleavageSite=62; ConfidenceScore=5.15e-01
MDISKPILGHGNVSMKTLYGATTNNPCVTKGHCYGGNNRGDHNSLFMTSSYSFTRTNNASLVASLPNKETNPFLTNGNCYGGNSQGDHNSLFMPPNYSFTSSNNASLVAPIPTKGISCVTKGNCYGGNSQGDHNSLFIPPNYSFTRTNNESLVATIPNKWTIPFSQYVNHPIYMGSSNNHIGHAPSVSSGISHQFDASNSQFFIDDFSIPFRSKFQNIKPNGIHLSYPIFVRNPSLPGYHMTERGLSIFPDSLKPFFVDTQTHSVSLNNIHQICERVKKHNRDKVQEKSSMMNPPKRPNINYGPLVYHEREMLQKNETLFSTKDAKLKDIDAIVFNDEGKIGSNSRSKNKVKEQEDDDLDLSLHL

SEQ ID NO: 197855 - protein, 265 aa, Glycine max
  Coding DNA Sequence Number=SeqID_81077
  Gene Ontology: Mol. function=potassium ion transporter activity; Cellular component=integral to membrane; Biological process =potassium ion transport
  Homolog annotation: Hit_ID=Q6DB92; Match level="QueryCoverage=100%, HitCoverage=54%, E-value=3e-74, Identity=87%"; Hit description=Low affinity potassium transport system protein kup
  Pfam annotation: Domain name=K_trans; Domain location=13-261; Score= -362.1; E_value=5.1e-08; Accession=PF02705.7; Description=K+ potassium transporter
MSSDKKQSLGAVTLAAIGVVYGDIGTSPLYTLRECLSGQFGFGVEREAVFGFLSLIFWLLILVVSLKYISYVMRADNAGEGGILTLMSLAGRNTGARATAILVIMGLIGGSFFYGEVVITPAVSVLSAIEGLEIAAPSLDSYIVPLAIAVLTLLFVIQKHGTGIVVSDSPGMVCGGAAVAGAQLFRPGRAAAGASGGHQKPVLPAGAGLGADSDADSRYAGHGDRLAGGDLRRILADAPGGASWLSAADAHRAHVRRGIRPDLYS

SEQ ID NO: 197856 - protein, 61 aa, Glycine max
  Coding DNA Sequence Number=SeqID_81078
  Gene Ontology: Mol. function=protein tyrosine/serine/threonine phosphatase activity; Biological process=protein amino acid dephosphorylation
  Homolog annotation: Hit_ID=Q6Z648; Match level="QueryCoverage=84%, HitCoverage=19%, E-value=2e-17, Identity=75%"; Hit description =Protein phosphatase-like
QCEKDKERVLVHCMSGKSRSPAIVIAYLMKSKGWRLVHSYQWVKERRPSVELTQGHRLTAH

SEQ ID NO: 197857 - protein, 704 aa, Glycine max
  Coding DNA Sequence Number=SeqID_81079
  Gene Ontology: Mol. function=protein binding; Cellular component =membrane; Biological process=defense response
  Homolog annotation: Hit_ID=Q8GZF0; Match level="QueryCoverage=99%, HitCoverage=81%, E-value=1e-178, Identity=63%"; Hit description =Resistance protein KR4
  Pfam annotation: Domain name=LRR_1; Domain location=206-227; Score =9.1; E_value=5.7; Accession=PF00560.23; Description=Leucine Rich Repeat
  Pfam annotation: Domain name=LRR_1; Domain location=342-363; Score =4.2; E_value=47; Accession=PF00560.23; Description=Leucine Rich Repeat
  Pfam annotation: Domain name=LRR_1; Domain location=420-440; Score =6.8; E_value=16; Accession=PF00560.23; Description=Leucine Rich Repeat
  Pfam annotation: Domain name=LRR_1; Domain location=442-472; Score =2.7; E_value=89; Accession=PF00560.23; Description=Leucine Rich Repeat
  Pfam annotation: Domain name=LRR_1; Domain location=560-582; Score =5.9; E_value=23; Accession=PF00560.23; Description=Leucine Rich Repeat
  Pfam annotation: Domain name=LRR_1; Domain location=585-606; Score =6.6; E_value=16; Accession=PF00560.23; Description=Leucine Rich Repeat
  Pfam annotation: Domain name=LRR_1; Domain location=615-635; Score =0.6; E_value=2.2e+02; Accession=PF00560.23; Description=Leucine Rich Repeat
  Pfam annotation: Domain name=LRR_1; Domain location=645-668; Score =11.8; E_value=1.8; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=206-227::342-363::420- 440::442-472::560-582::585-606::615-635::645-668
MESKFDDKAWICVSEEFNVLNISRAILDSLTDSTETSDQLEIVHTKLIDKLRGNKFFLVLDDVWNESQSKWKAVQNVGSLSRHAVRKLLLRCGQNNTACIAAITRRLLQEVVRETCISRCHELSLPSSPSQDMLCLLCFIPKDYVFDRECLIQLWMTENFLHCHQGSKSPEEVGQLYFNDLLSRSFFQQSSENKEDLPSNLHELTNLHHLEVVDTEIIKVPPHLGKLKNLQVSMSSFDVGKTSEFTIQQLGELNLHGRLSFRELPNIENSSDALAADLKNKTRFVELKLKWNLDWNPDDSAKERDAIVIENLQPSKHLEKLSIINYGVNQFPNWLSNNSLSNMVSLELGNCQSCQRLPSLGLFPVLKNLEISSIDGIVSIGADFLGNSSSSFPSLETLKFSSMKAWEKLECEAVTGAFPYLQYLSIRKCPKLKGHLPEQLLPLKKLEISECKQLDASAPRALELDLKDFGNLQLDWVSLKKLRMDGHGMEASFLEKSHTSLEGLKIYCCPKYEMFCDSEISDGCDSLKTFPLDFFPALRILHLNGFRNLHMITQDHTHNHLEHLEFGMCPQLESLPGSMNMLLPSLTLLLIDSCPRVESFPEGGNLDAESFPDEGLLSLSLTYLRIHDFRNLKKLDYKGLCQLSSLDELILVNCPNLQQLPEKGLPKSISPLSIVGCPNLNKHCQNPGGEDWSKIAHIQNLDIL

SEQ ID NO: 197858 - protein, 153 aa, Glycine max
  Coding DNA Sequence Number=SeqID_81080
MENVFALVYCNGDVIPSYEGIVFECPGDPKFITISEDMSLTALRKRIFESNGGCIILIHPFYHQPIYVGDSCVEYDCMELKGDDDVGKIFFIYSEISTKDLIELNATFGRSPNEILVLVHKPKKPRTLDEISDLMRDESELSLHKLLIDTFLE

SEQ ID NO: 197859 - protein, 133 aa, Glycine max
  Coding DNA Sequence Number=SeqID_81081
  Gene Ontology: Mol. function=methionyl aminopeptidase activity; Cellular component=chloroplast; Biological process=proteolysis
  Homolog annotation: Hit_ID=Q9FV52; Match level="QueryCoverage=72%, HitCoverage=26%, E-value=6e-40, Identity=75%"; Hit description =Methionine aminopeptidase 1B, chloroplast precursor
  Pfam annotation: Domain name=Peptidase_M24; Domain location=4-132; Score=-78.5; E_value=0.0081; Accession=PF00557.14; Description =metallopeptidase family M24
MVWKGGDMEVWVFSDGGISHEAMPSHHLTDGRNSIQNEHAEKYGYGVVERFVGHGVGTVFHSEPIIMHNRNEKAGRMIEGQTFTIEPILSMGSIDSITWPDNWTTITADGSPAAQFEHTILITKTGAEILTKC

SEQ ID NO: 197860 - protein, 73 aa, Glycine max
  Coding DNA Sequence Number=SeqID_81082
MRSLVVGEVTATLEEAIDGVEGDGDGEVGKGGRVDEGGEERVDGAKGSKLGDRMRRTTRARLLARLPQHCKRP

SEQ ID NO: 197861 - protein, 327 aa, Glycine max
  Coding DNA Sequence Number=SeqID_81083
  Gene Ontology: Mol. function=allene-oxide cyclase activity; Cellular component=chloroplast
  Homolog annotation: Hit_ID=Q711Q9; Match level="QueryCoverage=56%, HitCoverage=73%, E-value=6e-83, Identity=82%"; Hit description =Allene oxide cyclase precursor
  Pfam annotation: Domain name=Allene_ox_cyc; Domain location=149-327; Score=410.7; E_value=2.2e-120; Accession=PF06351.2; Description =Allene oxide cyclase
MASSETSSMADLLVVLGLERNGVVRDVERDNAEEEYPHVLGIVVVVVELLVVLECGEARFGRWCGIGVELEGEKGERAPLRRHSSIITINGFHGLSEDDFVPQTLPFKLFYLSPSNPKATTPQVSTSRRSTNKTTTTAFFFNNQKQHQDSSQPAKVQELFVYEINERDRGSPAYLRLSQKPVNSLGDLVPFSNKIYSGDLQKRLGITAGLCVLIQHEPEKKGDRYEAIYSFYFGNYGHISVQGAYLTFQDTYLAVTGGSGIFEGASGQVKLHQLVFPFKLFYTFYLKGVPDLPPELLGKPVEPSPSVEPSPAAMATEPHACLPNFTN

SEQ ID NO: 197862 - protein, 340 aa, Glycine max
  Coding DNA Sequence Number=SeqID_81084
  Gene Ontology: Mol. function=RNA-directed DNA polymerase activity; Biological process=RNA-dependent DNA replication
MTSSLVNAIMYYNGVITTTKHGSTFVSVSPKIVQLDNKMSLDALKQAIGNKISLPNGKVYYYTFEKLKEKFEEDQMIHISQEVNDKADELAWQETSPKPGQLKMFILHLVLEPSVSGKERLRVEENPSGWKKEIVECLSHETLPTDKGKAKKLRTQTTRLTMCSKSYMRASELCEEMTPMPKGWEFNTSAGQRTASYGLPLVVHCLGNGYSRTLPHSSKAKEIPVSDQKLNEFLGGLSVKHRVTSMEHPQTNGQAKATNKETPFWLTYRMNAMFPVEVGEVSLRRCYFIEAKNNEALWIELDLIKQALEDAVIMTEACKQRMTQCFNSKLASCQFEEGDL

SEQ ID NO: 197863 - protein, 65 aa, Glycine max
  Coding DNA Sequence Number=SeqID_81085
MEKVARQRCQNYLFDQNTCLLPLPNWYYLFLYGSGLTRKCTRLPNVLVFYAEDKNTKHRFLQSLD

SEQ ID NO: 197864 - protein, 107 aa, Glycine max
  Coding DNA Sequence Number=SeqID_81086
  Homolog annotation: Hit_ID=Q10F28; Match level="QueryCoverage=97%, HitCoverage=10%, E-value=4e-27, Identity=68%"; Hit description =Expressed protein
MAYSVSILDGVHQEFSFPEFFISGGDGLPQGVVENQVARVRHVINLHGYETRELIEDLKSASGMEMQGGKSKLGTDSKTLLRILCHRSDSEASQFLKKQYKIPSSSS

SEQ ID NO: 197865 - protein, 132 aa, Glycine max
  Coding DNA Sequence Number=SeqID_81087
MVKTRGLGHALGRVVARGLGKGDDDDSDDAPQRRVPVIVDDVVPAVPADSPAVPEAHATVVGDEPMDIGAQDATDEPEGFPGGPRDPSVLTEYLDHVAASVWSGQECPKLKLSSHGRKVHNLGRPVPAIEDM

SEQ ID NO: 197866 - protein, 166 aa, Glycine max
  Coding DNA Sequence Number=SeqID_81088
PQGPTILVKDKAKKEYISEGQPSPFELAFRVEKRALGSINLTSGTSSEENSINPYLTTQPSSGDNSTNVYSGDRFSKVVVVGTLAKVIVVVAPQAMGDMPNLFSVQCQICYKFEHGAPFCYHKLEENYVPTLPPPVLLAPAQTQTATAQTVQWTPSVLALQQVQEV

SEQ ID NO: 197867 - protein, 415 aa, Glycine max
  Coding DNA Sequence Number=SeqID_81089
  Gene Ontology: Mol. function=protein binding; Cellular component =membrane; Biological process=defense response
  Homolog annotation: Hit_ID=Q8GZF0; Match level="QueryCoverage=96%, HitCoverage=51%, E-value=1e-106, Identity=69%"; Hit description =Resistance protein KR4
MLHLPGGQNNTTCSNYKKIIAGSCLPNMHFMMIILNQIQDWENILKSEIWEIEDSDIVPALAVSYHHLPPHLKTCFAYYTLFPKDYEFDKECLIQLWMAENFLHCHQGSKSPEEVGQQYFNDLLSRYLKEQPSNLHELTNLHRLEFVNTKIIKVPPHLGKLKNLQVSMSSFDVGKTSEFTIQQLGELNLHGRLSFWELQNIENPSDALAADLKNKTRLVELELEWNWNRNPDDSAKERDAIVIENLQPSKHLEKLSIRNYGVAQLSILPTFAFPWTFSISQEPRDFKSSLDGIVSIGADFHGNGTSSFPSLETLKFSSMKAWEKWECEAVIGAFPCLQYLSISKRPKLKGDLPEQLLPLKKLQISECIQLEASAPRALELDLKDFGKLQLDWASLKKLRMGGHSAETSLRKSLIL

SEQ ID NO: 197868 - protein, 62 aa, Glycine max
  Coding DNA Sequence Number=SeqID_81090
  Homolog annotation: Hit_ID=Q1S7C5; Match level="QueryCoverage=100%, HitCoverage=5%, E-value=1e-09, Identity=50%"; Hit description =Integrase, catalytic region
MSFNHFELGPERKNNKSGVGNLEFRKKRLYPSHLCCNESHAPVFCLSVGSGHDRLLLGSPRD

SEQ ID NO: 197869 - protein, 185 aa, Glycine max
  Coding DNA Sequence Number=SeqID_81091
  Gene Ontology: Mol. function=methionyl aminopeptidase activity; Cellular component=chloroplast; Biological process=proteolysis
  Homolog annotation: Hit_ID=Q9FV52; Match level="QueryCoverage=83%, HitCoverage=40%, E-value=3e-31, Identity=49%"; Hit description =Methionine aminopeptidase 1B, chloroplast precursor
  Subcellular localization annotation: CTP_CleavageSite=71; ConfidenceScore=5.76e-01
MALTASLAHNSFLKIPTAIHSEASPLCSSFMGSPPTLSRSSTLPGNQSLSRNQFVVFARKISGLEEAMNIRRSSPVYRDRELQVVTKFKKRPPLRCGRVSPRLPVPDHIPRPPYVGSDILPEIASEHQVHDYEGIAKMRAAGELAARVLNFAGTMVRGSGFFIHLDTGADYHDYFFLFLLESITN

SEQ ID NO: 197870 - protein, 875 aa, Glycine max
  Coding DNA Sequence Number=SeqID_81092
  Gene Ontology: Mol. function=RNA-directed DNA polymerase activity; Cellular component=chromatin; Biological process=one-carbon compound metabolic process
  Pfam annotation: Domain name=Chromo; Domain location=685-734; Score =20.6; E_value=0.0036; Accession=PF00385.14; Description='chromo' (CHRromatin Organisation MOdifier
  Pfam module annotation: Pfam domain module=Chromo::RVT_1; Domain location=685-734::52-221
  Subcellular localization annotation: CTP_CleavageSite=59; ConfidenceScore=5.14e-01
SSSLFSLPYYLSRGAGLEPSFLLNNFGALVESRTQVRNRIMLQKGLIQPSTSPFSSLILLVKKSGGSWRFCVDYRALNAITVWDQFLIPTIDELLDELEGARCFSKLDLLQGYYQIRMHLEDVPKTAFRTHHGHYEFCIMPFRLCNAPSSFQTTMNNLFCPYLWQFIIVFFDDILIYSACPDDHLRHLELTFQVLSDNQFALKITKCFFAQNQVEYLGHLVSHKGVEPLASKVEAIQQWRTLRTVREVRSFLGLVGFYRRFIYGYASIAAPLVQAPILALPDYEHPFIVETDALGIGMGAVLSQRNQPITFFSKPFPLKFLNASVYVRDYSSSEKMETVFTGSLLHNHHLSHELERAINSVHLDSQPDPAKRSSMAPKRISHDSYTISGISHHPHRRAHGRDKKKTNRLLENFDCPGLRQDVIDFVSKCLDCQHVKYETKRTVGLLCPLPIPYRPWEDLSLDFIIGLPPFRGNTIILVVVDRFSKGIHLGMLPAAHTAHSVAAPGTQLRMSSAYHPQSDGQTEVLNRVIECLCAFVHGRPKEWEYIKGASTLDVVDEMLTNREETFQVIQKKLLRAQERMKLVADTKRREVHYQPGDWVMLKLCPYRQVSEKGTHAISGKLAKRFYGPFQVLERIGPVAYRLKLPEEARINFVFHCSMLKPFKGSPHEVPRAELPTKLIQHQPLISPLALLDYRRTSEHALLEVLVQWEGLPPDDTSWEFWEQLCEDFHLEDKVNLHGPTDDTKQGEAEATNSESFKHRSWHGAVTEGEALRCVGVYLKVHRHAEREFSVKVVTAERVDVAVRGYVNGIREPMPLAGLNCPIKTNVVEAMRELKLENTLGMRGKLTSFSIVYLQVLAPRVVAASFWWWMMGFVWF

SEQ ID NO: 197871 - protein, 103 aa, Glycine max
  Coding DNA Sequence Number=SeqID_81093
  Gene Ontology: Mol. function=protein binding; Cellular component =nucleus; Biological process=regulation of progression through cell cycle
  Homolog annotation: Hit_ID=Q39880; Match level="QueryCoverage=47%, HitCoverage=11%, E-value=2e-19, Identity=95%"; Hit description =Mitotic cyclin b1-type
  Pfam annotation: Domain name=Cyclin_N; Domain location=35-103; Score=- 13.7; E_value=0.0024; Accession=PF00134.13; Description=Cyclin, N -terminal domain
MVAKTDVSGGGEGRNGGLQVGGLNKQKNMGGEGRNRRKSSTEVNNGAVLATDGVDINAKMRSILVEWLIEMHRKFELMPETLYLTLNIVDRFLSVKAVPRREL

SEQ ID NO: 197872 - protein, 67 aa, Glycine max
  Coding DNA Sequence Number=SeqID_81094
MDQERMQRGNQEDWMLNETDCKRGKQGEFSVCATYFYILGRDFSLRSVISGRVSQGVSTLVVSIFFL

SEQ ID NO: 197873 - protein, 168 aa, Glycine max
  Coding DNA Sequence Number=SeqID_81095
MMTLASQVENLTSLTKFSLRSLSTSSLILRVGDVPVLVTGEASIEGVISRIYVKFTAQAGLVDGCGSDLRPFVHDHDLSAFSRSLTVTISPISVGNFIFKWGVESIAPSSLSISDGKAPRELVLTKGSHQVQSLEGFLVQDINGNALVDKELGHHEIRNDDGDGHGVV

SEQ ID NO: 197874 - protein, 256 aa, Glycine max
  Coding DNA Sequence Number=SeqID_81096
  Gene Ontology: Mol. function=DNA binding; Biological process=DNA integration
  Pfam annotation: Domain name=rve; Domain location=87-244; Score=-5.7; E_value=0.018; Accession=PF00665.16; Description=Integrase core domain
MANDECAPTTLVYVDDIVIKSQNIHQHLADLEEVFGELCKYDMCLNPIKCTFKPTLRADALDFTRRYNQCQEFANMPRTPNNLHSLSSPFPFAIWGMNIPRPLPNAPGAVKYLLVIIDYFTKWIETIPLWEITANEVEKFTWKHPTYKYNLPYAIVFDNGWNLKPPKKSKKWQGLEKKLPNSEQQGNRIQRFNHEPFNPTFSYGESEVKPKKIPERESLAPTGKVLSGSQPTLTTEHTDYKRWRAKQFQEHGMSHT

SEQ ID NO: 197875 - protein, 51 aa, Glycine max
  Coding DNA Sequence Number=SeqID_81097
MSLVMGGMYWSHNGGMYWSHNARRRAYQGWTLGFKSLRGTTMDALVLIRKM

SEQ ID NO: 197876 - protein, 272 aa, Glycine max
  Coding DNA Sequence Number=SeqID_81098
  Gene Ontology: Mol. function=RNA-directed DNA polymerase activity; Biological process=RNA-dependent DNA replication
  Homolog annotation: Hit_ID=Q1SFQ9; Match level="QueryCoverage=48%, HitCoverage=46%, E-value=1e-28, Identity=49%"; Hit description=RNA -directed DNA polymerase
MASSKKRRNNIKRFVANNGNIVSDAKGLCEVRSGIGMYVDKISFNSVHFGWSKVDLGVIEAMMLKMGFSGKWLGWIFMCLKLVVYSISINVDKATEVEATRMQHILRTYEEASGQAINFTKSEIFFTRNTGQKVQSKFIEIMGVIDCLGTGRLLATSKTEFGRESNLGVEGGCLELERKSLSNTKGDASHGINWLKWDKLTISKGGGGMGYFPNSSFLEALMGNNPSYSWRSLWSSGEIVKDGDSWRVGNVLSISVSKDPWLREKESAFIST

SEQ ID NO: 197877 - protein, 119 aa, Glycine max
  Coding DNA Sequence Number=SeqID_81099
  Gene Ontology: Mol. function=oxidoreductase activity
  Homolog annotation: Hit_ID=Q9LJI8; Match level="QueryCoverage=95%, HitCoverage=27%, E-value=3e-19, Identity=46%"; Hit description =Arabidopsis thaliana genomic DNA, chromosome 3, P1 clone: MZN14
MGEVVESESYSSDGVHELELLLSFLNDSSIEACSQGDVVGILLFSGLTDSFAYLNSKEPISQAVTDKKGDIITSLQSRLYIICDEVDVDSGNKYYVQNQVSNEISAEKPVPQLVLHLLG

SEQ ID NO: 197878 - protein, 89 aa, Glycine max
  Coding DNA Sequence Number=SeqID_81100
MVDEDVAKMAFCTHQEPLSLIIFIIYNWSFILCHKVNSTSSVPNACLMAFEQLKLTMMAAPVLALPDFSMPFTLETDASGITMGVVLMQ

SEQ ID NO: 197879 - protein, 92 aa, Glycine max
  Coding DNA Sequence Number=SeqID_81101
MGPKSTLRLIRTLRPSLASLAQSTWSFSIQCPCGVGLHHSLPLEKDLTSNPEMLGADNRKVSLHAIGLTGHDSRMGWSTKAGLLLLRILNLR

SEQ ID NO: 197880 - protein, 205 aa, Glycine max
  Coding DNA Sequence Number=SeqID_81102
  Gene Ontology: Mol. function=1-phosphatidylinositol-4-phosphate 5 -kinase activity; Biological process=phosphatidylinositol metabolic process
  Homolog annotation: Hit_ID=Q8L796; Match level="QueryCoverage=27%, HitCoverage=7%, E-value=3e-17, Identity=70%"; Hit description =Phosphatidylinositol-4-phosphate 5-kinase 2 (EC 2.7.1.68) (AtPIP5K2) ...
  Homolog annotation: Hit description=(1-phosphatidylinositol-4 -phosphate kinase 2) (PtdIns(4)P-5-kinase 2)
  Pfam annotation: Domain name=MORN; Domain location=13-36; Score=17.7; E_value=0.026; Accession=PF02493.10; Description=MORN repeat
  Pfam annotation: Domain name=MORN; Domain location=37-59; Score=5.4; E_value=1.5; Accession=PF02493.10; Description=MORN repeat
  Pfam module annotation: Pfam domain module=MORN::MORN; Domain location=13-36::37-59
MSGKYLWSNGCMYEGEWKKGKACGGKGRFSLPSGVTYEGEFTVGRMHCHSTFIGIDDDMSPIESAYWARNAMPTLQRSPCGSVDGDVKESGHTEPMELAAICGIIPMTVVLKDDAEMVKELNVVNMAGEGDHVVIILGGYRGAWDTRYCIIVNGNVLWERPLPEGTNHWHHSELHGAVVAMEAVSLTTGKVVRLPPLQHKLEALS

SEQ ID NO: 197881 - protein, 176 aa, Glycine max
  Coding DNA Sequence Number=SeqID_81103
  Gene Ontology: Mol. function=electron carrier activity; Cellular component=membrane; Biological process=electron transport
  Homolog annotation: Hit_ID=Q9XIL1; Match level="QueryCoverage=83%, HitCoverage=57%, E-value=2e-40, Identity=52%"; Hit description =Expressed protein
  Pfam annotation: Domain name=Cu_bind_like; Domain location=65-160; Score=5.6; E_value=1.6e-05; Accession=PF02298.8; Description =Plastocyanin-like domain
MGAKFGHGVMILFVISASMFSMSMANKDWSFGFNYTDWWSRFGNHAQNKTQQPPRQILVGGSEHWHYGFNYTDWAFKNAPFYLNDTLVFKYDAPNATSFPHSVYMIKSFGSFMKCDIEKAKMLANPTQGTGESFKFVLKRWQPHYFACGERNGFHCNNGTMKFAVMPMLRPFWRWP

SEQ ID NO: 197882 - protein, 72 aa, Glycine max
  Coding DNA Sequence Number=SeqID_81104
MGFLTVCGLVCSSLPCILVIVRVRALCQVGAGEHVGAGEQRDAGEQGDADAGEQRDGGEQRDTDAAGEQRDG

SEQ ID NO: 197883 - protein, 433 aa, Glycine max
  Coding DNA Sequence Number=SeqID_81105
  Gene Ontology: Mol. function=nucleic acid binding; Cellular component= membrane; Biological process=DNA integration
  Homolog annotation: Hit_ID=Q1ST43; Match level="QueryCoverage=94%, HitCoverage=36%, E-value=1e-111, Identity=47%"; Hit description =Integrase, catalytic region; Peptidase aspartic, catalytic
MPVPNNIDSDPLNLEQSPNITKRSLRQTHRPSKFKDFHVSYPTSTVASYSTEALNAEIKALEINDTWVLTDMPQHKNVIGCKWVYKIKHISDGSVERHKAILVVKGYTQVEGQDYLDTFSPVAKLTTVRLLLGLAATNKWYLKKLDVNNAFLHGDLNEEVYMMLPQGIQVAKPEQVCKLQRSLYGLKQASRQRYARLSSFLISHGYKQCASNHSLFLKHGFNIITTLLVYVDDIVLSGNDLIEIQGITQLLDNAFKIKDLGDLRYFLGFELVSTPSDYATKLHQQSGTPLSLEDASSFRRSITGYAMCIGDSLISWKSKKQANVSRSSSKAEYKALANTICELQWLTYLLEEFKVDFQKPATLYCDNKSSLHIVVNPVFHERIKHIEIDCHIVGEKVLSGLVKLLPIPSTHQLVGVYTKALMSGAFKFLHSKL

SEQ ID NO: 197884 - protein, 66 aa, Glycine max
  Coding DNA Sequence Number=SeqID_81106
MDKPFSIIGPLCGKAFRSLWRRVLLVGETRVVENTRLERGWWKFCKEARGVQMIVIRKVSVREGTG

SEQ ID NO: 197885 - protein, 109 aa, Glycine max
  Coding DNA Sequence Number=SeqID_81107
MKLRGMGGVSLKTDLAEQPLIDHIDNEKNVIEQPPIDNTDNGVEQPPRDDTGNGENVIEQPPINNTDNTNSHNFNQELEDNILEIGVEVNVGHNNTSSEVPTNIYDPGL

SEQ ID NO: 197886 - protein, 311 aa, Glycine max
  Coding DNA Sequence Number=SeqID_81108
  Gene Ontology: Mol. function=nucleic acid binding; Cellular component= beta-galactosidase complex; Biological process=DNA integration
  Homolog annotation: Hit_ID=Q1S4N1; Match level="QueryCoverage=93%, HitCoverage=23%, E-value=1e-120, Identity=72%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
KVKVYLLKKALYGLKQAPRAWYSKIDDHLLSIDFKKSLSEAILYVKHQSNEVLMISLYVDDLLVTGNNAGMIQEFKQEMMKVFEMTDLGLMTFFLGLEIKQAEYEVFICQKKYVKEILKKFKFQECKELCKEDGADKVDEGYFRSLIGCSMYLPTTCPGILNAVSILSRFMHCASELHLRAAKRIIRYVKGTSDFGVKFTWSKEFKLVGFSDSDWGGSINDMRSSTSGYYFTLGSSVFSWSSKKQEIVAQSTVEAEFIAATIVVNQALWLRKILMDLNLEQKESTKIFVDNQAAIAISHNPVFHGKSSIST

SEQ ID NO: 197887 - protein, 243 aa, Glycine max
  Coding DNA Sequence Number=SeqID_81109
  Gene Ontology: Mol. function=glutamyl-tRNA reductase activity; Biological process=tetrapyrrole biosynthetic process
  Homolog annotation: Hit_ID=Q6AVG1; Match level="QueryCoverage=88%, HitCoverage=54%, E-value=1e-88, Identity=67%"; Hit description =Expressed protein
  Pfam annotation: Domain name=DUF266; Domain location=1-115; Score =177.5; E_value=3.3e-50; Accession=PF03267.4; Description=Arabidopsis protein of unknown function, DUF266
MVFNFDVVTVRPRIEISNQPSPSQVAEWGMMRMCDAERRFMANALLDISNEWFILLSESCIPLQNFSIVYLYIARSRYSFMGAVDEPGPYGRGRYDGNMAPEINMSDWRKGSQWFEINRELALRIVEDNTYYPKLKEFCKPHKCFVDEHYFQTMLTINTPHLLANRSLTYVDWSRGGAHPATFGKDDIKEEFFKKILQDQTCLYNNHPSSLCFLFARKFAPNALGPLLDIAPKALGIGKRHSF

SEQ ID NO: 197888 - protein, 123 aa, Glycine max
  Coding DNA Sequence Number=SeqID_81110
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P09044; Match level="QueryCoverage=70%, HitCoverage=19%, E-value=4e-34, Identity=86%"; Hit description =Glyceraldehyde-3-phosphate dehydrogenase B, chloroplast precursor
  Pfam annotation: Domain name=Gp_dh_N; Domain location=1-86; Score= -18.6; E_value=5.2e-08; Accession=PF00044.14; Description =Glyceraldehyde 3-phosphate dehydrogen
MLGTFKEDVKILDNGTISVDGKPIKVVSSRDPLKLPWAELGIVIVIEGTGVFVDGPGAAKHIQAVAKMVIITAPAKGAAIPPYVVDIMFFLRLRKGTVSLDAMLTTGHAVEIKRLYGAGYDHN

SEQ ID NO: 197889 - protein, 327 aa, Glycine max
  Coding DNA Sequence Number=SeqID_81111
  Gene Ontology: Mol. function=nucleic acid binding; Cellular component= nucleus; Biological process=DNA integration
  Homolog annotation: Hit_ID=Q1SLU0; Match level="QueryCoverage=92%, HitCoverage=35%, E-value=1e-112, Identity=59%"; Hit description =Peptidase S8 and S53, subtilisin, kexin, sedolisin; Integrase, catalytic region
  Pfam annotation: Domain name=rve; Domain location=18-165; Score=61.4; E_value=2.9e-15; Accession=PF00665.16; Description=Integrase core domain
  Pfam module annotation: Pfam domain module=RVT_2::rve; Domain location=234-327::18-165
MPDYPQIVNQWQSIKGIIDIMPTHTDICGPQKTPSLAGNRYYAAFIDDFTRMCWIFFLKFKSEVAGAFWKFKKAVENQSGKQIQILRSDNGKEYTSIKFNQFCEEADIEHQLTTPYTPQQNGNKRDKLDKRASPGIFISYSTVTKAYKIFQPQTGSIVVSRDVHFVEDEEWNWDELKSLASRIEEEEDWQSELVDDAPARGTRSLSDIYERCNIVICEPADFEAAKKDQNWMAVMKEELSMIEKNRTCELVDRPQDRKVIGVKWVYRTKLNVDGSINKHKARLVVKGYAQIFGVDYLDTFALVTRLDTIRILLAVAAQMNWKVYQLD

SEQ ID NO: 197890 - protein, 152 aa, Glycine max
  Coding DNA Sequence Number=SeqID_81112
MASSLWSQLHCVDLVAPTNMRWVTHFIHPLLLEKDEGLDANNEVTRVVTRGACGVCRLGFRGRRGCIWCRLGARGKGGIGLGFKVEESVDGGMGSDFGVEGEGVGGGVKVFGSFFEGVENTVLIYENENVQYKEKGGWDENLWCLIFFFYTL

SEQ ID NO: 197891 - protein, 79 aa, Glycine max
  Coding DNA Sequence Number=SeqID_81113
  Homolog annotation: Hit_ID=Q1SRS8; Match level="QueryCoverage=83%, HitCoverage=19%, E-value=7e-20, Identity=68%"; Hit description=Amino acid/polyamine transporter II
MQATLAPPVEGKMLKGLCVCYVVVALSFFSVAISGYWAFGYQAAGLIFSNFVDDYSKPLAPKWLIYLPNICTIAQLLHV

SEQ ID NO: 197892 - protein, 49 aa, Glycine max
  Coding DNA Sequence Number=SeqID_81114
MELKLQEQKRSSIKSALIDTKLQGLIGHDASDRVMGWKGRQKRTSGIES

SEQ ID NO: 197893 - protein, 137 aa, Glycine max
  Coding DNA Sequence Number=SeqID_81115
  Homolog annotation: Hit_ID=Q9T052; Match level="QueryCoverage=37%, HitCoverage=6%, E-value=8e-18, Identity=80%"; Hit description =Phospholipase D gamma 3
MFHCSNNLRTHNITVLDNKVNFRSKMCNGDIEMLCPNRVLTVSDDKSSGNHNTGTRGRKDTEPVLETNNEGNKRTKQIHNKNKFKQRSIIQLTETKLTTKLVTTSTSSSQMHKNSNMKQRKNQSRREDVGICSESIP

SEQ ID NO: 197894 - protein, 140 aa, Glycine max
  Coding DNA Sequence Number=SeqID_81116
MEKELIVGAIVAASLQVAIDRLASRPVLNFFRRRKLDDLRKLKEKLRTMVDNNRKAWLDEVKDALFDAEDPLNVIDYEFFECELEAEFESQTKALQFQDQPSSSWELVEKREKHKSQECVNDNSCQIVEEYNLHQSRASQ

SEQ ID NO: 197895 - protein, 71 aa, Glycine max
  Coding DNA Sequence Number=SeqID_81117
MAYDGAGPVGGSSSTSTIKQVFTWYGATIEMDGATETDYTADEKFFFCSNNVELYKVLLKELAGMIDRQFT

SEQ ID NO: 197896 - protein, 77 aa, Glycine max
  Coding DNA Sequence Number=SeqID_81118
MVMTGPMQIVNDNDDFLHMLIQGKVASPNDVLHFLSPHYGHPGRGAITSNQPNKSLSGRASMTAAPQLEFEQRKSAK

SEQ ID NO: 197897 - protein, 166 aa, Glycine max
  Coding DNA Sequence Number=SeqID_81119
  Homolog annotation: Hit_ID=Q9SLZ4; Match level="QueryCoverage=98%, HitCoverage=15%, E-value=5e-77, Identity=85%"; Hit description =Retinoblastoma-related protein
MGNGTSEEAERYWFAFILYSVKKLIQKNEEGGKEDAENTGLSLCRILRAAKLNIADFFKELPQFVVKAGPTLSNLYGTDWENRLEAKEMHANAIHLKILSKYYKRVFGEFFVSTDTNAEKNSSITVHASEYHRFGWLLFLALRVHAFSRFKDLVTCTNGLISILVS

SEQ ID NO: 197898 - protein, 45 aa, Glycine max
  Coding DNA Sequence Number=SeqID_81120
MEDGKPMNGGDQVESRFVEFCKRGKARINVLEMSDMDKENELSEA

SEQ ID NO: 197899 - protein, 297 aa, Glycine max
  Coding DNA Sequence Number=SeqID_81121
  Gene Ontology: Mol. function=methyltransferase activity; Cellular component=cellulose and pectin-containing cell wall
  Homolog annotation: Hit_ID=Q1SBL8; Match level="QueryCoverage=64%, HitCoverage=31%, E-value=4e-71, Identity=63%"; Hit description =Putative methyltransferase
  Pfam annotation: Domain name=DUF248; Domain location=168-297; Score= -291.3; E_value=3.3e-08; Accession=PF03141.7; Description=Putative methyltransferase
MIELRELDTALAILRQTQLMGAMKQEQPERYLCLEHLVIRTYFDPSENFSFIGFSALATEVTIIPPSSLMTLIGQALKWQEHQGLRGYYHPINICCARSGCFFYLLGAWQRSGSRKGDNLALKVNNLMTDCTVLPNLSFESHDSDVEIVKPDVQKPKAFKPCDMKYIDYTPCQEQDQMKFPIKNMIYRERHCPSENEKLHCLIPAHKGYMTPLPWPKSRDYSYYANVPYKILTVEKAVQNWVQFLGNVFKFPGGGTMFPQGADVYIYELVSVIPITDGSIRTTLSTGCCWIKWSQNN

SEQ ID NO: 197900 - protein, 220 aa, Glycine max
  Coding DNA Sequence Number=SeqID_81122
MKQELKEAIKMELSQMASQHSPPVEAPDLQVLVAHVEGDHCTHLVALGKIYDGVSTIHNVPYGDDVVKMYKYPFFITYFHVNEIISGEKCLNISILQLWMMFMDDWSTSLGHILVYGFFEPQSMHNGKDRCNQCQHYIETWVKESQRQVYLRAYLNHEMKTLNSTSVGKFQQPTPHSIEVKSHVHTIGYECGYYVMHWILNIVSGGLKNEWTKCLVMEHR

SEQ ID NO: 197901 - protein, 38 aa, Glycine max
  Coding DNA Sequence Number=SeqID_81123
MGYTEEELATGSFVEAERKKGSKQGYENSQVDSKLQNG

SEQ ID NO: 197902 - protein, 132 aa, Glycine max
  Coding DNA Sequence Number=SeqID_81124
  Gene Ontology: Biological process=cell cycle
  Homolog annotation: Hit_ID=A0ELU7; Match level="QueryCoverage=42%, HitCoverage=8%, E-value=6e-11, Identity=62%"; Hit description=Cullin 1-like protein C
MVDDSPKGIQDASLNSTQLENPQIKPIGLPSVEEIHGQDILNNCAVRSVFSGVLDQNNWYNMWSRPWHQILTFLRDSQVYMEVRVNARKGVIVVGEQIDRSLLNNVLDIFVEIGMGEMDQYEQDFEHRLRIA

SEQ ID NO: 197903 - protein, 130 aa, Glycine max
  Coding DNA Sequence Number=SeqID_81125
  Homolog annotation: Hit_ID=Q5RZZ9; Match level="QueryCoverage=62%, HitCoverage=6%, E-value=2e-11, Identity=48%"; Hit description =Pyruvate orthophosphate dikinase
MKLKFGEALKHIPWKKDSYPTDRIILQNTDDGQIRTEIYVPKPEFQKVEDLVDDHSALEQDWEDYNAQLMEELLHKKRYPYHHPVYGSLARSKDPSTYKDKVIAIGLPASPGAAVGQVVFTANDAEEWHA

SEQ ID NO: 197904 - protein, 47 aa, Glycine max
  Coding DNA Sequence Number=SeqID_81126
MDNNNPGLSEPFVLLQHQALNRYCSFGKCDQSTIRNKAAPAKAQLLQ

SEQ ID NO: 197905 - protein, 161 aa, Glycine max
  Coding DNA Sequence Number=SeqID_81127
  Gene Ontology: Mol. function=protein binding; Cellular component =nucleus; Biological process=negative regulation of ethylene mediated signaling pathway
  Homolog annotation: Hit_ID=Q2PQJ1; Match level="QueryCoverage=98%, HitCoverage=30%, E-value=8e-31, Identity=45%"; Hit description=EIN3 -binding F-box protein 1
  Pfam annotation: Domain name=LRR_1; Domain location=104-127; Score =7.7; E_value=10; Accession=PF00560.23; Description=Leucine Rich Repeat
  Pfam annotation: Domain name=LRR_1; Domain location=130-154; Score =3.4; E_value=67; Accession=PF00560.23; Description=Leucine Rich Repeat
  Pfam annotation: Domain name=LRR_1; Domain location=52-79; Score=6.3; E_value=19; Accession=PF00560.23; Description=Leucine Rich Repeat
  Pfam module annotation: Pfam domain module=LRR_1::LRR_1::LRR_1; Domain location=104-127::130-154::52-79
MSMLSPCESLRSLVIQKGTGFGSASLAMIVQIVSPTLTSNIVSALVKIHGGTLELLNLDGCWKITDASSVAIAKNFIVINDLDVSKCAITNAGIAILSRANQPSLQVLSLSGCSDVSNKSAPFLTKLGQTLLGLNLQNCNSIGSDIMELLVEKLWRCHILA

SEQ ID NO: 197906 - protein, 146 aa, Glycine max
  Coding DNA Sequence Number=SeqID_81128
MGEVEEVQEQMKADMEAMKEQMATMMEAMMSTKKIMEANAVAVAATSAVAKVNLTPPSGLNQMNHPTSDMVSKDLGSTGGPHDVKIQNELPSCHMTCLPTIHHPMWRTLPMRMSITPLPYSLRADDLIMHMSLNPWGRHMKYPTTI

SEQ ID NO: 197907 - protein, 120 aa, Glycine max
  Coding DNA Sequence Number=SeqID_81129
MGFLMLVEGDEDAQNKRGRLRVHRSFSFSFFFLSLISLNFSQCWTLEPFTQPPSCLFIAKDGIWGHGSSPRRAGYFTPKLFGAPGEPEASLGEPGFRKKLKMTLFPLSLVIFHILDQNIE

SEQ ID NO: 197908 - protein, 424 aa, Glycine max
  Coding DNA Sequence Number=SeqID_81130
MDGVGYLAGPPKLGLIAGSATLVTLKGQLCEWSVADKGNPNKAIEVSSYVRSSVEASCSDNASIIAKITIGDFKEVSVNYSPKDNKPIHLCCYRMDAYERSDWVFLENESSINMPTTRDFFYVYDCIFRNLNIELPFDDFTMSILYILNMAISQLHLNGQKKKISSTLEEIDEKYGRKSIEEGLDSLLDVQSRFPTKPFVLLFKSSALFKDMRVILLSFESLALLSGMPQWFSLPILFCHCVLLPKRIRRKRIIERQRRRLDFGRDILQGVDASFALAINEVEEGVGGDEQGNKSSPSCKYRKLKREKDLMVALKCEVDAFKESLIKAQEEIKQGKEQYQFLMRGSREKVIMEHNVSFNKALRQVDHKFMIPHDAEFDILMDIHEGTLMGIQKGNLATIKVRPYPNKGIWKGILTTIKGFSLVK

SEQ ID NO: 197909 - protein, 116 aa, Glycine max
  Coding DNA Sequence Number=SeqID_81131
MKSFGSVTGFVLPDPKNRLLLWSVLILVSLISGAYFVGNAFFAKEYKQRLARWGLIHTMPHSKFNACKRQCLPFGSEALPEGIIARTSNLEMRPLWDSGKDNIVQIRLLDNNDLLH

SEQ ID NO: 197910 - protein, 269 aa, Glycine max
  Coding DNA Sequence Number=SeqID_81132
  Gene Ontology: Mol. function=RNA-directed DNA polymerase activity; Cellular component=nucleus; Biological process=RNA-dependent DNA replication
MKGPIELLMRFDTKKDEYIDVIVKYMVIHVSTSYNILLGQLSINAIGAIVFAPHLTMKLPMDDGSIVMEVARSVITQVLDVNADLFAWLIVNMPSMDPNYHCHRLSICRDAKPVMPFGIKNANATYQCLIDKIFKEQIGNNMEVYVDDMVVKSNDAEPHACDLEEIFAQIRKYNMRLDPEKIVFRVGGEIFLGFMLSHRGIQENSDKCQVVIDIRSPKNIKEIQRIIGQIASLTSFLPNIAEKAKHIMNLLKRAKDSNGIRGARMPFKH

SEQ ID NO: 197911 - protein, 202 aa, Glycine max
  Coding DNA Sequence Number=SeqID_81133
MPRQKISTGALPDVQIPRMLSDSMDTGNPLVVVPSFQKKGKSEEKRKGDEERAYSGRNIDPVKRKTMREGIGEWDFVGDSLSPAVSSEPSASWIKGLASALSLRVITPYILVMPSSVNAKAKVDKLLSIVVNGLVSATTIVLTYVILYGKGVSLPRDGDQQRGVVEETMVVRKEKKNASREKLPPTTANGGRKVAGREEEYI

SEQ ID NO: 197912 - protein, 133 aa, Glycine max
  Coding DNA Sequence Number=SeqID_81134
MESSYSRSIPLKSALVKVHPPPAKPPSMGVSPLWHHQYFSGNDLFQDPLPASTKCNYCSKLLVVLVSSSNCMNLAARHRRSSKSDVGFLQRLLTKGPGRNVITSLGVNEVLTRLDRQVTFCKWLACSMLDTFT

SEQ ID NO: 197913 - protein, 160 aa, Glycine max
  Coding DNA Sequence Number=SeqID_81135
MGCGEGRCTKHYPYKWDRGTQQHPSPQGHEGTRKQAYLAPLPIPMCMGPPRTSTHTVPALECWLCWWLEMVLVCEERWMKSDILAYVVNVCKHKELTSYPIAQRLFAMRRALGSPTTTTSFCGVTLPRFLSIGIRDFHHGSQMQMSSVGGDVGIAVFACD

SEQ ID NO: 197914 - protein, 86 aa, Glycine max
  Coding DNA Sequence Number=SeqID_81136
MNSITRSGSLSIILVVFFSLHFILGFSDDSSPASKDATKTEPHAGRSTSAIVIILWRKKKREEQYARLLKLFEEDDELELELGLRD

SEQ ID NO: 197915 - protein, 328 aa, Glycine max
  Coding DNA Sequence Number=SeqID_81137
  Gene Ontology: Mol. function=catalytic activity; Biological process =metabolic process
  Homolog annotation: Hit_ID=Q9M4H5; Match level="QueryCoverage=98%, HitCoverage=96%, E-value=1e-129, Identity=73%"; Hit description =Putative ripening-related protein
  Pfam annotation: Domain name=Hydrolase; Domain location=10-282; Score= 23.6; E_value=0.00054; Accession=PF00702.16; Description=haloacid dehalogenase-like hydrolase
MEYMNQRPKYDCLLFDLDDTLYPLSTGLAKACGQNIKGECLFANKVLGNVFIVLLFIGVADTSGTIDPDYMAEKLGIEKSKIDDLSNLLYKNYGTTMAGLRAIGYDFDYDEYHSFVHGRLPYENLKPDPVLRNLLLSLPYRRLIFTNSDKVHAVKALSRLGLEDCFEGIICFETLNPIHKSTVSDDEDDIEFVGGSGTTNPTTKKDASSFQIFDIIGHFAQPNPHTVLPKTPIICKPSENAIELALKIANLNPQRTLFFEDSVRNTQAGKRVGLHTVLVGKSQRIKGADYALESIHNLREAVPELWEDDIKSEVAYPGKLAVETSVTA

SEQ ID NO: 197916 - protein, 33 aa, Glycine max
  Coding DNA Sequence Number=SeqID_81138
MAYETSSMSWILRLEKKIKLGPKCEGIQRQSGK

SEQ ID NO: 197917 - protein, 148 aa, Glycine max
  Coding DNA Sequence Number=SeqID_81139
  Gene Ontology: Mol. function=RNA-directed DNA polymerase activity; Cellular component=chromatin; Biological process=chromatin assembly or disassembly
MASPMDIQGPMGIFGPHWVLSLLYQRIAFYKLKDTVSSVPTLQLLNFSKPFMVETDASGTWIGDVLSQSGAYESDHPNPRVTIVSRSSSWESHLVAQWPQPYPIIIDGVPYFTNGRAHGNQENSGTFGGKLCLGRYAQRLSIVHCFLP

SEQ ID NO: 197918 - protein, 256 aa, Glycine max
  Coding DNA Sequence Number=SeqID_81140
  Gene Ontology: Mol. function=RNA-directed DNA polymerase activity; Cellular component=chromatin; Biological process=chromatin assembly or disassembly
MQSPADISDYALSRKLQAKSQMRAKPNLQGQQVWILIDGSNTHNFIQERDIALQVQDQQFLVNFHVLPLYGVDLVLGVEWLKSLGPVLTYYNDLTMKFLLDGKNGVIRPSTSPFSSLVLLVKKRDESWRFCVDYRALNAITIKDRFLIPTVDKLLDELGRAQWFSKLDLLQGYHQILMKEEDINKMAFHTHHGHYKFLVMLFRLCNAPSSFQATMNDTFRPYLHKFIIVFFNDILIYRKTLVDHLQHLQQTFRVLE

SEQ ID NO: 197919 - protein, 724 aa, Glycine max
  Coding DNA Sequence Number=SeqID_81141
  Homolog annotation: Hit_ID=Q1SPY9; Match level="QueryCoverage=88%, HitCoverage=89%, E-value=8e-40, Identity=25%"; Hit description =Ankyrin
MSEKEMEASNKEMITFSDEIVKAQKEAAAKEWECFVDIFRRNDRKEELLFEPLDLVKNTAIHVLARSGNKQCLKELLQMLPKTKQLEALRKPNYEENTPLHEAVLFHDDPKMVDLIMGFMPSQPDKDALLEMKNNQNETVAFRAARYGRLRVIKYLHGKLQPRGLQSSKHFQPNIYGGRERPILHTCVLNFSFGAAIWLLKNVDKSLAKEKFMVQKKEKENTKIVLQLTCLKLLAKMQLAFESTGTLEMGLTKRLLYELLPEDGYESELEDDAENNSVKIARDEESSQPNDGNKKTTKSKVGVFSRINYAFWKHAKDRFSFIGKIWDQKKRHKFAEQLVKLLLDIDEESWKQYPLVPFNEPIALSLEFPGNVTEKKEDMKLINRVEKEERVKKLLEDKKSKKKLYSDDKVGIMWKSTLFMAAASGIIEVVNLIVGKYPEAISYVNEDGLNILHVALKYRQLEIYEFIEKTSAFELLTQRISKDKRTILHQAGSMEYYREQGLAGVAYQLQCELEWYHRVREKIPKQYLMHADEDGLTAGDLLDIDHAEMHDEAKQWMKETAQSCSTVAVLIAGVVFAAAYAIPGGNEGGRPVLRTSSAFRIFTIMDVVALATSLGSVVMFLSILTSSFDLWEFHRALPRKLKWGFAMLFFSLITTMLAFAATILLTIHMEGNKSSTTLAYSLAFVIVSIFGLTQFPLYKMVEDQVKAMKKWCGPKSTKSRSNKS

SEQ ID NO: 197920 - protein, 198 aa, Glycine max
  Coding DNA Sequence Number=SeqID_81142
  Gene Ontology: Mol. function=DNA binding; Cellular component=nucleus; Biological process=regulation of transcription
  Homolog annotation: Hit_ID=Q5IR72; Match level="QueryCoverage=59%, HitCoverage=79%, E-value=4e-22, Identity=41%"; Hit description=Zinc finger homeodomain protein SZF-HD1
  Pfam annotation: Domain name=ZF-HD_dimer; Domain location=65-119; Score=63.8; E_value=5.7e-16; Accession=PF04770.3; Description=ZF-HD protein dimerisation region
MEMRPVTRCIKTILEVDTYTHAPPSPFYLSLTPSMRMHTHPSISINLLLNFTMSNININHPLPIDEVVTYKECLHNHSAALGHVTYDGCVKYIAGEDALLCACCGCHRNFHHKNTIFTAEPQTQTPDQVQEMRSKRKKRTTFSSEHKNKLIRFAESVGWKPRKEKKDEIESFCSEMGITRRMFIVWLINNRHRAINNA

SEQ ID NO: 197921 - protein, 56 aa, Glycine max
  Coding DNA Sequence Number=SeqID_81143
MDDGVPEGHGKASGCHCSGVFGCGLVLLPEAGAGARDGCFHYCSPKILDLSPTKEH

SEQ ID NO: 197922 - protein, 64 aa, Glycine max
  Coding DNA Sequence Number=SeqID_81144
MASNRRRLAEEGSRKKARGRKNEKARGRRLAEGRKAEARRRLSDSGRGEENYFNILNFFNEGEQ

SEQ ID NO: 197923 - protein, 111 aa, Glycine max
  Coding DNA Sequence Number=SeqID_81145
  Gene Ontology: Mol. function=diacylglycerol kinase activity; Biological process=protein kinase C activation
  Homolog annotation: Hit_ID=Q9C5E5; Match level="QueryCoverage=59%, HitCoverage=13%, E-value=2e-26, Identity=85%"; Hit description =Putative diacylglycerol kinase
  Pfam annotation: Domain name=DAGK_cat; Domain location=2-110; Score= -3.3; E_value=0.0022; Accession=PF00781.14; Description =Diacylglycerol kinase catalytic domain
MLSQFVAEAQWLLPYLQKLATPDIAAGGGAALLFLICRALGRDDGTAGWLLGVVRDLKLSHLPPIATVPLGTWNNLPFAFGWGKKNPGTDEHAVKSFLDQVMNAKEMKIDK

SEQ ID NO: 197924 - protein, 144 aa, Glycine max
  Coding DNA Sequence Number=SeqID_81146
MPNRVHLLIKRVAKVVGIEVAKDDGRTNSEVEEGGGDKSSTSRSRKMTTEPALKRQIVDAEVTKDDGRISSEVEEGGGDKSSASRRQVIDIKVAEDDNRTSSEVEEGGGGEGVMKEGGLGGVGMEEGGEEVRVEREEESMEASF

SEQ ID NO: 197925 - protein, 110 aa, Glycine max
  Coding DNA Sequence Number=SeqID_81147
  Gene Ontology: Mol. function=nucleoside-triphosphatase activity; Cellular component=integral to membrane; Biological process=transport
  Homolog annotation: Hit_ID=Q9SZR9; Match level="QueryCoverage=97%, HitCoverage=17%, E-value=2e-32, Identity=62%"; Hit description =Probable white-brown complex homolog protein 9
  Subcellular localization annotation: CTP_CleavageSite=49; ConfidenceScore=5.13e-01
MTKIGILFFLSIFWGSMPLFQAIFTFPQELTMLKKERSSGMYMLSSYFMSRMVGDLPMELVFPTIFLTTVYWMAGLKASLVNFIYILLSVFLDVLVLQGQGLAIRAIVME

SEQ ID NO: 197926 - protein, 299 aa, Glycine max
  Coding DNA Sequence Number=SeqID_81148
  Gene Ontology: Mol. function=transcription factor activity; Cellular component=membrane; Biological process=regulation of transcription, DNA-dependent
  Homolog annotation: Hit_ID=Q6RK16; Match level="QueryCoverage=85%, HitCoverage=82%, E-value=3e-72, Identity=53%"; Hit description =Hypothetical protein precursor
  Pfam annotation: Domain name=HTH_1; Domain location=1-57; Score=77.2; E_value=5.3e-20; Accession=PF00126.17; Description=Bacterial regulatory helix-turn-helix protein, lysR family
  Pfam annotation: Domain name=LysR_substrate; Domain location=81-291; Score=119.6; E_value=8.9e-33; Accession=PF03466.10; Description=LysR substrate binding domain
  Pfam module annotation: Pfam domain module=HTH_1::LysR_substrate; Domain location=1-57::81-291
MRYFLAVADCGSLSAASAQLFVAVSAISRQIQRLEQQLGVTLFARHARGMVLTEAGEIFAHHVRKNLLDMEYALAEIKGLKAVRRTLIRVACTDGLAFTLLPRLIAAFRRDHPGVLFDVRVASAQGVAELLRSGECDVALQFSLHAERAVEVVGSWPAPVLLVMHESHPLAGVPQVALADLSHYPLALPQQNTTVRQLFELASHMSGHLIEPVLTCDNFSTLFHFLLRTPPAVTICSSFTLAEEAQQQGLVMRAVNIDQLSQRTLQLQTQSGRPRSAALTLFLTFLQQQLSALSAAIKA

SEQ ID NO: 197927 - protein, 473 aa, Glycine max
  Coding DNA Sequence Number=SeqID_81149
  Gene Ontology: Mol. function=protein dimerization activity; Cellular component=nucleus; Biological process=proteolysis
  Homolog annotation: Hit_ID=Q6D5G6; Match level="QueryCoverage=95%, HitCoverage=96%, E-value=0.0, Identity=68%"; Hit description =Putative peptidase
  Pfam annotation: Domain name=M20_dimer; Domain location=202-358; Score=31.4; E_value=3.2e-06; Accession=PF07687.4; Description =Peptidase dimerisation domain
  Pfam annotation: Domain name=Peptidase_M20; Domain location=89-453; Score=74.3; E_value=3.8e-19; Accession=PF01546.18; Description =Peptidase family M20M25M40
  Pfam module annotation: Pfam domain module=M20_dimer::Peptidase_M20; Domain location=202-358::89-453
MTAQQAVQQATAYFDSGEFQRILARRVAWQTESQRDDRDVALQDYLQQEIAPQLQALGFTLQLINNPHAAGRPFLVAVRMEDPALPTLLSYGHGDVVFGDDENWRSGLSPWQLTEEGDRWYGRGSADNKGQHCVNLAALEQVYQARGGRLGFNCKWLFEMGEEISSPGLAQLCQQQAELLQADLFIASDGPRLNAVRPTLFLGSRGAVNFRLTINARDNAYHSGNWGGLLSNPGTRLASAIATLVDAQGVLQVEALRPDSLTPQVRAILSDIEVGGMPGDPAIDTNWGEPGLTPAERLYGWNTLEVLSFLTGNPARPMNAIPGSATAVCQLRFVVGTDWQRLAQHVSAHLAQHGFHDVEVEFLRGSPATRLDPDDPLVHWVLNSMAATSGKKPALLPNLGGSLPNEVFAEILGLPTLWVPHSYPACGQHGVNEHMLKSIAREGLQIMTQLLWELGEQGTQWLAQNRAYAGGGA

SEQ ID NO: 197928 - protein, 79 aa, Glycine max
  Coding DNA Sequence Number=SeqID_81150
MVLIRPILKKNPFDEDVGFQDKDIALEDETEVEEIEQSKEITVKPPKDLQRELRKIIELGSGHADTQTKLGASVKDRRS

SEQ ID NO: 197929 - protein, 138 aa, Glycine max
  Coding DNA Sequence Number=SeqID_81151
MQGIKWLPKLKSLSGKEAEIPEESEEVQALKAELEKARVVKEKLMTAVTKWETKRTRKEEWSRNKFRGALWGNSNELKLRRAERDESRMESMVLEGLGSSSSMDSFASWKMNGRGMEKEEREETPLQGEDESRRSSPP

SEQ ID NO: 197930 - protein, 205 aa, Glycine max
  Coding DNA Sequence Number=SeqID_81152
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=26%, E-value=5e-39, Identity=59%"; Hit description=Chromo
MEPELAMILYTYRTVFDVPSGLPPSRTHNHSIPLVEGVEPVKVKPYRYPHSRKDQIEDGTWIFCTDYRALNAITIKDSFPIPTVDELIDNLLKKENFHWNDHTSMAFDNLKAAITKAPVLALPDFSKAFTLETDASGIGIRAVLSQEQHPIAFFSKKLTPRMQRQSAYIRESYAIIEAVAKFRHYLLGHRFVIKTDQRSLKSLTE

SEQ ID NO: 197931 - protein, 88 aa, Glycine max
  Coding DNA Sequence Number=SeqID_81153
MKESLQTQILSISEKLNKSNERIATAKYNLELEKLRIELRHAQGLHAVAQSEKIEASQKLNDLSMIKGRIIIWGNILYYSTAECPTNE

SEQ ID NO: 197932 - protein, 88 aa, Glycine max
  Coding DNA Sequence Number=SeqID_81154
MMQKILIFQLKYRDITISQTGLRNLIRLAMPKLMEADVQFESPTCPSNTAVDPELNSEDQVLCSVSIAPLRPTTESQLVLPLSTTELT

SEQ ID NO: 197933 - protein, 59 aa, Glycine max
  Coding DNA Sequence Number=SeqID_81155
DLAIRPATSGNESSETYEKKECKRAEDIDSPGKTTNFVSLGKVKKVVIVLTKDSDSLGN

SEQ ID NO: 197934 - protein, 530 aa, Glycine max
  Coding DNA Sequence Number=SeqID_81156
  Gene Ontology: Mol. function=nucleotide binding
  Homolog annotation: Hit_ID=Q1SL19; Match level="QueryCoverage=96%, HitCoverage=99%, E-value=0.0, Identity=67%"; Hit description =Nonsense-mediated decay UPF3
  Pfam annotation: Domain name=RRM_2; Domain location=7-106; Score =12.8; E_value=0.004; Accession=PF04059.3; Description=RNA recognition motif 2
  Pfam annotation: Domain name=Smg4_UPF3; Domain location=1-186; Score =203.0; E_value=6.9e-58; Accession=PF03467.6; Description=Smg-4UPF3 family
  Pfam module annotation: Pfam domain module=RRM_2::Smg4_UPF3; Domain location=7-106::1-186
MKGALDRTKVVLRHLPPSISEAALLSQIDAAFAGRYNWLSFRPGKISQKHMSFSRAYIDFKRPEDVILFAEFFNGHVFVNVKGSQFKVIVEYAPSQRVPRQWSKKDLRDGTIYKESFPLDKYKHLHGEHLDSEYLEFLELLAKPVENLPSAEIQLEKREAERSGAAKDIPIITPLMDFVRQKRAAKGPRRPLSNGKVSRRAGTSSNGGPSSATSRRGSGKKRVSATMYVARDPGKSSTIKDKSSYTLVPKQDDQHLPNKASNMASSDGNQTLDENGVSGNHDAGKKKVLLLKGKEREIITVSDLDSMSQHHNVTSSAKTVVGSTVLKQSQRHEGSGRIIRSILSKKELHQSQSSRALSEQKILTSNLEKEKQPPRPLHVQLILKGSNGTPENKIGVHDSHVSSERQERHVRHKDRPDRGVWTSRFNGADVSFSSPASSQVDPLEGSQADLKHDMPNARSVEVKSEGSVRTSHSSENGFNKHFGRRGPSYGVKDVDGYSVSSEGKHPRRSSTSAYGSNEKQVWVQKASSGS

SEQ ID NO: 197935 - protein, 106 aa, Glycine max
  Coding DNA Sequence Number=SeqID_81157
  Homolog annotation: Hit_ID=Q1SM26; Match level="QueryCoverage=34%, HitCoverage=9%, E-value=6e-07, Identity=67%"; Hit description =Nucleic acid-binding, OB-fold
  Pfam annotation: Domain name=DUF889; Domain location=1-99; Score= -84.8; E_value=9.7e-06; Accession=PF05970.5; Description=Eukaryotic protein of unknown function (DUF889)
MRLQTNMQPGDKDETAKFAQWILDFGDGIIGHPNDDLCQHHNNTKFFQSRAILASTNETVQQVNDYILSLIPAKIISGKNIGLKVYIPRMSMSPSQSPWPFKLLRR

SEQ ID NO: 197936 - protein, 356 aa, Glycine max
  Coding DNA Sequence Number=SeqID_81158
  Gene Ontology: Mol. function=protein kinase activity; Biological process=protein amino acid phosphorylation
  Homolog annotation: Hit_ID=Q1SN45; Match level="QueryCoverage=92%, HitCoverage=19%, E-value=2e-69, Identity=40%"; Hit description=AAA ATPase
  Pfam annotation: Domain name=DUF889; Domain location=139-356; Score =242.5; E_value=8.7e-70; Accession=PF05970.5; Description=Eukaryotic protein of unknown function (DUF889)
MYAEQNYDKAQLEHDFQTYFASLTGTGMTFMWKTLASVLRSKGDIVLTVTSSGIASLLLPNNRIAHSKFVIPVPTLDNSTCNIHRGTELAELLKAIKLIIWYEAPMAHKYYFEALDKTLKDIMCMSHVDNVPFGGKVVVFGGNFWKILPMIPRGSRLDIVHATINASYLWDYCIVLKLTKKMCLQSNSTMSNAEEIKSFSQWLIDVSDGKLGKGDDGFSEIENPSEFLITNFTDPIESIVSHTYPNIQQNYKDEDFLKSRAILASTIDTVDQINDYVFNIIPSDKKEYLSCDSIDMIDVATTECYQAITPEFLHSLKIVGIPNHKIRLKIDTFIMLIQNLDQAKGLCNGTRLIVSR

SEQ ID NO: 197937 - protein, 149 aa, Glycine max
  Coding DNA Sequence Number=SeqID_81159
  Gene Ontology: Mol. function=RNA-directed DNA polymerase activity; Cellular component=intracellular; Biological process=RNA-dependent DNA replication
  Homolog annotation: Hit_ID=Q1SYR3; Match level="QueryCoverage=94%, HitCoverage=12%, E-value=6e-21, Identity=51%"; Hit description=RNase H, putative
MTTKKFKLTLNPAKCTFCVKSVKLLGFIVNQRGIKVDPDKVRAILEMPPPRTKKEIRGMIARWQVQFSEYDIVYVTQKAIKGSALTNYLAHQPVEDYQSMQCEFPDEGIMALFNNKYSSKERRWIMWFDGASNIMGHGVGVVLLSLEKQ

SEQ ID NO: 197938 - protein, 313 aa, Glycine max
  Coding DNA Sequence Number=SeqID_81160
  Gene Ontology: Mol. function=unfolded protein binding; Cellular component=chloroplast; Biological process=protein folding
  Homolog annotation: Hit_ID=Q39641; Match level="QueryCoverage=79%, HitCoverage=35%, E-value=1e-127, Identity=93%"; Hit description=Heat shock protein 70
  Pfam annotation: Domain name=HSP70; Domain location=88-313; Score =17.0; E_value=2.9e-16; Accession=PF00012.10; Description=Hsp70 protein
VTKGGITRAKEQLIANSGNVAPKEVREELWRCLKDKKKQERKTFHKMRQHLLEDYGDSDEERTKKAAFIKLKSTPRRLRPLRVVNEKVVGIDLGTTNSAVAAMEGGKPTIITNAEGQRTTPSVVAYTKNGDRLVGQIAKRQAVVNPENTFFSVKRFIGRKMSEVDEESKQVSYRVIRDDNGNVKLDCPAIGKQFAAEEISAQVLRKLVDDASKFLNDKVTKAVVTVPAYFNDSQRTATKDAGRIAGLEVLRIINEPTAASLAYGFEKKNNETILVFDLGGGTFDVSVLEVGDGVFEVLSTSGDTHLGGDDFDK

SEQ ID NO: 197939 - protein, 76 aa, Glycine max
  Coding DNA Sequence Number=SeqID_81161
MTDNKSSFHSSLAVSNIRNHISITLEMENVCRRAASSFNLFRVSQVHIESCLAAVISRYRFLDVEQDNTVTDKAKS

SEQ ID NO: 197940 - protein, 261 aa, Glycine max
  Coding DNA Sequence Number=SeqID_81162
  Gene Ontology: Mol. function=protein-tyrosine kinase activity; Biological process=protein amino acid phosphorylation
  Homolog annotation: Hit_ID=Q1SKX1; Match level="QueryCoverage=83%, HitCoverage=73%, E-value=1e-60, Identity=56%"; Hit description =Octicosapeptide/Phox/Bem1p
  Pfam annotation: Domain name=PB1; Domain location=24-110; Score=72.4; E_value=1.5e-18; Accession=PF00564.15; Description=PB1 domain
MGDESPRNKVKFLCSYGGKVLPRPSDGLLRYVGGETRVVSVPRDITFPELMKKVSSMVEGGGEMVLKYQLVPEDLDALVSVRTEEDVKHMMEEHDRHHTGGLLRAFLFPPCKHIGLMACETYLLEQRYIDAINGIIRTSSRKGSACSSPKSNSPDATDQHSPRFSISRVQSSPNLSGLDHHHQHHHHQNPNFHLSKPPQDPQMGMRLGGGRAPTPAFNHHYSRQPPYRAYAYYDDSAAASYAHDNRIHTVSRSPRTKSIWE

SEQ ID NO: 197941 - protein, 104 aa, Glycine max
  Coding DNA Sequence Number=SeqID_81163
  Subcellular localization annotation: CTP_CleavageSite=60; ConfidenceScore=5.21e-01
MMSGYSRISDESSSQQSARSMDEFSESNEGEKFGVMLGRSASSSSSSSQFQFQRAFSMRRSSSVSERYCRIHDQYTPPPIGSKKKQRGGGPNKILKACKRLLRL

SEQ ID NO: 197942 - protein, 160 aa, Glycine max
  Coding DNA Sequence Number=SeqID_81164
  Gene Ontology: Mol. function=nucleic acid binding; Biological process= RNA-dependent DNA replication
MLVEFSTVGFNEECSTIVLKKLPPKLTNPWKFSIPCTIGSLKIDRALCDLGASIDLMLYFVYKKFELQEPQPINISLVLVDKTITYLKGIVENLLIIVATNKIMTIVAKSHPSVGKEDPPRKKVIPKDLGQSKRKGKDYEVDDYTEGSMQKGKIILFEGG

SEQ ID NO: 197943 - protein, 107 aa, Glycine max
  Coding DNA Sequence Number=SeqID_81165
NKRGYISCGSVQVEGTSTWFFKENKGGYIPCGSLACKGFYKVERNLMNRLVAWGLDVIHFLDKVVEFNGHEGLGCCEIKFGGGEFGNGVLNVVQVGFGARRISHGAQ

SEQ ID NO: 197944 - protein, 153 aa, Glycine max
  Coding DNA Sequence Number=SeqID_81166
MDMAKLSSMISHVGLRVTFVKRIRDETFKTKDSDAKLYIEPLPCMKDSKKIIRLSSSYFSSLEASLSPRILRGYSCIPNILVLSLSSMANSTSSKSNLDHIEDTIAKLTSTKLNLATTQTFMAIKLNDLIQKMNNLETANVGSSGLRIIKKGG

SEQ ID NO: 197945 - protein, 48 aa, Glycine max
  Coding DNA Sequence Number=SeqID_81167
MGVVPSHRVGNNRGRIVRGRLDIEQIKKGSRGRGPPLGLSKLYERLLE

SEQ ID NO: 197946 - protein, 214 aa, Glycine max
  Coding DNA Sequence Number=SeqID_81168
  Homolog annotation: Hit_ID=Q1SKW8; Match level="QueryCoverage=92%, HitCoverage=32%, E-value=3e-99, Identity=89%"; Hit description =Membrane attack complex component/perforin/complement C9
  Pfam annotation: Domain name=MACPF; Domain location=2-138; Score= -27.1; E_value=0.0017; Accession=PF01823.10; Description=MACPerforin domain
MGGKDVIYLKQQHSSTLQPADVQKKLKEMADRRFLDANGHYSIASDQVFPNDKFGIREQRLTFANISPSSSYSHKEDIVSICKRRGGRDDRNLSHNEWLQTVQSEPDVISMSFIPITSVLNGVPGSGFLSHAINLYLRYKPPIVELHQFLEFQLPRQWAPVFSDLPLGPQRKQRSSASLQFSFMGPKLYVNSTQLACGASMEAGSLSFNEVLQW

SEQ ID NO: 197947 - protein, 259 aa, Glycine max
  Coding DNA Sequence Number=SeqID_81169
  Homolog annotation: Hit_ID=Q1SKW8; Match level="QueryCoverage=88%, HitCoverage=38%, E-value=1e-117, Identity=88%"; Hit description =Membrane attack complex component/perforin/complement C9
MCHRNTRKPLLVIYNLCAEARNTCHVIYQVDVGKRPVTGLRLYLEGKKSNRLAIHLQHLSSLPKIFQLEDDPNENFWRKSYDRRFYEKVQWKNFSHVCTAPVESEEDLSIVTGAQLQVENYGIKNILFLRLRFSTVLGAKAVKHPEWEGSLKLGAKSGLISTLISQHFTSTFQKPPPRPADVNINSAVYPGGPPVPVQAPKLLKFVDTTEMTRGPQESPGYWVISGAKLVVDKGKISLRVKYSLLTMVLPDEEEMLDDQ

SEQ ID NO: 197948 - protein, 314 aa, Glycine max
  Coding DNA Sequence Number=SeqID_81170
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=O80919; Match level="QueryCoverage=87%, HitCoverage=67%, E-value=5e-94, Identity=61%"; Hit description =Expressed protein
MKLQKGGRDGAAGRGITIKEAKMKVANTHQIVLAGTSLGVRNTFHSIVAILTTLVVVTTVCLRQDGGHLPPKINASGSNSSSSSSSSKCDLFYGKWVFDNESYPLYKEKECTFMSDQLACAKFGRKDLSYQNWRWQPHHCDLTRFNATALLERLRNKRLVFVGDSLIRGQWVSMVCLVDSVLPKTLKSMHSTANGSLNIFKAKEYNASIEHYWSPLLVESNSDDPVNHRVPERTVRVKAIEKHARYWTDADFLVFNTYLWWRRPVMNVLWGSFGDPDGVYKGVEMLRVYEMALRTWSDWLEVHVNRNKTQLFFR

SEQ ID NO: 197949 - protein, 207 aa, Glycine max
  Coding DNA Sequence Number=SeqID_81171
  Homolog annotation: Hit_ID=O80919; Match level="QueryCoverage=49%, HitCoverage=25%, E-value=1e-39, Identity=69%"; Hit description =Expressed protein
  Pfam annotation: Domain name=DUF231; Domain location=2-106; Score =70.6; E_value=5e-18; Accession=PF03005.6; Description=Arabidopsis proteins of unknown function
MALAEEWGAAKGNNCYSETEMIAEEGYWGKGSDPKMMHMVENVLDDLKARGLNVQMLNITQLSEYRKEGHPSIYRKQWDALTQEQIANPNSYADCIHWCLPGVPDLCGREPKSLPSPSILALHPHRSSTMLTRTQEHGCCLTYDYVTDDATDLLGEEDLDSISTLRGLLISRPADSSFSHKNALHRCMEHAKLWLAQDREHILFLSL

SEQ ID NO: 197950 - protein, 342 aa, Glycine max
  Coding DNA Sequence Number=SeqID_81172
  Gene Ontology: Mol. function=DNA binding; Cellular component=nucleus; Biological process=regulation of transcription, DNA-dependent
  Homolog annotation: Hit_ID=Q1SKV9; Match level="QueryCoverage=77%, HitCoverage=46%, E-value=8e-86, Identity=58%"; Hit description =Bromodomain
  Pfam annotation: Domain name=Bromodomain; Domain location=148-238; Score=71.6; E_value=2.5e-18; Accession=PF00439.15; Description =Bromodomain
MKRKRGHKKGKAKGSTNHGSSGADANKEETSGLEVDTPSSTGTGMDQQQHYNLANINPDGSVDKAIGRVKVKLKTPKILDSQPTSSDAPSPTQSDTERMEDSANSLPDMKLSTLSKRAASIKIKSSSNHTLSASTEITLPKERKNKQELDASLVVLRKVMKMDAAEPFNVPVNPEALGIPDYFDIINTPMDFGTICNNLEKNEKYMNSEDVFKDVQYVWDNCYKYNNKGDYILDLMRRVKKNFMKYWTAAGLYSEQSKGTKGETSINMGVCFHYESHTERTSAEDIALSGDGKAGKGGQLKQKTKKRHGSVFSNCNLTPYLLYYNSLCGNSSYNGNDLVAIM

SEQ ID NO: 197951 - protein, 137 aa, Glycine max
  Coding DNA Sequence Number=SeqID_81173
  Homolog annotation: Hit_ID=Q1S717; Match level="QueryCoverage=98%, HitCoverage=14%, E-value=3e-20, Identity=36%"; Hit description =Ovarian tumour, otubain
MRSGQYGCRKKDFVRRDTESRKCGCPFKLCGKSVIGGQGWMVKLMCKTHNHELAKSLVGHAYAGRLTKDEKTIIADMTKSMVKPKNILLTLKKHNVNSCTTIKQIYNARSAYRSSIRGSDTEMQHLMKLLERDQYIH

SEQ ID NO: 197952 - protein, 384 aa, Glycine max
  Coding DNA Sequence Number=SeqID_81174
  Gene Ontology: Mol. function=pseudouridylate synthase activity; Biological process=tRNA processing
  Homolog annotation: Hit_ID=Q1SKV8; Match level="QueryCoverage=99%, HitCoverage=100%, E-value=1e-106, Identity=58%"; Hit description =TRNA pseudouridine synthase
  Pfam annotation: Domain name=PseudoU_synth_1; Domain location=53-165; Score=76.5; E_value=8.2e-20; Accession=PF01416.10; Description=tRNA pseudouridine synthase
MTQNLKHTVDLECSDNSRPSKISKIEYPSDSDIDEEEEGMSQNPRNGIQRYLVAIEYIGTLFSGSQKQLNVRTVVGALEEAFSKFVGQPVSVSCSSRTDAGVHALSNVCHVDIQRISKRRPGEVLPPHEPAVVGRAVNHFLQKHDSDLMVIDVRCVPSDFHARFKAQERTDTGEYHIIDSYLELLFRYFYRLLSGPEPLSTFEKDRAWHVPEELSLPAMQLFKLLMISMQEACRVLVGCHDFSSFRAAGCQAKSPIRTLDELSVNEVIESPYFPSLMDREQHNKVSGDLRSCSNNTETDIPPISNPSIDKVITSSQDAGFGKRRRHRCLVVRLLVGVLKAAGTGNLTIPDVERILNAKTVTAASPMAPACGLYLGEVKYDLPTT

SEQ ID NO: 197953 - protein, 170 aa, Glycine max
  Coding DNA Sequence Number=SeqID_81175
  Gene Ontology: Mol. function=RNA-directed DNA polymerase activity; Biological process=RNA-dependent DNA replication
MARGEQESPIFISTRRHLRVADLQFDAALFQEDNKFGFAACIRNSEGVFISAISWFQGIPKPQEAESYAVLSTLQWISDLQLTNVIIETDCKAIPHAIHSKRFHELEAGRILCICAKKICNLHNCRIQFVSREANQVTHNLTRVSRSYACPQVFDFSRAFIEHFLDYDII

SEQ ID NO: 197954 - protein, 222 aa, Glycine max
  Coding DNA Sequence Number=SeqID_81176
  Gene Ontology: Mol. function=chromatin binding; Cellular component =chromatin; Biological process=chromatin assembly or disassembly
  Homolog annotation: Hit_ID=Q1SAV4; Match level="QueryCoverage=76%, HitCoverage=53%, E-value=2e-36, Identity=39%"; Hit description =Integrase, catalytic region
  Pfam annotation: Domain name=Chromo; Domain location=118-169; Score =36.5; E_value=9.1e-08; Accession=PF00385.14; Description='chromo' (CHRromatin Organisation MOdifier
MGLSPYKITFGKKPPNIPHYVTGTSNLDAEDDFLADREAVFADFRKKLIKAHHTMKHFPNNNRHDKIGPIAYQLELPPGSRIHPVFHCSLLKPFQPLTDQTNPIAELPTTSVDNDPIISPLVILDTKWDQSDNGPKLMVLVQWKGLFPEDASWEPWESLKADFHLEDKVFFDGHGNVMNETEQQQQTNNIDRAIQQADTGETITNQRPKRRIIKPQYLKDFA

SEQ ID NO: 197955 - protein, 459 aa, Glycine max
  Coding DNA Sequence Number=SeqID_81177
  Gene Ontology: Mol. function=RNA-directed DNA polymerase activity; Cellular component=chromatin; Biological process=chromatin assembly or disassembly
MGPILTDYNELTMKFIHDGNIIELKGNTNSGLHSITPPQLRRMIKTDNVSAYFHIRILSSEPPSIKTNTIPYPKIDSLIHKFSSLFQTPTTLPPSRNTNHAIHLLPNSEPVNVQPYRYPYFQKQEIENQVKSMLKRGIIQPGTSPFSSPVLLVKKRDGTWQFCVDYRALNAITIKDRFPIPTIDELLDKLRGSCYFSKLDLLQGYHQILMQDDDVYKTAFRTHHGHCKFCVMPFGLCNAPSSFQAMMNSIFAPYLHKFIIVFFDDILICNKSFTEHLVQLESAFQVLVTGQFYLKLSKCTFAQKQIEYLGHVVSQHGVEPVPAKIYKGLCFHGGSINSSFGQRSVLVDTRISTSLRHFKECDLSGPRSRATGFFLALRCRDRCFRGGHGRCSVPTKPPHCFLQQAIMLEAPSLFYLCQRTRGYHLYNEEMAPVSTGSSLHDLNRSLESERVDVAGDLDA

SEQ ID NO: 197956 - protein, 327 aa, Glycine max
  Coding DNA Sequence Number=SeqID_81178
  Gene Ontology: Mol. function=carbonate dehydratase activity; Cellular component=chromatin; Biological process=one-carbon compound metabolic process
MAESTHSKTNLERMEEVIAELASNQLHITTKLNELIQRITVLETNQQQSASPSSSSTNPSHIAPSSQLPRMKLEVPRFDGTDPSGWIFKINQFFAYHVTPEHERLTIASFYMEGPALAWFQWKTRNGQLTSWSGLLQALEARFAPSQYEDPTGILFKLTQCGSVMDYLSQFETLVNRIVGLPAPFLLSCFVSGLKPDICREVQALQPLTLVQVVALARLQEEKITEHHRAFRGRTTLGLPPPLGSTSPPPSTIPLLLPPAKPPPLPLNDYRWKKWRIAARRGSASTATRSSLEGTDAPQSSSSSSQTKRPQRMSTTLPKSHFPILKI

SEQ ID NO: 197957 - protein, 165 aa, Glycine max
  Coding DNA Sequence Number=SeqID_81179
  Homolog annotation: Hit_ID=Q2ULH2; Match level="QueryCoverage=35%, HitCoverage=7%, E-value=1e-22, Identity=84%"; Hit description=DNA repair protein
LAQGFPVSTGTPGFIYLRSDLPSQWLLFLSAVPPVQLLTGWCVTAKAPPDISAGKCSGRVPFAIQAAQLLGRAIGAGLFAITPAGERGMCCKAIKLGNARVFPEFDVGANQVDTTTTCFTTQQKNHLGSFWVVESIHEFLTFVDVHGSVEPETAILFVTTQLLHE

SEQ ID NO: 197958 - protein, 409 aa, Glycine max
  Coding DNA Sequence Number=SeqID_81180
  Gene Ontology: Mol. function=transporter activity; Cellular component= viral capsid; Biological process=transport
  Homolog annotation: Hit_ID=Q2KYY4; Match level="QueryCoverage=56%, HitCoverage=43%, E-value=1e-109, Identity=83%"; Hit description=ABC transporter substrate-binding protein
MSTWSTSPPRKYVDAAALERHRARGRVRDHVEHQLIQVGFAGLPVVGVARQLDVFAAFPFLEHERAGADRFLVGRVGHVVGAGVDVLGHHRREARLEHQHEGRERRLQLDDHRLRVAGLHRIDELVQDHASSRMGLGQHVRQREDHVVGGERLAVVPLDVVLQVEGVGQAVARGFPRLGQAGLGLEVGAVRQQAFVDLAGDELGGTLLVDGRDDHGRLGLDDHVERAALGLGQRLRGGQGGRQDQGADAEGEPSLRFHCEPPGWKRVVRWPRVTRRVPAMTSKPRATCFSGNCGVELLQQCCVWVQRRRRAPMRRQTRCTVGALLGDVDPGGFEVAVLVQRVQRFVAAEARLLDAAERHGDIAIGVAIDPHQAGAQAARQAVRAAQVGGPQAGAQAVRGIVGQCDGFVF

SEQ ID NO: 197959 - protein, 114 aa, Glycine max
  Coding DNA Sequence Number=SeqID_81181
MSPPPLRVSITYLKQTIVKETANAKDTGLPCSDVLCLFSAGKGQRSVGRDPIPTCIRPYVPASRKQNPWPIVSGHRLTLVDFRSQLVLTSSRDLRRPCPCYHKICMCMCMYECS

SEQ ID NO: 197960 - protein, 69 aa, Glycine max
  Coding DNA Sequence Number=SeqID_81182
  Homolog annotation: Hit_ID=Q84VH5; Match level="QueryCoverage=74%, HitCoverage=7%, E-value=1e-10, Identity=65%"; Hit description =Envelope-like protein
MKRESPLSLHYKLFERTHVPDIVPTSGKAAASGAVSKDALIAELKDTCKLIEDAAARAWRQGEQKADVT

SEQ ID NO: 197961 - protein, 110 aa, Glycine max
  Coding DNA Sequence Number=SeqID_81183
MDDMEKSSWVICDAKVPIKLKGKFIGLREKIGRLCSEESRPDGEKANNLRQRKTQKDYKRGGRHIHTTLCFTNPSDAFVVLTLTTLTLSRNCAQSHYVTGNAAAAMVWKV

SEQ ID NO: 197962 - protein, 58 aa, Glycine max
  Coding DNA Sequence Number=SeqID_81184
ETIFIPPPMLTAFRTPQVRPLAPIRIIFPDGVSHNRNQSNYMSFIPTPGLPNRQDSNK

SEQ ID NO: 197963 - protein, 67 aa, Glycine max
  Coding DNA Sequence Number=SeqID_81185
MEKSDKKTFKDKKGKKVYISWEDNNMDSSGDLENEVVNLSLMAKNYESEEEDSLKRSCSLIAEANHT

SEQ ID NO: 197964 - protein, 210 aa, Glycine max
  Coding DNA Sequence Number=SeqID_81186
  Gene Ontology: Mol. function=hydrolase activity; Cellular component =integral to membrane; Biological process=alanyl-tRNA aminoacylation
  Homolog annotation: Hit_ID=Q3K8I0; Match level="QueryCoverage=98%, HitCoverage=99%, E-value=9e-58, Identity=49%"; Hit description=Metal- dependent hydrolases
  Pfam annotation: Domain name=tRNA_SAD; Domain location=164-205; Score= 20.9; E_value=0.00084; Accession=PF07973.4; Description=Threonyl and Alanyl tRNA synthetase s
MMTERRYYYSDDVQGQAQVLSCTPAEAGAYAVELDATLFHPQGGGQPSDVGTLGGVAVLRVQQQGDSVVHFTAAPLPIGPVTLQIDEALRRLHARWHSGGHLIGWLGETRGWRPVKAHHWPGEGRITFAPGPDAQTIEADFLQVELARLIAADLPRRQQAVDGMRQVGFGELPAYGCGGTHVAALGEVGAIAITGVKMKKGQLIVQYELG

SEQ ID NO: 197965 - protein, 92 aa, Glycine max
  Coding DNA Sequence Number=SeqID_81187
AILGGEAPSSLAYSLVDGASPLLFSFAFRCISMLSLVRVDVAKEGSKISHVRLKVAFVKGEIEPGTYRVEWKLRVLICWDCYGVVPTLAYND

SEQ ID NO: 197966 - protein, 36 aa, Glycine max
  Coding DNA Sequence Number=SeqID_81188
VFRKLRRPIPEEVLPEDVSGRPSSGSGHSGPSSFCA

SEQ ID NO: 197967 - protein, 127 aa, Glycine max
  Coding DNA Sequence Number=SeqID_81189
MEISEDTDIPVILGRPFMWTASCIVDMGKRKLELGNGWRSRGSENKNQNIRSPSERQLRAKRIFGHALSRESQALSPQPLHLRLIWFAKLDKDELGQLQFNLNSAKLQPGSLSDNLSLAKRDLLSPS

SEQ ID NO: 197968 - protein, 166 aa, Glycine max
  Coding DNA Sequence Number=SeqID_81190
MAQVNSGTVSAAARAVRYGFPAIAASIGYIFTEDEMKNKWPSTHKYWPDAVDYVVEVVETLNHKQVSGTPLLPKGSGLSINYPPLPKSKIKGVHYVENEMFPTPQIGYDILPDGRAKQTINPESLKTVENDTDSGWLNKGYITYSLFDGAMNAPQFQAQYEELLSK

SEQ ID NO: 197969 - protein, 58 aa, Glycine max
  Coding DNA Sequence Number=SeqID_81191
MDLMERMGTSVGLHTAANALGDHLSMVFLARACCFCWYNPHRFTLLSADLPVDDAVLS

SEQ ID NO: 197970 - protein, 92 aa, Glycine max
  Coding DNA Sequence Number=SeqID_81192
MDKSLKVGEYEWREKERSTKFYSSNELWFSPLIQDRVQDSPLSVLRCHKAYKWAHIEPMGPKSTPRLMRTLGPSPASLAQSSWTLLSNALGG

SEQ ID NO: 197971 - protein, 94 aa, Glycine max
  Coding DNA Sequence Number=SeqID_81193
MEDLVDGSGFELVTENEFCGSQRSTTAAAFSSIAYFATSILESWVSCESSLPVVASFWASLSVFTSKWRTWKTDPNKQQEFSRIENNDGTWNIA

SEQ ID NO: 197972 - protein, 253 aa, Glycine max
  Coding DNA Sequence Number=SeqID_81194
  Gene Ontology: Mol. function=transcription factor activity; Biological process=regulation of transcription, DNA-dependent
  Homolog annotation: Hit_ID=Q1M4I5; Match level="QueryCoverage=47%, HitCoverage=28%, E-value=1e-09, Identity=36%"; Hit description =Putative LysR family transcriptional regulator
MEQLIIAGGKGGRQAYFGQRSDPPGERLDWRGKRLAAWRRDSAAGGRRPVFSGRLHGLQQVDKRGAERRRGRLMAGKDVKARADVDLLRRDFLQVQLRGVVCDHPIAQQCDIALLPDQAPGRQKGVEREALAFQRLHGQIGAARRAVQAADRQIQLAVSQPGQQALRAVFHHRHPGMRVAAVEAFEHLRQIAEQRIDAHPYPQALLAVSAQAAQFVKRVEQLIGGGVYPPVKQLADRRQAHAAVAALQQPRAD

SEQ ID NO: 197973 - protein, 113 aa, Glycine max
  Coding DNA Sequence Number=SeqID_81195
  Gene Ontology: Cellular component=mitochondrion
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESP

SEQ ID NO: 197974 - protein, 568 aa, Glycine max
  Coding DNA Sequence Number=SeqID_81196
  Homolog annotation: Hit_ID=Q4V092; Match level="QueryCoverage=48%, HitCoverage=59%, E-value=1e-142, Identity=87%"; Hit description =Glutamine synthetase
  Pfam annotation: Domain name=Gln-synt_C; Domain location=386-568; Score=186.0; E_value=9.2e-53; Accession=PF00120.14; Description =Glutamine synthetase, catalytic domain
  Pfam annotation: Domain name=Gln-synt_N; Domain location=298-379; Score=155.8; E_value=1.1e-43; Accession=PF03951.9; Description =Glutamine synthetase, beta-Grasp domain
  Pfam module annotation: Pfam domain module=Gln-synt_C::Gln-synt_N; Domain location=386-568::298-379
AGRQPQQQCRAQRDAVNGEGGEPVRLDVAHQPLHYDEAGDGRGKEGHAHVGPVLAAQLPGLGHLQEGVGAGGEHGGNADQEHELGGGGAAAQAQQHGQEDRRGRARGAGEHAGHHLRQAHTDRHCPGHLVAVGQARGIGLHQQHPDATDDQCPGHRADRLRQRPAGLAHHQADDGGDQEGRAQLEHVLAVLALVQAGGQLQQALAEHQHHGHDRAGLDDDVEEVRAGTQPVLGDEQVAGAGDRQEFGQAFEDAQQQGGEQVGHGQCGHARQEGRRHSSPSEVVPMSVENVEKLIKDNQIEFVDLRFVDMRGVEQHVTFPVSIIEPSLFEEGKMFDGSSIAGWKGINESDMVLLPDTASAYVDPFYADPTIVISCDILDPATMQPYGRCPRGIAKRAEAYLKSSGIAETAFFGPEPEFFIFDSVRFANEMGNTFFKVDSEEAAWNSGAKYDGANSGYRPGVKGGYFPVPPTDTLHDLRAEMCKTLEQVGIEVEVQHHEVATAGQCEIGTKFSTLVQKADELLRMKYVIKNVAHRNGKTVTFMPKPIVGDNGSGMHVHQSLSKGGTNLFS

SEQ ID NO: 197975 - protein, 114 aa, Glycine max
  Coding DNA Sequence Number=SeqID_81197
  Gene Ontology: Mol. function=DNA binding; Cellular component=nucleus; Biological process=protein modification process
  Homolog annotation: Hit_ID=Q84ZU4; Match level="QueryCoverage=66%, HitCoverage=11%, E-value=1e-19, Identity=61%"; Hit description =Telomere binding protein TBP1
LITVPEMGMEALAVLPVHQKSKRTEIAPRRIRRPFSVAEVEALVQAVEKLGTGRWRDVKLHAFDNAKHRTYVDLKDVAITPHVVEWHAFFFNSSSINFNLKPISSCFKTIACIL

SEQ ID NO: 197976 - protein, 185 aa, Glycine max
  Coding DNA Sequence Number=SeqID_81198
DAWDCYVDNILDRNILPERNVKLYITEFDEFIREVKRRNWHRELTNFFEGSIDVAVVKKFYANLYYPEDKAPKQVRVQGHLIKFDADSLNTFLKTLVVLEQGESLPSYSRFYRAKLVYGLVMKMDMNIGAFISGQISLIAQSNSSRLGFPALIIALCKARGVTSDSLTYESLSPAINLAYIKKNC

SEQ ID NO: 197977 - protein, 69 aa, Glycine max
  Coding DNA Sequence Number=SeqID_81199
MSQKLTDYAIVPSLASEMLWNFTDCALTLPFNSRHVTELHGLPNDGCQLMKGTDDDKVSPHVIGLAASG

SEQ ID NO: 197978 - protein, 159 aa, Glycine max
  Coding DNA Sequence Number=SeqID_81200
  Gene Ontology: Mol. function=nucleic acid binding; Cellular component= integral to membrane; Biological process=protein amino acid phosphorylation
  Homolog annotation: Hit_ID=Q9FNZ2; Match level="QueryCoverage=99%, HitCoverage=40%, E-value=9e-43, Identity=58%"; Hit description=Zfwd1 protein
  Pfam annotation: Domain name=WD40; Domain location=126-157; Score =6.8; E_value=5.9; Accession=PF00400.22; Description=WD domain, G -beta repeat
  Pfam annotation: Domain name=WD40; Domain location=3-40; Score=16.5; E_value=0.099; Accession=PF00400.22; Description=WD domain, G-beta repeat
  Pfam annotation: Domain name=WD40; Domain location=81-117; Score=8.9; E_value=3.3; Accession=PF00400.22; Description=WD domain, G-beta repeat
  Pfam module annotation: Pfam domain module=WD40::WD40::WD40; Domain location=126-157::3-40::81-117
MVNNACICIHGFMVITGIALPVGSDKLYSGSTDGTVRIWDCHTGQCAKVINLGAEVTSLISEGSWIFVGLQNAVKAWNIQTMSEFTLDGPKGRVRAMTVGNNTLFAGAEDGVIFAWRGSSKANSPFELVASLTGHTKAVVCLAVGCKMLYSGSMDQSIK

SEQ ID NO: 197979 - protein, 93 aa, Glycine max
  Coding DNA Sequence Number=SeqID_81201
VVVAPTITVVVAEVTMVIMAVATIVIVVIMHGDNNHNDDSNDNGDGDAGDYKSGIGVGVLVTGTRQWTLSLKVIIKELSKLHRLSLRFGVITL

SEQ ID NO: 197980 - protein, 133 aa, Glycine max
  Coding DNA Sequence Number=SeqID_81202
MVKVVVSPKDTNLFTELRLIWEILRPEFQETGKEFHDALRGHDLLQRWRHAHKLCVLDQIRSDLRSLSPKAGNHISSTSTTAMPSQNGVTASFASSPNFLVQRVFAFGQVEEWGEVGNALQMHRSNLCRSQLE

SEQ ID NO: 197981 - protein, 145 aa, Glycine max
  Coding DNA Sequence Number=SeqID_81203
  Homolog annotation: Hit_ID=Q6IVK3; Match level="QueryCoverage=30%, HitCoverage=9%, E-value=4e-13, Identity=79%"; Hit description =Putative UDP-glucuronate decarboxylase 3
FNKTVVAVKASSSCCCFLPPPEIHTLATKKENKEDVVLKLSCGSPTQQNPHAHRTPTCWSPSSSRCSTSGGMLNDIMLDKLKSRVPKMVHHVLFSFDEEIVHHDHVVPSRNQSIHHVKIFDSRSKYEIGRDLYETLEDEAEGEDE

SEQ ID NO: 197982 - protein, 98 aa, Glycine max
  Coding DNA Sequence Number=SeqID_81204
MASPGFVKGLVLDLFNQVLKVGSRRSIKKETWAPFEETKFGLSPSHDPSMSYLVGIVKKNVDHPHAGRNDEFISCCSKQLKSKVKDFIFKENGTFSRI

SEQ ID NO: 197983 - protein, 49 aa, Glycine max
  Coding DNA Sequence Number=SeqID_81205
MPQLLKLLALTLIWWSTDILGATELKGPVSFEYKDLKAGTKNFSADNKP

SEQ ID NO: 197984 - protein, 542 aa, Glycine max
  Coding DNA Sequence Number=SeqID_81206
  Gene Ontology: Mol. function=binding; Cellular component=nucleus; Biological process=apoptosis
  Homolog annotation: Hit_ID=Q6AZH5; Match level="QueryCoverage=92%, HitCoverage=91%, E-value=2e-87, Identity=37%"; Hit description =Ctnnbl1-prov protein
  Pfam annotation: Domain name=Arm; Domain location=101-141; Score =16.5; E_value=0.096; Accession=PF00514.13; Description=Armadillobeta- catenin-like repeat
  Pfam annotation: Domain name=DUF1716; Domain location=27-133; Score =186.6; E_value=6.1e-53; Accession=PF08216.2; Description=Eukaryotic domain of unknown function
  Pfam module annotation: Pfam domain module=Arm::DUF1716; Domain location=101-141::27-133
MEVAANARNPAAKRKFDDAVSNGVAAPADVDLSLLEAIEKSQNAVEALDLRALKKHVLSFERRLKDNIEARLKYPNQPDRFADSEVELHEELQKLKVLAGAPELYPDLVNLNVVPSIVDLLNHDNTDIAIDVVQLLQDLTDEDVLDDNDDSARVLVDALVDNSALELLVQNLHRLNDSDPDENAAVYGSLATVENMIEVKPAVAELVCEKTKLLKWLLGKIKVREFDSNKQYASEILAILLQSSTVNQKKLGQMNGVDVVLQAVAMYKSKDPKSSDEEEMLENLFDCLCCLLMPLENKERFVKAEGVELMIIIMKQKKLAYGSAIRALDFAMTKYPPACERFVDVLGLKTAFAAFMELLRVYPVLVFELLLLVFVKDYAIPLSKKNKKERYQEDLEERIVSLIASLFGGILRGSRRERLLSKFVENECEKIDRLMELYIRYSDRVKAETERLNQVELDDLELIAVILGHLWCSEHPQMRGRIELLLKQNKLSKKHIKDILQEYHDNIGDLDGPEEKERAQTKIQKVMEKEHRSANVVEIIAM

SEQ ID NO: 197985 - protein, 79 aa, Glycine max
  Coding DNA Sequence Number=SeqID_81207
MSYNCILSEAMSELCWYFLMKAAIRSFQEWTQEDSRLVYQVIVAHVLQQHGAQRGVQMKISATLAQSGSGPAQRIKCIL

SEQ ID NO: 197986 - protein, 282 aa, Glycine max
  Coding DNA Sequence Number=SeqID_81208
  Gene Ontology: Mol. function=endonuclease activity; Cellular component=intracellular; Biological process=mRNA catabolic process, nonsense-mediated decay
  Homolog annotation: Hit_ID=Q6EU00; Match level="QueryCoverage=74%, HitCoverage=77%, E-value=7e-42, Identity=39%"; Hit description=TRNA -splicing endonuclease positive effector-like
MAKFYLMSARLIFCTAASSTKLFTDGMTPVEFLVIDVKSQVSQEAEYGSSLFERLVSLGHKKHLLNVQYRMHPSISVFPNKEFYEKQISDALFVREMSYNRRSLEGKMYDSYSFINIAKGNTVGRTWPRLLLFARLLKALKMDPNFSVSVRSVDGFQGGEDDIIIIISTVRSNGNGKIGFLDNRQRANVALTRSRHCLWILGNEKTLSSDDKKLAKAIEEEALRIEIPDESESPFKKLSLRGTSRTTATTLRVFQGQTKDTKVVTGEGWEYIEIAREQQYEL

SEQ ID NO: 197987 - protein, 305 aa, Glycine max
  Coding DNA Sequence Number=SeqID_81209
  Homolog annotation: Hit_ID=Q9FHU6; Match level="QueryCoverage=45%, HitCoverage=16%, E-value=8e-39, Identity=58%"; Hit description =Similarity to DNA helicase
MSMNKKSASRKQTVSVGVISPYKAQVLAIQDALGKRFVGNVDNDFSLKVSTVDGFQGGEEDVIIISTVRYNNMGYVGFLSNFQRTNVALTRARYCLWIVGNSETLMNSGSVWERLILDARARGCYHNADEDERLSDAIATSVIELGQVSDLLKLDSLLFKKAKWKVCLNQSFLISMARIKSAEICKKICSLLMQLSSGWRQPHRNINIRVLDDTSSQQLELYKVNESLYLAWTIDVLEENSNYVQVLKIWDVLPLSEVSNLVRDVDISYKSSNHLSNYNLPQADPMQFLCNQFSSLRLRDINWNQ

SEQ ID NO: 197988 - protein, 515 aa, Glycine max
  Coding DNA Sequence Number=SeqID_81210
  Gene Ontology: Mol. function=helicase activity
  Homolog annotation: Hit_ID=Q9FHU7; Match level="QueryCoverage=100%, HitCoverage=62%, E-value=9e-72, Identity=34%"; Hit description =Similarity to nonsense-mediated mRNA decay trans-acting factors
  Pfam annotation: Domain name=ResIII; Domain location=165-310; Score= -30.6; E_value=0.017; Accession=PF04851.6; Description=Type III restriction enzyme, res subunit
MKMLSEAPACEITDINLSEDYSPPHDLLYQIEMKTIVASDKKGDVYEPEVGHLIALTDKRPTCIDDLNKHGNSYLIALIRKVRKKNDDENVFEVQILASQPIKLEILTTNMRIWNALNSDPDGPVIHVSKQLLQPDSAVGENCAQCYSFQRYTDDGSMIGAAIRLFDLNKAQEEGVLSCLAARECSHKNTVKLIWGPPGTGKTKTVASLLFALLKKKCRTLTCAPTNVAVLEVTSRFLRLVTESIDYHTYGLGDILLFGNRKRMSIDDRDDLLDIFLDYRANILAKCFAPLSGWKHHLEQVILLLENPEEQYREYLKCEEKRDYEIDDDDDCLKEENELHAIASQQTKQEKKHMSKDSKICKQNEWMKIINKTLRENRLCFKEANKKMLSNNSITDQQLYKARKECLTKLKSLQKIILPDFFDEYTIKNFCIKRSRMIFCTASSSARLHAVEHYRLEMLVIDEAAQLKECESNIPLQLPGLRHVVLIGDEKQLPALVKSEISGKAGFGRSLFERL

SEQ ID NO: 197989 - protein, 48 aa, Glycine max
  Coding DNA Sequence Number=SeqID_81211
MKNDMTSFVFDKPSLALKHKLAPSDFLGTRIFNIDGNTWKFQSSPQQQ

SEQ ID NO: 197990 - protein, 99 aa, Glycine max
  Coding DNA Sequence Number=SeqID_81212
  Homolog annotation: Hit_ID=UPI0000D55436; Match level="QueryCoverage =72%, HitCoverage=85%, E-value=1e-07, Identity=33%"; Hit description =PREDICTED: similar to UPF0287 protein DC13
  Pfam annotation: Domain name=UPF0287; Domain location=23-93; Score =16.6; E_value=2.6e-05; Accession=PF08583.1; Description =Uncharacterised protein family (UPF0287)
MGAQRRLTVGRCCRLIWLWEDAPSFNIAQTPNIIEQFQKCHIEHPIAKFFGECTDLKIKLDRCFREEKALKRKANFEESKKLKEQLRALRKENAASSGQ

SEQ ID NO: 197991 - protein, 43 aa, Glycine max
  Coding DNA Sequence Number=SeqID_81213
MWKLIKERMENKVVNFVGLNKVKWWLDRSIEMAITEATGLQMR

SEQ ID NO: 197992 - protein, 103 aa, Glycine max
  Coding DNA Sequence Number=SeqID_81214
  Homolog annotation: Hit_ID=Q93XN3; Match level="QueryCoverage=86%, HitCoverage=53%, E-value=1e-28, Identity=64%"; Hit description =Salicylic acid-induced 1 protein
MVYPERAKNNPCTVLTYIILAAGAVSTEVLYLAEKGDAATTWSSACGSFGRFCHKVTASVAITFVAVFCYVLLSLISSYKLFTNYDAPASRPTAAIEVAAFPG

SEQ ID NO: 197993 - protein, 117 aa, Glycine max
  Coding DNA Sequence Number=SeqID_81215
MCSKSNLSLFLESMNEQSSPIFDPNSPLASTSDLDLSPMNANSCCVRLQRMVLHTRLRGGLGFEYLLMVLLREFLSKAMASKIWCFGREVVHKFGSVRIDSVRVVEVVMVVARRRLG

SEQ ID NO: 197994 - protein, 94 aa, Glycine max
  Coding DNA Sequence Number=SeqID_81216
GRVPWVSSPPVASSPKRLGLEAKGCCVGCIVKGQYGGFGWNRDGRGLFKDVGVVKSGKRPCKGFGDSCVVGQSIVVERGHCGGDLRSSMVMEMG

SEQ ID NO: 197995 - protein, 117 aa, Glycine max
  Coding DNA Sequence Number=SeqID_81217
MTVGACILPQLETDLSSFPDSPESNLRFLAMLAGPLYPILHVVNESRDAKIKVDEKHNRKYQFKNECVWEEVGIASIDGKAETCFVVVVWSHEKSTHKKIGMDSIARLNMCKAPEAL

SEQ ID NO: 197996 - protein, 94 aa, Glycine max
  Coding DNA Sequence Number=SeqID_81218
  Gene Ontology: Mol. function=transcription regulator activity; Cellular component=intracellular; Biological process=regulation of transcription, DNA-dependent
  Homolog annotation: Hit_ID=Q7CR30; Match level="QueryCoverage=99%, HitCoverage=49%, E-value=4e-36, Identity=80%"; Hit description=2 -aminoethylphosphonate transport, repressor
  Subcellular localization annotation: CTP_CleavageSite=90; ConfidenceScore=5.19e-01
MHTGIDQVVLSLINLGQTAVEIVAQQLRHPRGQAVGCSASGAITSSGTAVKRPSSSTVFGSRPCSRHSLWKLVFCVGSNHSRSGVTNQPRRSAR

SEQ ID NO: 197997 - protein, 97 aa, Glycine max
  Coding DNA Sequence Number=SeqID_81219
  Gene Ontology: Mol. function=RNA-directed DNA polymerase activity; Cellular component=intracellular; Biological process=RNA-dependent DNA replication
MTTLIRKELVALLRDYQDVFAWSYQDMPGLRCDIVQHRLPLNPSCSLVKQMLRRMKPEMSLRIKEEVEKQVDVGFLAVARYPEWVANIVPVPKKDRK

SEQ ID NO: 197998 - protein, 190 aa, Glycine max
  Coding DNA Sequence Number=SeqID_81220
  Gene Ontology: Mol. function=RNA-directed DNA polymerase activity; Biological process=RNA-dependent DNA replication
MVEREKFDHIEERLRVIKGGRNYAFVDMAQLCLVPDVVIPPKFKVLDFDKYKGTTCPKNHLKMYCRKMGAYAKDEKLLMHFFQKSLTGPVVTWYTNLESSWVCSWKDLMVAFIRQYQYNSDMAPVRMQLENMCKREHESLKEYAQKWRDLAAQVAPPMMEREMITVIVDTLLMFYYEKMVGYMPSSFVDL

SEQ ID NO: 197999 - protein, 109 aa, Glycine max
  Coding DNA Sequence Number=SeqID_81221
MSLELLLLVETYWALLTYQLLKFVSAERGFRNSDVVKKASLWWRDLAKVGENVTLGWGCRGANVDWEAVLRDPAKLRAWAWINAKGKGRKFSYYEWEMNPRACLNCLTL

SEQ ID NO: 198000 - protein, 815 aa, Glycine max
  Coding DNA Sequence Number=SeqID_81222
  Gene Ontology: Mol. function=protein dimerization activity; Cellular component=nucleus; Biological process=regulation of transcription, DNA-dependent
  Homolog annotation: Hit_ID=Q9FGV1; Match level="QueryCoverage=88%, HitCoverage=87%, E-value=0.0, Identity=64%"; Hit description=Auxin response factor 8
  Pfam annotation: Domain name=Auxin_resp; Domain location=349-432; Score=201.0; E_value=2.8e-57; Accession=PF06507.4; Description=Auxin response factor
  Pfam annotation: Domain name=B3; Domain location=222-327; Score =107.2; E_value=4.9e-29; Accession=PF02362.12; Description=B3 DNA binding domain
  Pfam module annotation: Pfam domain module=Auxin_resp::B3; Domain location=349-432::222-327
MVAHACCHITPNQRSRFSGHKREPLVSTPHFTLSFHGDLGERATVAAGCFVFCGGCGLWSECIGIIMVEENVGECLCNGLKQIEGEKQKKVKLDYMKLSTSGLGQQGHEGGEKKCLNSELWHACAGPLVSLPTAGTRVVYFPQGHSEQVAATTNREIDGHIPNYPSLPPQLICQLHNVTMHADVETDEVYAQMTLQPLTPQEQKDTFLSMELGIPSKQPSNYFCKTLTASDTSTHGGFSVPRRAAEKVFPPLDFSLQPPAQELIARDLHDAEWKFRHIFRGQPKRHLLTTGWSIFVSAKRLVAGDSVLFIWNEKNQLLLGIRRANRPQTVMPSSVLSSDSMHIGLLAAAAHAAATNSCFTVFYNPRASPSEFVIPLSKYIKAVYHTRISVGMRFRMLFETEESSVRRYMGTITGISDLDSVRWPNSHWRSVKVGWDESTAGERQPRVSLWEIEPLTTFPMYPSLFPLRLKRPWHPGTSSLHDGRDEATNGLMWMRGGPVDQGLNSLNFQGAGMLPWMQQRLDPTLLGNDQNQQYQAMLAAGLQNLGSGYLMKQQMMNFQQPYHYLQQSGNSNSPLQLQQQQPIQQSVSSNMLQPQAHVLTENLSQHLLQKPHNNQEVQAQQQQHTYQDSLLIPSDQLHQRQHSGIPSPSYSKPDFLDSSMKFPASVSPGQNMLSSLCPEGSGSLLNLSRSSLSLLTEQLPQQQWTQKYAPVQVNTYGGTVSHAQYSGKDSAMVLPHCNSDAQNSTLFGVNIDSSGLLPITVPGYTTSSADTNSSTMPLADSGFQGSLYGCMDSSELLQSAGHVDPENQSQTFVKV

SEQ ID NO: 198001 - protein, 186 aa, Glycine max
  Coding DNA Sequence Number=SeqID_81223
  Gene Ontology: Mol. function=calcium ion binding; Cellular component =oxygen evolving complex; Biological process=photosynthesis
  Homolog annotation: Hit_ID=Q9XFT3; Match level="QueryCoverage=77%, HitCoverage=65%, E-value=1e-12, Identity=30%"; Hit description =Oxygen-evolving enhancer protein 3-1, chloroplast precursor
  Pfam annotation: Domain name=PsbQ; Domain location=14-186; Score =17.1; E_value=1.8e-06; Accession=PF05757.2; Description=Oxygen evolving enhancer protein 3 (PsbQ)
MELTSLILQPNLTHLFPTFTCCVKLKPSFQHLQNNKELSLKISRRVGVLAAITSLILGVNGNFGTQSANAFEFKFVAPDMTVEDALSGVRGHAQDLLHVRDLLELESWRAAQKTLRQSSAILKKDIYTIIQSKPGIERAQLRKLYSTLFNNVTRLDYAARDKDGPQVWQCYENIVVAVNDILSRIE

SEQ ID NO: 198002 - protein, 110 aa, Glycine max
  Coding DNA Sequence Number=SeqID_81224
MRVAVHETKYESTDSFDQICSSSHTLCGNQTADASTGFGAVGQQVLVDLQKATPKISGYFTATKTQVAGGAIYAIAQCDETFTQANCLDCLTNEQSSTQGYLSNTNGRAF

SEQ ID NO: 198003 - protein, 66 aa, Glycine max
  Coding DNA Sequence Number=SeqID_81225
MMITTLVVVDNNQNNDVGNDDENDNSVSVGSNNSRNNNDDYDGDNNNSNDNDGRKNVYMVVVTMIM

SEQ ID NO: 198004 - protein, 105 aa, Glycine max
  Coding DNA Sequence Number=SeqID_81226
  Gene Ontology: Mol. function=protein binding; Cellular component =integral to membrane; Biological process=defense response to fungus
  Homolog annotation: Hit_ID=Q1T435; Match level="QueryCoverage=98%, HitCoverage=47%, E-value=9e-14, Identity=41%"; Hit description =Leucine-rich repeat; Leucine-rich repeat, cysteine-containing type
  Pfam annotation: Domain name=LRR_1; Domain location=16-38; Score =15.1; E_value=0.26; Accession=PF00560.23; Description=Leucine Rich Repeat
  Pfam annotation: Domain name=LRR_1; Domain location=40-62; Score =14.4; E_value=0.41; Accession=PF00560.23; Description=Leucine Rich Repeat
  Pfam annotation: Domain name=LRR_1; Domain location=69-91; Score=8.7; E_value=6.7; Accession=PF00560.23; Description=Leucine Rich Repeat
  Pfam module annotation: Pfam domain module=LRR_1::LRR_1::LRR_1; Domain location=16-38::40-62::69-91
MLEGPIPDGFGKVMNSLEGLYLYGNKLQGEIPSFFGNMCALQSLDLSNNKLNGEISSFFQNSSWCNRYIFKSLDLSYNRLTGMLPKSIGLLSELTDLYLAGNSLE

SEQ ID NO: 198005 - protein, 105 aa, Glycine max
  Coding DNA Sequence Number=SeqID_81227
MRTRSPLKAKACSPLQARTYSPLKVIGTSTQGSTFMRKQEIDSSRGQIDCPFEKGDNSCNLILSFANLSGNSLRVSKMFGCLDNAKGSSASKFYSRQESKKNQDI

SEQ ID NO: 198006 - protein, 153 aa, Glycine max
  Coding DNA Sequence Number=SeqID_81228
MCRFRIGSEIPLAIYTLGVMAKYLDVLEIPRGVHVQFLVIQNALSMHVCEFSQGDVCDVICHFCFKSNVPLVKLTFQMFAFAGMAPRKLASKRSRKDKAAEGTSSAPEYDSHRFRSVVHQQRFEAIKGWSFLRERRVQLKDDEYTDFQEGGIL

SEQ ID NO: 198007 - protein, 40 aa, Glycine max
  Coding DNA Sequence Number=SeqID_81229
MLDLFGSDFPWAILMLRDSNIHHSICWPVPEGMLTMNSPD

SEQ ID NO: 198008 - protein, 92 aa, Glycine max
  Coding DNA Sequence Number=SeqID_81230
MENALTISSHSFQLEGGGHMNESQFMGLRKSCKLEGGGHMNENAIHGAPKKVENGELHLAITMNGSKLEGGGHMNENAIHGAPKKDKNGELH

SEQ ID NO: 198009 - protein, 97 aa, Glycine max
  Coding DNA Sequence Number=SeqID_81231
MFVKFLIFFCKASICSLKSATTIVSLETEDELEIRIAARLPWWHCRMKLPENAQQLPLADMDKSSEQAAGTEPQSRRRRSNSAWEEEEEEEEATSSS

SEQ ID NO: 198010 - protein, 751 aa, Glycine max
  Coding DNA Sequence Number=SeqID_81232
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=39%, HitCoverage=93%, E-value=5e-64, Identity=39%"; Hit description =Integrase, catalytic region
  Pfam annotation: Domain name=Chromo; Domain location=682-728; Score =23.8; E_value=0.0006; Accession=PF00385.14; Description='chromo' (CHRromatin Organisation MOdifier
  Pfam annotation: Domain name=RVP_2; Domain location=217-352; Score= -26.2; E_value=0.00011; Accession=PF08284.2; Description=Retroviral aspartyl protease
  Pfam module annotation: Pfam domain module=Chromo::RVP_2::Retrotrans _gag; Domain location=682-728::217-352::72-207
  Subcellular localization annotation: CTP_CleavageSite=31; ConfidenceScore=5.10e-01
MSLKLDEILHRLSPSSPSSTSPNPPPQTPVPATTHKMKLEVPRFDGTEPLGWIFKINQYFEYHNTPDKDRLTIASFYMEGRALAWFQYMTTNAQFTSWAAFLQALQTRFAPSQYDDPIGMLFKLTQTSTAHQPLTLVQAAGLASLQEEKLSSSRAIPRQPPPQLLPAPARAAPLPPLLPSPPRPPPPPLRHLTPEEISSRRERGLCFTCDEKYHRGRRCASRVLLMIAEEEDPSWSNIDTGPEALRLMGLISDHRVIVLVDGGSTHNFVQPQVVTSLRLPCQTISTPLRVMVGNGQYLECVSICEDVLVSIQDHTFTLDLYILPISGANIILGVQWLKTELCAITTTVKKWRQYLLSQHFIIITDHRSLKEILTQTIQTPEQHIYMARLMGYDYEVHYRSDSHNQAADALSRLPETNSSLSLILSVPTLTFMEELHKQLEANSEPLMSIAGTKSSLGGSLPGLYCRTTSISGDPPWYAPEFPHRTYDCFIFINIVVKIHSIPRSLVSDRDPLFISKVLNHVIEQYLRAFVHRRPSIWGKLLPWVEWSHNTSWNASTGTTPFEVTFGRKPFNFAEYISGSSRVDAVEEMMIDRDTTFQAIRSKLLKAQNAMKSRADDKRREVNYQVGDWVLLKLRPRREVTTKGAQAITDKLAKHFYGPFQVLERIGPGIPLPTELLNDQPLVFPLVILDTRRAPDKGTWEVLVQWNGLSPDDTTWENWEELCNNYHLEDKVVFQGTENDTNAQTETHTCRR

SEQ ID NO: 198011 - protein, 115 aa, Glycine max
  Coding DNA Sequence Number=SeqID_81233
  Gene Ontology: Mol. function=nucleic acid binding
  Homolog annotation: Hit_ID=Q1T4R7; Match level="QueryCoverage=64%, HitCoverage=14%, E-value=1e-12, Identity=45%"; Hit description =Ovarian tumour, otubain
MTFSAAFVYLKAEHENNFVWELERCRGLFHIFDGLRKLVVIDRDLALLNAMKIVFPKSDNLLFQFHINENVKAKCDYEDSLTKFKVFYQPWHEFVAYVKDLVDPSQGNICKGMDK

SEQ ID NO: 198012 - protein, 80 aa, Glycine max
  Coding DNA Sequence Number=SeqID_81234
MENCQPWMKREHELFGTKFLVFEDQTSPSKEFPKGFLEVEFTHSASNIVIEVRELKEGDSLIVQNFEVEDVIGESGEVVQ

SEQ ID NO: 198013 - protein, 125 aa, Glycine max
  Coding DNA Sequence Number=SeqID_81235
  Subcellular localization annotation: CTP_CleavageSite=59; ConfidenceScore=5.48e-01
MSPPPLETSQSLKISSKASQDGFLVKLSSLLVSPQLKTLKKLNNLSKIEISALNRHSCRASLLSLSLRVKGGALSEFTLAQRLYTSHPSSRFFCVLSWRMVCLADDSPSEFINSPLHQSCPFCLK

SEQ ID NO: 198014 - protein, 62 aa, Glycine max
  Coding DNA Sequence Number=SeqID_81236
MVVDPSTPLLKILEDPATPVLGLTTTPPATPVLHFTDEEGTQDQDTQQDDKGEACVEIISFE

SEQ ID NO: 198015 - protein, 91 aa, Glycine max
  Coding DNA Sequence Number=SeqID_81237
  Gene Ontology: Mol. function=RNA-directed DNA polymerase activity; Cellular component=chromatin; Biological process=RNA-dependent DNA replication
MLQTLKDNKLYAKLSKCEFWLEEVSFLRHVISKGRIVVDPSKVKALMSWKSPKFIEGFSKLTLALTKLTRNGQAFVWDAQCQSSFRTLKER

SEQ ID NO: 198016 - protein, 227 aa, Glycine max
  Coding DNA Sequence Number=SeqID_81238
  Gene Ontology: Mol. function=nucleic acid binding; Cellular component= nucleus; Biological process=DNA integration
  Subcellular localization annotation: CTP_CleavageSite=83; ConfidenceScore=5.08e-01
TYQGNPCGVYPDLSSFTESGVYPDLSSFTGSGVIQISVACIKRSAPSQGTKNLRRPMGSDQYIYSGSKMTSHVEAVGTCSLVLSSENGVAYNSMNVSGGLKQCVVNEDSSMLWHQRWGYISIERIKRLVNDGVLSTSDFANFETCVDCIKGQQTNKLKIGAKRSSNLLDIIHTDICCLNMEASNTRYFITFIDDYSRYMYLYLLHSKDEALDAFKVFNAKVEKQCGK

SEQ ID NO: 198017 - protein, 107 aa, Glycine max
  Coding DNA Sequence Number=SeqID_81239
VVGEHHPHKMVQGKFVPNLGEALVPKKKGKYGEGMNEKVKVIIWMNALLEPKFLNPRKTMNCWQPNPITSLESPSYSFLCVHYCMIGDEMQRLELVLVVYDGISLNT

SEQ ID NO: 198018 - protein, 59 aa, Glycine max
  Coding DNA Sequence Number=SeqID_81240
MARCRAGSRGKDQSRLARLGEHPCTWKHKNEGGGVSLHPKLSSLIQKMQTPTGFADFHP

SEQ ID NO: 198019 - protein, 65 aa, Glycine max
  Coding DNA Sequence Number=SeqID_81241
LFLDGGKGYNSAVECHLDVVEVISSSLIIPKPNRTPVEYEAPGYKLCLGLEENSESALSTNKEAI

SEQ ID NO: 198020 - protein, 73 aa, Glycine max
  Coding DNA Sequence Number=SeqID_81242
  Homolog annotation: Hit_ID=O80919; Match level="QueryCoverage=75%, HitCoverage=13%, E-value=1e-09, Identity=61%"; Hit description =Expressed protein
MLSYVQCTTLLERLRNKRLVFVGDSLIRGQWVSMVCLVDSILPSTLKSMHSTANDSLRIFKAIVSPHSCNRHA

SEQ ID NO: 198021 - protein, 50 aa, Glycine max
  Coding DNA Sequence Number=SeqID_81243
MSGHRVRHRGSCSFTSALDFYLALYSNSSILGLDQLQYSRAGCQDIVSDI

SEQ ID NO: 198022 - protein, 1069 aa, Glycine max
  Coding DNA Sequence Number=SeqID_81244
  Gene Ontology: Mol. function=protein serine/threonine kinase activity; Cellular component=integral to membrane; Biological process=protein amino acid phosphorylation
  Homolog annotation: Hit_ID=Q9SN80; Match level="QueryCoverage=92%, HitCoverage=97%, E-value=0.0, Identity=42%"; Hit description =Receptor-kinase like protein
  Pfam annotation: Domain name=LRRNT_2; Domain location=33-73; Score =59.0; E_value=1.6e-14; Accession=PF08263.3; Description=Leucine rich repeat N-terminal domain
  Pfam annotation: Domain name=LRR_1; Domain location=102-124; Score =6.9; E_value=15; Accession=PF00560.23; Description=Leucine Rich Repeat
  Pfam annotation: Domain name=LRR_1; Domain location=126-148; Score =8.4; E_value=7.5; Accession=PF00560.23; Description=Leucine Rich Repeat
  Pfam annotation: Domain name=LRR_1; Domain location=150-172; Score =11.1; E_value=2.3; Accession=PF00560.23; Description=Leucine Rich Repeat
  Pfam annotation: Domain name=LRR_1; Domain location=174-196; Score =16.5; E_value=0.098; Accession=PF00560.23; Description=Leucine Rich Repeat
  Pfam annotation: Domain name=LRR_1; Domain location=198-220; Score =13.0; E_value=1.1; Accession=PF00560.23; Description=Leucine Rich Repeat
  Pfam annotation: Domain name=LRR_1; Domain location=222-244; Score =17.3; E_value=0.056; Accession=PF00560.23; Description=Leucine Rich Repeat
  Pfam annotation: Domain name=LRR_1; Domain location=246-269; Score =5.1; E_value=32; Accession=PF00560.23; Description=Leucine Rich Repeat
  Pfam annotation: Domain name=LRR_1; Domain location=271-293; Score =2.0; E_value=1.2e+02; Accession=PF00560.23; Description=Leucine Rich Repeat
  Pfam annotation: Domain name=LRR_1; Domain location=295-316; Score =11.5; E_value=2; Accession=PF00560.23; Description=Leucine Rich Repeat
  Pfam annotation: Domain name=LRR_1; Domain location=318-340; Score =2.0; E_value=1.2e+02; Accession=PF00560.23; Description=Leucine Rich Repeat
  Pfam annotation: Domain name=LRR_1; Domain location=348-369; Score =10.3; E_value=3.3; Accession=PF00560.23; Description=Leucine Rich Repeat
  Pfam annotation: Domain name=LRR_1; Domain location=373-395; Score =9.3; E_value=5.3; Accession=PF00560.23; Description=Leucine Rich Repeat
  Pfam annotation: Domain name=LRR_1; Domain location=397-419; Score =7.3; E_value=12; Accession=PF00560.23; Description=Leucine Rich Repeat
  Pfam annotation: Domain name=LRR_1; Domain location=421-443; Score =7.7; E_value=10; Accession=PF00560.23; Description=Leucine Rich Repeat
  Pfam annotation: Domain name=LRR_1; Domain location=445-467; Score =7.0; E_value=14; Accession=PF00560.23; Description=Leucine Rich Repeat
  Pfam annotation: Domain name=LRR_1; Domain location=469-492; Score =15.8; E_value=0.16; Accession=PF00560.23; Description=Leucine Rich Repeat
  Pfam annotation: Domain name=LRR_1; Domain location=493-515; Score =6.7; E_value=16; Accession=PF00560.23; Description=Leucine Rich Repeat
  Pfam annotation: Domain name=LRR_1; Domain location=517-539; Score =11.8; E_value=1.8; Accession=PF00560.23; Description=Leucine Rich Repeat
  Pfam annotation: Domain name=LRR_1; Domain location=541-563; Score =15.2; E_value=0.23; Accession=PF00560.23; Description=Leucine Rich Repeat
  Pfam annotation: Domain name=LRR_1; Domain location=565-587; Score =18.2; E_value=0.03; Accession=PF00560.23; Description=Leucine Rich Repeat
  Pfam annotation: Domain name=LRR_1; Domain location=589-612; Score =2.4; E_value=1e+02; Accession=PF00560.23; Description=Leucine Rich Repeat
  Pfam annotation: Domain name=LRR_1; Domain location=78-100; Score =3.6; E_value=62; Accession=PF00560.23; Description=Leucine Rich Repeat
  Pfam annotation: Domain name=Pkinase; Domain location=707-978; Score =123.1; E_value=8e-34; Accession=PF00069.15; Description=Protein kinase domain
  Pfam annotation: Domain name=Pkinase_Tyr; Domain location=707-1014; Score=40.9; E_value=5.6e-15; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=33-73::102-124::126-148::150-172::174-196::198-220::222 -244::246-269::271-293::295-316::318-340::348-369::373-395::397 -419::421-443::445-467::...
  Pfam module annotation: Domain location=469-492::493-515::517 -539::541-563::565-587::589-612::78-100::707-978::707-1014
MSSVVCPTCLAWFLLFTSNLWSQNTITTYALGNETDHFALLKFKESISHDPFEVLNSWNSSSNFCKWHGVTCSPRHQRVKELNLRGYHLHGFISPYIGNLSLLRILLLNDNSFYGEVPQELDRLFRLHVLNFADNTLWGEFPINLTNCSKLIHLSLEGNRFIGEIPRKIGSFSNLEELLIGRNYLTRQIPPSIGNLSSLTCLSLRSNKLEGNIPKEIGYLKNLRILRVSDNKLSGYIPLSLYNLSSLNVFIITKNQFNGSFPVNLFLTLPNLNFFAVGANQFSGSIPTSITNASGIQTLDIGNNLLVGQVPSLGKLKDISILQLNLNKLGSNSSNDLQFFKSLINCSQLEILDIGDNNFGGPFPSFVGNYSITLTQLIVGRNHFFGKIPMELGNLVNLITLAMEKNFLTGIIPTTFGKLQKMQLLSLGVNKLIGEIPSSIGNLSQLYYLELSSNMFDGNIPSTIGSCRRLQFLNLSNNNITGAIPSQVFGISSLSTALVSHNSLSGSLPTEIGMLKNIEWLDVSKNYISGVIPKTIGECMKLEYLYLEGNSFHGSMPPSLASLKGLRKLDLSRNNLSGSIPERLQNISVLEYFNASFNMLEGEVPTNGVFQNASAISVTGNGKLCGGVSELKLPPCPLKVKGKKRRKHHNFKLVVMIICLVLFLPILSCILGMYLIRKRKKKSSTNSAIDQLPKVSYQNLNHATDGFSSQNLIGIGSHGSVYKGRLDSTEGFVAIKVLNLQKKGSNKSFVAECKALRNVRHRNLVKAVTCCSSVDYNGNDFKALVFEYMSNRSLEEWLHPQNGSAERPRTLDLETRLEIVVGVASALHYLHHECEEPIIHCDIKPSNVLLDDDMVAHVSDFGLARLVSKIDNCHNQISTSGIKGTIGYFPPEYGASSQVSTKGDMYSFGILILEILTGRRPTEEMFKDGQTLHDYVKIALPNNFSEIVDATLISMGNESSPTITVSEQNSIFEIVDHLHPNTKKCLFSLFRIGLACSVEPPGQRMNMMEVTKELNMIRNVFYARRIRENISSLDHMVIQQGQVTCQDYPNDDTVGSGFMLDSLVECKFE

SEQ ID NO: 198023 - protein, 87 aa, Glycine max
  Coding DNA Sequence Number=SeqID_81245
MEMLDMLVWFNVYFLVNKFKQLCKGYDLVNHESFYVVTNEGGALVRVADLTVVGYLKVLRMSSVGSGIYRICWLQAGVHCLVTCTGK

SEQ ID NO: 198024 - protein, 160 aa, Glycine max
  Coding DNA Sequence Number=SeqID_81246
MKREEKSQRGRKERQASKPGDRKPRQKLEGLGTNAHGRSNEGAASQLDTWQKTKARHQARWQKTKVKAGGLYARTFTHAKIKYFKPPFDKLVGHELESRNIFACAKIRLRTTTLPHIYLHVKRSLRPLGYVSFLFKYWINDGKFYTKSTDSKSNERMQIS

SEQ ID NO: 198025 - protein, 157 aa, Glycine max
  Coding DNA Sequence Number=SeqID_81247
  Gene Ontology: Mol. function=oxidoreductase activity, acting on single donors with incorporation of molecular oxygen, incorporation of two atoms of oxygen
  Homolog annotation: Hit_ID=Q1RT74; Match level="QueryCoverage=56%, HitCoverage=54%, E-value=2e-28, Identity=65%"; Hit description =Glyoxalase/bleomycin resistance protein/dioxygenase
MAIDQILSIDLGPCRATLINKLYGLYGLFNYGIGIHLLESEKVPVKKREINPKENHISFQCSDMKVIMQKLDAMKIEYVTAVVEEGGIKVDQLFFHDPDGYMIEICNCQNLPVLPISSCPLKQLGGEATFKINCFAEESMSMLMMDNFVMDMLKISI

SEQ ID NO: 198026 - protein, 107 aa, Glycine max
  Coding DNA Sequence Number=SeqID_81248
  Gene Ontology: Mol. function=ribonuclease H activity; Biological process=RNA-dependent DNA replication
  Homolog annotation: Hit_ID=Q1S4N4; Match level="QueryCoverage=91%, HitCoverage=28%, E-value=7e-22, Identity=46%"; Hit description =Ribonuclease H
MAMDNEDMNTDGTSIGNPVNAGFGGINGDQHGNWITGYSGSCGYTTSLNAELLAIYFGMNLAWNLGYKTIVCESDSKVALDLIMKGINSTHPYAPLIQKIEALRRQA

SEQ ID NO: 198027 - protein, 306 aa, Glycine max
  Coding DNA Sequence Number=SeqID_81249
  Gene Ontology: Mol. function=ion channel activity; Cellular component= integral to membrane; Biological process=ion transport
  Homolog annotation: Hit_ID=Q5H8A5; Match level="QueryCoverage=89%, HitCoverage=28%, E-value=1e-123, Identity=85%"; Hit description =Putative ion channel POLLUX, chloroplast precursor
MLSDCSGGQGGDGGSNCAYALNYALHPSGWDSVVLEALLAPGSELWMFNEVPEKEREKKLVDGGLDVSELENIKLVHREGNAVIRRHLEGLPLETFDSHFRFEMNRCVLRKESSSTYAPYESVEDSVAHSDSRSLATLLLIRDIQSRRLPYRDTKSTSLRLSGFSHNSWIREMQQASDKSIIISEILDSRTRNLVSVSRISDYVLSNELVSMALAMVAEDKQINRVLEELFAEEGNEMCIKPAEFYLFDQEELCFYNIMIRGRTRKEIVIGYRLANQDRAIINPSEKSVPRKWSLGDVFVVIAKGD

SEQ ID NO: 198028 - protein, 621 aa, Glycine max
  Coding DNA Sequence Number=SeqID_81250
  Gene Ontology: Mol. function=ion channel activity; Cellular component= integral to membrane; Biological process=ion transport
  Homolog annotation: Hit_ID=Q5H8A5; Match level="QueryCoverage=93%, HitCoverage=70%, E-value=0.0, Identity=68%"; Hit description =Putative ion channel POLLUX, chloroplast precursor
  Pfam annotation: Domain name=DUF1012; Domain location=383-592; Score=- 10.4; E_value=0.0014; Accession=PF06241.3; Description=Protein of unknown function (DUF1012)
MRKSNEESSNLSLRKPPLKRSKTIPNPKHTASAPHFSVSVSDSDEQWNYPSFLGTTTKKKKPSFKPHNLNLSKPSLVPPPPPPPPPPPPTSSSPLSSQVTRPQHHQRTPILYLLFITSIVFVPHSAYLQYRLTKLEDEKLNLCCQIDFCPGNERTSIEKVDASFSYILNADSRTVALYIVVVTLILPFVLYKYLDYLPQIINFLRRTNNNKEDVPLKKRVAYIVDVFFSVYPYAKLLALLFATLFLIGFGGLALYAVTGGSFAEALWHSWTYVADSGNHAETEGTGQRIVSVSISSGGMLIFAMMLGLVSDAISEKGSLLKQLAIANKSVGGGVIVVLAEKEKEEMEMDIAKLEFDFMGTSVICRSGSPLILADLKKVSVSKARAIIVLASDENADQSDARALRVVLSLTGVREGLGGHVVVEMSDLDNEPLVKLVGGELIETVVAHDVIGRLMIQCALQPGLAQIWEDILGFENAEFYIKRWPELDGLFFKDVLISFPDAIPIGVKVAADGGKIIINPDDSYVLRDGDEVLVIAEDDDTYAPGLLPEVCKGLCPWIRDPPKYPEKILFCGWRRDIDDMIMLWWPCLGHKGPPVGFKSLQAGGFFFFQSFRKIKQKQETRS

SEQ ID NO: 198029 - protein, 138 aa, Glycine max
  Coding DNA Sequence Number=SeqID_81251
MVVCIGSELQRSMSSVSICYGTQSDIREKRYCRLSWLRDSTFNFERLDILRDSIRHPSKKLLSFELAQRFNIQFRASRYITGLNQTSEGSTFNFECLDMLRDSIKHSSKKSMSFIFAQRFNIQFRASRYVTGLNQTSE

SEQ ID NO: 198030 - protein, 49 aa, Glycine max
  Coding DNA Sequence Number=SeqID_81252
  Homolog annotation: Hit_ID=Q41042; Match level="QueryCoverage=76%, HitCoverage=6%, E-value=8e-10, Identity=76%"; Hit description=Pisum sativum L
MVGKIFSNRVEKLLMFVYIQMLKGGLEALDMLSLQQQKQHKKCGTGLAL

SEQ ID NO: 198031 - protein, 116 aa, Glycine max
  Coding DNA Sequence Number=SeqID_81253
MTFMIEDNNLSIIIVPWLTLMEAKTLVANQTPESGSYHSVPVILICNVKFLMGNKSDPKAGATAVPPLRIGKREGENEDEQQVTAKKQKRDEVAEEQRIMDEIVSDDSFADFEPDK

SEQ ID NO: 198032 - protein, 425 aa, Glycine max
  Coding DNA Sequence Number=SeqID_81254
  Homolog annotation: Hit_ID=Q53ML8; Match level="QueryCoverage=38%, HitCoverage=16%, E-value=8e-73, Identity=83%"; Hit description =Similar to seven transmembrane protein Mlo4
  Pfam annotation: Domain name=DUF827; Domain location=10-163; Score= -101.2; E_value=0.0066; Accession=PF05701.2; Description=Plant protein of unknown function (DUF827)
  Pfam annotation: Domain name=NifU; Domain location=280-347; Score =126.2; E_value=9.5e-35; Accession=PF01106.8; Description=NifU-like domain
  Pfam annotation: Domain name=NifU; Domain location=361-425; Score =21.0; E_value=1.7e-06; Accession=PF01106.8; Description=NifU-like domain
  Pfam module annotation: Pfam domain module=DUF827::NifU::NifU; Domain location=10-163::280-347::361-425
MDFSSTVDTSRPFTSVKEAVAIFGERLLLGEIYSPIKRESSWRLSSPSPSPSSRPMKTDEENNNNNNGQLADIIKKLEAELEQTKVELKLLKERGSETEVALATLNAELHKNMSKLAQAEATAAGKAATTKTVRFEISEDRKDGTVEKKKESQSLSHMLSLGEKDHLFGGKKGKKQKQKQKPIIPLRSKKNKSKLGSKNLKNTTSKMHVVVVLNTQSYCRGLEPPSSSPSVVSNKGTRTLSFRRLLLRPSLGIHLSRSFALKCVVTPNPAVELPLTAENVESVLDEIRPYLIADGGNVALHQIDGNVVRLKLQGACGSCPSSVTTMKMGIERRLMEKIPEIVAVEPIADEETGLELNEDNIEKVLEEMRPYLVGAADGTLELVAIDEPIVKVRITGPAASVLTVRVAVTQKLREKIPAIAAVQLL

SEQ ID NO: 198033 - protein, 90 aa, Glycine max
  Coding DNA Sequence Number=SeqID_81255
  Gene Ontology: Mol. function=transcription regulator activity; Cellular component=nucleus; Biological process=regulation of transcription
  Homolog annotation: Hit_ID=Q1SB44; Match level="QueryCoverage=49%, HitCoverage=4%, E-value=9e-15, Identity=84%"; Hit description =Importin-beta, N-terminal
MKVLQRLVPGCDKVTRKALMLDEIINYVQSLQNQVELVTLLKFFLVLAYRNLTLQCLTEVAALQFGNYYDVQYVKMYNIFMGIHIVPNMS

SEQ ID NO: 198034 - protein, 579 aa, Glycine max
  Coding DNA Sequence Number=SeqID_81256
  Gene Ontology: Mol. function=ribonucleoprotein binding; Cellular component=nucleolus; Biological process=rRNA processing
  Homolog annotation: Hit_ID=Q2PEP5; Match level="QueryCoverage=82%, HitCoverage=63%, E-value=0.0, Identity=78%"; Hit description =Putative WD-40 repeat protein
  Pfam annotation: Domain name=BOP1NT; Domain location=155-410; Score =478.6; E_value=7.5e-141; Accession=PF08145.2; Description=BOP1NT (NUC169) domain
  Pfam annotation: Domain name=WD40; Domain location=411-463; Score =16.4; E_value=0.11; Accession=PF00400.22; Description=WD domain, G -beta repeat
  Pfam annotation: Domain name=WD40; Domain location=467-505; Score =1.3; E_value=26; Accession=PF00400.22; Description=WD domain, G-beta repeat
  Pfam module annotation: Pfam domain module=BOP1NT::WD40::WD40; Domain location=155-410::411-463::467-505
MRRTRSFGNVGCYGAMGVADMESCGDRDLTRCLGTLEMKGKKNTMTKNDVEDDGAPVPSPTVSDSDSDYEDSSADDDDKSSDSLDSQSESELEDASPENGGSGDVESAEDEDTVNDEDGGSESSDLHQEGAESDSSEDEVVAPRNTIGDVPLKWYEDEPHIGYDIKAKKIKKKEKQDKLDSFLASVDDSKNWRKIYDEYNDEVVELTKDEIKLVRRLLKNRAPHSDFDPYPDGVDWFKWEDAKHPLSNAPEPKRRFIPSKWEAKKVVQYVRAIRQGLITFDKPKEEDGPYLLWGDDSGSTERANHLAYIPAPKQKLPGHDESYNPPLEYIPTQEEVNSYQLMFEEDRPKFIPKRFASMRSIPAYENAMKDCFERCLDLYLCPRVRKKRLNIDPESLKPKLPSRKELKPYPTTCYIEYKGHEDAVTSISLEASGQWMASGGMEMGPLFSVICKGSSDGTVRIWEVETGRCLRRWEVGESVSCVAWNPLPNIHLLAVSVGQDVLLLNTCLGDDEEQKQIKELLWVDSSTALDDSGNQAPSVSWLKDDKHMGLRLRHFKTVTAVEWHRKGDYFSTVMPADIL

SEQ ID NO: 198035 - protein, 148 aa, Glycine max
  Coding DNA Sequence Number=SeqID_81257
  Gene Ontology: Mol. function=catalytic activity; Cellular component =integral to membrane; Biological process=cellular metabolic process
  Homolog annotation: Hit_ID=Q1T6L3; Match level="QueryCoverage=55%, HitCoverage=27%, E-value=1e-33, Identity=82%"; Hit description =Ribosome-binding factor A
  Pfam annotation: Domain name=LRR_1; Domain location=120-142; Score =15.3; E_value=0.22; Accession=PF00560.23; Description=Leucine Rich Repeat
  Pfam annotation: Domain name=LRR_1; Domain location=96-118; Score =10.0; E_value=3.9; Accession=PF00560.23; Description=Leucine Rich Repeat
  Pfam module annotation: Pfam domain module=LRR_1::LRR_1; Domain location=120-142::96-118
MAPSFDISTHTICVMDASGHLGFSLVQRLLQRGYTIHASVKKYGEENLFNGISSDPDKLKVFRSDPFDYHSIIDALRGCSDLCDWNGVSCTATRDHVIKLILHGNSLVGVIPKELGMLKSLKVLDLGINHLIGPIPPEIGNLTQVMKM

SEQ ID NO: 198036 - protein, 120 aa, Glycine max
  Coding DNA Sequence Number=SeqID_81258
  Gene Ontology: Mol. function=nucleic acid binding; Biological process= DNA integration
MKDLVEASFVLGIEIHRDRSCHTLKLSQNSYIDRVLERFNMQNCKPIDVPVVKGDKFNKDQCPKNEIERVDNLEVVGCTDSNLGGCLDDRRLAFGYIFMLVKGAILWKSFGHLILISVGK

SEQ ID NO: 198037 - protein, 238 aa, Glycine max
  Coding DNA Sequence Number=SeqID_81259
  Pfam annotation: Domain name=rve; Domain location=84-234; Score=10.7; E_value=0.00076; Accession=PF00665.16; Description=Integrase core domain
MNGVIGECTELRDLSAQRGQFSKFCVCSWINPSMERSNRLNLIAIKKTVSEHLLSGLPEKAIAKEFLNALGKRYQVSNDVESKCLMKQLTNIRYDNARGKGQHHNVGGPRSAIFKKEKFETLEKFKIFKNEVEKELGKVIKIVRFDRGGKYYGKYGVTGQHMGLFALYLQDYGIVPQYTIHGSPEQNGVAKRHNRTLKDMMRSMMSRFETTIVTRDIVGSQANDMFDPPIGDENAQTN

SEQ ID NO: 198038 - protein, 51 aa, Glycine max
  Coding DNA Sequence Number=SeqID_81260
MATSDFTYESLCTQYPDEGVPYVLKIGLIHLLPKCHGLSGEDPYKHLKESI

SEQ ID NO: 198039 - protein, 106 aa, Glycine max
  Coding DNA Sequence Number=SeqID_81261
  Gene Ontology: Mol. function=metal ion transporter activity; Cellular component=integral to membrane; Biological process=response to nematode
  Homolog annotation: Hit_ID=O64738; Match level="QueryCoverage=79%, HitCoverage=33%, E-value=4e-09, Identity=30%"; Hit description=Zinc transporter 6, chloroplast precursor
  Subcellular localization annotation: CTP_CleavageSite=8; ConfidenceScore=5.31e-01
MCMLLHVRAAARSTTRARSVPTSMTRPARGKSLQGWCDATWHWRVQRTSRGARGPVRSKRGFLQKIPARTADDDIPTTLVTKMTKIEINFRCATARVAFVTHAERE

SEQ ID NO: 198040 - protein, 218 aa, Glycine max
  Coding DNA Sequence Number=SeqID_81262
MELDEFKAELERRNFHKCLTNLADNNIDLALVKEFYANLYSPEGPSPKQVRIRGHLIRIDADSLNTFLETPVFVLNAEGYPGKILRNDLTTLAQLDMNVGAFISGQITSMAQSNSSRLFPALIIALCRSRGVASDSLVFERLSPIINLAYIRKNYWNLDDLTAIIRGARRARARPAKAPSTSAPPLPARTSTAPSTPPSVAWPGIQPPIHREDEGPTA

SEQ ID NO: 198041 - protein, 42 aa, Glycine max
  Coding DNA Sequence Number=SeqID_81263
MRKQEQERDDVGLDLLHARGWKQYREVLSRWEESELQSKTVL

SEQ ID NO: 198042 - protein, 426 aa, Glycine max
  Coding DNA Sequence Number=SeqID_81264
  Gene Ontology: Mol. function=nucleic acid binding; Biological process= DNA integration
  Homolog annotation: Hit_ID=Q1SDG1; Match level="QueryCoverage=34%, HitCoverage=12%, E-value=1e-22, Identity=37%"; Hit description =Integrase, catalytic region; Zinc finger, CCHC-type
  Pfam annotation: Domain name=zf-CCHC; Domain location=236-253; Score =8.3; E_value=0.043; Accession=PF00098.13; Description=Zinc knuckle
MKEEFVANKPPMFKGANYDYWKKMMIAFFESTHIDMWDVVEKGNDIPLDAHKNEIHRDKWKNDNKSRFLLNSSMRNALLCALSQEEYSKVHDFRSAKQIWDTLAITYEGSSKVKHNKLSLLTSIKNLDSMTLEELVGILKVHEQELAQDEGIKKGKLLALIAQRPKCNFVSKESSSVALVVDDTSKEESNDDDSDEEDEELSLITRKIKKMWKNKNSSRFKSSSKRSVHKKEKSPDICYECKKLGYFKSECSDLEKLEDKKKKFFKSKKKSLMSTWEDLDDSSCNEDNEEEANLCLMADVFTSKIEPALDASLDDEDPQINYSVNFDSDEVIFESREDLIKGYNQLLFAFAYVSKAYRKLNKCFQNLERQHGDLKKIHQAHLVDFVLETTSPGDVLFVRRLRHYWMKRYLVDERFFLRIFKTWKKG

SEQ ID NO: 198043 - protein, 73 aa, Glycine max
  Coding DNA Sequence Number=SeqID_81265
  Gene Ontology: Mol. function=protein serine/threonine kinase activity; Biological process=protein amino acid phosphorylation
  Homolog annotation: Hit_ID=Q7Y1P1; Match level="QueryCoverage=99%, HitCoverage=7%, E-value=5e-11, Identity=61%"; Hit description =Putative receptor-like kinase
MAPEYAMKGVVSIKTDVFSLGVLLLEILSSKKNNSRYHSDHPLNLIGYVKIFCGCSNSCRRGSSGMQAELWSL

SEQ ID NO: 198044 - protein, 82 aa, Glycine max
  Coding DNA Sequence Number=SeqID_81266
MTAGRRGGGEEEEAEEEKKEAKKFNQVLIGKERDHFEGVINEIERKGNLLEKLLKKSIEQRCTSRRRSTSFMKMGMDVAPLR

SEQ ID NO: 198045 - protein, 406 aa, Glycine max
  Coding DNA Sequence Number=SeqID_81267
  Gene Ontology: Mol. function=magnesium ion binding; Cellular component=chloroplast; Biological process=metabolic process
  Homolog annotation: Hit_ID=Q6EJ97; Match level="QueryCoverage=95%, HitCoverage=44%, E-value=4e-92, Identity=79%"; Hit description =Isoprene synthase
  Pfam annotation: Domain name=Terpene_synth; Domain location=1-301; Score=171.1; E_value=2.7e-48; Accession=PF01397.11; Description =Terpene synthase, N-terminal domain
  Pfam annotation: Domain name=Terpene_synth_C; Domain location=306 -406; Score=16.2; E_value=1.9e-06; Accession=PF03936.6; Description =Terpene synthase family, metal binding domain
  Pfam module annotation: Pfam domain module=Terpene_synth::Terpene _synth_C; Domain location=1-301::306-406
MENLEERARKVEEEVRRMINGADTEALRLLELIDEIQRLGLTYKFEKDIFKALEKTISLDENEKHISGLHATALSFRLLRQHGFEVSQGTIYTHIYTYQRLTGLHFFYTVSCETNTKDEEKGNDKASYETEKGRRTSNNSVRRRTNCRTARVTVGLQRTTTEDDSDITTSREDAMLVMTELQCRERLQIRVQKRSSESDESERFQNVFKRFKDKEGGFINELKGDMQGLLSLYEASYLGFEGETLLDEARAYSITHLKNNLKVGVNTEVKEQVSHALELPYHRGLNRLEARWFLEKYEPNESHHHVLLELAKIDFNLVQVMYQKELRELSRWWSEMGLTSKLKFVRDRLMEVYFWVLGMAPRPQFSECRKAVTKTFALIGIIDDVYDVYGTLDELQLFTDAIERFV

SEQ ID NO: 198046 - protein, 139 aa, Glycine max
  Coding DNA Sequence Number=SeqID_81268
LIHHHFHCLHLRTPERQANPSLSLLTYNALDKLATATTIAPLIWQYYSNSNLSLNFKAYISTSINTFLATSPQGLTSFTTPGWEDTKPDVEHSFMQQLVLFHSDGFARFIPCCADVDTGKSKEELLLQLHAYQMYMPAM

SEQ ID NO: 198047 - protein, 225 aa, Glycine max
  Coding DNA Sequence Number=SeqID_81269
  Gene Ontology: Mol. function=magnesium ion binding; Cellular component=chloroplast; Biological process=metabolic process
  Homolog annotation: Hit_ID=Q6EJ97; Match level="QueryCoverage=99%, HitCoverage=37%, E-value=1e-98, Identity=81%"; Hit description =Isoprene synthase
  Pfam annotation: Domain name=Terpene_synth_C; Domain location=1-169; Score=45.9; E_value=1.4e-10; Accession=PF03936.6; Description =Terpene synthase family, metal binding domain
MNTLPDYMKLCYLAVYNTVNDTCYSTLKAKGHNNMSYLTKSWCELCKAFLQEAKWSNNKIVPTFSKYLENASVSSSGMALLTASYFSVCQQQDISNQQALCSLTNFQGLVRSSSNIFRLCNDLATSAAELETGETANSITCYMHEKDTSEEQAREELTNLIDAEWKKMNREFVSNSTLPKAFKEIAINMARVSHCMYQYEDGLGRPGYTTENKIKLLLIDPVPIN

SEQ ID NO: 198048 - protein, 144 aa, Glycine max
  Coding DNA Sequence Number=SeqID_81270
  Subcellular localization annotation: CTP_CleavageSite=79; ConfidenceScore=5.16e-01
MGVIFMTFTEPRSHWRDQNFKMMSLCKTQNALSPFMLAWNRRARTKKKSPSDAMRNPWVAHNRVFGTCFGPRSYVGCCVCSWEAKCTELPGSLALALGHVHTPYGVYVIGGALIGPWSLALTFGRVHSSYDIGNRVTVAECTLY

SEQ ID NO: 198049 - protein, 87 aa, Glycine max
  Coding DNA Sequence Number=SeqID_81271
MMIRTSDGLLNLLQATMTPTHDALLYYNGRWNMSRQHDFVGYSFTRKNPKRFDIPSECTIDGLKDMIKQVAPQGIPPYGIHESQTIR

SEQ ID NO: 198050 - protein, 108 aa, Glycine max
  Coding DNA Sequence Number=SeqID_81272
  Homolog annotation: Hit_ID=Q7XZF5; Match level="QueryCoverage=55%, HitCoverage=3%, E-value=3e-19, Identity=68%"; Hit description=RST1
MSILMILHTCRGQQHIFLCTSYIDAYSGEGLQGQRHLVMKEVLPPSVHMVKSAASKFLLEWLFQHEHEHRQWSAAVSLGLISSCLHVTDHKERYHNITGLLEASGSGE

SEQ ID NO: 198051 - protein, 119 aa, Glycine max
  Coding DNA Sequence Number=SeqID_81273
MLERESAGYNILLIEESLSIPIARADADVDADVVMAIAQDRYLLVSFNHAISATMSFFTAIFAFLITCKKETGVVFGIVVASNSEAEKTSPPLSLSLWRDGDSGGLGRDVRVAAGCICK

SEQ ID NO: 198052 - protein, 109 aa, Glycine max
  Coding DNA Sequence Number=SeqID_81274
MNVTTLFGNLRDYELDLGRLKDEEEVDKKKKGLALKTSTLQCEGASSIEGKCVESPPTFIWGKCRKNQNGKGQGFAYFENEGSGVVYARGRVFPSLLRILECDEDIRPT

SEQ ID NO: 198053 - protein, 114 aa, Glycine max
  Coding DNA Sequence Number=SeqID_81275
MRVFLDSVDRGVGDVVVNGPHIPKVVVDGKEVEKYFNSLSHEGTTKVKRARKKTLIQEYEMFRMLSRKSISDVQNHFTHVLSHLLALGKNFVLEIRESTTWNNLRLKLEAQRKV

SEQ ID NO: 198054 - protein, 167 aa, Glycine max
  Coding DNA Sequence Number=SeqID_81276
  Homolog annotation: Hit_ID=Q9LI88; Match level="QueryCoverage=34%, HitCoverage=31%, E-value=4e-11, Identity=50%"; Hit description =Arabidopsis thaliana genomic DNA, chromosome 3, P1 clone:MYF5
  Subcellular localization annotation: CTP_CleavageSite=30; ConfidenceScore=5.44e-01
MCRSWWARTSPRTESSTALRRRSSKPVCFRSANVEGSLRTKTTRSRGRPAKLLEGIEREGLDLRSFFLPFLFNHAAKKPQSRAWAQNKHDSEKKKKDAAHDDIDDWELPHVVARTTDAFIFITGVKNDTTLAPLTKKEISDLVLTADFKFEDLSSDSKGKPTMDELE

SEQ ID NO: 198055 - protein, 155 aa, Glycine max
  Coding DNA Sequence Number=SeqID_81277
MDMTRMDEEEAKEKKSRGLVLKSPIPSTDKSDEESVEGSKSKNLTLIVRKFKKFLENKNPKGRSFQHNKNFKKNDLTFSNFISFEMLLAPQVIQAMKKRQICLMADDEVESAISSSDFKTKLDENYDQLLDALNEMHEEAQKLSQANNSLKGNLR

SEQ ID NO: 198056 - protein, 819 aa, Glycine max
  Coding DNA Sequence Number=SeqID_81278
  Gene Ontology: Mol. function=zinc ion binding
  Homolog annotation: Hit_ID=Q9FN44; Match level="QueryCoverage=98%, HitCoverage=17%, E-value=0.0, Identity=55%"; Hit description=Genomic DNA, chromosome 5, P1 clone:MYJ24
PTDLFDPGDAILISIFFGERRKFPGERFSTDGWLRILRKLGLRTATEVEVIIECAKRVEFLGIECMKTGDLDDFEADTINTCSEVSPEVWALGGSVVEFVFSNFALFFSNNFCDLLGNIACVPAELGFPSVGCKRVLASYNEAILSKDWPLAWSCAPILSKQHTVPPEYSWGPLHLQSPPPFCTVLKHLQVIGRNGGEDTLAHWPIASGMNIEECTCEILKYLDKVWSSLSSSDVAELHKVAFLPVANGTRLVAADALFARLMINLSPFAFELPTVYLPFVKILKDLGLQDMLTLSAAKGLLLNLQKACGYQRLNPNELRAVMEILNFICDQIVEGNTLDGLNWKSEAIVPDDGCRLVHSASCVYVDSYGSRYVKCIDTSRIRFVHADLPEGVCIMLCIKKLSDIVLEELDENHTLQTLGSLGSVSLVTIKQKLSSKSLQTAVWTIVNSMGSYIPAFNSFSLDTMECLLNSTAEKLQFVKSLKTKFLLLPNLVDVTRAGKDFIIPEWKNDSAHQTLYFMNQSRSRILVAEPPTYISLFDLIAIIVSQILGSPIILPIGSLFGCPEGSEIAVVNVLKLCSDKKEVEPVNGSSNMVGKEILPQDARLVQFHPLRPFYSGEIVAWRSQHGEKLKYGKVSEDVRSSAGQALYRLKIEVSPGDTQSFLSSHVFSFKSVSASSPLKESLVHESHVLGSNRPHVDFPESSGRGESYSQVQPVRDQSGKVSAAELVQAVNEILSAAGIKMDVEKQALFQRTINLQENLKESQAALVLEQERVEKATKEADTAKAAWVCRVCLSSEVDITIVPCGHSSIRQYRLTEVG

SEQ ID NO: 198057 - protein, 86 aa, Glycine max
  Coding DNA Sequence Number=SeqID_81279
MDKNLRRTKNTNKKMNEGLKVEVGAEEVEAEVQRKKESRGYKGRLGAKDGGADRGGWGPTKEVAKEVGVCSVNFKWIHKMCLKISN

SEQ ID NO: 198058 - protein, 578 aa, Glycine max
  Coding DNA Sequence Number=SeqID_81280
  Gene Ontology: Mol. function=zinc ion binding
  Homolog annotation: Hit_ID=Q9FN44; Match level="QueryCoverage=97%, HitCoverage=11%, E-value=1e-166, Identity=52%"; Hit description =Genomic DNA, chromosome 5, P1 clone:MYJ24
RYLAYDLTPVAGIAALISSNGHHANVYSRSSIMAPLPMSGCINMPITVLGCFLVCHNRGRYLFKYQDRGTLAEGHFDAGNQLIESWNREVMSCVRDSYVEMVLEIQKLRRDIPSSIIDSSVCSAISLSLKAYGDKIYSFWPRSCERHVLSDQLGNHDNNHPSTTAVVLKADWECLKDRVIHPFYSRIVDLPVWQLYSGTLVKAEEGMFLSQPGNGLLGNLLPATVCSFVKEHYPVFSVPWELVTEILAVGFSVREIRPKMVRDLLKVSSKPIALRSVDMYIDVLEYCLSDFQLAESSSSARDNDPASANVFCRETDNGITSSQMGSNIHGSTGMATRGSASSGDALEMMTSLGKALFDFGRGVVEDMGRAGTPVAYNAAGIDQIRDQKFISIAAELKGLPFPTATSHLKKLGFSELWIGNKEQQSLMVPLGEKFIHPKILDRPLLGDIFSNFSLQSLLKLRNFSLNLLANHMKLIFHEDWVNHVMGSNMAPWLSWEKLPSSGSQGGPSPEWIRIFWKSFRGSQEELSLFSDWPLIPAFLGRPVLCRVRECHLVFIPPLLEYPTSTSGISERESAGSYE

SEQ ID NO: 198059 - protein, 281 aa, Glycine max
  Coding DNA Sequence Number=SeqID_81281
  Gene Ontology: Mol. function=protein binding; Cellular component =integral to membrane
  Homolog annotation: Hit_ID=Q5N7I7; Match level="QueryCoverage=86%, HitCoverage=65%, E-value=1e-54, Identity=48%"; Hit description =Putative NTS2 protein
  Pfam annotation: Domain name=DUF803; Domain location=17-271; Score =232.8; E_value=7.6e-67; Accession=PF05653.4; Description=Protein of unknown function (DUF803)
  Subcellular localization annotation: CTP_CleavageSite=55; ConfidenceScore=5.14e-01
MATSSSSSSTSSWREGMSSDNIKGLCLALSSSFFIGASFIVKKKGLKKAGASGIRAGSGGYSYLYEPLWWVGMITMIVGEIANFAAYAFAPAILVTPLVLLLLILFYGRGYIFLEFLVAFCVSWDLQQLFCMLLKNGKLNLFQKCGILLWNQISYLTTNQEHNLSTAAFLFYAALVITATFILIFHFIPLYGQTHIMVYIGVCSLVGSLTVMSVKALGIVIKLTLSGMNQLIYPQTWAFTLVVIVCVLTQMNYLNKLNEEGQQGKQKFDSRLSVGQDFPVF

SEQ ID NO: 198060 - protein, 280 aa, Glycine max
  Coding DNA Sequence Number=SeqID_81282
  Gene Ontology: Mol. function=2,5-didehydrogluconate reductase activity
  Homolog annotation: Hit_ID=Q11DV1; Match level="QueryCoverage=47%, HitCoverage=48%, E-value=6e-49, Identity=72%"; Hit description =Aldo/keto reductase
  Pfam annotation: Domain name=Aldo_ket_red; Domain location=152-279; Score=-60.6; E_value=9.5e-06; Accession=PF00248.11; Description =Aldoketo reductase family
LARHHAGIGQGADAESHIGAIKIKINQFVRQGQKFRQQRLKRQRAQCNRCIDADRTARACRTLRKFAFDFLEIAQQPLTTLIINLPLGRQRQAAGRAFQKPHAEPCFDTGYKLADGRRDQQNDGPKHEPPKLALLTRNAEGQSTGDNMKIVNAHGAAIPALGFGVFRMTDAEVENVVPAALEAGFRHFDTAQIYQNEAALGRALEKAGARREDLFLTTKVWVDNYSAEKFSTSVDESLDKLKVDQVDLLLLHWPADKVAIADQIDMLNTVQTAGKTRFIG

SEQ ID NO: 198061 - protein, 670 aa, Glycine max
  Coding DNA Sequence Number=SeqID_81283
  Gene Ontology: Mol. function=nucleic acid binding
  Pfam annotation: Domain name=zf-CCHC; Domain location=426-443; Score =6.1; E_value=0.096; Accession=PF00098.13; Description=Zinc knuckle
MDWTREEFMVVMHHMGKFKFEPSLHYADVKKDTFHGLNIDTWSFFEGVGLLKGLVYDGKMKFWWKAEDAQFEGNLKPFMNDNDALKLPKFALLNKCKVGIYVEHTVSIAEIVEQVDDDTVNVCGKEQLGSEDGHFLNVGESENVDGVGQSKQNSSRDVCSGELAISQMMKIAMTIFHKMQLVVDDEMHMHQIEEDYFSEELVSDIEDSDVEGNAWADWARKLAIEDVERDATKQYSLPSLDVQPRFGAFYMCLDGCKRSFLAACRPFIRAIVEFEAKESWKWFLTLLFQDIGDVRTYKWVFMSDRQKGLNLVFDELLGDVEHGASFEEAWDEKMNISKRHACAAIQDNSQEPEDYVDKYYLKDTYMKCYEHAITAINGPINWPETPAESILPPEYKQGVGRPKKLRRREPDEEPSATKYRRTCTKKKCGRCREVGHNVGKCPAVIDSVTPNENPVGATVNVDATNPQFDNEVDGDGTTVNLTGSGINESNRMNQVRQTAQLKQEQHVESAKECGMPQSNLVGVPKVLTSDAVKKPTSTATASAALKPAIVGAPKILKPPTTRVSKSAPSTAAGVGSHDQNTKGKGKKNHPLIPTIGKKIQAYTVAQCVVAATNHKVKQLQQINKKQSSNNSKYSHQHVGSSTKKVEGQGYVPFGNTQSSHVLNEGQHSGI

SEQ ID NO: 198062 - protein, 100 aa, Glycine max
  Coding DNA Sequence Number=SeqID_81284
  Homolog annotation: Hit_ID=Q9FN44; Match level="QueryCoverage=74%, HitCoverage=1%, E-value=4e-17, Identity=58%"; Hit description =Genomic DNA, chromosome 5, P1 clone:MYJ24
MKFFILEVSGTDLTQRFCDQFSPMLIDRNDLWSLADSTIIRMPLSSDCLKVEPDLGSNRIKHITDIFMEHGSRALLFLKSVLQVVANSSKKCWGFDVVKI

SEQ ID NO: 198063 - protein, 849 aa, Glycine max
  Coding DNA Sequence Number=SeqID_81285
  Gene Ontology: Mol. function=RNA-directed DNA polymerase activity; Cellular component=membrane; Biological process=RNA-dependent DNA replication
MASNPEKSAGNHAPHLMQQEELFVFGVRDLSRSPAERMGTCQRGMMGGSIREFNDWIAELEVEEVPWVGKGFTWFKPNGTTKSKLDRIFVSPEWISKWPGSFQHTLHRNFSDHCPVLLTSKSVDWGPKPFRILDCWLSDNSFKKLVQDSWTSNHLSGWGGYVLKQKIKTLKDKIKVWNREQFGNTFKKYKKIEDDLNKLEEESDDRQLDHNELIVRKQLQQALWEAAQAHESLLRQKARSKWIKEGDCNSRYFHLMINSRRRANCLNGVMIDGLWKDEPAIVKEEIRRFFLQHFHENVQARPTLDGICFQSIDIQQNDMLVERFKEDEIKRAGIERIFYSPNSEASGIPKLKKVMHLIINERQSAFIQGRHMLHSVMIANEVVEEAKRGQKPCFIFKVDYEKAYDSVSWEFLTYMMTRMGFCTKWIQWIVGCLKSASVSVLVNGSPSSEFSPQRGLRQGDPLSPLLFNIVAEGLNGLLSKAIEKRLYRGFLVGTNKVEISLLQYADDTIFFGEASMENVRTIKAILRAFELASGLKINFAKSSCGAFGVSDLWISDAANYLHCSLMSFPFNYLGLPIGANPRRCQTWDPIITKCERKLGAQKSGEQVNKVAEEFSMGGSVGAKQNSLDPLGNGVLAKRRWRNLSEARSANNESTWWRDLKIVDQHPQQGEDNRLLEKYPRLYSISVQQNYFIQQMGEFKESGWEWDFKWRRPLFDNEIDMAVSFLQELEGNRIRSHRADQWVWVADSSGQYTVRSAYNVLREDLLQEDQDGEFKELWKVKVPSKVTVFAWRLLKDRLPTRDNLRRKHVELQDFMCPFCRTIEESADIIFFSTYMEHLKEYSWTDGRGGG

SEQ ID NO: 198064 - protein, 105 aa, Glycine max
  Coding DNA Sequence Number=SeqID_81286
MNAKVKVKVGGFLWLEGLVEACCLHRVVILCMRSNKLLMRTGQCFLLNGFIFLGSIFVLNSVVIPALWWILPDQCSQFVSHKLCDLGGTLKFYSFLRLALIQLFY

SEQ ID NO: 198065 - protein, 1951 aa, Glycine max
  Coding DNA Sequence Number=SeqID_81287
  Gene Ontology: Mol. function=zinc ion binding; Cellular component =cellular_component; Biological process=protein modification process
  Homolog annotation: Hit_ID=Q9FN44; Match level="QueryCoverage=98%, HitCoverage=63%, E-value=0.0, Identity=45%"; Hit description=Genomic DNA, chromosome 5, P1 clone:MYJ24
MEFFLRGFLQAVDQLHETPHPYASQPAGRNENNILRTGQAFCFLPLPVRTGLSVQVNGFFEVSSNRRGIWYGDDMDRSGKVRSTWNRLLLEDLVAPAFMHMLLGIKELLGPTDIYYSLWPIGSFEEPWNILVQQIYKNIGNAPVMYSNYNGGRWVSPSEAFLHDEKFTKSEDLGLALMQLGMPVVHLPNSLFDMLLQYSSCKVVTSGTVRQFLRECGMFNYLSRQYKLLLLEYCLEDLVDDDVGKEAYDLPLLPLANGNFASFSEASKGVSYFICDEFEYKLMQPVSDRVIDQNIPPNILNRLTGIAMSSKTNVILCSIHHFAQLFPAFMSADWKYRSKVFWDPESCQKPTSSWFLLFWQYLGKQTEILPLFSEWPILPSTSGHLLRPSRQLKMINGSNLSDTVQDILVKVGCNILSPKYVVEHPDISNYVCDGSAGAVLESIFNAVSGPVVMHASFDSLVTEERNELRRFLLDPKWYVGRSMDEFVIRLCKRLPIFQVYGRDSAQDYQFSDLENPRKYLPPLDVPEIILVGIEFMVRSSTIEGDILSRYYGVERMGKAQFYKQHVFNRVGDLQADVRDSIMLSVLQNLPLLSLEDISIKDSLRNLKFIPTFIGALKVLFSYLEVNALKWLPDQVIDNKGAVNRMLSRATTAFRSCNTKSDLEKFWNDLRLVSWCPVLVSTPFQSLPWPVVSSMVAPPKLVRPLNDLWLVSASMRILDGECSSTALLYGLGWMSPPGGGVIAAQLLELGKNNEIVSDQVLRQELAMAMPRIYSILSGMMASDEIEIVKAVLEGCRWIWVGDGFATSDEVVLDGPLHLAPYIRVIPVDLAVFKKMFLELGIREFLQPADYAHILCRMAVRKGSSPLDTQEIRVVTLIVHHLAEVYHHEPVQLYLPDVSGRLFLAGDLVYNDAPWLLGSDDPNGSFGNAPTVALNAKRTVQKFVHGNISNDVAEKLGVCSLRRMMLAESSDSMNFGLSGAAEAFGQHEALTTRLKHILEMYADGPGTLFEMVQNAEDAGASEVMFLLDKSHYGTSSVLSPEMADWQGPALYCFNDSVFSPQDLYAISRIGQESKLEKAFAIGRFGLGFNCVYHFTDIPMFVSGENVVMFDPHASNLPGISPSHPGLRIKFVGQQILEQFPDQFSPLLHFGCDLQHPFPGTLFRFPLRTAGLASRSQIKKEAYTPEDVRSLLAAFSEVVSETLLFLRNVKSISIFVKEGTGQEMRLLHRVHRTCIGEPEIGSTEAQDMFNFLKESRHVGMNRVQFLKKLSLSIGRDLPYKFQKILITEQSTSSRNSHYWITTECLGDGNAQKRTSETANSNCYNFVPWACVAAYLNSVKLDGDLVESSEVEDDCMVSPDLFKSVSLPTYPLENFEGRAFCFLPLPISTGLPAHVNAYFELSSNRRDIWFGSDMAGGGRKRSDWNIYLLENVVAPAYGHLLEKIASEIGPCNLFFSLWPTSLGLEPWASAVRKLYQFVAEFNLRVLYTEARGGQWISSKHAIFPDFTFPKAAELIKALSRASLPVITLPQSLLERFMEICPSLHFLTPRLLRTLLIRRKREFQDRNAMILTLEYCLHDLQESMQFDTLCGLPLLPVADGSFTSVDMKGVGERVYIARGDEYGLLKDSIPHQLVDCAIPEEVHRKLCYIAQTDGTNISFLSCQLLEKLLVKLLPVEWQHARQVSWTPGIHGQPSVEWLQLLWNYLKSYCDDLLMFSKWPILPVGDDCLMQLTQNLNVIRNDGWSEKMSSLLLKVGCLFLRHDLLLDHPKLEYFVQPVTARGVLNVFLAIAGEPQKIDGILTDVSEGELHELRSFILQSKWFSEEQIDDTNIEIIRHLPIFESYKSRKLVSLSNPIKWLGPTGVCEDLLNDKFIRTESEMERVIMKRYLGMKEPTKVEFYKDHIFNHMSEFLSKQEVVSAILHDVQHLIKQDLSLKSSFSSARFVLAGNGSWQQPSR

SEQ ID NO: 198066 - protein, 527 aa, Glycine max
  Coding DNA Sequence Number=SeqID_81288
  Gene Ontology: Mol. function=zinc ion binding
  Homolog annotation: Hit_ID=Q9FN44; Match level="QueryCoverage=94%, HitCoverage=41%, E-value=1e-105, Identity=40%"; Hit description =Genomic DNA, chromosome 5, P1 clone:MYJ24
MLHGNVFFPSDKFLDPEILDTLVCLGLRTTLGFTGMLDCARSVSLLHDSGDTDASKHGGELLDLLDTLAFKLSNKRESNNGDQQGGVALGSSSIMDDAFLYDGFPKDETSLTDIDSFLSSSTCDMVEEEFWSELKLISWCPVIPDPAVRGLPWLKSNNQVVAPPTSVRPKSQMWMVSSSMFILDGLNGVSWVWIGDDFVLPNALAFDSPVKFTPYLFVVPSELSEYKDLLIKLGVRLSFGISDYLHVLQRLQNDVHGVPLSTDQLNFVHRVLEAIAECCQEKPLFEPFDSPLLIPNDFGVLMQAGDLVYNDAPWLENNSLIGRHFVHPIISNDLADILGVQSVRCLSLVSDDLTKDLPCMDYNKVNELLAQYGDNEFLLFDLLELADCCKAKRLHLIYDKREHPRQSLLQHNLGEFQGPALVAIFECACLSREEFSNFQLRPPWRLRGNTINYGLGLVCCYSICDLLSVISGGYFYMFDPRGLVLGAPSTNAPSAKMFSLIDIAQCEMIGSSGPKNSRAPILCVLFY

SEQ ID NO: 198067 - protein, 128 aa, Glycine max
  Coding DNA Sequence Number=SeqID_81289
MAILFPLFVLTATGSESEQEISFEKHKWRVAGVGRLPIFYVADKVSMWMLSLLPLEKGDQDKFYVTSSDGIGWGIALVTSKIAGALFTVIHRKVVVVTTVGLVINDGAIHKKYTDCNQSVRSIQIDNS

SEQ ID NO: 198068 - protein, 60 aa, Glycine max
  Coding DNA Sequence Number=SeqID_81290
MTLHQGISKRPLSIITNSVVMVYTLSSSGKAVAHIEVEMSQAKPNFIRLEFDSLPVIDFV

SEQ ID NO: 198069 - protein, 777 aa, Glycine max
  Coding DNA Sequence Number=SeqID_81291
  Gene Ontology: Mol. function=RNA-directed DNA polymerase activity; Cellular component=extracellular region; Biological process=RNA -dependent DNA replication
KVKRKSNGDGAEEMVEMNDDDGKEDEGNKEIPPPPISKNGSVKDQKKRDQCQNVRSHAEFQKFVRTQWNHLIPWKELMVKIQNDLQRWNKEEVWSKYEEVLIQEEVFWFQKARSKWLAFRDTNSSYFHGTTVIRRRSRVDIIQDEDDVWISDPEQLKNLATGFYKSLFAESDDYVPYVVSGMFPTLNSHSLSALGAPVTFQEVYNTVRSMGAFKAPVPDGFQAVFYQSQWEVVGETLWKMVQMMFLNHQQIGEINETLITLIPKVDNVVKMKQLRPISLCNVSYKVITKLLAHRLRPLMGKLVSLCQCSFIPNRQSRDNIVIAQEVFHSMCNKKGSKGWMAIKIDLEKAYDRLSWKFVQDTLIDIGCPENFSDIVWQCLSSPTMRLLWIGEALEEFKPMKGVRQGDPISPYLFILCIERLFQLILITVDNKLWKPIQIAREALKLSHLAFADDLLIFVGASEDRAEVDQRLSAWKTCHLSYAGRVTLVKSVLQAMPSYVMQFTCIPRAVCDEIDKRCRSFIWGDSENHNKIHTVAWNNLSSLRMKVVWGLDLPGTDDLWVWIMRAKYRCGDDLGLCRNWKHVNQNLSWNIGDGTKVEFWKDRWTPGGGKLLEASTHSVPDHLSSDLACQYVDDNGCWNMNMFQPYLSFNSIDLIRAIPLPSSTKRNDQLPWNGSANARVRRHLTHDASCERCGADIENLDHIFRTCAESRVIWYMILPYSLHATFFTQDFDSWMNTNLQNEDNVNGRKWSRVFAVTLDNIWLYRNKTIFESFQFQPH

SEQ ID NO: 198070 - protein, 122 aa, Glycine max
  Coding DNA Sequence Number=SeqID_81292
MHEGQSFHGAPNKSGEWRIALGNHFAWLQTHWWRMHERQSILGAPNKSGEWTFALGNHFGWFQIHWWRMHERQSIHGVWIKCGEGRFALGNHYAWLQTHCWRRHKGQSIQGVPIKSGEWRLH

SEQ ID NO: 198071 - protein, 245 aa, Glycine max
  Coding DNA Sequence Number=SeqID_81293
  Gene Ontology: Mol. function=catalytic activity; Biological process =regulation of transcription
  Homolog annotation: Hit_ID=Q1SWL7; Match level="QueryCoverage=69%, HitCoverage=34%, E-value=2e-74, Identity=83%"; Hit description=TCP transcription factor
  Pfam annotation: Domain name=TCP; Domain location=61-214; Score =158.4; E_value=1.9e-44; Accession=PF03634.4; Description=TCP family transcription factor
  Subcellular localization annotation: CTP_CleavageSite=70; ConfidenceScore=5.61e-01
MELSDLQNKKQSSSSSSTGATHQQQQQQQQSSSTHLVVPSPSNSSASLIDASLAIATRSDDSTKKTQQPSTNTKRSTKDRHTKVDGRGRRIRMPATCAARVFQLTRELGHKSDGETIEWLLQQAEPAIIAATGTGTIPANFSTLNVSLRSSGSTLSAPPSKSAPHTFHGALALAHHPYDEAFQHPALLGFHPHHHQQQLLSADQIAEALPSAGGGDSGGNYLRKRYREDLFKDDNINNTQSQNDS

SEQ ID NO: 198072 - protein, 351 aa, Glycine max
  Coding DNA Sequence Number=SeqID_81294
  Gene Ontology: Mol. function=protein binding; Cellular component =cytoplasm; Biological process=cell adhesion
  Homolog annotation: Hit_ID=Q9C6V6; Match level="QueryCoverage=97%, HitCoverage=84%, E-value=1e-102, Identity=53%"; Hit description =Bystin, putative
  Pfam annotation: Domain name=Bystin; Domain location=95-348; Score =449.9; E_value=3.3e-132; Accession=PF05291.2; Description=Bystin
MAKRKERIQNPEPFDPYGADPAKTKKRSKPPKRHQQEEQFIAPKLSSKIMKQALIQQKEEEKEETHENNAAANLFEEVPNFEEDGGDDIDDFAGFSETQSQFAGYDEEINEEDERLMEAFISKEPENRPVPKLDKSIIDIYKGVGTHLSRYTIGKIPKAFKHIPSMQLWEEVLYITEPENWSPNALYQATRIFASNFGAKKAERFYKLVLLPRVREDIRKNKRLHFALYQTLKKALYKPAAFFKGILFPLCESRTCTLREAVIIGSIIEKVSIPPLHSSVALLKLSGMEYCGTTSYFIKLLLEKKYALPYRVVDAVVAHFMRFFNETRIMPVIWHQSLLAFVQRSVIHHLS

SEQ ID NO: 198073 - protein, 114 aa, Glycine max
  Coding DNA Sequence Number=SeqID_81295
  Gene Ontology: Mol. function=protein translocase activity; Cellular component=endoplasmic reticulum; Biological process=intracellular protein transport
  Homolog annotation: Hit_ID=Q9SW34; Match level="QueryCoverage=59%, HitCoverage=98%, E-value=6e-21, Identity=75%"; Hit description =Protein transport protein SEC61 gamma-1 subunit
  Pfam annotation: Domain name=SecE; Domain location=55-111; Score =86.0; E_value=1.1e-22; Accession=PF00584.11; Description=SecESec61 -gamma subunits of protein translocation complex
MTSLDPAWHDSIGQYTYISELNLHKHLMNEKKNPNETQERQTEKRMDAIDSVFDPLREFAKDSVRLVKRCHKPDRKEFSKVAVRTAIGFVVMGFVGFFVKLIFIPINNIIVGSG

SEQ ID NO: 198074 - protein, 83 aa, Glycine max
  Coding DNA Sequence Number=SeqID_81296
HFVSKRPFRGNTGSNKDRRKSLKVYQSHTGQGLKFSPWVKVYDKLGFWLKACRTAGHDICQGLANGLGIKGMSYIISMIHMQQ

SEQ ID NO: 198075 - protein, 41 aa, Glycine max
  Coding DNA Sequence Number=SeqID_81297
MDKGTLKTHIVLLDGESNSMGHRINKDVHEIIPVGKDLNTP

SEQ ID NO: 198076 - protein, 211 aa, Glycine max
  Coding DNA Sequence Number=SeqID_81298
  Gene Ontology: Mol. function=hydrolase activity; Biological process =signal transduction
  Homolog annotation: Hit_ID=Q7Y049; Match level="QueryCoverage=93%, HitCoverage=34%, E-value=3e-75, Identity=71%"; Hit description=LAF3 isoform 1
  Pfam annotation: Domain name=Amidohydro_3; Domain location=1-182; Score=-73.5; E_value=0.0062; Accession=PF07969.2; Description =Amidohydrolase family
MLPAGCLTGDSFQVAIHAIGDKANDLILDMYGLVASTNGMRDRRFRIEHAQQLAAGTPGRFGKQRVVASMQPDQLLDDADSTSKKLGKDRAEKESYLFRSLLNNNALVAFGSDWPVVDINPLSGIKTAMKRRPPNWQSAWIPSECISLDDAIKAYTISAARASFLDKDLGSLSPGKLADFVILSTDSWKDFAEDASANVEETYVSGVRAYP

SEQ ID NO: 198077 - protein, 427 aa, Glycine max
  Coding DNA Sequence Number=SeqID_81299
  Gene Ontology: Mol. function=helicase activity; Biological process =viral genome replication
  Homolog annotation: Hit_ID=Q1SN45; Match level="QueryCoverage=99%, HitCoverage=35%, E-value=3e-85, Identity=34%"; Hit description=AAA ATPase
MAICSTVGFSDLFLTFTCNPYWPEIQRSISALNLSAQDLPYIDIVTRVFKLKLEQLMSNLKDKKVLGNVLACLPHAHILLFLDVGSKYPSPADIDRIISIEILDSIEQPQLYECVKKHMMHGPFGLANRQCNDGKYIDRNGVALDNKYMVPYNPYLLLKYQAHLNIEWCNQSMSIKYLFKYINKGYDRITVALVPVKNEDGTTKQTVDDIKHYLDGRYISPCEACWRIFSFQIHKRSPAVERLYFYLLGENSVIFEDGDEIDALLSKLTIKESMFTSWLQANAIFQQAKDPTYLMMLGVVKGTTTYEQIRLVNGQLYSTFREACFAMGYLVDDKEYIEALEKHTIGLEIKELQTLALLEIKDILQCNKKSLKDYPAMPFARHVVLSQMGTGGMFFLYGYGGTGKTFMWKTLASALRSKGNTVLTVAS

SEQ ID NO: 198078 - protein, 572 aa, Glycine max
  Coding DNA Sequence Number=SeqID_81300
  Gene Ontology: Mol. function=DNA-directed RNA polymerase activity; Cellular component=nucleus; Biological process=transcription
  Homolog annotation: Hit_ID=Q1L5X4; Match level="QueryCoverage=98%, HitCoverage=28%, E-value=2e-62, Identity=28%"; Hit description=RNA polymerase IV largest subunit
NTSTTVDQTKTKSNEWSAWESNKSEIPAGGSKAVQEDSSKSNAWNRSTTADQTKTKSNEWSAWGSNKSEIPAGGSKAVQEDSSKSNAWNTSTTADQTKTKSNEWSAWGSNKSEIPAGGSKAVQEDSSKAWNTSTTADQTKTKSNEWSARVSNKSEIPAGGSKAVQEDSWGSSKWKADVAQEDNSRLGAWDANAADQTKSNEWSGWGKKKDVTQEDNVQHSWGSGKRKDKVTQEDNSGSGDWGANRTDLAITKSSEWSSWGKNKTEIPAGGSANVQNDSWGLGKLNDTQKDNSGCGAWGENSGSAWVRNKAETIDGGSEKPQEDAWNSGNWKAESKVGNTTWGKPKSSESHAWDSHNQSNQNSSSQGWESHIASANSENEKGFQWGKGRDSFKKNRFEGSQGRGSNAGDWKNRNRPPRAPGQRLDIYSSEEQDVLKDIEPIMQSIRRIMQQQGYSDGDPLAAEDQLFVLENVFEHHPDKETKMGAGIDYVMVNKHSSFQESRCFYVVCKDGQSKDFSYRKCLANYISKKYPDLAESFLGKYFRKPRARGDQTATLGGDQTATPAQDEAATSGE

SEQ ID NO: 198079 - protein, 1112 aa, Glycine max
  Coding DNA Sequence Number=SeqID_81301
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9M1I3; Match level="QueryCoverage=98%, HitCoverage=98%, E-value=0.0, Identity=64%"; Hit description=Beta Galactosidase-like protein
  Pfam annotation: Domain name=Bgal_small_N; Domain location=798-1093; Score=239.0; E_value=9.9e-69; Accession=PF02929.7; Description=Beta galactosidase small chain, N terminal domain
  Pfam annotation: Domain name=Glyco_hydro_2; Domain location=265-396; Score=26.9; E_value=1.6e-06; Accession=PF00703.11; Description =Glycosyl hydrolases family 2, immunoglobulin-like beta-sandwich domain
  Pfam annotation: Domain name=Glyco_hydro_2_C; Domain location=398 -663; Score=310.7; E_value=2.6e-90; Accession=PF02836.7; Description =Glycosyl hydrolases family 2, TIM barrel domain
  Pfam annotation: Domain name=Glyco_hydro_2_N; Domain location=88-263; Score=310.4; E_value=3.2e-90; Accession=PF02837.8; Description =Glycosyl hydrolases family 2, sugar binding domain
  Pfam module annotation: Pfam domain module=Bgal_small_N::Glyco_hydro _2::Glyco_hydro_2_C::Glyco_hydro_2_N; Domain location=798-1093::265 -396::398-663::88-263
MASSSLVVVGSLHLTSQNGYKVWEDPSFIKWRKRDPHVTLHCHESLEGSLKYWYQRNKVDFLASQSAVWNDDAVQGSLDCAAFWVKDLPFVKSLSGYWKFFIADSPNNVPTYFYESEFQDSGWKTLPVPSNWQLHGFDTPIYTNVVYPFPLDPPFIPVENPTGCYRTYFHIPKEWEGRRVLLHFEAVDSAFCAWINGHPVGYSQDSRLPAEFEITDFCHPCGSDLKNVLAVQVFRWCDGSYLEDQDQWRLSGIHRDVLLMAKPEVFITDYFFKSNLAEDFSCAEIMVEVKIDRLQETSKDNVLTNYSIEATLFDSGSWYTSDGNPDLLSSNVADIKLQSSSAPAQPLGFHGYVLTGKLKSPKLWSAEKPYLYTLVVVLKDRSGRIVDCESCPVGFRKVSKAHKQLLVNGHAVVIRGVNRHEHHPQVGKANIESCMIKDLVLMKQNNINAVRNSHYPQHPRWYELCDLFGMYMIDEANIETHHFDYSKHLKHPTMEPKWATSMLDRVIGMVERDKNHTCWIRGRDSSRVLHYEGGGSRTPCTDIVCPMYMRVWDMVKIANDPTETRPLILCEYSHAMGNSNGNLHIYWEAIDNTFGLQGGFIWDWVDQALVKVYEDGTKHWAYGGEFGDVPNDLNFCLNGLTFPDRTPHPVLHEVKYLYQPIKVALKEGKLEIKNTHFFQTTEGLEFSWSISADGYNLGSGLLGLVPIKPQSSHAVDWQSGPWYSLWASTDEEELFLTITAKLLNSTRWVEAGHIVSSAQVQLPTRRNIAPHVIDINGGTLVAETLGDTIVVKQQDAWDLTLNTKTGLVESWKVKGVHVMKKGILPCFWRAPIDNDKGGGSASYLSRWKAAGMDCLHFITESCSVQNITENSVRILVVFLGVTKGEDGSLSNQDKSKVLFTTEMAYTIYASGDVIIECNVKPNPDLPPLPRVGIELNVEKSLDQVTWYGRGPFECYPDRKAAALVAVYEHNVSELHVPYIVPGESSGRADVRWATFRNKDAFGIYASKYGSSPPMQMSASYYSTSELDRATHNEELIEGDSIELYAVYVHSVCCIKIHLDHKHMGLGGDDSWSPCVHEQYLIPPVPYSFSVRLCPVNPATSGHDIYKSQFQNS

SEQ ID NO: 198080 - protein, 1316 aa, Glycine max
  Coding DNA Sequence Number=SeqID_81302
  Gene Ontology: Mol. function=DNA-directed RNA polymerase activity; Cellular component=nucleus; Biological process=transcription
  Homolog annotation: Hit_ID=Q5D868; Match level="QueryCoverage=97%, HitCoverage=70%, E-value=0.0, Identity=50%"; Hit description=DNA -directed RNA polymerase alpha subunit
  Pfam annotation: Domain name=RNA_pol_Rpb1_2; Domain location=142-295; Score=103.5; E_value=6.1e-28; Accession=PF00623.11; Description=RNA polymerase Rpb1, domain 2
  Pfam annotation: Domain name=RNA_pol_Rpb1_3; Domain location=298-444; Score=0.1; E_value=1.7e-05; Accession=PF04983.8; Description=RNA polymerase Rpb1, domain 3
  Pfam annotation: Domain name=RNA_pol_Rpb1_4; Domain location=446-539; Score=-1.5; E_value=0.014; Accession=PF05000.7; Description=RNA polymerase Rpb1, domain 4
  Pfam annotation: Domain name=RNA_pol_Rpb1_5; Domain location=572-931; Score=-131.3; E_value=0.0056; Accession=PF04998.8; Description=RNA polymerase Rpb1, domain 5
  Pfam annotation: Domain name=Staphylcoagulse; Domain location=1100 -1126; Score=4.0; E_value=18; Accession=PF04022.3; Description =Staphylocoagulase repeat
  Pfam annotation: Domain name=Staphylcoagulse; Domain location=1144 -1170; Score=4.5; E_value=15; Accession=PF04022.3; Description =Staphylocoagulase repeat
  Pfam annotation: Domain name=Staphylcoagulse; Domain location=1188 -1214; Score=3.1; E_value=26; Accession=PF04022.3; Description =Staphylocoagulase repeat
  Pfam annotation: Domain name=Staphylcoagulse; Domain location=1232 -1258; Score=6.3; E_value=6.9; Accession=PF04022.3; Description =Staphylocoagulase repeat
  Pfam annotation: Domain name=Staphylcoagulse; Domain location=1276 -1302; Score=6.3; E_value=6.9; Accession=PF04022.3; Description =Staphylocoagulase repeat
  Pfam module annotation: Pfam domain module=RNA_pol_Rpb1_2::RNA_pol _Rpb1_3::RNA_pol_Rpb1_4::RNA_pol_Rpb1_5::Staphylcoagulse::Staphylcoagu lse::Staphylcoagulse::Staphylcoagulse::Staphylcoagulse; Domain location=142-295::...
  Pfam module annotation: Domain location=298-444::446-539::572 -931::1100-1126::1144-1170::1188-1214::1232-1258::1276-1302
MEIIKRIPIETKKKLAGKGFFPQDGYVLKYLPVPPNCLSVPEVSDGASVMSSDPSMTILRKLLRKVEIIKSSRSGEPNFESHHVEANDLQSVVDQYFQIRGTSKPARDIETHFGVNKELTASSTKAWLEKMRTLFIRKGSGFSSRNVITGDCYKRINEVGIPVEVAQRITFEERVNIHNIRYLQKLVDEHLCLTYKEGVSTYSLREGSKGHIYLKPGQIVHRRIMDGDIVFINRPPTTHKHSLQALYVYIHEDHTVKINPLICGPLGADFDGDCVHLFYPQSLAAKAEVVELFAVENQLLSSHSGNLNLQLSTDSLLALKMLVKRCFLGRAAANQLAMFLLLPLPRPALLKASSDDACWTSIQILQGALPMGFDCTGGRYLIRQSEILEFDFSRDALPATINEIAASIFFGKGPMEALKFFDVLQPFLMESLFAEGFSVSLEEFSISRAIKRIIRRSIGKASSLLYQLRSLYNELVAQQLEKHIQDVELPIINFALKSTKLGDLIDSKSKSTIDKVVQQVGFLGQQLFDRGRFYSKGLVDDVASHFHAKCCYDGDGYPSAEYGLLKGCFFNGLDPYEEMVHSISTREIMVRSSRGLSEPGTLFKNLMAILRDVVICYDGTVRNICSNSIIQFEYGIQAGDKTEHLFPAGEPVGVLAATAMSNPAYKAVLDASPNSNSSWELMKEILLCKVNFRNEPVDRRVILYLNDCDCGGSCCRENAAYSVKNQLRKVSLKNAAVEFIIEYQQQRTQKENSETDAGLVGHIYLDESCSSSHPAAPCLTFWLKNHDSDLDNAVKVLSENICPVLFETIIKDTNTWVRNPYKSSNGELALDIVLEEEAVKQSGDAWRIVLDSCLPVLHLIDTRRSIPYAIKQIQELLGISCTFDQAIQRVAASVKMVAKGVLREHLILLASSMTCGGNLVGFNTDVSGYYYSYFVNVTMQTPKKCFERAAEKCHTDSLSSIVASCSWGKHVAVGTGSKFDIVWDSSEIKSNEIEGMDVYSFLHMVKSVTNGEEETDACLGEDIDDLLEEEYMDLGMSPQHNSGFEAVFEENPEVLNGSTSNGWDVSSNQTQSKTNEWSGWASSNKDGRSETAQENSWGKTVNQEDSSKSNAWNTSTTADQTKTKSNEWSDWGSNKSEIPAGGSKAVQEDSSKSNAWNTSTTSNQTKTKSKEWSAWGSNKSEIPACGSKAVQEDSSKSNTWNTSTTADQTKTKSNEWSAWGSNKSEIPAGGSKAVQEDSSKSNAWNTSTTADQTKTKSNEWSAWGSNKSEIPAGGSKAVQEDSSKSNAWNTSTTADQTKTKSNEWSAWGSNKSEIPA

SEQ ID NO: 198081 - protein, 77 aa, Glycine max
  Coding DNA Sequence Number=SeqID_81303
MSIRRTDAMDVLDACSLKEWDTSYVGFIVDGAKWLVDNTDIKLVGSFPWAFFLSGVPSPMVGSSFALVACFPLNYFV

SEQ ID NO: 198082 - protein, 75 aa, Glycine max
  Coding DNA Sequence Number=SeqID_81304
MKRLEGTVAIGCVLDSKKTGDSVSNENWRTASVVAEPSYCGTAEGGDIEGVTRAVGAEGEKGVEGVGGDGGFEGG

SEQ ID NO: 198083 - protein, 752 aa, Glycine max
  Coding DNA Sequence Number=SeqID_81305
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=Q9SFB8; Match level="QueryCoverage=95%, HitCoverage=99%, E-value=0.0, Identity=69%"; Hit description =Phosphatidylinositol-4-phosphate 5-kinase 6 (EC 2.7.1.68) (AtPIP5K6) ...
  Homolog annotation: Hit description=(1-phosphatidylinositol-4 -phosphate kinase 6) (PtdIns(4)P-5-kinase 6)
  Pfam annotation: Domain name=MORN; Domain location=109-131; Score =30.7; E_value=5e-06; Accession=PF02493.10; Description=MORN repeat
  Pfam annotation: Domain name=MORN; Domain location=132-154; Score =27.7; E_value=4.2e-05; Accession=PF02493.10; Description=MORN repeat
  Pfam annotation: Domain name=MORN; Domain location=155-177; Score =34.1; E_value=4.8e-07; Accession=PF02493.10; Description=MORN repeat
  Pfam annotation: Domain name=MORN; Domain location=178-200; Score =40.6; E_value=5.5e-09; Accession=PF02493.10; Description=MORN repeat
  Pfam annotation: Domain name=MORN; Domain location=201-223; Score =17.1; E_value=0.031; Accession=PF02493.10; Description=MORN repeat
  Pfam annotation: Domain name=MORN; Domain location=225-246; Score =10.4; E_value=0.29; Accession=PF02493.10; Description=MORN repeat
  Pfam annotation: Domain name=MORN; Domain location=62-85; Score=22.6; E_value=0.0014; Accession=PF02493.10; Description=MORN repeat
  Pfam annotation: Domain name=MORN; Domain location=86-108; Score =26.2; E_value=0.00011; Accession=PF02493.10; Description=MORN repeat
  Pfam annotation: Domain name=PIP5K; Domain location=443-749; Score =464.2; E_value=1.7e-136; Accession=PF01504.9; Description =Phosphatidylinositol-4-phosphate 5-Kinase
  Pfam module annotation: Pfam domain module=MORN::MORN::MORN::MORN::MOR N::MORN::MORN::MORN::PIP5K; Domain location=109-131::132-154::155 -177::178-200::201-223::225-246::62-85::86-108::443-749
MNKELTSFVKAWEAAVRKSAGPKRRANSIFTPMSVAHVDDDDDATRNVVGEVEKILPNGDFYTGQWLDNNGPHGQGKYLWTDGCMYVGEWQKGGIMGKGRFSWPSGATYEGDFKGGYMDGKGTFIGSSGDTYKGCWVMELRHGQGTQSYPNGDFYDGEWRKGLQNGHGRYQWKNGNHYIGQWRNGLFHGNGTMMWSNGNRYDGCWEEGLPKGNGTFRWGGDGSFYVGVWSKDPKEQNGTYYPSGSCAGHLEWDPQELFSLDLVECSVCGLEKVAIYPSHKSLNMLEGDNKMCKKGTDGTGRTRRMSVDARISNYSSEDGSYSSYNGSRSSQVDNSIPRVPHLRLKAPKRQGETISQGHKNYELMLNLQLGIRHAVGRPAPSTSLDLKSSAFDPKEKVWTKFPPEGSKHTPPHQSCEFRWKDYCPVVFRALRKLFKVDPADYMLSLCGNDALRELSSPGKSGSFFYLTNDDRYMIKTMKKSEVKVFLRMLPGYYKHVRAFENTLVTKFFGLHCVKLTGTAQKKVRFVIMGNLFCSQYPIHRRFDLKGSTFGRTTDKPESEIEPTTTLKDLDLNYIFRLRKSWFQEFCRQVDRDCDFLEHERIMDYSMLVGLHFRGMSCGDNVTPSGHSPGPQTPTGHGNFDDGAPRLSGVDVDHLVVDPNRWIQLGISMPARAEMTVRKSCDTPQLVGEPTGELYEIIIFFGIIDILQDYDISKKLEHAYKSFQYDPTSISAVDPRLYSKRFRDFIFRVFVED

SEQ ID NO: 198084 - protein, 197 aa, Glycine max
  Coding DNA Sequence Number=SeqID_81306
MCPTPQWSPACNTKTTISKEMRETMLLDNPNLTLRDIADAIQALGQNNFGVNPQCTKPVELSATKASSKTTNVDTSLPHDEAIETMASTLTLLTTRRHCFGSCPISRATKEPKTDDKGVLLEESNSQTKSGNTMNEQPMNNNVGRHDLFVTRFPSLRLNLQQHPRSKIILFTTLKVTKNQLHKDVRAVWCLPPAFGV

SEQ ID NO: 198085 - protein, 132 aa, Glycine max
  Coding DNA Sequence Number=SeqID_81307
  Homolog annotation: Hit_ID=Q1STC5; Match level="QueryCoverage=53%, HitCoverage=33%, E-value=3e-25, Identity=80%"; Hit description =Argonaute and Dicer protein, PAZ
MEFVMFSRMFVDALDVQMYDEHHSTGHYSLSLSKSCKIVGGQRYTKGLNEKQITSLLKVSCQRPREQETNILQTIHETDYEYNPYAKEFGISIDSKLVSVKARVYTFFIPVFSSSMFMSRNISYSLQYMAAI

SEQ ID NO: 198086 - protein, 88 aa, Glycine max
  Coding DNA Sequence Number=SeqID_81308
MESIGMPYGHIVIVLQALDLNELPKSLRLDRWSKEAREEICCIFVGACNYWYSYLVARYATILDLSSAYHTIQASQKGMFHLQPIQNP

SEQ ID NO: 198087 - protein, 99 aa, Glycine max
  Coding DNA Sequence Number=SeqID_81309
MAPEELKQLTQQIRNQLEESITKKMQSQGLALPLEPEVSPSATRVSTKKSCVDPSGNDPETGDSDKCGLYIKENPSCLVALGRVYEESIAVHNIPLLHG

SEQ ID NO: 198088 - protein, 174 aa, Glycine max
  Coding DNA Sequence Number=SeqID_81310
MCGKRHRPSRSKTPPHVLSHGGYEYLEQKLIVEKTKKKLEEAAQSGCTEGVINPPSPIRRHVKWKMARTKKIGQMTSKAAKEIAEKIASQDSFVPHGCQDVLTAAIGRYEHPSRVRAVGAGATIKQYFGSAPRTSHNSSSMAPEELKQLTQQIRNQLEESITKKVTRQLMLSFS

SEQ ID NO: 198089 - protein, 525 aa, Glycine max
  Coding DNA Sequence Number=SeqID_81311
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=98%, HitCoverage=38%, E-value=1e-178, Identity=56%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam module annotation: Pfam domain module=RVT_1::RVT_2; Domain location=54-269::30-287
ECDIVHFALYADAEPVSFEEALKNDKWVNAMKEELKSIETNHTWQLMELPKLKRPIAVKWVFKVKRNPVGEVVKHKARLVAKGFLQKEGVGYGEIFAPVARIEIVRLVVAISSMKGWSMYQLDVKSAFLNGPLKEEVFVKQPPGFEVVGHEGKVYKLKKALYGLKQAPRAWNKKIDSVLIQIGFSKCISEHGVYVKGENESELVILCLYVDDLLITGNNKIEIDKIKQLLKNQFEMTDLGSLSYFLGIEFKETKVGIMMHQSKYATDLLKKFRMTNCNAAATPAETGLALSLRDEGEPVDETQYRQIVGSLRYLCNTRPDLAFSVGLISKFMQAPKTPHMMAAKRILRYIRGTINYGILLLNTITSSNMELVGYTDSDWRRDNDDRKSTAGYIFLLGNALVSWSSKKQDPVALSTCEVEYIAASMCSCQGLWLRKLLKEMKIQKTEAINILVDNKSAISLAKNPIDHGGSKHIETRYDFIRDKVSKGKLKLLYCKSKDNLADLVTKPLKKNIFEDLRNKMMIMIE

SEQ ID NO: 198090 - protein, 159 aa, Glycine max
  Coding DNA Sequence Number=SeqID_81312
  Gene Ontology: Mol. function=protein serine/threonine kinase activity; Cellular component=membrane; Biological process=protein amino acid phosphorylation
  Homolog annotation: Hit_ID=Q93XL9; Match level="QueryCoverage=96%, HitCoverage=21%, E-value=4e-17, Identity=47%"; Hit description=CTR1 -like protein kinase
MEMPARRSINYSLLSQTPDDKLTPPLFGSSSGDAKINNSKFERVSDWDSGVDHRQGNRIGNLHSSFGMQRQSIESSFGESSLSGEFYAPILSTVAANEIDGFRGQVSGKFGNEERRFLWQELGAADGGELSSYSWPWLFGFHRRPRVLMIPIFSDPGAR

SEQ ID NO: 198091 - protein, 358 aa, Glycine max
  Coding DNA Sequence Number=SeqID_81313
  Gene Ontology: Mol. function=protein serine/threonine kinase activity; Cellular component=membrane; Biological process=protein amino acid phosphorylation
  Homolog annotation: Hit_ID=Q93XL9; Match level="QueryCoverage=98%, HitCoverage=42%, E-value=1e-117, Identity=59%"; Hit description=CTR1- like protein kinase
MDPYVWTVCTNLQENDRIPPLETLKSINPSSDSSLEVVFVDRRSDPSLRELQNRVQDISCCCIETTDVVDQLAKLVCNCMGGSASVWEDDLFPIWRERINDLRDCLGSVVVPIGSLSTGLCRHRAVLFKVLADTIDLPCRIAKGCKYCSRDDASSCLVRFGLDREYMVDLIGKPGCLCKPDSLINGPSSISFSSPLRFPRHKPAEPTIDFRSLAKQYFSDCMSAELVFDSSSADFGFSILEQYERQYMGRNPGPIPNDNNKSSLVPLHSQPYCSSAHDRGSETFKSGNPAQNAVEPTMTSRDSLPLKHNRPGHRDTKTRLLIPSKPTREFSLDMEDLDIPWTDLDLKGRIGSGIYAFL

SEQ ID NO: 198092 - protein, 257 aa, Glycine max
  Coding DNA Sequence Number=SeqID_81314
  Gene Ontology: Mol. function=protein serine/threonine kinase activity; Cellular component=membrane; Biological process=protein amino acid phosphorylation
  Homolog annotation: Hit_ID=Q5YKK5; Match level="QueryCoverage=85%, HitCoverage=25%, E-value=1e-106, Identity=89%"; Hit description=CTR1- like protein kinase
  Pfam annotation: Domain name=Pkinase; Domain location=2-225; Score =105.8; E_value=1.3e-28; Accession=PF00069.15; Description=Protein kinase domain
  Pfam annotation: Domain name=Pkinase_Tyr; Domain location=5-223; Score=133.0; E_value=8.2e-37; Accession=PF07714.7; Description =Protein tyrosine kinase
  Pfam module annotation: Pfam domain module=Pkinase::Pkinase_Tyr; Domain location=2-225::5-223
MEQDFKGERFKEFLREVAIMKGLRHPNIVLLMGAVTKPPNLSIVTEYLSRGSLYRLLHKPGATEMLDERRRLSMAYDVAKGMNYLHKRNPPIVHRDLKSPNLLVDKKYTVKVGDFGLSRLKANTFLSSKSAAGTPEWMAPEVLRDEPSNEKSDVYSFGVILWELATLQQPWSNLNPPQEPQTGAKRTLQVVAAVGFKGKRLEIPRDLNPQLASIIEACWAKVFSFDVQQEYTVSVVPGNDYQFSNGEWGHYLPDIVS

SEQ ID NO: 198093 - protein, 1104 aa, Glycine max
  Coding DNA Sequence Number=SeqID_81315
  Gene Ontology: Mol. function=nucleic acid binding; Cellular component= intracellular
  Homolog annotation: Hit_ID=Q6ZAQ9; Match level="QueryCoverage=81%, HitCoverage=90%, E-value=1e-29, Identity=43%"; Hit description =Putative S-locus protein 4
  Pfam annotation: Domain name=DUF618; Domain location=197-257; Score =8.2; E_value=0.00087; Accession=PF04818.4; Description=Protein of unknown function, DUF618
  Pfam annotation: Domain name=zf-C2H2; Domain location=958-980; Score =16.7; E_value=0.084; Accession=PF00096.16; Description=Zinc finger, C2H2 type
  Pfam module annotation: Pfam domain module=DUF618::zf-C2H2; Domain location=197-257::958-980
MESTRRSLDRSREPGPKKPRLIDELSARQLPQRTAAVTTLASTRFRANDRDSEISDLGRGGGGGGYQPQPPPHQELVTQYKTALAELTFNSKPIITNLTIIAGENLSAAKAIAAAVCANIIEVNKIYRLGLKWYTLPCTLKEQKTYLLFQSMSFGQMTVVWYFDWGIENPGKHGIFHLQERSEPQQFPISISAKVPSDQKLPSLYLLDSIVKNIGRDYIKYFASRLPEVFCKAYRQVDPCVHSSMKHLFGTWKGVFPPQSLQMIEKELGFAPAVNGSASVSATVRSDLQSQRPPHSIHVNPKYLERQRLQQSSRSKGVVSDMTGAVLNSNEDSERPDRAAARPWLDPRINMLNNQHTHRDAFNDSVTEKSIDGSYGSSEYSSVISSNLVSGAGRTGSKLIDLGHDKTWFKTDGGDADTTSGQRNGFGLKRSFSNQEAPKSMNLDAHRQPRQSITNLRNNVMSGNWKTSEEEFTRDEMNNGLIDHGPNVLSNLSTDTWMADDENLEGEDHLHLQITRPIGTKVDREISTVKKQLPGLGGHPPSSWQLQKHHSIDKLNLKPDYSEGFVSTLSGLPTNASSLAVKKGNQSFMSNAVVGMTKFVGQQFDSGETESPSGQSPLRQQSPSLPGTVHHPHSMQNLANQELPPSLKTSQLLGGQIISQHIRDHSPTLRPIVKVGNLRRSQEKDMQGPLSSMTSLRPKLQQKQLNPSQTEVTATTKLPQSKVSLTRETSEQLTTNNLSAAPVKTGIIPKKSITSNLDPRKRPSQTGVQPTQSGRPTTLISSGSAVASPSSLDPLHNDSSTLPKKPKGKAGQPPQRLSTQPPASSNVSSSSAPILNAAKNNKPNPIANLLSTLVAKGLISAETESPTTVPSVAPKGSKDQTEIITTSCSLPVTSISGSAAVPVSSSDDEVDAATKTCLASPQSTSTEIRNLIGFDFRPNVIREFHPSVIRELWDDIPHHCKVCGIKLKQEELFNRHLEWHATREHGPIKASRSWYAKSSDWIAGKAEYSSESEFNDSVDVHDEKTGSSQLDTMVLADENQCLCVLCGELFEDVYCHERNEWMFKGTIYMNYSDVNSEMESGNVGPIIHAKCLSENSIITNLDND

SEQ ID NO: 198094 - protein, 33 aa, Glycine max
  Coding DNA Sequence Number=SeqID_81316
MAYETSSMSWILRLEKKIKLGPKCEGIQRQSNK

SEQ ID NO: 198095 - protein, 76 aa, Glycine max
  Coding DNA Sequence Number=SeqID_81317
MAAWWLYYGDTVVVVGVVEWQLRQIVNEATRWWKRYYNGGGAAMVEGWYIVTMVVGMVEWKTCMGDEGWQRRRIMD

SEQ ID NO: 198096 - protein, 124 aa, Glycine max
  Coding DNA Sequence Number=SeqID_81318
MTPHFYPKLQGEAIFGVLEHTSTSWGFKFQGFMMMLCDICMLKMLIEKLVEMMGRVNLGLNVRMVMLKAWAEQMRKMSDKCERKEPFLGKMLLNCAADFYHSAEKWLCIASHGKGSTSHVPSIY

SEQ ID NO: 198097 - protein, 212 aa, Glycine max
  Coding DNA Sequence Number=SeqID_81319
  Gene Ontology: Mol. function=RNA-directed DNA polymerase activity; Cellular component=chromatin; Biological process=chromatin assembly or disassembly
  Pfam annotation: Domain name=zf-H2C2; Domain location=106-147; Score =14.2; E_value=0.0047; Accession=PF09337.1; Description=His(2)-Cys(2) zinc finger
MSFMVDTDALGTGMGFVLYQLGHLLAFFSSIYQANRIRWRMPCLELLKIHKAHYLSFPYLTSPFWINSNMSWLFTLSSSPCNRKSKESIWLPNGLNLIPSLLTEFHTSPTGGHMGIKKTLARLGENFVWAAMCNDVQQFIASCLGCQNTKYEARKPAGLLCPLLAPVRPWENLSLDFIVGLPPYHGNTTIMVVVDRFSKGIHLGMLNLNFTT

SEQ ID NO: 198098 - protein, 150 aa, Glycine max
  Coding DNA Sequence Number=SeqID_81320
MYVLVVSARDQVWVTKGEPEEGADLKWAKVVAYTIVKGCEAWTSCRISGAKVKTKQLNKKDPHIEKEQIRSLMPARKRSMTKIGCSSTSIGTMLEPVLPYKKKQSSNQRDRNRQTAVLPTSYEERKGMSDVDYDGLWTMLVNGRLSPGEL

SEQ ID NO: 198099 - protein, 309 aa, Glycine max
  Coding DNA Sequence Number=SeqID_81321
  Gene Ontology: Mol. function=RNA-directed DNA polymerase activity; Cellular component=chromatin; Biological process=chromatin assembly or disassembly
MAPETLRLLGLLKGQQVWILIDGGSTHNFIQERLVLALKVQDQQFLVNFHVLSLYGVDLVLGVEWLKSLGPILTNYNDLTMKFLLDGRVVELKGEREGTAKSITTHQLRQLVQTHGVSEFFHLRIEPSLTQTSKLPYPTPEIETLIQQFQHHYLRPEIELQVDSMLKNGVIRPSTSPFSSPILLVKKCDGSWRFCVDYQALNTITIKDRFPIPTVDELLDKLGGAQWFSKLDLLQGYHQILMKEEDINKMAFRTHHGHYEFHVMLFGLCNVPSSFQATMNDTFRPYLHKFIIVFFDDILIYSKTLVGHL

SEQ ID NO: 198100 - protein, 43 aa, Glycine max
  Coding DNA Sequence Number=SeqID_81322
MGQCDVNTFTGAGGLSAPLAAYGARNNGTIIECKQGNTTFWSR

SEQ ID NO: 198101 - protein, 66 aa, Glycine max
  Coding DNA Sequence Number=SeqID_81323
MVDEIDGCVDEIEEGNEGGRKEGKGLCLCLRLLVSASVGVMMVPVVSGKRLPLELGYSCNWTRVAS

SEQ ID NO: 198102 - protein, 464 aa, Glycine max
  Coding DNA Sequence Number=SeqID_81324
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=40%, E-value=1e-105, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MASNGHFPSNLPILISKNFNRWSVQMKALLGFQDLTDVIEDGIEIPKEGASDSQKTGFKDLKKKDYKALVILHQCVDDSHFEKIANAKSAKEAWDILNKAYAGADKIKKMEETESIGDYFGRLQVLANLITSCGDTITNLTLVEKVLRTLNPRFDYIVVAIEESKDLESLSVDELQGSLEAYEQRLHERANDKATEQALQAHHQSRNGGHYAEECWYKEKNVDDEAQLATRAVSDTEPVLLMVTTKTGTDAEDQWYLGIGCSTHMTGHKDWFVSLDESVNHKVRFADDSTIRVEGHGKVVIKRRDGTVSYIEDVLYDPNMRCNLLSLGQLLEKKYIMVMEDKEMKIYDKDRRLIIKAPLTRNKNFKVGIQVMKHNCLQAEIGREEWLWHYRFGHLNFKNLSQLHRMAQGIPQLRQMTENCRECLECKQPRNAFQKFVPVKSTQKLEVIYSDVCGPLQVESLGGN

SEQ ID NO: 198103 - protein, 90 aa, Glycine max
  Coding DNA Sequence Number=SeqID_81325
MENKKCIYNTPFGIQTIGKMKWHGTATTRHGKKIHTRGYPPESVPTLTGNTRVDRGYPIPDGYGDETINLNPSGIGLDAGAIDSATSEVL

SEQ ID NO: 198104 - protein, 60 aa, Glycine max
  Coding DNA Sequence Number=SeqID_81326
MSASVAPELLELQSFVESTVSGSLSSKSKKSVPWLQIVILVVGTRGDVQPFLAIAKKLQA

SEQ ID NO: 198105 - protein, 88 aa, Glycine max
  Coding DNA Sequence Number=SeqID_81327
GVCVCYKMRMRWYGLAGGHSGELIQNGGKNTMKGIVMGVYNVLKLLSMAIPLHLMSPQFVFDLHQSALHHHQSVCGCRRVHHRLAIAA

SEQ ID NO: 198106 - protein, 78 aa, Glycine max
  Coding DNA Sequence Number=SeqID_81328
MVPPPLRLPVMVVTTNLGHAEAYATFIPSQHLYVIVVATKTIMMPPPLCLAVAGKGVKRGTEEDEEMRRQERRSRKML

SEQ ID NO: 198107 - protein, 74 aa, Glycine max
  Coding DNA Sequence Number=SeqID_81329
MVSVDLVLAQARHEGSVWIYAWGVSMTLSQDEIQLTQLSKIVGDTSQECQHNGGVGALHGSNSIANPSTKGWVI

SEQ ID NO: 198108 - protein, 151 aa, Glycine max
  Coding DNA Sequence Number=SeqID_81330
  Gene Ontology: Mol. function=transferase activity; Cellular component= intracellular; Biological process=translation
  Homolog annotation: Hit_ID=Q1SP37; Match level="QueryCoverage=80%, HitCoverage=37%, E-value=2e-31, Identity=52%"; Hit description =Bacterial adhesion
MDSNINFDTLLDQIIDEELEDNTDEEVIRYLFLRFVEAFTNHDEYFQMRVDAKRRNDLSPLQKCIGVLRILAYGLPVDSVNEYIQIAEITVVECLQRFVSDICAIFGDEYLRRPNDEDTRRLLQMGAICGFSGMLGSIDYMHCEWKNYPVA

SEQ ID NO: 198109 - protein, 896 aa, Glycine max
  Coding DNA Sequence Number=SeqID_81331
  Gene Ontology: Mol. function=voltage-gated potassium channel activity; Cellular component=integral to membrane; Biological process=potassium ion transport
  Homolog annotation: Hit_ID=Q9LEG6; Match level="QueryCoverage=96%, HitCoverage=93%, E-value=0.0, Identity=67%"; Hit description =Potassium channel
  Pfam annotation: Domain name=Ank; Domain location=567-599; Score =40.7; E_value=4.9e-09; Accession=PF00023.20; Description=Ankyrin repeat
  Pfam annotation: Domain name=Ank; Domain location=600-632; Score =16.9; E_value=0.073; Accession=PF00023.20; Description=Ankyrin repeat
  Pfam annotation: Domain name=Ank; Domain location=666-698; Score =43.7; E_value=6.2e-10; Accession=PF00023.20; Description=Ankyrin repeat
  Pfam annotation: Domain name=Ion_trans; Domain location=100-300; Score=144.1; E_value=3.9e-40; Accession=PF00520.21; Description=Ion transport protein
  Pfam annotation: Domain name=Ion_trans_2; Domain location=209-306; Score=60.3; E_value=6.3e-15; Accession=PF07885.6; Description=Ion channel
  Pfam annotation: Domain name=cNMP_binding; Domain location=387-465; Score=38.9; E_value=1.7e-08; Accession=PF00027.19; Description =Cyclic nucleotide-binding domain
  Pfam module annotation: Pfam domain module=Ank::Ank::Ank::Ion _trans::Ion_trans_2::cNMP_binding; Domain location=567-599::600 -632::666-698::100-300::209-306::387-465
  Subcellular localization annotation: CTP_CleavageSite=37; ConfidenceScore=5.11e-01
MAATTVSLLGYYLPLEPKVTADLSSSPSLFLPMTAVTVSLQNALPLRSIHFNKNHHTPTTITLSHWRIWETFLVILVVYTAWVSPFEFGFLKKPQAPLSITDNIVNGFFFVDIVLTFFVAYIDKSSYLIVDDRKQIAWKYARTWLSFDVISIIPSELVQKISPSPLQSYGLFNMLRLWRLRRVGALFSRLEKDKNYNYFWVRCAKLIAVTLFAVHCAACFYYLIAARYHDPKKTWIGATMDNFLEHSLWSRYVTSIYWSITTLTTVGYGDLHPVNSREMIFDVFYMLFNLGLTAYLIGNMTNLVVHGTSRTRKFRDTIQAASNFAQRNQLPHRLQDQMLAHLCLKYRTDSEGLQQQETLDSLPKAIRSSISHYLFYSLIDKVSEMKAEYFPPKEDVILQNEAPTDFYILVTGAVVVGEAKTGDLCGEIGVLCYKPQLFTVRTKRLSQLLRLNRTTFLNIVQANVGDGTIIMNNLLQIFFKTGILGAYGNCRKTIPWVQIFSKFKCLEHLKEINDPIMEGVLVDIENMLARGRMDLPVSVCFAAARGDDLLLHQLLKRGMDPNESDNNRRTALHIAASQGKQNCVLLLLDYGADPNIRDLEGNVPLWEAIVGGHESMSKLLSENGANLQCGDVGQFACTAAEQNSLNLLKEIMRYGGDITLPNSSNTGTTALHVAVSEGNVETVKFLLDHGASIDMPDKHGWTPRDLADQQAHTEIKALFDSIGEPKVHSSVAIPVRNSKIKYLGRFTSEPTMTLPLDGSFHGTDGSWSQNQSQNQSRPRRRSNNYHNSLFGILSAAHNGEKYLLSAVDMNNNARNGMKSSSAVGPTRVIISCPEKGEVVGKLVLLPGSFQELVEIGAKKFGFYPNKVVCKDGGEIEDIEIIRDGDHLVFLGASGGC

SEQ ID NO: 198110 - protein, 74 aa, Glycine max
  Coding DNA Sequence Number=SeqID_81332
MAEPMGMVFANTAGGTYAGWCRDIWHGHGDAADMHIGVGDMHAMQAWDYADENGDITYPLRNMFKKGPLLRISL

SEQ ID NO: 198111 - protein, 167 aa, Glycine max
  Coding DNA Sequence Number=SeqID_81333
  Homolog annotation: Hit_ID=Q1SNF1; Match level="QueryCoverage=68%, HitCoverage=84%, E-value=3e-20, Identity=44%"; Hit description =Expansin 45, endoglucanase-like
  Pfam annotation: Domain name=DPBB_1; Domain location=84-165; Score =37.6; E_value=4.2e-08; Accession=PF03330.8; Description=Rare lipoprotein A (RlpA)-like double
MGDWLERVIEVDRIIAIAVAIAILMSKIMSAPTLHHFSSLFTLFIVLLHHSNADVGTASRYSPPYLPSGCYGTEATQFPSSNLFAAAGDGIWDNGAACGRQYLVRCISAEQPRTCIPDQSIQIKIVDYAATAVSPASAGGTTMVLSDKAFGTIANMSATLINIELQQ

SEQ ID NO: 198112 - protein, 49 aa, Glycine max
  Coding DNA Sequence Number=SeqID_81334
MRDINGQISKIDRQKKCQQCQSSGTLGGGWKKIKIEDGASFRTFYEWGR

SEQ ID NO: 198113 - protein, 223 aa, Glycine max
  Coding DNA Sequence Number=SeqID_81335
  Gene Ontology: Mol. function=zinc ion binding
  Homolog annotation: Hit_ID=Q1S4D5; Match level="QueryCoverage=54%, HitCoverage=17%, E-value=7e-22, Identity=38%"; Hit description=FAR1; Zinc finger, SWIM-type
  Pfam annotation: Domain name=FAR1; Domain location=43-173; Score= -40.8; E_value=0.0011; Accession=PF03101.5; Description=FAR1 family
MKEGGLGGVGVEQGGEEVRVEREEKCMEASRARGAKKENGILSVKVKSKSENEKNPSGVYKREFVCHRAGNAKHHKVCCLVSLIIKVLELEKGIDADNLSFLEKDIKNFIQSQHSIEEENEGTEVLKLCKSLKDKDDAFQYDFTLDENNKLEHIIWVFGDSIRAYEAFGDAVIFDTTYGINRYDMPHGLWIGVDNCYALCYSTSVPSLQCSYAEKLPKPRSLE

SEQ ID NO: 198114 - protein, 216 aa, Glycine max
  Coding DNA Sequence Number=SeqID_81336
  Homolog annotation: Hit_ID=Q5R216; Match level="QueryCoverage=32%, HitCoverage=4%, E-value=2e-25, Identity=76%"; Hit description=Myosin XI
MAFWNLSFLGAFYLQCRVQNPAEATCDQGGNTQILIRVHNVDLLGHRTFGQVAKCWDSDTNSFVVVKIIKNQPAYYQRALIEVTILITVITNISGFPKDDEAPPGGIDDMTKLSYLHEPRVLHNLAARYELNEIYVPKRILAINPFRRLPHLYDTYMMEQYKRAAFESSSLNNRSYIKKPKKTLNEVTKELCPVGSQLHKISTTYWDEQHIIPQYK

SEQ ID NO: 198115 - protein, 59 aa, Glycine max
  Coding DNA Sequence Number=SeqID_81337
MLLGNNNPCKTAGIGSIRFRLHDGVERLLIEVRKDKCPWLCIAMKNSTYSLNEEKNFKP

SEQ ID NO: 198116 - protein, 91 aa, Glycine max
  Coding DNA Sequence Number=SeqID_81338
  Gene Ontology: Mol. function=nucleic acid binding; Biological process= DNA integration
  Homolog annotation: Hit_ID=Q1SAJ1; Match level="QueryCoverage=98%, HitCoverage=32%, E-value=7e-17, Identity=50%"; Hit description=Zinc finger, CCHC-type
MKMRALLVQQGLVEALEREAKLEKSMANKDKKAILEKTHNVIISSLGDKVLKQVFKEKKTSVGFWAKLEGLYMTKSLANRLYLKQSLYSLR

SEQ ID NO: 198117 - protein, 56 aa, Glycine max
  Coding DNA Sequence Number=SeqID_81339
MLNLNAYLQCSQNWTGHRTGKDIGSRVNGSTEKKFSAKPVKPVKSTGSPVFNRFSD

SEQ ID NO: 198118 - protein, 281 aa, Glycine max
  Coding DNA Sequence Number=SeqID_81340
MKVDMEAMKEQMTMMMEAMMSMRKMMEVNVATVVAASTATKRDLVHPPGFNQVQSKSSFSPYSLPPNYTPPTAVYAPGESIGNSAPIFIESQQPQLNDTPAHVSQPMGETHEAPQDHTMTDFRVYSGYTTEGYALSSVPMPNALGAPQYRPPSQPLSFFMGGGPSIDLMDVFNRQYQYNSDMAPDRMQLQNMCKIDNESFKEYAQRWRDLVAQMVGYMPSSFADLVFACERVEAVLVMGDPGGVARGRRSENLMLWQQFSLAEISRGQSLVNSNVVKQYYA

SEQ ID NO: 198119 - protein, 34 aa, Glycine max
  Coding DNA Sequence Number=SeqID_81341
MMLNLNAYLQCSQNWTGHRTGKDIGSRVNGSTEQ

SEQ ID NO: 198120 - protein, 667 aa, Glycine max
  Coding DNA Sequence Number=SeqID_81342
  Gene Ontology: Mol. function=hydrolase activity; Cellular component =nucleoplasm; Biological process=mRNA polyadenylation
  Homolog annotation: Hit_ID=Q1SWM0; Match level="QueryCoverage=98%, HitCoverage=99%, E-value=0.0, Identity=88%"; Hit description=Beta -lactamase-like; RNA-metabolising metallo-beta-lactamase
  Pfam annotation: Domain name=Lactamase_B; Domain location=33-198; Score=49.2; E_value=1.4e-11; Accession=PF00753.17; Description =Metallo-beta-lactamase superfamily
  Pfam annotation: Domain name=RMMBL; Domain location=365-407; Score =65.5; E_value=1.7e-16; Accession=PF07521.2; Description=RNA -metabolising metallo-beta-lactamase
  Pfam module annotation: Pfam domain module=Lactamase_B::RMMBL; Domain location=33-198::365-407
MNNCTAKRRENARSSREEDQLIVTPLGAGNEVGRSCVYMSYKGKTVLFDCGIHPAYSGMAALPYFDEIDPSTVDVLLITHFHLDHAASLPYFLEKTTFRGRVFMTYATKAIYKLLLSDFVKVSKVSVEDMLFDEQDINRSMDKIEVIDFHQTVEVNAGVRVLYTGDYSREEDRHLRAAETPQFSPDVCIIESTYGVQHHQPRHTREKRFTDVIHSTISQGGRVLIPAFALGRAQELLLILDEYWANHPELQNIPIYYASPLAKKCLTVYETYTLSMNDRIQNAKSNPFSFKHVSALSSIEVFKDVGPSVVMASPGGLQSGLSRQLFDMWCSDKKNSCVLPGYVVEGTLAKTIINEPKEVTLMNGLTAPLNMQVHYISFSAHADSAQTSAFLEELNPPNIILVHGEANEMGRLKQKLISQFADRNTKILTPKNCQSVEMYFNSQKMAKTIGKLAEKTPEVGETVSGLLVKKGFTYQIMAADDLHVFSQLSTANITQRITIPYSGAFNVIQHRLKQIYESVAQSVDEESGVPTLQVHECVTVKHESEKHVSLHWASDPMSDMVSDSIVALVLNINRDVPKIVNESDAIKIEEENEKKAEKVMQALLVSLFGDVKVGENGKLIINIDGNVAELNKESGEVESENEGLKERVRTAFRRIQSSVKPIPVSAP

SEQ ID NO: 198121 - protein, 491 aa, Glycine max
  Coding DNA Sequence Number=SeqID_81343
  Gene Ontology: Mol. function=calcium-dependent phospholipid binding; Cellular component=mitochondrion; Biological process=fruiting body development (sensu Dictyosteliida)
  Homolog annotation: Hit_ID=Q1SWM3; Match level="QueryCoverage=93%, HitCoverage=92%, E-value=1e-148, Identity=59%"; Hit description =Proteinase inhibitor, propeptide
  Pfam annotation: Domain name=XYPPX; Domain location=246-250; Score =1.6; E_value=1e+02; Accession=PF02162.7; Description=XYPPX repeat
  Pfam annotation: Domain name=XYPPX; Domain location=259-263; Score =1.6; E_value=1e+02; Accession=PF02162.7; Description=XYPPX repeat
  Pfam annotation: Domain name=XYPPX; Domain location=272-276; Score =1.6; E_value=1e+02; Accession=PF02162.7; Description=XYPPX repeat
  Pfam annotation: Domain name=XYPPX; Domain location=285-289; Score =1.6; E_value=1e+02; Accession=PF02162.7; Description=XYPPX repeat
  Pfam annotation: Domain name=XYPPX; Domain location=298-302; Score =1.6; E_value=1e+02; Accession=PF02162.7; Description=XYPPX repeat
  Pfam annotation: Domain name=XYPPX; Domain location=311-315; Score =1.6; E_value=1e+02; Accession=PF02162.7; Description=XYPPX repeat
  Pfam annotation: Domain name=XYPPX; Domain location=324-328; Score =1.6; E_value=1e+02; Accession=PF02162.7; Description=XYPPX repeat
  Pfam annotation: Domain name=XYPPX; Domain location=337-341; Score =1.6; E_value=1e+02; Accession=PF02162.7; Description=XYPPX repeat
  Pfam module annotation: Pfam domain module=XYPPX::XYPPX::XYPPX::XYPPX: :XYPPX::XYPPX::XYPPX::XYPPX; Domain location=246-250::259-263::272 -276::285-289::298-302::311-315::324-328::337-341
  Subcellular localization annotation: CTP_CleavageSite=64; ConfidenceScore=5.65e-01
MASSLIHLRRTVRALSGVAQSFSVHAASYSVPIRCGVSWSLQSPKGVVQPRSFRSSSISLLSFRSSQRQSNIPDEIGPDTILFEGCDYNHWLIVMEFKDKDNKPSPEDMVRVYEETCAKGLNISLEEAKKKIYACSTTTYIGFQAVMTEEESKKFEGLPGVIFVLPDSYIDPVNKQYGGDQYINGTIIPRPPPVQFGRNQGRRDWNRSPGQYNRQENPVPSPQGNPSYNSQGPMPRGGRNYGPSQNYPPQQNSGQASQNYPPQQNYGPASQNYPPQQNFVRASQNYPPQQNYGQASQNYPPQQNYGQASQNYPPQQNFGQASQNYPPQQNYGQAPQNYPPQQNFDQASQNYPQQQRYGPSSPQYAQQQSFGPPGQGERRNYMPQQNIGRPGQGERRDPVPRHGASEARGDTFTPSYVQDFKSAYKEEFEQAELGNHPAKEQTGSQQRYPPSGPGTFTGELHCSVTKLDLVGVTECQFWDEQLDGLPEPNSL

SEQ ID NO: 198122 - protein, 147 aa, Glycine max
  Coding DNA Sequence Number=SeqID_81344
  Gene Ontology: Mol. function=hydrolase activity
  Homolog annotation: Hit_ID=Q1SWM0; Match level="QueryCoverage=42%, HitCoverage=9%, E-value=2e-27, Identity=93%"; Hit description=Beta -lactamase-like; RNA-metabolising metallo-beta-lactamase
MAALPYFDEIDPSIVNVLLITHFHLDHAASLPYFLEKTTFRGRVFMTYATKAIYKLLLSDFVKHTSRTMTCCWHMGTMGMYKKRCYYTKIEESLPSEGCTFPRKISFNGDEPSPDTYPNSSTQLMSPQKPSHTFLFNVTAPTIFLEV

SEQ ID NO: 198123 - protein, 68 aa, Glycine max
  Coding DNA Sequence Number=SeqID_81345
MEQPKNYPTPPAKQPENSQADTTRNSPAAKVPTSKIAGNKATNHEKKEREKRRKEEEGRRRKSERMRE

SEQ ID NO: 198124 - protein, 314 aa, Glycine max
  Coding DNA Sequence Number=SeqID_81346
  Gene Ontology: Mol. function=DNA binding; Cellular component =chromatin; Biological process=DNA integration
  Homolog annotation: Hit_ID=Q1RSZ9; Match level="QueryCoverage=75%, HitCoverage=17%, E-value=6e-63, Identity=52%"; Hit description =Polynucleotidyl transferase, Ribonuclease H fold
MAGNDSTSKSTFYPTFSVSNIKNYIQITLEMENVHYDSWVELFLNTANAFDVADHIIPPKDATVKKDAQWSRLDAIVKQWIYSTISIDLLHTILKLGATAQEAWNRLKDIFHDNKNSRAVYLEQQFSQIHMDNYPNASSYCQALKLIAEQLSNVGAPVNEDRLVLRLVTGLSSGYDSLATIIQQLDPLPSFYKARSMLTLEETRRNKNTGAKSALLHAQSDVSSAAPNRSPDVAPSRSNNRNTDGRGKQYRGKGNNNNKGNSYKNSFDNNKNNSGTNNRQGNQPTSWTWVPFTPPSWPQQPSWNPPPCPYPTTG

SEQ ID NO: 198125 - protein, 201 aa, Glycine max
  Coding DNA Sequence Number=SeqID_81347
  Gene Ontology: Mol. function=calmodulin binding; Cellular component =integral to membrane; Biological process=cell death
  Homolog annotation: Hit_ID=Q1SWM9; Match level="QueryCoverage=71%, HitCoverage=28%, E-value=1e-59, Identity=77%"; Hit description=Mlo -related protein
  Pfam annotation: Domain name=Mlo; Domain location=1-199; Score= -229.6; E_value=3.9e-08; Accession=PF03094.6; Description=Mlo family
MQQSSSSSPHETNSGPFNQCGEGHEPFVSYEGLEQLHRFLFVLGITHVLYSCLAVGLAMSKIYSWRRWGNQAAMATGGNLQGKKIKVMRRQTTFVFHHTSHPWSRSPILNWMLCFVRQFRSSIQKSDYLALRLGFITLAALDLCHSLHLREHPWSEYILLAIIYPCNLGIPRTIVLHEKPLHDHHTVGMGWFHLSFKNALF

SEQ ID NO: 198126 - protein, 324 aa, Glycine max
  Coding DNA Sequence Number=SeqID_81348
  Gene Ontology: Mol. function=DNA binding; Cellular component =chromatin; Biological process=DNA integration
  Homolog annotation: Hit_ID=Q1SF34; Match level="QueryCoverage=99%, HitCoverage=36%, E-value=1e-159, Identity=86%"; Hit description =Integrase, catalytic region
MAQQVTTLEPTHQTVAASPVPSPPMRTRAQHDIHKPKSIFDLSVTTSVSPIPKSPISALHDKNWKQAMTNEFDALIKNKTWVLVTRPPDVNITRCIWLFKHKYKSNGDLERYKARLVVNGRHLSETVYMHQPPGFRDRNHPDHVCLLKKSLYGLKQAPRAWYQRFASFLSTIGFVNSKTDHSLFIYTHGDDTSYILLYVDDIILTTSSHSLRDTIIAALQSEFSMTDLGPLNYFLGVSATRHSGGLFLHQSKYAEDIISCAKMVNCKSALTPVDTKSKLSATSGEKFDDPTLYRSLGGALQYLIFTRPDISYAVQQICLYMHDP

SEQ ID NO: 198127 - protein, 84 aa, Glycine max
  Coding DNA Sequence Number=SeqID_81349
  Homolog annotation: Hit_ID=Q2HV31; Match level="QueryCoverage=75%, HitCoverage=10%, E-value=3e-13, Identity=59%"; Hit description =Prefoldin
MGQVQPINKRKNEGDRKVEANLKAIEEIKVATDMALRNTEMVDSAKVLVKGELRLVEEQCTNGLCVEMTTWAGHDCIIYVVLGH

SEQ ID NO: 198128 - protein, 535 aa, Glycine max
  Coding DNA Sequence Number=SeqID_81350
  Gene Ontology: Mol. function=transition metal ion binding
  Pfam annotation: Domain name=Transposase_23; Domain location=373-443; Score=-0.0; E_value=0.0012; Accession=PF03017.5; Description =TNP1ENSPM transposase
  Subcellular localization annotation: CTP_CleavageSite=44; ConfidenceScore=5.65e-01
MATPPASPPPPLPPPPADASATPSTLKRTRKVTWLRSLATRPPRAERPVVNIDPATSKADGPHKKKLRTYLGIVARDKVDVTYDTWKEVPTAQKDLIWEDIQRWRQFRSDLTRKWALVADKDDVDDIVCEKYGISKEKWAQFCQTRRDPSWEDVRKKEQASQKQNTAPHVLSRGGYEYLEEKLMAEKTKKKLEEAAQFGSTESIIDPPSPIRRHVKWKMARMKKTGQMTSEAAKEIADRIASQGSFVPHGRQDILAATIGRPEHPGRARVVGAGVTIKQYFGSASRTSRSSSSMPPEDLEQLTQQIRDQLEESITEKVTRKMMASFSQMQSQFQSQMQSQGLALPPEPKVGPSGPRVSTKESCVAPSGNDPGTSDSDKCGLYIEENPSRLVALGRLYEGSTTVHNIPLLHGQVKVGVEEVKDAEALVPVPTNEVTLVGQTLNTFLAWPTHLVKRLSEHAAMSPAKPPESLDEEVDDPLYLMTLTIPQLFLKPLQVMWDATIFGVFNQNFPLYIKHEDLSEIAHGGQCLSISVIQL

SEQ ID NO: 198129 - protein, 91 aa, Glycine max
  Coding DNA Sequence Number=SeqID_81351
MKMKANKTRNELKVSDSNTYRSKTEERMKNERKTVKNGGKSSRICSRKRLGSVTLKCIVWGSGILETQPPPPIYRKNGEVLAAQRLLEEYF

SEQ ID NO: 198130 - protein, 290 aa, Glycine max
  Coding DNA Sequence Number=SeqID_81352
  Gene Ontology: Mol. function=protein binding; Cellular component =integral to membrane; Biological process=phagocytosis
  Homolog annotation: Hit_ID=Q1SWN1; Match level="QueryCoverage=97%, HitCoverage=49%, E-value=1e-129, Identity=77%"; Hit description =Nonaspanin
  Pfam annotation: Domain name=EMP70; Domain location=29-290; Score =91.3; E_value=3e-24; Accession=PF02990.7; Description=Endomembrane protein 70
MYWILLQYQQDDPVTLWVNKVGPYNNPQETYNYYSLPFCRPPGNTAHKWGGLGEVLGGNELIDSQLEIKFLGNVEKTIFCRIELDEAKVKQFKDAIENNYWFEFFMGYVGELHPDKNGDNGKHVLYTHKNINVQYNKDQIIHVNLTNDNPRPLEVGKPLDMTYSVKWSPTNVTFGRRFDVYLDYPFFEHQIHWFSIFNSFMMVIFLTGLVSMILMRTLRNDYAKYAREDDDLETLERDVSEESGWKLVHGDVFRPPRSLVILSAIVGTGAQLALLVLLVILLAIVGMLYV

SEQ ID NO: 198131 - protein, 500 aa, Glycine max
  Coding DNA Sequence Number=SeqID_81353
  Gene Ontology: Mol. function=transferase activity; Biological process= response to oxidative stress
  Homolog annotation: Hit_ID=Q9SS68; Match level="QueryCoverage=99%, HitCoverage=50%, E-value=0.0, Identity=78%"; Hit description =Putative phosphoribosylanthranilate transferase
  Pfam annotation: Domain name=C2; Domain location=132-215; Score=43.7; E_value=6.4e-10; Accession=PF00168.20; Description=C2 domain
  Pfam annotation: Domain name=C2; Domain location=289-381; Score=84.4; E_value=3.4e-22; Accession=PF00168.20; Description=C2 domain
  Pfam module annotation: Pfam domain module=C2::C2; Domain location =132-215::289-381
IGTHSVKTRSESEGKDWDQVFAFDKEGLNSTSLEVSVWSEEVKEGDEKSESSLGTVSFDLQEVPKRVPPDSPLAPQWYTLESETSPGNDVMLAVWIGTQADEAFQEAWQSDSGGLIPETRAKVYLSPKLWYLRLTVIQTQDLQLGSGPEAKARNPELYVKAQLGAQVFKTGRASPGSANPTWNEDLVFVAAEPFEPFLVVTVEDVSNSKTVGHAKLHVASIERRTDDRTDPKSRWFNLSSEDESNSYTGRIHVRVCLEGGYHVIDETAHVTSDVRASAKQLAKPPIGLLEVGIRGAANLLPVKTNDGTRGTTDAYVVAKYGPKWVRTRTIMDRFNPRWNEQYTWDVFDPCTVLTIGVFDNGRYKRGEDGEPNRDCRVGKVRVRLSTLDTNRVYVNSYSLVVLLPSGAKRMGEIEIAVRFSCSSWLSLMQAYASPILPRMHYVRPFGPAQQDILRQTAMKIVTARLARSEPALGQEVVQFMLDSDTHVWSMRRSKAELVRV

SEQ ID NO: 198132 - protein, 337 aa, Glycine max
  Coding DNA Sequence Number=SeqID_81354
  Gene Ontology: Mol. function=oxidoreductase activity; Biological process=metabolic process
  Homolog annotation: Hit_ID=Q6W254; Match level="QueryCoverage=99%, HitCoverage=97%, E-value=1e-120, Identity=60%"; Hit description =Glucose-6-phosphate dehydrogenase [coenzyme F420]
  Pfam annotation: Domain name=Bac_luciferase; Domain location=1-336; Score=106.3; E_value=8.7e-29; Accession=PF00296.11; Description =Luciferase-like monooxygenase
MERISPDEPQDKLYNEMMTLCEMADEAGMHAIWTGEHHGMNFTIAPNPFINLADLANRTKRVRLGTGTIIAPFNHPLRLAGEAAMTDIITGGRLELGVARGAYNYEYQRLMPGLDAWEAGQRMRELVPAVKKLWEGDYTHQGEYWQFPASTSSPQPKQQPHPPIWIAARDPNSHEFAVSNGCNVQVTPLHQGEEEIVRLAECFHETRQRLAPEKPLKIMLLQHGFVAEDENDAQQAAEELNRFYNYFGAWFKNERPVSQGLIQPLSDEEIAANTYYSAAAMRKNLAIGTPNEIITRLKKYEALGYDEFALWIDSGMPFERKKASLTRFIQQVMPEFR

SEQ ID NO: 198133 - protein, 77 aa, Glycine max
  Coding DNA Sequence Number=SeqID_81355
MELENGERRLRCRAVTQNKRWRIYEREREREWDLGEFRRKAKNRVRNLQQELVLSVPSYGKITKVEGSYEGSTFQGA

SEQ ID NO: 198134 - protein, 118 aa, Glycine max
  Coding DNA Sequence Number=SeqID_81356
MANCKTVPFAESKIGGCHTLISSGNLCSMTCDHSLVLVRCLAPIIRQFVKFQDMPKNQKNIDAQSQRGVYLVKMGVQIAPRPTWALRNIPPEGGCFWRKQPSSPGRAGRQPPPLFCYK

SEQ ID NO: 198135 - protein, 522 aa, Glycine max
  Coding DNA Sequence Number=SeqID_81357
  Gene Ontology: Mol. function=thiamin-phosphate diphosphorylase activity; Cellular component=cytosol; Biological process=thiamin biosynthetic process
  Homolog annotation: Hit_ID=Q1SWN4; Match level="QueryCoverage=94%, HitCoverage=85%, E-value=0.0, Identity=79%"; Hit description =Thiamine monophosphate synthase; Phosphomethylpyrimidine kinase
  Pfam annotation: Domain name=Carb_kinase; Domain location=17-283; Score=-84.6; E_value=0.064; Accession=PF01256.8; Description =Carbohydrate kinase
  Pfam annotation: Domain name=Phos_pyr_kin; Domain location=24-273; Score=421.6; E_value=1.1e-123; Accession=PF08543.2; Description =Phosphomethylpyrimidine kinase
  Pfam annotation: Domain name=TMP-TENI; Domain location=297-482; Score= 307.8; E_value=2e-89; Accession=PF02581.7; Description=Thiamine monophosphate synthaseTENI
  Pfam module annotation: Pfam domain module=Carb_kinase::Phos_pyr _kin::TMP-TENI; Domain location=17-283::24-273::297-482
MSVRVLQAEADMKIPHVLSVAGSDSGGGAGIQADLKTCGARRVYCSTVITAVTAQNTAGVQGLNILPEDFVADQLHSVLSDMHVHVVKTGMLPSLNIVKVLSQTLRKFPIKALVVDPVMISTSGDVLVGPSVLAGFLEELLPMTDIVTPNIKEASVLLGGVPLKSVSDMRTAAKLIHDLGPRNVLVKGGDLPNSLDAIDVFFDGEDFYELCSPRVNTRNSHGTGCTLASCIAAELAKGSSMLSAVKTAKHFIQAALDYSRDMTIGNGAQGPFDHFLALKINQSSYRQNRFNPNDLLLYAVTDSAMNRKWDRSIAEAVKAAVEGGATIVQIREKDAETRDFLEAAKECLKICHSYGVPLLINDRIDVALACDADGVHVGQSDVPARLARTLLGPEKIIGVSCKTPEQAHQAWIDGADYIGCGGVYPTNTKANNRTIGLEGLKEICLASKLPVVAIGGIGLSNAREVMELGVPNLNGVAVVSALFGRECILTETRNLHALNVGAILLKFFLVKEVIATVVVAFT

SEQ ID NO: 198136 - protein, 91 aa, Glycine max
  Coding DNA Sequence Number=SeqID_81358
  Subcellular localization annotation: CTP_CleavageSite=69; ConfidenceScore=5.45e-01
MPCLVTTLLALQPSLLPKLNSPYNKQMKVVGLSFCPRACVLSHASLEKVRGLCVFWRFYLRVGRSSRKPCSLGGQVKERKKRNNTTLSPFE

SEQ ID NO: 198137 - protein, 126 aa, Glycine max
  Coding DNA Sequence Number=SeqID_81359
MVRIGSNIPLAIYTLGMMAKYLDVLEIPRGVHVHFLVPQNALSMHVCEFSQGDVCDVICHFCFKSNVPLVKLTFQMFAFAGMAPRKLASKRSRKDKAAEGTSSAPEYDSHRFRSVVHQQRFEAIKG

SEQ ID NO: 198138 - protein, 73 aa, Glycine max
  Coding DNA Sequence Number=SeqID_81360
MACGMKEMCEDDKGYNFCCPNCMDWILLSLVHLLKCLFPVVTIGIKEFDTGLVAPSHWGLVSNKQMMQEEQPL

SEQ ID NO: 198139 - protein, 109 aa, Glycine max
  Coding DNA Sequence Number=SeqID_81361
MNPTEKHCKTAIYCVMHGYKFTNNSSMQLASESTSWWWVIGPQGSAVYISWHMASRFGEFTLGRIKEGMAECRVDREREIKKRVVTDLWFAVVLVGMWGNRGITWKTLR

SEQ ID NO: 198140 - protein, 161 aa, Glycine max
  Coding DNA Sequence Number=SeqID_81362
  Gene Ontology: Mol. function=phosphogluconate dehydrogenase (decarboxylating) activity; Cellular component=mitochondrion; Biological process=pentose-phosphate shunt
  Homolog annotation: Hit_ID=Q9FFR3; Match level="QueryCoverage=99%, HitCoverage=24%, E-value=8e-31, Identity=48%"; Hit description=6 -phosphogluconate dehydrogenase
SLVDVGDAGVVLDLSGNFVEDVLDIGVGMVGPTGHEGGVVACAVFTTRGANAEVEEAFVGDEVHAALGVLVPLIVAVDDAVAGVRERTKSRGVYWLVRGREPSLVHAALDVLVPLVVVVDDVVVGVEVVEEGDDGMVDWGVDLDEDDDGSGVLGGKEARRG

SEQ ID NO: 198141 - protein, 161 aa, Glycine max
  Coding DNA Sequence Number=SeqID_81363
MGIPPSFLLSCFVSDLTLEIRFEVQAHQPLSLTQAADLARLQKEKFFDHRPSPPPPCPRPPSLTNHGPLHPNPQLTLLPPSPRPSPSIPSSSPRPNPPPPFKHLTFEEIVSRRKRGLCFSCDEKYHKGHRCASRVFLLLAEEDKPPDPLLIANLDPSLDPS

SEQ ID NO: 198142 - protein, 94 aa, Glycine max
  Coding DNA Sequence Number=SeqID_81364
  Gene Ontology: Mol. function=phosphogluconate dehydrogenase (decarboxylating) activity; Cellular component=mitochondrion; Biological process=pentose-phosphate shunt
  Homolog annotation: Hit_ID=Q9FFR3; Match level="QueryCoverage=70%, HitCoverage=13%, E-value=7e-22, Identity=74%"; Hit description=6 -phosphogluconate dehydrogenase
MNLVADKGLLYLGIGTSGGENGACHDPSLMPGGSHHAYSNVQDILHKIAAQVEDDPCVTYIDEGGSGNWAAMVGFRGCYNFSDGREGTGIRKGK

SEQ ID NO: 198143 - protein, 351 aa, Glycine max
  Coding DNA Sequence Number=SeqID_81365
  Gene Ontology: Mol. function=carbon-carbon lyase activity; Cellular component=mitochondrion; Biological process=aromatic compound metabolic process
  Homolog annotation: Hit_ID=Q69NF8; Match level="QueryCoverage=72%, HitCoverage=74%, E-value=3e-90, Identity=65%"; Hit description =Putative 2,4-dihydroxydec-2-ene-1,10-dioic acid aldolase
  Pfam annotation: Domain name=HpcH_HpaI; Domain location=85-319; Score= 296.8; E_value=4.1e-86; Accession=PF03328.5; Description=HpcHHpaI aldolase family
  Subcellular localization annotation: CTP_CleavageSite=97; ConfidenceScore=5.77e-01
MGSISTSSIRAPPTRRTTVTPFSSLLPKPKPHFLSLSTSKSHAFPLSKPLTISPNSHPLIPKSIPTLSSSSPLNLKSRLRNGETLYGLFLLSFSPTLAEIAGHAGYDFVVVDMEHGPGGIHDALPCLHALAAANTAAILRVPESTAAWAKKALDLGPQGLMFPMIDSLQSAQDAVSYCRFPPTGLRGAAHPIVRASKYGLDEGYLGNYLDELLIMCQVESEEGVANAGAIAAVDGVDCVQMGPLDLSASLGYLWDPGHKKVREVLREAENKVLESRNDDVESGAYLAGFATAYDGARDLRSRGYHMVSGAVDVGLFRSAALEDVTRFKMDGDGSESDEGEEKEGDEKYWSE

SEQ ID NO: 198144 - protein, 414 aa, Glycine max
  Coding DNA Sequence Number=SeqID_81366
  Homolog annotation: Hit_ID=Q1SL01; Match level="QueryCoverage=32%, HitCoverage=13%, E-value=6e-15, Identity=36%"; Hit description =Ribonuclease H
MVGCNHCKVVGKIYGICANEGITEKCVELAMPWDEYYDKSVLLALATAVGRSVKVDMMTLNTSSGMFARVCVDVELHQPMVGKCGSKTHGLKLSMMEEKVAMLKARLVVMSILKMVEDLVMGDGLDNVMESESLCGERLGYMIKDAVDKGDWEPITLSRNGPKLSHLFFVDDAFLFTKAKLSQMRVSLEKSKAFASNRVPRRNNIGIYLGLNIVHGRVTMNHFDPLLDKNQSVLLLGKAIYWGGLVIGSMERKVHLVNWKVITRKRKQGVEYIDIRDVEVKVGDVYTSNKWDFSNLYIEILSGTKDYLARMRLILHYASSDLIVWFGDILGYIPKSHPYTIVSHVSTSASQVMLHIDGSCILNPGFAGYKGLVRNSNDIFMYGFFDDIGVQEGLPNCHQYASIVLSIRDFLRED

SEQ ID NO: 198145 - protein, 388 aa, Glycine max
  Coding DNA Sequence Number=SeqID_81367
  Gene Ontology: Mol. function=microtubule motor activity; Cellular component=microtubule associated complex; Biological process =microtubule-based movement
  Homolog annotation: Hit_ID=Q56YQ6; Match level="QueryCoverage=79%, HitCoverage=51%, E-value=6e-66, Identity=46%"; Hit description =Putative kinesin heavy chain
  Pfam annotation: Domain name=Kinesin; Domain location=2-125; Score= -147.3; E_value=4.6e-05; Accession=PF00225.13; Description=Kinesin motor domain
MGKSSSTTLAASVNFVDLAGSERASQALSAESRLKEGCHINRSLLTLGTVIRKLRLSPSFLAYGVYLLYSASNIVSKPTSGLFNSTPSLGGNSRTSIICTLSPARSHVEQTRNTLLFACCAKQVTTKAQVNVVMSDKVLVKQLQKEVARLESELRTPCPPSTNCDCAAMLRKKNLQIQKMEREIRELIEQRHLAQSQIEDLMCMVGNGQKSRKEDDDSISESSSTYPFDLRIREFNNPHYNNENSESSPDSKFFLFFPLPVNTRCCKEIQSVELEESSRDDLEYADPSVSNNGVLALTLYGEENVISQEIPTPVNEDREEKQNQLTYGVLEQRLDDSQLSNDSPMTMSETVPNCRNLKLLRSWSCREYYTSSSPEKAGVPRPFTLDDE

SEQ ID NO: 198146 - protein, 204 aa, Glycine max
  Coding DNA Sequence Number=SeqID_81368
  Gene Ontology: Mol. function=protein serine/threonine kinase activity; Cellular component=membrane; Biological process=protein amino acid phosphorylation
  Homolog annotation: Hit_ID=Q5NJB1; Match level="QueryCoverage=49%, HitCoverage=16%, E-value=2e-28, Identity=56%"; Hit description=S -receptor kinase-like protein 1
  Pfam annotation: Domain name=Pkinase_Tyr; Domain location=103-203; Score=-142.6; E_value=0.001; Accession=PF07714.7; Description =Protein tyrosine kinase
MAKIKMGHPPGQCEQNQHAFIINYHLDYFSLCFARKNPLFVLSWAHSGSAMSKRNTFFHNLIKPFKFSPSKEGQSEVEEIKNLAAQEQKIFPYETLVAATNKFHILNKLGEGGFGPVYKGKLNDGREIAVKKLSHRSNQGKTQFVNEAKLLARVQHRNVVSLFGYCTHGFEKLLVYEYVLHESLDKLLFSECFFANPLCLLDLI

SEQ ID NO: 198147 - protein, 228 aa, Glycine max
  Coding DNA Sequence Number=SeqID_81369
MAQALRVGEHLCRVIGSDDCSLDWQVQFYVSPSCPHLIDTPRAQTIFLEEDDHRCEARIASSRTGFRKLSVRVNLGCGVPVVFLRWKDEKRLKPKLGDLVILPFLGPNHDLPIGARTEKVAKFIRNLVGTYAKWDGGGEICFGRRMCIKVSIDVRKPPRKDHVIRECDEHNREETIEGDEGWELLGQIGKFDASFRVSCDALWKQIWEVNVAHKCKTHGVESMMQHLT

SEQ ID NO: 198148 - protein, 49 aa, Glycine max
  Coding DNA Sequence Number=SeqID_81370
MQKHRGRLYVVIWEEIQTVMIQSRPEIRLFKITSDGSDDKIDHLTWPNS

SEQ ID NO: 198149 - protein, 73 aa, Glycine max
  Coding DNA Sequence Number=SeqID_81371
MAQRKIVPKYYFGAQVLLTRHLPNILVRSLGSAKWDKGYIHVEFCQFRKVGLERKMETSSSEKRIYSLRSISK

SEQ ID NO: 198150 - protein, 36 aa, Glycine max
  Coding DNA Sequence Number=SeqID_81372
MAKIPDSDPSNLCKEFEGNSSNGTRKQRPIHPNWTY

SEQ ID NO: 198151 - protein, 70 aa, Glycine max
  Coding DNA Sequence Number=SeqID_81373
  Subcellular localization annotation: CTP_CleavageSite=21; ConfidenceScore=5.09e-01
MTDIETLSVGTISVETRHGTRARRGRGVLPRSSSPNLTLLPVPAPCGVGIFCPVPVSRLPEGTCGDPVLH

SEQ ID NO: 198152 - protein, 237 aa, Glycine max
  Coding DNA Sequence Number=SeqID_81374
  Gene Ontology: Mol. function=DNA binding; Cellular component=nucleus; Biological process=regulation of transcription
  Homolog annotation: Hit_ID=Q9LSH5; Match level="QueryCoverage=94%, HitCoverage=97%, E-value=1e-104, Identity=75%"; Hit description =Similarity to NAM
  Pfam annotation: Domain name=NAM; Domain location=6-134; Score=305.1; E_value=1.2e-88; Accession=PF02365.6; Description=No apical meristem (NAM) protein
MSPVGLPPGFRFHPTDEELVNYYLKRKINGQEIELDIIPEVDLYKCEPWELAEKSFLPSRDPEWYFFGPRDRKYPNGFRTNRATRAGYWKSTGKDRRVSCQSRPIGMKKTLVYYRGRAPQGIRTDWVMHEYRLDDKECEDTTGLQDTYALCRVFKKNGICSDIEEQGQCNISLIESSQTIINECETMSPDIPGASSSCLEEEDKDDSWMQFITEDAWYSSNAAMVGSEEVSHVTFTN

SEQ ID NO: 198153 - protein, 310 aa, Glycine max
  Coding DNA Sequence Number=SeqID_81375
  Homolog annotation: Hit_ID=Q53PU8; Match level="QueryCoverage=59%, HitCoverage=44%, E-value=2e-16, Identity=30%"; Hit description =Expressed protein
  Subcellular localization annotation: CTP_CleavageSite=21; ConfidenceScore=5.08e-01
MLLSQAKLHNNNNNSISNAINMSMKNKGNNNNNNNHCSPAILYLYPCLDGVFAALAAHLYFKATSLLSPLFFPNTVYNPLSAEDLPLNEIGDLYLLDFVGPDGFVQEISTKVPRVIVLDHHKSALEMLGNEASLGENVVKVIDMERSGATIAFDYFKDKILSPDVAVKHPSVHEEFERVRQLFLYTEDGDLWRWRFPNSKAFGSGLKDLNIEFDARKNPSLFDQLLSLDLDNIISKGKLSLSDKQKLIDEYLRKSYEIALGNAEFGHCLAVNVDTVFSELRSELGHQLATKSQKMNLRYVFPPRNYSLYP

SEQ ID NO: 198154 - protein, 50 aa, Glycine max
  Coding DNA Sequence Number=SeqID_81376
MQLAGVIGEFGDEVTGCRKRGSFKQLKMPVLLAICAAVGVASSTGELSFK

SEQ ID NO: 198155 - protein, 125 aa, Glycine max
  Coding DNA Sequence Number=SeqID_81377
MESSMRLGYLMTIFAVSGSMVFLFHQVNKHLCNNFMKKFEIEIRGSMKHQAKKKVRFAKDVVEFPMEEKNDHINVARTQEVIKKVLFIDDVKKWKHEQKLKDVMPPNRAILYKGIMNDRKGRLGF

SEQ ID NO: 198156 - protein, 97 aa, Glycine max
  Coding DNA Sequence Number=SeqID_81378
MAKLHRQKQNSRKEKLDIPKLSICPFAEKHQSTLEELQTHGVPGEEDRKPIGDTVIDEGGAVAGKEGTSHLTILPSHFTNRSATKASRHAHGDATPP

SEQ ID NO: 198157 - protein, 68 aa, Glycine max
  Coding DNA Sequence Number=SeqID_81379
MDNKNPLHQKSIWRVSPCMEVRKRVSWLWLGKERNGARCDGARLACGRETYLRGRLLEYKFEMKFHIG

SEQ ID NO: 198158 - protein, 176 aa, Glycine max
  Coding DNA Sequence Number=SeqID_81380
MALIATGGDIRPQMNLRRMAQAMLHGAEKIRQRKIVDITGKHMAAKRIMHHVFQQIGVFRPAKHLAYGRARIVTIDILQGLQPGSTHQNTPPFANNTRQSGRNHFPLPEQSRPAAAVARQSLRRRHDAARQTAHGGIQNRGETPGFCSCESAGNRSRSSPALCCECGRTGVQPPLA

SEQ ID NO: 198159 - protein, 563 aa, Glycine max
  Coding DNA Sequence Number=SeqID_81381
  Gene Ontology: Mol. function=glycine hydroxymethyltransferase activity; Cellular component=vacuole; Biological process=L-serine metabolic process
  Homolog annotation: Hit_ID=Q75HP7; Match level="QueryCoverage=83%, HitCoverage=80%, E-value=0.0, Identity=76%"; Hit description =Putative hydroxymethyltransferase
  Pfam annotation: Domain name=Aminotran_1_2; Domain location=126-504; Score=-109.0; E_value=0.064; Accession=PF00155.11; Description =Aminotransferase class I and II
  Pfam annotation: Domain name=Aminotran_5; Domain location=137-503; Score=-206.7; E_value=0.09; Accession=PF00266.9; Description =Aminotransferase class-V
  Pfam annotation: Domain name=SHMT; Domain location=106-511; Score =781.7; E_value=4.4e-232; Accession=PF00464.10; Description=Serine hydroxymethyltransferase
  Pfam module annotation: Pfam domain module=Aminotran_1_2::Aminotran _5::SHMT; Domain location=126-504::137-503::106-511
MDLSHPQSNLSLGFSSSHASPPPRSDPPVPLQLMEPQTENGNLDVESDDDEDKEVEEFRILGHSMCLKRRRDCDSSSSSSAAKRVSVEPDLDARKAAVRAWGCQPLSIADPDVHEIMEKEKKRQFRGIELIASENFVCRAVMEALGSHLTNKYSEGMPGARYYGGNQYIDEIETLCCERALNAFGLDPKCWGVNVQPYSCTSANFAVYTGLLLPGDRIMGLDTPSGGNTSHGYYTPNGKKVSGASIFFESLPYKVNPQTGYIDYDKLEERALDFRPKILICGGSSYPREWDYARFRHIADKCGAVLLCDMAQISGIIAAKECVNPFDYCDIVTSTTHKSLRGPRGGIIFYRKGTKPRKRGILLSQGHESDQYDFEEKINFAVFPSMQGGPHNNHIAALAIALKQVATPEYKAYMQQVKKNAQALACALLRRKCRLVTGGTDNHLILWDLRPLGLTGKFYEKVCETCHITLNKIAIFGDNGTIIPGGVRVGTPAMTSRGCLEAHFETMAEFLIRAAQIASILQREHGKLQKTTLKGLESNRDVVELRARVEAFATQFAMPGFDI

SEQ ID NO: 198160 - protein, 78 aa, Glycine max
  Coding DNA Sequence Number=SeqID_81382
  Subcellular localization annotation: CTP_CleavageSite=40; ConfidenceScore=5.00e-01
MSMQRRIEKFDSVKGSASNDQGPPRTGDDSHFTITWAGVRTSHTSQQPSRTLEQSVALPSFSNWVKSQTYDFHIISTL

SEQ ID NO: 198161 - protein, 312 aa, Glycine max
  Coding DNA Sequence Number=SeqID_81383
  Gene Ontology: Cellular component=integral to membrane
  Subcellular localization annotation: CTP_CleavageSite=36; ConfidenceScore=5.38e-01
MGTNTSVSGFYNFLTQGLNELHQSFLSHSFMSFQFLSQVISSLQSFHSQLTILVRKLRLPVGGKWLDEYMDESSRLWDACHVLKSAISGMENYYSAASNIASSLDGYHHFTPELSRQVIRAINVCQRDILGLEEENKSLMETRIEPLSQCLIQNISMESKLNGFSGFRGVLYAMRSVSSLLLMILLNGLAYCWSSCCFHQGYDGHMVFGSDFMVSMAILQQKVAEEIDQIEGQPGILLFEFQQAKSAMEELKVELERIASLSYAEIQEKVDNVKSCFGLLRCGVDTITGQLDDFFDEIVEGRKKLLDMCSHR

SEQ ID NO: 198162 - protein, 56 aa, Glycine max
  Coding DNA Sequence Number=SeqID_81384
MPPYFHVPNWISSPHNFLATSKCTNRQCTRSKGFIQDNFAQPLEYKIVIRVNKRIE

SEQ ID NO: 198163 - protein, 89 aa, Glycine max
  Coding DNA Sequence Number=SeqID_81385
MCVQFDSSRNLRGSEWCRNLPFGGCTKRPYHGPKRLSPREKMSGVATNVYSKKTLEKPKKDEGLHILKMRVQESFMHGKGLILTEQKSF

SEQ ID NO: 198164 - protein, 104 aa, Glycine max
  Coding DNA Sequence Number=SeqID_81386
MNKQEEGKKGMTQKGEKGRLAGNTILFSMLKSLIISTFLFSHVEPLLTLAEEEEDLLLLLIRRLAVTTTVASKRRWIYAVVVENLHCSFQEKLYHLEEAVSVKD

SEQ ID NO: 198165 - protein, 94 aa, Glycine max
  Coding DNA Sequence Number=SeqID_81387
MAISSSLKASCKKKKMKAKVLVFGEEMGVIMKNLVERLGVHGRTCLTMGGIGTGLQEHSNRMTPKTYTPKSPSGPLPPDSVDPITTHRALTRHP

SEQ ID NO: 198166 - protein, 179 aa, Glycine max
  Coding DNA Sequence Number=SeqID_81388
MECENFARFLRRIRRRKMIYLEAQENLKGKSMKRRLHKNSPYKEKLLLSEGTILFSTFDGRYYGSLDKEIPQPSISFLPLMLDIMVSQTRRFHDHQYRRRIRRDIRRFLSLTRNLLISRCKNIYVPFSLTLKNTNRATRGGALESTINVTITNRECLSDYLEVRGYSCLGIRMNMCKVS

SEQ ID NO: 198167 - protein, 126 aa, Glycine max
  Coding DNA Sequence Number=SeqID_81389
MRRALTEIVPFINRWSSNVSPVLPRCRVPLSSSKFALHIFILKLDIDASSIGACRPRIFFINGFLCFLEDEWQRNGERERERRRHFKGKMSLEEAHHHRRPWIRAWRKNEMNEGRGREEHEILCSK

SEQ ID NO: 198168 - protein, 233 aa, Glycine max
  Coding DNA Sequence Number=SeqID_81390
  Homolog annotation: Hit_ID=Q9FHD0; Match level="QueryCoverage=92%, HitCoverage=13%, E-value=6e-19, Identity=34%"; Hit description =Genomic DNA, chromosome 5, TAC clone:K24M7
MLSQTPKVENSLDMLKPEPSRQYPYEALESVSLVENEFVFLDKDLMQTFEAFYDTKASDDLVTYGWMFKKEFNFKSFDELIVSNEIALTDDIFKSLHVLVFSDHIKMITLHDIIVKQFSSLKTLPLSASDGIYLNWDLLEEDKCNCKISNWYHNILAKIDLNNQDFGGTSFDDGKLVFDLVFCDDTINECDIKQNEKLKKLLSNCMPLLDNHPVKVASGKNLEHVSSKQGSQE

SEQ ID NO: 198169 - protein, 198 aa, Glycine max
  Coding DNA Sequence Number=SeqID_81391
  Gene Ontology: Mol. function=transition metal ion binding; Cellular component=nucleus; Biological process=DNA integration
MKVLKGYTKNQYRPKASIVERYVVEEAIEFCLEYIQTATPVGLPKSRHGCIRGETILANDSSSKTLRLLDVGPNLNVPTWKGYDINKYSLYTESQDDKNSVQNSKVNVDVDSDHFCGALYNNPWVNGNIGVCQDKMGFTLLDLQKLAYKDEPFIMAKQVRQVFYIEDPCNSRRSVVLLGRPTEHEEEDVHANRNDHDE

SEQ ID NO: 198170 - protein, 115 aa, Glycine max
  Coding DNA Sequence Number=SeqID_81392
  Gene Ontology: Mol. function=transition metal ion binding
  Pfam annotation: Domain name=Transposase_21; Domain location=3-88; Score=-144.7; E_value=0.03; Accession=PF02992.5; Description =Transposase family tnp2
MAHVVKMQPQTTTIQQRCAVGPTQPGNDIDVYLIPLIKDLRKMWYRGLMCMMGMFSRPQKAFNGSQQIQSAPTSLAVQEVFDRVKDIINIFGKTQKKDASKKNIWKKRRIISNWA

SEQ ID NO: 198171 - protein, 411 aa, Glycine max
  Coding DNA Sequence Number=SeqID_81393
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=80%, HitCoverage=48%, E-value=4e-40, Identity=44%"; Hit description=Chromo
MDLRYQERNDKMLHMKTLMDQIQLMMNKLLKIVSQPHGSSANNDTHVVTLISVALPTKEISLGFLHFDGTTLKLSMVSTCPELTRALESQFGPSPFNFPMAKLFKLHGLNRDLHRDVAAMTPPTLLRAVALAKLLEEKYNPIPKYTRSSYIQKYSQISTTLVSISSQPKIQNKNSLPELLPTPQGPPLKSSNVKKTSPMEMQLRRKKGLCYFCDEKFSFSNKCPNRQFLFLQLEEEDVEDSSRVGTIRFMAYIDKLPMTVLIDGGSSDNFLQPRVAKFLKLPVEPATQFRVMVGNGSGIAMDANKLEAIQNWPEPMNLKKLRGFLGLTGYYRRFVKTYATIATPLTVLLKKDSFKWGQATAQAFQKLKIAMTSAPVLAIPNFNKLFVLETDASGRGVGVVLSQNKHPIAYF

SEQ ID NO: 198172 - protein, 66 aa, Glycine max
  Coding DNA Sequence Number=SeqID_81394
MGQGITTTSLPRSLLELSHVQTGGYECGYYVMHWMWNIISGGLKNEWTKWSGDGTPLDIDAITTIR

SEQ ID NO: 198173 - protein, 98 aa, Glycine max
  Coding DNA Sequence Number=SeqID_81395
FSAMVEEFVKDSVHQDSVAVITLDHPKGIRTIDRAAKTWQTALRAPDDGIMTAELLERAALGALEDGIMTTEFLERLYLEIRNKDTGSATHMKSPRVL

SEQ ID NO: 198174 - protein, 265 aa, Glycine max
  Coding DNA Sequence Number=SeqID_81396
  Gene Ontology: Cellular component=microtubule organizing center; Biological process=microtubule cytoskeleton organization and biogenesis
  Homolog annotation: Hit_ID=Q9SC88; Match level="QueryCoverage=50%, HitCoverage=17%, E-value=4e-49, Identity=73%"; Hit description=Gamma- tubulin complex component 4 homolog
MGKKQNEIQKTGLGRALLSRFYRKKFLESFTEVSDIDAVVEQSLEPLPKLAAAASTTLISLELIERIIVFGFYYREMERFSGKCRDLSWIRSANANPLEKKEKGSVYRRALANGIVEILSVYRSAVLHIEQKLLSENMPILATVTQGLNKFLCLLPPLYELILEIERDDIRGGQLLNLLHKRCHCGVPELQTCMQRYAVLFTCSILGNVKMQEKQVDLLSKLKKNVSTPEGVPRLFDLVKVQDERMKLAFFAALRNTVVAKDLDQ

SEQ ID NO: 198175 - protein, 89 aa, Glycine max
  Coding DNA Sequence Number=SeqID_81397
  Subcellular localization annotation: CTP_CleavageSite=33; ConfidenceScore=5.45e-01
MDEQYSQLQKAYSTSVKLSYLRRASHRLCYRCRCKSTTTTSVSPTTVFVMSEDNSTVVVRIDFNVGCEWGPSLFQKSIKTGGGCTRCCF

SEQ ID NO: 198176 - protein, 193 aa, Glycine max
  Coding DNA Sequence Number=SeqID_81398
  Homolog annotation: Hit_ID=Q2HVC0; Match level="QueryCoverage=38%, HitCoverage=11%, E-value=1e-06, Identity=43%"; Hit description =Protein kinase
MRQLQASLGADEEGRRSAVDPAFRKAWLDQSLKTMMEIYVSLHLNYNMHGEGILKVVKGHQAQNLEGYPSISVKPQKRFRADLQGKVLLEDNMKEGSEIVAEGPRCSLRSRKCPVCDYLKMFLLNVPETVVALGLFFFLDDVTGFEISYLIKYQTDNSFILTFPSNVPFPSSYISISSSQKKEPLECKVHFRV

SEQ ID NO: 198177 - protein, 1402 aa, Glycine max
  Coding DNA Sequence Number=SeqID_81399
  Gene Ontology: Mol. function=RNA-directed DNA polymerase activity; Cellular component=chromatin; Biological process=chromatin assembly or disassembly
  Pfam annotation: Domain name=Chromo; Domain location=1309-1359; Score= 17.4; E_value=0.0088; Accession=PF00385.14; Description='chromo' (CHRromatin Organisation MOdifier
  Pfam annotation: Domain name=RVP_2; Domain location=330-454; Score= -27.8; E_value=0.00015; Accession=PF08284.2; Description=Retroviral aspartyl protease
  Pfam annotation: Domain name=rve; Domain location=1006-1162; Score =114.9; E_value=2.3e-31; Accession=PF00665.16; Description=Integrase core domain
  Pfam module annotation: Pfam domain module=Chromo::RVP_2::RVT _1::Retrotrans_gag::rve; Domain location=1309-1359::330-454::547 -716::92-182::1006-1162
MAEHGTRRTTTDCLEEAIAALTEKHSDLANKFEAMCERLSHMSSSAPPRPQVPRPPVKLDVPRFDGHDPLGWIFKISQFFDYQGTPEEDRIMVASFYLDGPILSWFQWMFINGFITSWSALLQAIESRFAPSIYDDPREALFKLTQRGTVTKYLTEFEKLANCITGLSPSVLLSCFISGLSPEIRREVQAFQPLSLPKVIALAHLQEDKINDRRKHARTPCNHPSPNTTSSNSHSTQTPRPKPPFVQRTQEDMAYRREKGLYYNCDEKWSSSHRCKGRFLFFIANSDESSPSELSLTEPLSPFGSEPDPSVDEPTQPFDPASLQPHISLHAMAGMPATDTFRLYGLINNICVTILVDSGSTHNFVQPRVAKFLNLPMQDTIPLRVMVGNGSVLDCQLMIPETKILIQDHSFVVTLRVLPLSGADVILGVEWLRTLGPVVTYYTTFTMKFTLFGKPIHLRADVQVDTNLVSAHQVKRLISTNSTSGLFHLSLQPIPSPELLNTALHPVPAIDELLLKYESLYPYFQKTEIEKQVTALLDFGLIQPSRSPFSSPVLLVKKKYGTWRMCVDYRALNFITVRDRFPLPTIEELLDELGHALWFSKLDLRQGFHQILMVKRDIPKTAFWTHQGHYEYRVMPFSLCNAPSTFQAAMNALLIPFLRKFTAVFFDDILVYSATLQDHLHHLECVFNSLSQAQYFLKRSKCLFGQRQLDYLGHVVFGEGVQPNPSKVQAILDWPKPSSPRDLRAFLSLTGFYRNFAAFDNLKKAVIAAPVLALPDFTLPFALETNASNYAMVRELHTIVAAVRKWRQYLLGHRFTIFTNHRSLRELVSQTIQTPEQQFYLAKLLGFDYDIQYKAGTSNVVVDSLSHVSDSTQGQCLVLSVPHHEFMLQLKQSLSSSPEFQKQREAIQVAPADHPDFSILGDFVLFKGAIWIDAQNPFIPALLHEYHAAPLAGHFGVKKTFHHLRSNFQWTNMLRDVKTFVRNYNTCQQVKPIMRKSAGLLQPILIPSGIWEDLSMDFVTHLPSSQRFTAILVVVDKFSKGVHLGALPSHYTAFKVANLFLNIVCKLHGFPRSIISDRDPILVSSFWRELFRLSGTTLRMSTTYHPQTDGQTEVMNRMIEQYLHSFVHRNPAEWYKFLALVEWSYNTSQHSGTGFTPYEVVYGKPPPSVLDYLKGSSRNDAVDTMLVTRGVVHAALRRKLLKAQEDMKLLADKRRRDVQYEEGQMVYVRLRPHRQLSLQDQSPNKLAKRYLGPFPIIERIGKVAYRLQLPKASKIHSVFHCFMLRPHHGPLELPVSALPPDTIQNQPILKPLTILNSRMDPSTDPSTQLVLVQWIGLAPEESTWEKWDDICRSHHLEDKVIFPRGGGDDDRATSAANTVNEGARAERPKRNVSRPKHLDDYV

SEQ ID NO: 198178 - protein, 616 aa, Glycine max
  Coding DNA Sequence Number=SeqID_81400
  Gene Ontology: Mol. function=voltage-gated potassium channel activity; Cellular component=integral to membrane; Biological process=potassium ion transport
  Homolog annotation: Hit_ID=O24538; Match level="QueryCoverage=94%, HitCoverage=67%, E-value=0.0, Identity=77%"; Hit description =Potassium channel
  Pfam annotation: Domain name=Ion_trans; Domain location=116-319; Score=114.6; E_value=2.8e-31; Accession=PF00520.21; Description=Ion transport protein
  Pfam annotation: Domain name=Ion_trans_2; Domain location=228-325; Score=68.1; E_value=2.8e-17; Accession=PF07885.6; Description=Ion channel
  Pfam annotation: Domain name=cNMP_binding; Domain location=455-544; Score=67.5; E_value=4.3e-17; Accession=PF00027.19; Description =Cyclic nucleotide-binding domain
  Pfam module annotation: Pfam domain module=Ion_trans::Ion_trans _2::cNMP_binding; Domain location=116-319::228-325::455-544
MEGMNFSSLYNPQLASSSKKSYSKQEYNHSGEHHHLNEEGYMSPSFNLRNISKLILPPLGVSSQNPVNSKGWIISPMDSRYRCWESFMVLLVAYSAWVYPFEVAFMHKSSNMKIYIADSVVDLFFGIDIVLTFFVAYIDRTTHLLVRDKKKIVVRYLSTWFVMDLASTIPYEAIGYLFTGKRKLGLPYFLLGLFRFWRIRRVKQYFTRLEKDIRFSYFWVRCARLLSVTLFSIHCAGCLYYMLADRYPHQGKTWIGAVNPNFRETSLRIRYISAMYWSITTMTTVGYGDLHAVNTLEMIFIIFYMLFNLGLTAYLIGNMTNLVVEGTRRTMEFFRFLTTWNPSRFLGMLPELYVIVTNVPCNFMSLSVQRNSIEAASNFVSRNRLPPRLKEQILAYMCLRFKAENLNQHQLIEQLPKSICKSICQHLFFATVEKVYLFKDVSKEILLSLVAKMKAEYIPPREDVIMQNEAPDDIYIIVSGEVEIIHTEMERERILGTLHTGDMFGEVGALISRPQSFTYRTKTLTQLLRLKTNTLMEAMQIKREDRQILKNFLQHIKQLKDLSIKDLMVENVEEEDPNMAVNLLTVASTGNAAFLEELLRAGLDPDIGDSKGKTPL

SEQ ID NO: 198179 - protein, 61 aa, Glycine max
  Coding DNA Sequence Number=SeqID_81401
MGNCFHSGTELLQQARDRMQTYNSKKISENFLNVLHVVDEEMYKIGQDVKKGGITSKKEQK

SEQ ID NO: 198180 - protein, 69 aa, Glycine max
  Coding DNA Sequence Number=SeqID_81402
MEVFYIGCEGRTNVQWGEFYIGYEGETGVELGKFYTKVAYFFWIYNLASLKVLKEEEYGQLVIMYYNNI

SEQ ID NO: 198181 - protein, 191 aa, Glycine max
  Coding DNA Sequence Number=SeqID_81403
MDRSKDLASEVEFNGTESGWTTYIGSPTYNEVSNGDDEHSVYFEDYGNNYKNAHRNIYDDDNKRENNDDFKRDTDEESDDSMASDAASGPSHLHLVCINSEGSHGLDFTEHTENDNEKIPLTKRASKQIVLLVMFKEESAEFFHLEIWRRGVYSNQSFLLTSKETHRPIMECELVYKLVKVGGKICKVYVK

SEQ ID NO: 198182 - protein, 82 aa, Glycine max
  Coding DNA Sequence Number=SeqID_81404
MEQAVKTAGMKIKSFKDEDTRISIWNIAGHGSASFFIIISSLFRKPCNKEQKSSIEIEEDLQYWLRFIVSNFKRAIQQIKFQ

SEQ ID NO: 198183 - protein, 304 aa, Glycine max
  Coding DNA Sequence Number=SeqID_81405
  Homolog annotation: Hit_ID=Q1T1F7; Match level="QueryCoverage=34%, HitCoverage=22%, E-value=1e-16, Identity=43%"; Hit description=IMP dehydrogenase/GMP reductase
  Pfam annotation: Domain name=DUF1723; Domain location=108-157; Score =56.2; E_value=1.1e-13; Accession=PF08330.1; Description=Protein of unknown function (DUF1723)
MPTTSTHRQQEVAPVAEDDLVLTKDVHAHAEEAIDDAEGFPGGPRDLSVLTDYGDHVAVIVWNDEERPELKLSSHGRKVLKFGRPAPEIEGLVAITGLSPLIACSVDTGDRGLISTFVERWHKETSSFHLPVGELTITLDDVSLERKLELRQHNVMGHTYAYRGYEIFIRVDVIYDGVPLSSDTDQRGWCGNLDMFRPSSINYGTVCIRLHTVDDTYVEPHIPEVLVAPAAAPAYAPSDVEQPRHVVACQTIAERLERLVNLRIVTAGTKIHEVMEDNIRIARGVTPDGNVYVRSRQRRRTDQP

SEQ ID NO: 198184 - protein, 262 aa, Glycine max
  Coding DNA Sequence Number=SeqID_81406
MQPLTEMRSLPRRWKSKTELQVLNADNKPPNVWQTNLQRKQTTSGGEEARTSPRKQANGAAKKNGIFAHSLKILGAPAIMLGATSNTHDIIFHWLGFKAKVTTSIVDTRLCSYGAMGVFIIYTLPSTTVSLVNRLCMLSINIQRWSCPNNCRCTTRVPARATHADSIITSKSPIDTVLALALAVASLLCHTFFPLSCFALLIPREFVNLHLTLNNLTPLQGLRAFVNRNWVSIVENKLESLEGFEGLSKLTILASLVLLLAC

SEQ ID NO: 198185 - protein, 83 aa, Glycine max
  Coding DNA Sequence Number=SeqID_81407
MDEGGSKQLENAGEKWESESGRRRDKRKKLGVTVHSAFCFLKFLITRAKWEVSNIAGLLSDWWWVYQPSYKACILEPIVVPNK

SEQ ID NO: 198186 - protein, 123 aa, Glycine max
  Coding DNA Sequence Number=SeqID_81408
  Gene Ontology: Mol. function=catalytic activity; Biological process =cellular metabolic process
  Homolog annotation: Hit_ID=A0EJL8; Match level="QueryCoverage=79%, HitCoverage=26%, E-value=2e-52, Identity=92%"; Hit description=GDP-D- mannose-3',5'-epimerase
MVDTSEAREWELEDQRRKQGSINLLETNVSLKESDAWPAEPQDAYGLEKLATEELCKHYNKDFGIECRIGRFHNIYGPYGTWKGGREKAPAAFCRKSLTSKDRFEMWGDGLQTRSFTFIDECV

SEQ ID NO: 198187 - protein, 108 aa, Glycine max
  Coding DNA Sequence Number=SeqID_81409
  Subcellular localization annotation: CTP_CleavageSite=46; ConfidenceScore=5.02e-01
MSHPIRALCPDVLQHKGQNTISPSQSTSINTQALCNIYTKTQSYMQCGTISVKNLVERLGVHDKTKHTLASQITLTRLKGALKSGVFTPKAYTPKSQLGSLPPDSGPT

SEQ ID NO: 198188 - protein, 486 aa, Glycine max
  Coding DNA Sequence Number=SeqID_81410
  Gene Ontology: Mol. function=unfolded protein binding; Cellular component=chloroplast; Biological process=cellular protein metabolic process
  Homolog annotation: Hit_ID=Q9C667; Match level="QueryCoverage=99%, HitCoverage=78%, E-value=0.0, Identity=72%"; Hit description =Chaperonin, putative
  Pfam annotation: Domain name=Cpn60_TCP1; Domain location=2-485; Score= 501.7; E_value=8.2e-148; Accession=PF00118.14; Description=TCP-1cpn60 chaperonin family
MVAELLGVTLGPKGRNVVLPNKYGPPKIVNDGETVLKEIELEDPLENVGVKLVRQAGAKTNDQAGDGSTTSVVLAHGLIREGAKVIAAGMNPVQIARGIEKTATALVSELRLMSREVEDHELADVAAVSAGNDYSVGNMISEALHQVGRSGVVTIETGRSTENSLEIVEGMQFDRGYLSPYFVNNRRKMTVELHNCKLLLVDKKITKTKELINILNNSAKEKYPVLIVAEGIEQEALAPVIKNKLRGALKVAAIKAPAFGERKTHYLEDIAILTGGTVIREDMGFNLEKAHKNDLGSATKVVITKNSTLIVTDGSTREAVEKRVCQLRRLVENTVENFQKKILNERIARLSGGIAILQVGAQTQVELKDKQLRIEDALNATKILRTRQAAIEEGVVVGGGCCLLRLSQKVDGIKKLLENEEQQIGAEIFRRALSYPTRMIAKNAGVNGNVIIDKVLSDDNLNFGYNAARDCYEDLMKAGIMDPTKV

SEQ ID NO: 198189 - protein, 923 aa, Glycine max
  Coding DNA Sequence Number=SeqID_81411
  Gene Ontology: Mol. function=nucleic acid binding; Cellular component= nucleus; Biological process=ubiquitin cycle
  Homolog annotation: Hit_ID=Q2HSV7; Match level="QueryCoverage=87%, HitCoverage=94%, E-value=0.0, Identity=67%"; Hit description=Zinc finger, FYVE/PHD-type
  Pfam annotation: Domain name=PHD; Domain location=122-176; Score =29.3; E_value=1.3e-05; Accession=PF00628.19; Description=PHD-finger
  Pfam annotation: Domain name=zf-MIZ; Domain location=344-393; Score =90.5; E_value=5.2e-24; Accession=PF02891.10; Description=MIZ zinc finger
  Pfam module annotation: Pfam domain module=PHD::zf-MIZ; Domain location=122-176::344-393
MPFRSVLGGWTQSARGFTKKDGLLSSSIQKLILHYLNQQCNKLATGKGWVMAHPLTEFSKLWTKKNAVGKQQVAKLVDETYRKLQVSGAIDLSSKGQGASDSSNGKIKGEIDNSFQSDTKIRCLCGNVLDTEPLVKCEDTKCHVSQHINCVIIPEKPMDGIPPVPDKFYCEICRLDRADPTNPVQSVERTFQLTRANKELVSKSEYDVQVWCMLLNDKVSFRMQWPQFADLKVNGLPVRAINRPGSQLLGANGRDTGPVITPYTKDGINKISLTGCDARIFCLGVRIVKRLSMPEVLSMIPEESDGERFEDALARVCCCVGGGNANDNADSDSDLEVVSDTFSINLRCPMSGSRMKIAGRFKPCVHIGCFDLEVFVEMNERSRKWQCPICVKNYALENMIIDPYFNRITTLMKNCGEEIAEVEVKPDGCWRVKAKNESERQELGTLAQWHHPDGSLIVSTDEVKSMENLKLKQEGLSDSPIAGLKLGIRKNSNGVWEVSKPENTNTSSGNNRLNEDFENHEHVIIPMSSSDTGSGRDEDDPSINQGGGEHIGYSTTNGIEMNSVFNNNIDSAYGYTVNNASATMGDAKIIILSDSEEDSDVLISHTPISGYRNNQTSDAVDVYSVLQPGIIDPYTEDHNPGGNPTLGVFNNPSEDDFGMPPLWPLQSGTPAVSGFQLFSSEVEDVSDALIDLHHGNINCSSSLNGYMLAPDTALGSSTLVPDSSAGRPDDDLNGGLVDNPLAFPREDPSLQIFLPPKPAESSMQHELRDHADMSKGVFIEDWISLRLGGSTSGSNGDISTANGLNSRQQITPRENAGDSLTDAAPLLPGMNDVRSEKASRQRSDIPFSFPRQKRSVRPRPNLPSDSEKWKMMWSEAPLGIVSPLMVRVLAAKIPNSLCLIFKSYDILKGQVRGMLLFPFSARN

SEQ ID NO: 198190 - protein, 94 aa, Glycine max
  Coding DNA Sequence Number=SeqID_81412
  Homolog annotation: Hit_ID=Q680Q4; Match level="QueryCoverage=57%, HitCoverage=6%, E-value=6e-15, Identity=72%"; Hit description=E3 SUMO--protein ligase SIZ1
  Pfam annotation: Domain name=SAP; Domain location=41-75; Score=42.2; E_value=1.8e-09; Accession=PF02037.17; Description=SAP domain
MIDRCWRWHALASGALLADFSSFLLKILCKMDWVASCKEKLQYFRLKELKDVLTHLGLSKQGKKQDLVDRILAILSEDQGKIVLSFSMTYTQGG

SEQ ID NO: 198191 - protein, 324 aa, Glycine max
  Coding DNA Sequence Number=SeqID_81413
  Gene Ontology: Mol. function=RNA-directed DNA polymerase activity; Cellular component=membrane; Biological process=RNA-dependent DNA replication
  Homolog annotation: Hit_ID=Q1SYP9; Match level="QueryCoverage=69%, HitCoverage=25%, E-value=2e-15, Identity=24%"; Hit description=Myb, DNA-binding
MQCRPQLNGISFSNIGQQQNQMLVCNFYEQEIRAFNKALLGKWRWDMLQQSNKLWSKIMHSKYGGWRSLVEGSRRNNESGWWKDLMEVTHYQQMNSILQDGTTWRVGCGDKIKFWEDSWAGHGKAQKMKYPRLYRISLQQHKLIQQVGSFNDSSWEWNLSWRRSLFDNEIASAAGFLEQICQITIQPHIADCCKWEAEPNGCYSTRSAYNIIQQEDAAHLFFNCTKSLALWWESLAWTGIVGAFPIIPRYHFLQHQNGMNGGKRNNRWKDVDEEKDKEEQNKKKIKEVSHECSLVNKHKAIWMTKPEEITKEEYSAFYKSLTND

SEQ ID NO: 198192 - protein, 311 aa, Glycine max
  Coding DNA Sequence Number=SeqID_81414
  Gene Ontology: Mol. function=hydrolase activity, hydrolyzing O -glycosyl compounds; Biological process=carbohydrate metabolic process
  Homolog annotation: Hit_ID=Q2HU31; Match level="QueryCoverage=89%, HitCoverage=91%, E-value=1e-111, Identity=70%"; Hit description =Glycoside hydrolase, family 18
  Pfam annotation: Domain name=Glyco_hydro_18; Domain location=47-293; Score=27.6; E_value=1.2e-08; Accession=PF00704.18; Description =Glycosyl hydrolases family 18
MTMELFPTSKLCTLKPFFLIFLLLLTSTHATPSSSSNLFREYIGAEFNNVKFSDVPINPSVQFHFILSFAIDYDTSSSPSPTNGKFNVFWDTDNLSPTQVSAIKRKNSNIKVALSLGGDSVVGGGNANFNPSSIDSWVSNAVSSLTSIIKEYNLDGIDIDYEHFKADPETFSECLGRLIKTLKSNGVISFASIAPFDDDQVQSHYLTLWKSYGNLIDYVNFQFYAYDKGTTVDQFIGYFNAQSSNYNGGKVLVSFSTEGSGGLSPDGGFFTACHTLKSQQKLHGIFVWSADDSMSNGFRYEKQSQALLALP

SEQ ID NO: 198193 - protein, 171 aa, Glycine max
  Coding DNA Sequence Number=SeqID_81415
MKQELKNFDMLTFTLARSRHHSKGHEIGYVVVVRTMARVFVLGGRKGNVTIRMRLLHHHLYPPLPNHTFGTFSSNFTVMRKDFLLKEGQIYCRGLVLKTIYQIGSVLKQIAGGSIIYVGAVIVTGVKLVTSLAITGTAMPPLAAAGRGGERRETRHWCWQDRKREETRHWH

SEQ ID NO: 198194 - protein, 77 aa, Glycine max
  Coding DNA Sequence Number=SeqID_81416
MVTNKKVEEKVVTKEESQKSNKQATDKGKVVVNHPPVEHRAYPHASSKNNKQRRIMDNEKVEAIGSPLLSNCRKPEP

SEQ ID NO: 198195 - protein, 48 aa, Glycine max
  Coding DNA Sequence Number=SeqID_81417
  Homolog annotation: Hit_ID=P38417; Match level="QueryCoverage=61%, HitCoverage=3%, E-value=1e-09, Identity=93%"; Hit description =Lipoxygenase-4
MDWNLEHGTCLKYDGDPSAPHGVRLLIEDYPYASDGLQIWDVIKSKGY

SEQ ID NO: 198196 - protein, 154 aa, Glycine max
  Coding DNA Sequence Number=SeqID_81418
MKSPKHPWYPLKRCKVKGLFKLMFDCQIREQKPQGKGQNGHFLELPRPKLAQASIWLAWAMGKLQPEATRSPGRADTFKLKQPVCLGELPLHQMVVEILAIKISIPANIGSNQAQSLKKRILSSQGQCMEVTSLRKLGQKMGQIYIASLTTANT

SEQ ID NO: 198197 - protein, 803 aa, Glycine max
  Coding DNA Sequence Number=SeqID_81419
  Homolog annotation: Hit_ID=Q10NT0; Match level="QueryCoverage=98%, HitCoverage=89%, E-value=1e-58, Identity=28%"; Hit description =Expressed protein
  Pfam annotation: Domain name=DUF593; Domain location=462-555; Score =171.2; E_value=2.6e-48; Accession=PF04576.6; Description=Protein of unknown function, DUF593
PENNKGSCRDLVCEAHAFEISKLDFCLNHRKLAESETMCEDCSSSCHQNFVDLSQSFGFFSWMQQKGMIHDADDNNKVLETGVEPLKCSCCGVNFVRDKPSLRVLDYSQKQNSITECGVEAEIDEGHHHSDHDRDDFELDHPVEEQNIVENRENSMVFYVNEGSGGGGKGADDISVCSMCDGGKETVYGENYKLDLGIGKGQEEPTREETLNVPRDDQPCEETTHQVSCTSENTEQIPPKHLEFVIHGNDCFLIPVEFGDSFATKSENQHRYKVGDDGFSGDEDVVLDFDINSGAESAPVIENWHTSGDTVSLFSDPGCTKVFKANGFELRSEHLEQNYLDMKFAQSTEDSSINGNVEANMKRRDVELCSVVPQVSEGVTQMRGDELEAEVSTQDQDILEDSSQQIQEVPPSSSTTFTIQDDSENLHQLRKRLQLLGRKESGTEESLEGSVMCDIECGELTIEKLKSALKAEREALNVVYAELEEERSASAIAANQTMAVINRLQEEKAAMQMEALQYERMMEEQSEYDQEALQLLNDLMVKREKEKLELEKEVEIYRKKVHEYEVREMVMSRRESHMRSRTSPSCSNALDSDELSIDLSRDLKKKNGNYTHQEFSNQNAHEDAVLYLEESLENFEEERLLILEQLNMLEEKLVTLNYEEEYFDGIKSIEHLCEENGNGYQDHNDYIVHVNGLANAKHQDGRKTKCTKAENGVMSNGLDFTSLQNSSDENVQLEKKKLDVKVEVDHVYERLQALEADREFLKHCISSLGKGDKGLDLIQEILQHLRDLRNVELRIMNMGDISV

SEQ ID NO: 198198 - protein, 82 aa, Glycine max
  Coding DNA Sequence Number=SeqID_81420
MVVVRLELGAMLRLLDANLAGAGCEHGSVWCGRDRVGRSHSVDVVGDDDGYASSDLDGGDELGEKKVVGREKGKKGGGKREG

SEQ ID NO: 198199 - protein, 116 aa, Glycine max
  Coding DNA Sequence Number=SeqID_81421
  Subcellular localization annotation: CTP_CleavageSite=49; ConfidenceScore=5.02e-01
MWDWHILKGALKPGVFTPKAYTPKSPSGPLPPDSGVVDTSFYTRREIVRCFGQGCEKYLRGGEKFHFRQFSGPWLAWPHKLLRAEGTNSPGRASFFRIKHQLTWVSCHSPKCPYFL

SEQ ID NO: 198200 - protein, 64 aa, Glycine max
  Coding DNA Sequence Number=SeqID_81422
FLASSKSKESLAQNLKEVLQLLQQEEEEEPPKKEAESSEKNDDQEDDPFYQNEDDCFGISLDDD

SEQ ID NO: 198201 - protein, 152 aa, Glycine max
  Coding DNA Sequence Number=SeqID_81423
MWVHITREEKTIPQRLRELSETDKEFEGFVQVALQKRKATTQVALTPKRPKTVQPTPAIRESVIPSTIPKRIKTRATKANPKFGEKEWTVSFTGNKENFASSSSNSESTDETLISPLQKCPVPIPKQCPPPSHIHLKKFTRSTLQKEPLTKA

SEQ ID NO: 198202 - protein, 178 aa, Glycine max
  Coding DNA Sequence Number=SeqID_81424
  Gene Ontology: Mol. function=RNA-directed DNA polymerase activity
  Homolog annotation: Hit_ID=Q1SYN8; Match level="QueryCoverage=53%, HitCoverage=60%, E-value=8e-09, Identity=29%"; Hit description=RNA -directed DNA polymerase (EC 2.7.7.49) (Clone AmLi2)-garden snapdragon-related
MVEGLMFLRKRLKRVKLDLETWSKEHFGELESKRGNLIKKIGVLDGRDEVGSLSLRRINNLNDLSIQWEEDPKKVKDEVKRFFKDKFREEDYSDVSLDGVWFKSFAAEDNIMLSKEFSEEEIKLVVWDCDRNKCSGHDSGKNMLDNIVIAYKVNQEAKIGKRLCYVFKADFEKAYDSM

SEQ ID NO: 198203 - protein, 151 aa, Glycine max
  Coding DNA Sequence Number=SeqID_81425
  Gene Ontology: Mol. function=oxidoreductase activity; Cellular component=intrinsic to endoplasmic reticulum membrane; Biological process=electron transport
  Homolog annotation: Hit_ID=Q2QCX0; Match level="QueryCoverage=95%, HitCoverage=39%, E-value=8e-45, Identity=60%"; Hit description =Flavin-containing monooxygenase family protein FMO2
MEKKVKCVFEDGLVAFEDGFSVYADAIIHCTGYKYHFPFLETNGLVTVDDNRVGPLYKHVFPPALSPWLSFIGLTFKNSVYQIIELQCKWVAKVLSGKVLLPTEKEMMESVKEYYQLMEENGLPKRYTHSLYPLQIFNIWTWLDLHCNISN

SEQ ID NO: 198204 - protein, 1143 aa, Glycine max
  Coding DNA Sequence Number=SeqID_81426
  Gene Ontology: Mol. function=nucleic acid binding; Cellular component= intracellular; Biological process=DNA integration
  Homolog annotation: Hit_ID=Q1T010; Match level="QueryCoverage=98%, HitCoverage=98%, E-value=0.0, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTSSNGNLMGNLPILDGMNWGEWRIQMQVVFGFQDVPEVVECEIAELEKQSSDLQKAACKDAKKSDCKALFFIHQSVDKANFQKIAHAKTTKEAWCILRKAYSGDAKLKKGCGEKLDDQMIMEKILRSLSPRFDYIVCVIEESKNLEDLKIEELQGSLEAHEQMLNDRDTERSTNQALQAHSSKGKGRGKWSTDKGKGSHKTHSKNFEETQSKTRESSGQHKNGMKSWKNEGKKFDKRKVKFFNCNKYGNFASKFTHKQKEGRNKAGDEANLAEGADNDSEQVLLMVTEKSDKGGSEVWYLDTNCSNHMTGNKHWLVNLDTSQGSKVRFANSSLINCEGIRNVVIKRKDESNDVIENVMYCPTMDSNLLSLGQLLEKGYKMRMEDLMLKVYDKKQRFILKAKMSSNRKFKVNFNVADVHCITAEGNDVNWLWHFRYGHLNFQGLSRLVAKHMVSGMPQIKAPAEVCEGCVAGKQPRNSFNVSLPPRAKEPLEVVCSDKFKAYAEKQNGATLKILRTDGGGEYISKEFEDFCESKGIEQNFAEHGVEHAKIEGAAKGTLKLEEITPEEAWTGKKPRVSHFRIFGSPYWKHVPDEKRKKLDDKSTQMIMNKTEKVQSKGMSVLDELGETSGEEAIGNSIGGASPIVAQRPQRVSKPSTRLSDFKVYTDDAITSKGELVYYTLLVDAEPVGYVEALKEEVRKKAMLEELAAIERNNTWKLVRLPKGKKPISLKWVFKVKRKPDGTIAKHKARLVVRGFMQREGLDYTEVFTPIARIEIIRIVVVLAHSRGWNMWQLDVKSAFLNGLLKDEAPRAWNKRIDGFLLKIGFEKCKVEYGVYVKDENGDIIILYLYVDELLITDSNEVVIQTVKKQLQQEFDMIDLGVMSYFLGIKFIHKNGGLVMHQKKYALEVLKRYKMEECNLAKSPIDFGLKLGAGLDEKPVDATLFKQMVGSLRYLCHSRPDIAYGVGLGTLDYGLLFSKASHNQGLRLIGFSDADWSGDLEDNKSTTRYVFKLLGSTICWSSKKQKDVGLSTCESEYMVAASAACQSAWLESLFVELKIQLYSVVQLNMDNKSVICLANNPIAHGRTKHIGTKYHYLRDQVRKERISLAYCKSEEQEVDILTKALRGEKFYKFREKLGIVNCLN

SEQ ID NO: 198205 - protein, 75 aa, Glycine max
  Coding DNA Sequence Number=SeqID_81427
MSGRLRDEILGKKIGLKGGGYCKKKKFGERGRKRGDRAKQLASGITFLKQLGDTARLQQLVIHLKFSFCMESIIY

SEQ ID NO: 198206 - protein, 140 aa, Glycine max
  Coding DNA Sequence Number=SeqID_81428
  Homolog annotation: Hit_ID=Q9LW83; Match level="QueryCoverage=41%, HitCoverage=7%, E-value=1e-17, Identity=74%"; Hit description =Receptor kinase 1
MAEKFISHTVSHFSFFRKIVKEGMILSQFRALSQYTHHLRAALTQLTLFVTHPSMPARPVIEHIWPPFNYYRHHPRFVVYTYYVPTTLLVFSSDHCNPNILAKPKSEILGFISSSSNILLAFKSVCITFSLEYLCKYTSR

SEQ ID NO: 198207 - protein, 160 aa, Glycine max
  Coding DNA Sequence Number=SeqID_81429
  Gene Ontology: Mol. function=nucleotide binding; Biological process =DNA packaging
  Homolog annotation: Hit_ID=O64316; Match level="QueryCoverage=98%, HitCoverage=93%, E-value=4e-45, Identity=58%"; Hit description=Gp1
  Pfam annotation: Domain name=Phage_Nu1; Domain location=1-142; Score =167.1; E_value=4.6e-47; Accession=PF07471.3; Description=Phage DNA packaging protein Nu1
MATSLGISVQAFDKWGVIPTEKRGREVFYDVRSVLENRLAHQVRKQQPDEDSEVAAEQRLQIARIRLTEAQAEAQELKNQKGKGLVVETAFCTFALSRVAGEIAGILDGIPLTLQRRFPGVDPRHLDYLKSTLAKAMNRTAVVGERVEAWMDEYIEQSAD

SEQ ID NO: 198208 - protein, 200 aa, Glycine max
  Coding DNA Sequence Number=SeqID_81430
  Gene Ontology: Biological process=DNA packaging
  Homolog annotation: Hit_ID=O64317; Match level="QueryCoverage=99%, HitCoverage=31%, E-value=1e-101, Identity=87%"; Hit description=Gp2
  Pfam annotation: Domain name=Terminase_GpA; Domain location=12-200; Score=-236.2; E_value=4.8e-05; Accession=PF05876.3; Description =Phage terminase large subunit (GpA)
MTAVEWANEYYYLPKESSYQEGRWETLPFQVAIMNAMGSDDIREVNLIKSARVGYSKMLLGVVAYFLQHKQRNGLMWQPTDGDAENFMKSHVEPTIRDVPSLLAMAPWFGKKNRDNTLSMKRFSNGRGFWCLGGKAAKNYREKSVDFVSYDELAAFDEDIEKEGSPTFLGDKRIEGAVWPKSIRGSTPKIRGMCQIERAA

SEQ ID NO: 198209 - protein, 70 aa, Glycine max
  Coding DNA Sequence Number=SeqID_81431
MDPYIVIKKDLMGTGEDDKGGTCTNVQSVYAREYYSLRSPKVKKEIKNFNEFNHVHDLGVMRFLGGLEFA

SEQ ID NO: 198210 - protein, 138 aa, Glycine max
  Coding DNA Sequence Number=SeqID_81432
  Pfam annotation: Domain name=DUF1218; Domain location=80-138; Score= -17.0; E_value=0.058; Accession=PF06749.3; Description=Protein of unknown function (DUF1218)
MDVAAGILGFEAEIAQNKNCQLRSLNQRPLLPSFSLLHPFLSHWVIFCAPSFVVKFMLISSPLLFSAKQVKHLRLWIFECREPGHQTFMLGLGAAVLLGLAHAITNLLGGCNCISSQQEFEKASSSRQLSTACLILTW

SEQ ID NO: 198211 - protein, 533 aa, Glycine max
  Coding DNA Sequence Number=SeqID_81433
  Gene Ontology: Mol. function=metal ion binding; Cellular component =intracellular; Biological process=metabolic process
  Homolog annotation: Hit_ID=Q2HU53; Match level="QueryCoverage=94%, HitCoverage=83%, E-value=2e-91, Identity=35%"; Hit description =Tetratricopeptide-like helical
  Pfam annotation: Domain name=PPR; Domain location=133-167; Score =41.4; E_value=3.1e-09; Accession=PF01535.11; Description=PPR repeat
  Pfam annotation: Domain name=PPR; Domain location=237-271; Score =38.8; E_value=1.9e-08; Accession=PF01535.11; Description=PPR repeat
  Pfam annotation: Domain name=PPR; Domain location=32-66; Score=42.1; E_value=1.9e-09; Accession=PF01535.11; Description=PPR repeat
  Pfam module annotation: Pfam domain module=PPR::PPR::PPR; Domain location=133-167::237-271::32-66
MWNFTPITLQPACGHMPYAQHIFHQIVLKNSFLWNSMIRGYACNNSPSKALILYREMLHFGHKPDNFTYPFVLKACGDLLLREIGRKVHALVVVGGLEEDVYVGNSILSMYFTFGDVAAARVMFDKMPVRDLTSWNTMMSGFVKNGEARGAFEVFGDMRRDGFVGDGITLLALLSACGDVMDLKAGREIHGYVVRNGGNRRLCNGFLMNSIICMYCNCESMSFARKLFEGLRVKDVVSWNSLISGYEKCGDAFLVLELFGRMVVVGAVPDEVTVTSVLGACNQISALRLGASVQSYVVKRGYGVNVAVGTAISIFYEMLGKGVTSDEGIFTAVLSACSHYGLVGDGYLAEAYGVIENMKLKPNEDVWTALLSACRLHRNVKLAVISAQKLFELNPDGVSSYVCLSNTEMMVHQFFVGDTSHEQSDDIYAKLKDLNEQLKKAGYKPDTSLVLYDVEEEIKEKMLWDHSERLALAFALINTGPGTTIRITKNLCVCGDCHTMVYAHAVDIGELMEDVLELLQCSITVSIADATGL

SEQ ID NO: 198212 - protein, 46 aa, Glycine max
  Coding DNA Sequence Number=SeqID_81434
MVEQGLGRRVAVVLRSNIEAEGVFHESWRGTSTRTGTRTRREYFKY

SEQ ID NO: 198213 - protein, 61 aa, Glycine max
  Coding DNA Sequence Number=SeqID_81435
MNQNVSAGLYFFEFMDIGTHEHPVKQLSMVWLASRYELWIQELDYQNMVLELDCKPVVWMG

SEQ ID NO: 198214 - protein, 842 aa, Glycine max
  Coding DNA Sequence Number=SeqID_81436
  Gene Ontology: Mol. function=actin binding; Cellular component =phragmoplast; Biological process=actin cytoskeleton organization and biogenesis
  Homolog annotation: Hit_ID=Q1SGQ9; Match level="QueryCoverage=55%, HitCoverage=46%, E-value=1e-148, Identity=59%"; Hit description =Pyridoxal-dependent decarboxylase; Actin-binding FH2
  Pfam annotation: Domain name=FH2; Domain location=370-775; Score =464.6; E_value=1.3e-136; Accession=PF02181.13; Description=Formin Homology 2 Domain
MELIRLSYAVVYVILLCALAQGGSEGKGGKEEEISRDGGEAFSSSINYVHGINKVENELKHCRKELIERNNDVKTSTSPPAPVSEKGSSRYLLPKHSRSTLGVESAHGRNLIADSPHNAPSPSATTAEPPSHGPTPTSSPSSPTPSSPSQSSPTPSPKGVDLPLPPDMFVPLPPSPRAPHPPPQNFRPIVDAPVASSPNNENKKKQTIILAASLSGIIILIGLALCYREARGNKGDRDDRPLLVLTSSDYSGGSKKVVRLGDADKEESDIDNGKKPSNFRNWSIKGGHNNASLVETTASEGVGQVLKGKPAPPPPPLPPGPPPPSAPKPPPPPAPRAPPPPKGAHPPPAPPKPLGGKNQGPLLAKEGTSSDGDAPKPKLKPFFWDKVNAKPDQSMVWHEISAGSFVINEEMMESLFGCTNQNKNEPKKNSLHVDTSVQYIQIIDPKKAQNLSILLRALNVTTEEVIDALKEGNEIPVELIQTLLKMAPTTDEELKLRLFNGQLSELGPAERFLKVLVDIPFAFKRLESLKFMFMLKEDFSSIKDSFATLEVACDELRKSRLFLKLLEAVLKTGNRMNDGTYRGGAQAFRLDTLLKLSDVKGTDSKTTLLHFVVQEIIRSEGIRAARTERAGRSISSVGTNNDSDEGGAEESEEHYRSLGLQVISGLSNELGDVKKAALIDGDALSSTVLKLGHSMVKTQEFLDNDMKNIEEESEFQHCMESFMEKAREEVTWLVNEEKRIMALVKSTADYFHGNAGKDEGLRLFLIVRDFLIILDKVCSEVRESTMKIAKAASNSAKEAARSSVSSSQNSPTPSTSDMHRRLFPAIAERRMDYSSSDEDEDF

SEQ ID NO: 198215 - protein, 103 aa, Glycine max
  Coding DNA Sequence Number=SeqID_81437
MVEQRSTVGVGVTGESFKGPLLNGLKEEWNRLRKGHQQKQDIIEVGARDNDFLFASEKRSSERGDRGQGWAPRWLPNNGKGRHGIVHLQRAAQTIAKRDQTLI

SEQ ID NO: 198216 - protein, 655 aa, Glycine max
  Coding DNA Sequence Number=SeqID_81438
  Gene Ontology: Mol. function=binding
  Pfam annotation: Domain name=Arm; Domain location=108-149; Score =23.3; E_value=0.00086; Accession=PF00514.13; Description =Armadillobeta-catenin-like repeat
  Pfam annotation: Domain name=Arm; Domain location=150-192; Score =25.9; E_value=0.00015; Accession=PF00514.13; Description =Armadillobeta-catenin-like repeat
  Pfam annotation: Domain name=Arm; Domain location=193-233; Score =13.6; E_value=0.25; Accession=PF00514.13; Description=Armadillobeta -catenin-like repeat
  Pfam annotation: Domain name=Arm; Domain location=234-277; Score =19.5; E_value=0.012; Accession=PF00514.13; Description=Armadillobeta- catenin-like repeat
  Pfam annotation: Domain name=Arm; Domain location=426-466; Score =35.8; E_value=1.5e-07; Accession=PF00514.13; Description =Armadillobeta-catenin-like repeat
  Pfam annotation: Domain name=Arm; Domain location=551-591; Score=5.6; E_value=2.4; Accession=PF00514.13; Description=Armadillobeta-catenin -like repeat
  Pfam annotation: Domain name=HEAT; Domain location=119-151; Score =4.5; E_value=12; Accession=PF02985.12; Description=HEAT repeat
  Pfam annotation: Domain name=HEAT; Domain location=199-235; Score =18.1; E_value=0.031; Accession=PF02985.12; Description=HEAT repeat
  Pfam annotation: Domain name=HEAT; Domain location=432-468; Score =0.2; E_value=41; Accession=PF02985.12; Description=HEAT repeat
  Pfam module annotation: Pfam domain module=Arm::Arm::Arm::Arm::Arm::Ar m::HEAT::HEAT::HEAT; Domain location=108-149::150-192::193-233::234 -277::426-466::551-591::119-151::199-235::432-468
  Subcellular localization annotation: CTP_CleavageSite=45; ConfidenceScore=5.45e-01
MLASTILTPSKLVPPITVVVAAETHPRNRVALFPKSNSKLAFVARASGNARDGTVDATSAPEIDAVTSSSSGLGDGYVALFVRMLGLDRDPLDREQAIVALWKYSLGGKKCIDTLMQFPGCINLVVNLLRSESSSACEAAAGLLRSLSSVNLYRNSVADSGAIEEINRLLRQSSLAPEVKEQSLSALWNLSVDEKLCIKISKTEILPLAIKYLGDEDIKVKEAAGGILANLALSRVNHDIMVEAGVIPKLAKFLTSNLEGSKVIRKEARNALLELVKDKYHRILVIEEGLVPVPLIDAAAFKSFTPGLHLWPTLPDGTEIERTSRLPSRYGASELLLGLNVDDKNANLEEAKVNAIVGRTQQQFLARVGALEMEEKTMPHSECSNDLRFTLLPWMDGVARLVLILELEDKSAIIKAAESIATACINEHMRIAFREAGAIKHLVRLLNCDDNAVQLAATQALERLSVSNIVCRVIEAEGVLGPLVSILKCSEIAGTIVEKSLNILARILDPSKEMQLKSYDGPANESEKAFGGAKGDCVSTGFSSTEQTVSQTYTRNDILDSVFIAHLVEILKSFPPSLQEKAATVLEFVALTDPTLAPIISLDIESGLNSAFQQKILKISVAWTSVQMQFKTMRESYELRGETMTGSSCGGEVRP

SEQ ID NO: 198217 - protein, 81 aa, Glycine max
  Coding DNA Sequence Number=SeqID_81439
MALWNVTHGDSVTWMSHGKGECEEEVVEMVLSFQKLLGSARLQYGHGIGWFGDRPLTYNYMFLYSITNSPPLTLHTVAEGQ

SEQ ID NO: 198218 - protein, 165 aa, Glycine max
  Coding DNA Sequence Number=SeqID_81440
  Homolog annotation: Hit_ID=Q2HRE8; Match level="QueryCoverage=85%, HitCoverage=59%, E-value=2e-16, Identity=51%"; Hit description =Lipopolysaccharide-modifying protein
  Pfam annotation: Domain name=DUF821; Domain location=3-165; Score= -223.8; E_value=1.5e-07; Accession=PF05686.3; Description=Arabidopsis thaliana protein of unknown function (DUF821)
MAYFVGRIERRHYEDTMAEQRALCLLERIGFENYKRGSTNQTCQVNALIDIRCTLKVLLGQSVKNTFCHVTLPLYVYDYMFHLLNSYAKLFRYKPSISANATELCVESMVCGAEGSVKKFMMESLVKVPANTDPCTMPAPFDPPTLYATSQRKESSIQQVESWEK

SEQ ID NO: 198219 - protein, 120 aa, Glycine max
  Coding DNA Sequence Number=SeqID_81441
IQRTNRLRILCLNTLEGTSFVVQVEGTSTWVVVTENKRGYISCGSVQVEGTSTWLFKENKGGPFDPTVQVAWPKGQRPSVRGGDTFGVANDDAADIVANDDYVADIRDAHRTWDPGPTQD

SEQ ID NO: 198220 - protein, 62 aa, Glycine max
  Coding DNA Sequence Number=SeqID_81442
MECNGKQDGQMHEKVCDLVVFPMEKTSKASREASDCKSPSWPRKALPTHYSSLPRPKGKKLM

SEQ ID NO: 198221 - protein, 154 aa, Glycine max
  Coding DNA Sequence Number=SeqID_81443
  Gene Ontology: Mol. function=transition metal ion binding; Cellular component=cytoplasm; Biological process=fucose metabolic process
GSQSEPFDVQIGDRLEDMIHDLGQESFQQAHAPMYDTLQIDSKKLLYPSSPLQVVHDMLPEGNTLLKSYYQEKKILCPMGMEYQKIHACPNDCILYRHEFQQMPKCPRCGVSRYKVKYDEECSSDENSKGPPAKVLWYLPIIPRFKCLFANGDD

SEQ ID NO: 198222 - protein, 66 aa, Glycine max
  Coding DNA Sequence Number=SeqID_81444
MLVRMIHTRLFAAARVKSCPGMHSRCVIASLSGCARTVGRPLISGGGPGSKGKGPYILLRCGYGAY

SEQ ID NO: 198223 - protein, 86 aa, Glycine max
  Coding DNA Sequence Number=SeqID_81445
  Homolog annotation: Hit_ID=Q93YU5; Match level="QueryCoverage=39%, HitCoverage=3%, E-value=4e-09, Identity=88%"; Hit description =Probable exocyst complex component 4
MESNSFKVTLGVLGTYVAKGTLYNEKKGRHGGKGSLMMRSGEEEGTLLASLAVCTAASADAASGVARRISHISCWHSLYKNMGEGI

SEQ ID NO: 198224 - protein, 130 aa, Glycine max
  Coding DNA Sequence Number=SeqID_81446
  Homolog annotation: Hit_ID=Q93YU5; Match level="QueryCoverage=67%, HitCoverage=8%, E-value=2e-25, Identity=64%"; Hit description =Probable exocyst complex component 4
  Subcellular localization annotation: CTP_CleavageSite=31; ConfidenceScore=5.07e-01
MPPHICWATAHVRNGGQRNVRRKRLGQTTQRASNHVGGKYHHSRSDSAPTRSLASFAQDYRKLAIDCLKVLRIEMQLETVFHMQEMANTEYLDDQDAEEPDDFIISLTAQFLVVSWDGYGNEPLGVTRVM

SEQ ID NO: 198225 - protein, 137 aa, Glycine max
  Coding DNA Sequence Number=SeqID_81447
MHEFSIVDGFVEISECMAEMTNQQNRRLAASSGDSLILGDQQIPWMRSHRCNPNLPLSVTSVSVTSSFQAAETDELPVSSQVEEEPQHEQTDLLILALISCQYQKDFKANKEAKLAEWLDGTGDLDDNCGTGDEKRS

SEQ ID NO: 198226 - protein, 125 aa, Glycine max
  Coding DNA Sequence Number=SeqID_81448
MGDYYESSKSNLGFRDTSVPYWCSNVLQAFENGGGPLLLLNWQISFLQRKKVISREKEGPLIAFICTDEAYCDNERRSRKTELNLPCCSGSEALATAGGERLLDMHGAYRQHSVSPFFVSSPLPI

SEQ ID NO: 198227 - protein, 52 aa, Glycine max
  Coding DNA Sequence Number=SeqID_81449
MGILHWNNVDEQEHAADLITPAKNEVVKKVVHYDADARALRLCISSHENIII

SEQ ID NO: 198228 - protein, 73 aa, Glycine max
  Coding DNA Sequence Number=SeqID_81450
  Homolog annotation: Hit_ID=Q5N749; Match level="QueryCoverage=80%, HitCoverage=3%, E-value=6e-15, Identity=62%"; Hit description =Putative microtubule bundling polypeptide TMBP200
MSEEEKLLKEAKKLPWEDRLFHKNWKVRNEANIDLASLCDSITDPKDSRIREFGRVYAFSDSIPDLRVADLDA

SEQ ID NO: 198229 - protein, 396 aa, Glycine max
  Coding DNA Sequence Number=SeqID_81451
  Gene Ontology: Mol. function=binding; Cellular component=centrosome; Biological process=establishment and/or maintenance of microtubule cytoskeleton polarity
  Homolog annotation: Hit_ID=Q8S912; Match level="QueryCoverage=93%, HitCoverage=18%, E-value=1e-138, Identity=67%"; Hit description =Microtubule bundling polypeptide TMBP200
  Pfam annotation: Domain name=HEAT; Domain location=214-250; Score =15.8; E_value=0.16; Accession=PF02985.12; Description=HEAT repeat
  Pfam annotation: Domain name=HEAT; Domain location=256-291; Score =1.4; E_value=29; Accession=PF02985.12; Description=HEAT repeat
  Pfam annotation: Domain name=HEAT; Domain location=30-67; Score=0.9; E_value=34; Accession=PF02985.12; Description=HEAT repeat
  Pfam annotation: Domain name=HEAT; Domain location=309-344; Score =30.3; E_value=6.6e-06; Accession=PF02985.12; Description=HEAT repeat
  Pfam module annotation: Pfam domain module=HEAT::HEAT::HEAT::HEAT; Domain location=214-250::256-291::30-67::309-344
MEKAIKNKVAKAVVPAIDVMFQALSDFGAKIVPPKRILKMLPELFDHQDQNVRASSKGLTLELCRWIGKDSVKSILFEKMRDTMKKELEAELVNVTGTAKPTRKIRWMLILMVLNFPIPMYGHYHFILSCRRSEQDKEPEQEAVSEVVGPGPSEESGNDAPQEIDEYELVDPVDILIPLEKSGFWDGVKATKWSERKEAVAELTKLASTKRISPGDFSEVCRTLKKLITDVNIAVAVEAVQAIGNLARGLRTHFSSSSRFLLPVLLEKLKEKKPALAEALTQTLQAMHKAGCISLIDIVEGSNKGVIMKVHKDYVPICMECLNDGTPEVRDAAFSALAGIAKSVGMRPLERSLEKLDDVRRKKLSEMISGSEDAVPGASSADTHPSLTISICDARG

SEQ ID NO: 198230 - protein, 303 aa, Glycine max
  Coding DNA Sequence Number=SeqID_81452
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=5e-34, Identity=29%"; Hit description= UPI00006A17C9 related cluster
  Pfam annotation: Domain name=PT; Domain location=246-281; Score=9.1; E_value=0.069; Accession=PF04886.3; Description=PT repeat
MLSHKGEPLGTSTLTFRGLHSLAFRGLHDLVFRGLLALAFRGLHVLTIRGLHALTFRGQHVLTFRGQHVLTFRGLYVHTFRGPHVLSFRGLLALTFRGLHVLAIRGLHALTFRGLHVLTFRGPHALAFRGPHVLTFRGLHVLTFRGLHNLTFRGLRVLSIRGLHIPVFRGLHVLTYRGLHVLTFIRLHALTFRGLHVLIFRGMHALASEDYTSSSSEDYTSSPSEDYTSSSSEDYTSSPSEDCMSSPSEDCTSSPSEDYTSLPSEDCTSSPSEGYTSSPSEGYMSSSSEDYTSSPSEGYTPSP

SEQ ID NO: 198231 - protein, 156 aa, Glycine max
  Coding DNA Sequence Number=SeqID_81453
  Gene Ontology: Mol. function=nucleic acid binding
  Homolog annotation: Hit_ID=Q1S4H8; Match level="QueryCoverage=77%, HitCoverage=36%, E-value=3e-17, Identity=37%"; Hit description=Zinc finger, CCHC-type; Zinc finger, SWIM-type
VVDYVNKYYSREIYGVCYGHKVVSINGMDIWPDDIQPLKYKKGLSRPKKLRRREPDEDPNRTRLTRDPVAYKGTRCRAIGHNSRRCPLPPPTVLEEENVELNGAQDANQGAGEGATQDANQGAGEDANQAAGVTHDVENDVRAADDDVGVENKPVR

SEQ ID NO: 198232 - protein, 244 aa, Glycine max
  Coding DNA Sequence Number=SeqID_81454
  Homolog annotation: Hit_ID=Q015I8; Match level="QueryCoverage=67%, HitCoverage=69%, E-value=1e-07, Identity=27%"; Hit description =Chromosome 07 contig 1, DNA sequence
  Subcellular localization annotation: CTP_CleavageSite=63; ConfidenceScore=5.65e-01
MSSATAIGFSANWWLRCHGRMTPPSCFPVSVSYSSSFNSNSSSSKFNYIHGASSEGLPNELVEDSKFVPLNEEDPIYGPPALLLLGFEADEALKYNVHPDLEQIQQLLKELDGEFLKVIYCTEDMITRSLWEAMHTTHPTLEEVKMLLMHLGTFSISQTILIFAEGIAKSLPRICFLSGLSGEEMMMFIDSFPETELKPAAFAALVPNSANKPLEELIEEIMGDHEMLEITSFMAADWGAVMKI

SEQ ID NO: 198233 - protein, 321 aa, Glycine max
  Coding DNA Sequence Number=SeqID_81455
  Gene Ontology: Mol. function=cysteine-type endopeptidase activity; Cellular component=lysosome; Biological process=proteolysis
  Homolog annotation: Hit_ID=Q43448; Match level="QueryCoverage=99%, HitCoverage=92%, E-value=1e-160, Identity=80%"; Hit description =Cysteine proteinase precursor
  Pfam annotation: Domain name=Inhibitor_I29; Domain location=54-110; Score=68.2; E_value=2.7e-17; Accession=PF08246.2; Description =Cathepsin propeptide inhibitor domain (
  Pfam annotation: Domain name=Peptidase_C1; Domain location=111-321; Score=345.8; E_value=7e-101; Accession=PF00112.13; Description =Papain family cysteine protease
  Pfam module annotation: Pfam domain module=Inhibitor_I29::Peptidase _C1; Domain location=54-110::111-321
MEAKRDHSITCLARVSLFLFALTLSSAHESTTVHDIARKLKVGDNELLRTEKKFKVFMENYGRSYSTREEYLRRLGIFSQNMLRAAEHQALDPTAVHGVTQFSDLTEVEGLPENFDWREKGAVTEVKIQGRCGSCWAFSTTGSIEGANFLATGKLVSLSEQQLLDCDNKCEITEKTSCDNGCNGGLMTNAYNYLLESGGLEEESSYPYTGERGECKFDPEKITVRITNFTNIPVDENQIAAYLVKNGPLAMGVNAIFMQTYIGGVSCPLICSKKRLNHGVLLVGYGAKGFSILRLGNKPYWIIKNSWGKKWGEDGYYKLCR

SEQ ID NO: 198234 - protein, 128 aa, Glycine max
  Coding DNA Sequence Number=SeqID_81456
MYIKYVSKDTSRSIANKTSYPNETKKTPHTYSQNDSKAPKFLKDMVISWVFSFKACSELQKQRKGKQGSKGLSKELIQGKHQQESSQGYCASNQWGKTHQMIMMMDGSNSHKGKLITFKLSFQNYHDM

SEQ ID NO: 198235 - protein, 85 aa, Glycine max
  Coding DNA Sequence Number=SeqID_81457
MTMSIIIIAMTISILVIVDDSGDGGDNDNNDFSGVGNYNNDHNDIVTMMVLVGVEVVTMLEVLTITMSEVMVVLRIVMMLVVVGR

SEQ ID NO: 198236 - protein, 45 aa, Glycine max
  Coding DNA Sequence Number=SeqID_81458
MGYWVNNWCRICFFSVPSQTNNVIFRGANGNWEAVLCGRMGFGKT

SEQ ID NO: 198237 - protein, 199 aa, Glycine max
  Coding DNA Sequence Number=SeqID_81459
MDVDKILPSSNTLGWHSPKVNVEVQMKKDLWWIPGHPETRKGVVSNEMLQGVENKGRFGDSRYWSTFQTAAESTGRQETTCLNRENEVVGELYKCCATRRSSRECCTLDGKSLVTKSITSLCFDPSSMGHVESHDELWSWVKCHSNLELAGSPRNALRDNQEVCLEATTIGAGRKSDTKSRQTLNTQCDLKITWVKIGQ

SEQ ID NO: 198238 - protein, 178 aa, Glycine max
  Coding DNA Sequence Number=SeqID_81460
  Gene Ontology: Mol. function=metal ion transporter activity; Cellular component=integral to membrane; Biological process=metal ion transport
  Homolog annotation: Hit_ID=P64423; Match level="QueryCoverage=70%, HitCoverage=38%, E-value=1e-57, Identity=85%"; Hit description=Zinc transport protein zntB
MTPQRDVYARLASERLNWMNDDQRRRMQDIADRLGRGLDEIDSCIARTAVMADEIAQVMQESLARRTYTMSLMAMVFLPSTFLTGLFGVNLGGIPGGAYHYGFTAFCVMLVVLIGGVAWWLHRTSTLKAMTVNSGGNDEHPQRSAIATITSVRSHPDRSGANARSHPASSADARPAAR

SEQ ID NO: 198239 - protein, 83 aa, Glycine max
  Coding DNA Sequence Number=SeqID_81461
MDSSGAFSRMIRRSAKMYSSSFFQILPHAQPKEWCAQWMGFIHNVEAKLSQVYFDDAKDSSQELRVKQVSRIKESFNQESRYK

SEQ ID NO: 198240 - protein, 111 aa, Glycine max
  Coding DNA Sequence Number=SeqID_81462
MYNYHEKGKAPNLESVLADFMTYQASSKGDCYSMQQQGTQFERDYSFADYQWESEWQPYYCGVPKLMTEVDPHHPLESQGHPQQAQGGSSSRSSSGSSSDDVTSDHLDWLH

SEQ ID NO: 198241 - protein, 192 aa, Glycine max
  Coding DNA Sequence Number=SeqID_81463
  Homolog annotation: Hit_ID=Q1SDS1; Match level="QueryCoverage=43%, HitCoverage=16%, E-value=1e-08, Identity=36%"; Hit description=IMP dehydrogenase/GMP reductase
MPTRRKETVSVFWVIPLHGKSSEGGQDLSARIGPTFLVFEVVLFPNLDGLVDLVVIDVFLAYHHSKESIANVPLMGMRGCINYNPILAIRQLGYPMRGAPIEESIALFIARSFSDPYEKMLQRVRKAWNAVQRKDKDLRGSSNGVIGRYHKWLKAWMQGIIWLPKLKISSGEEAGVPEESEEVQALKAELER

SEQ ID NO: 198242 - protein, 139 aa, Glycine max
  Coding DNA Sequence Number=SeqID_81464
MGDPISRLSFPGRRIVFHSKSICWNICLFAKACLHFSGENTETFSSLTSYPELRRSEFLIGGYVGARASLLSTTPPFVVMTQELVARGDTLRLSAPFCHPEAAGPMTSRDQVWSFCTHDTRRYLMVIRTPFVIQRRRAR

SEQ ID NO: 198243 - protein, 141 aa, Glycine max
  Coding DNA Sequence Number=SeqID_81465
MQSSQRDVYLGAYLNGFHCSGHWQMVVILPKEHLVVWFCSLHNRPDNYLKGIINSAIKGLDDAPHPKSKASARWIVVMCNRQKGSTECGYYVMHWMSTIILGTFRNNWEAYFNEPRPLEPKKLKALRIQWAQFYLQVRVQA

SEQ ID NO: 198244 - protein, 180 aa, Glycine max
  Coding DNA Sequence Number=SeqID_81466
MVPTRHPLDTDKSNRALGFPVLITGLCQSYRVPVTPSKVIRLPITRAFIEKYCTPRQAHARPLGVERYLQHLVRQQAANHRGQGQGFAPFVCPTSKQFGAEVAWPGDWPDAQVGEEPAGSPGEADESHMDEDMIDLLGFLGQGWTFSPWVKVYGELGFWLKAHCRNLPFGGRATRDSRDA

SEQ ID NO: 198245 - protein, 195 aa, Glycine max
  Coding DNA Sequence Number=SeqID_81467
MKANKTRNELKVSDSKTYRLKNEERMKNGEEQRKTFTDLLTETSWKHYGSTSAWIFFTETIFSPKRAEMLSQGGKMGGGCRPARPSELGCFLHKQPRFQNVLEGPRFENLKISICTPILISSTPFFVIYGKVTKALRKYFGFDFHLFSSSLSPILSEICLTKVFKNFTEALQKPRKPRKPFFNNVEELAAQLLPP

SEQ ID NO: 198246 - protein, 68 aa, Glycine max
  Coding DNA Sequence Number=SeqID_81468
MCHRQCTNLCVDELRDFGGGGSASVARCRPSPGYCGVSPCACLGVQYFLMKARLVGGLMTLLGATSTP

SEQ ID NO: 198247 - protein, 53 aa, Glycine max
  Coding DNA Sequence Number=SeqID_81469
MNLSPMKDKSEDFESHEIIKQRTLSPMKQANGHWYQRAQPYEKARDACNIHLK

SEQ ID NO: 198248 - protein, 360 aa, Glycine max
  Coding DNA Sequence Number=SeqID_81470
  Gene Ontology: Mol. function=methyltransferase activity; Cellular component=mitochondrion; Biological process=menaquinone biosynthetic process
  Homolog annotation: Hit_ID=Q7WF12; Match level="QueryCoverage=71%, HitCoverage=99%, E-value=1e-128, Identity=87%"; Hit description =Ubiquinone/menaquinone biosynthesis methyltransferase ubiE
NNGQAAAPQVPPGQRQAESDPAQSGQAHALVQGRDAGRQVEVLHPLQAGGAQHVRQGFLVGMHADGFGQVAVAGLVLGHRLAQPGQHVEGIPVVGRRQRLGDAGELQHQQLAARLEHAGHLGQGAILVGHVAQPESHADAVEIARRERQALGVTDGGGHQLAGVGQAVAADAQHGIVDIGQPDLAGGARALGESLGQVAGAARDVQHLHAGADGGAADGEGLPDAVQAGRHEIVHDVVALRHRVEDFGDLAGFFAFRHRLEAEMRRLGRGIRGMLRFGGVLHGEFPIYRPMHHPRRRRRTRNPGTDRRQPVLRRPQGAARLRRRPGPDPDPRRTARPDPAGLDAARHLRPGHGAQAAQPR

SEQ ID NO: 198249 - protein, 75 aa, Glycine max
  Coding DNA Sequence Number=SeqID_81471
MVEDDPFLFFDGSAILMKFQWISIGGSERGVKKRKIGLYGTRFGEDLSKIRSLEDLGCCNRLQAACLCVIDYTGW

SEQ ID NO: 198250 - protein, 136 aa, Glycine max
  Coding DNA Sequence Number=SeqID_81472
MARNVFAPCPYLKGPIWEGTKKAFSDNSQGGHISLDAVGTTSNNKFSKRKALDEGSDANSIGACRPRIFFINGFLCFLEDEWQRNGERERERRRHFKEKMSLEEAHHHRRPWIRAWRKKEMNEGRGREEHEILCSK

SEQ ID NO: 198251 - protein, 150 aa, Glycine max
  Coding DNA Sequence Number=SeqID_81473
  Subcellular localization annotation: CTP_CleavageSite=45; ConfidenceScore=5.29e-01
IFNIQNYQHAKRSNSAKARINRKRIMQQKRHPHAQSSSQPTMNCTSEYDSSGSNFLSAYEDCQSPTNHLVINTEGYSDLGDQLMQCRYCNAQMWYDERISKDKNCQSPRFSLCCGDGKVELPLLQNPPQYLQRLLFDDNTIDSKNYQHNL

SEQ ID NO: 198252 - protein, 124 aa, Glycine max
  Coding DNA Sequence Number=SeqID_81474
MIIRGQDIYSSQDEATTSPSSSESEEAKGEESSKEIYPQEEGQPLMVKEECKETLVSIATPLRLEFIPQVKELLDEGVPMNPKRIKVIPEWPTPPTSLIELVRNHVPPWEDAHEMGAEEKSPEF

SEQ ID NO: 198253 - protein, 263 aa, Glycine max
  Coding DNA Sequence Number=SeqID_81475
  Gene Ontology: Mol. function=tetracycline:hydrogen antiporter activity; Cellular component=integral to membrane; Biological process=tetracycline transport
  Homolog annotation: Hit_ID=Q2NX31; Match level="QueryCoverage=97%, HitCoverage=95%, E-value=1e-112, Identity=59%"; Hit description =Putative transport protein
MRSPSRPRRGAEISAAMPGTAAIMPLTKAILLTSPDSSRMNNGEDQRRIGQRTEHRLAAQLIRFFHRDAPLFNQEQRHQEADEHQPGGDEKHYPQPQMVGHQPAQQRPGDHAGDLPGRKRAQRPAAFIARHLRGDQRHGVGNIAGRQPHQGAQCEQLPDVGGQPLQRDDDRHAQRGAQQHQFAAFAVGQAAPQRRHHRRDQKGAAEHQPGPQAEGLVIADAELFDVQRQKREDLAHRQPGVETPEPDRDQIDFPRFHRLTVPR

SEQ ID NO: 198254 - protein, 177 aa, Glycine max
  Coding DNA Sequence Number=SeqID_81476
  Gene Ontology: Mol. function=unspecific monooxygenase activity
  Homolog annotation: Hit_ID=O04892; Match level="QueryCoverage=52%, HitCoverage=17%, E-value=4e-28, Identity=79%"; Hit description =Cytochrome P450 like_TBP
  Subcellular localization annotation: CTP_CleavageSite=29; ConfidenceScore=5.44e-01
MRRKRATIPPSGKTSPMSRGARSLQTQARARAERSSVQICLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 198255 - protein, 209 aa, Glycine max
  Coding DNA Sequence Number=SeqID_81477
  Homolog annotation: Hit_ID=Q1SKD7; Match level="QueryCoverage=98%, HitCoverage=53%, E-value=1e-10, Identity=25%"; Hit description =Ankyrin
MASKKRKAPATPSQVRYDRSRFSSLEAWERYTYIVVPRKILPERNMVIYHTEFDDFKEELERRNWHEELTSFEESNIDVAIMKEFYANLYDPKDKSPKQVTVRGHLVKFDEDALNTFLKTPMIIEEGETLSAYSKFALLRPNPQELAAKLCIPGRGFELNVDGLPLKILRKNLTTIAQTWSVLSFSNLVPTSHTSDITLDRAKLIYGII

SEQ ID NO: 198256 - protein, 340 aa, Glycine max
  Coding DNA Sequence Number=SeqID_81478
  Gene Ontology: Mol. function=oxidoreductase activity; Biological process=electron transport
  Homolog annotation: Hit_ID=Q7W3Q1; Match level="QueryCoverage=100%, HitCoverage=27%, E-value=1e-143, Identity=73%"; Hit description =Putative pyruvate ferredoxin/flavodoxin oxidoreductase
  Pfam annotation: Domain name=TPP_enzyme_C; Domain location=143-271; Score=-25.2; E_value=0.0005; Accession=PF02775.11; Description =Thiamine pyrophosphate enzyme, C-term
MARFSDGLDEILVVEEKRQVLEYQLKEELFSWIGSGKKIPRVVGKFDDKDGGEWAVPQGNWLLPAHYEFSPAMVAKAIAARLLRFELPADVRAGIEARLAFIADREQERTRPRVVEDRKPWFCSGCPHNTSTRVPEGSRGMAGIGCHYMVTWMGRSTDTFTHMGGEGVTWAGQAPFTDTPHVFQNLGDGTYFHSGSLAIRQAVAAGVNITYKILYNDAVAMTGGQPVDGPLSVPDIAKQMRAEGIHTIVVLSDNIGKWTGQREHFPSDVEFHDRSELDEVQKRLREVKGVSILIYEQTCATEKRRRRKRGKLEDPQKRVLINSLVCEGCGDCGKKSFCVS

SEQ ID NO: 198257 - protein, 73 aa, Glycine max
  Coding DNA Sequence Number=SeqID_81479
MEIVFGTYPLSSCLSQTGLCFRDCNHIVEFAFVEFVSALPSKLLQNKLWSNNKGVRQFLVGFQEGRQEAVKFT

SEQ ID NO: 198258 - protein, 127 aa, Glycine max
  Coding DNA Sequence Number=SeqID_81480
MRFKPNLSSFVREKNETQSNNSKKTQSLYTYFKTLEAPSVNPYFSRTSPLPLELPKHSGFTQFKLDDYWEYTPYHSTTMKFSPTQLWLAFVRLLSWNCGSATTNSVPHPQETTSQQSIPQVPPRVVI

SEQ ID NO: 198259 - protein, 89 aa, Glycine max
  Coding DNA Sequence Number=SeqID_81481
MHHSHTTMLIFLFTLVALLMAFFHEIRTVIIVIKRKECTLQHLYRMHARARVRSEIEEVQEQMKADMEAMKEKMATMIEAMMSMKKMIE

SEQ ID NO: 198260 - protein, 255 aa, Glycine max
  Coding DNA Sequence Number=SeqID_81482
MVEGILASIKALFVEEHKKKLAEDARLSALAKKGKAIEEATMMDIDGESIPEEVVLKFVNNHSKNEAMNVVLFEEMDADIIRLLESICGTPMPEGFQGNNPFNYPYWDTLLEEEEDALGVYGEKELVLKDQGVFYRVDFDVDASVDLDAFVVEVYDPSPFREYVRLIEAELLRMRKASAQALEDHAHVEMEVDKWHHNGDFFYKKVSGWEPPRTFTPPSSLVVLGPINLSSDFDSSDEELKTLEDLAAKQKREKK

SEQ ID NO: 198261 - protein, 164 aa, Glycine max
  Coding DNA Sequence Number=SeqID_81483
MRKVPNFKFELESQPHQNGQPLRLNILRHGKQTRTGRYHPTPAPTLMGNPRIDQARVGMGIRRVYPDPQRGRGWRKKSIPVEDEDKETVYLYPPHPVAMSKHPQSQPQPTPITFPKPQESAYEILATSQSEPASPSKEQEFDVEILETPTLKLAPSLALPPQTS

SEQ ID NO: 198262 - protein, 846 aa, Glycine max
  Coding DNA Sequence Number=SeqID_81484
  Gene Ontology: Mol. function=binding; Cellular component =intracellular; Biological process=metabolic process
  Homolog annotation: Hit_ID=Q2QNV4; Match level="QueryCoverage=93%, HitCoverage=66%, E-value=1e-128, Identity=29%"; Hit description =Pentatricopeptide, putative, expressed
  Pfam annotation: Domain name=PPR; Domain location=111-145; Score =19.1; E_value=0.016; Accession=PF01535.11; Description=PPR repeat
  Pfam annotation: Domain name=PPR; Domain location=146-180; Score=1.4; E_value=5.1; Accession=PF01535.11; Description=PPR repeat
  Pfam annotation: Domain name=PPR; Domain location=212-246; Score =27.0; E_value=6.6e-05; Accession=PF01535.11; Description=PPR repeat
  Pfam annotation: Domain name=PPR; Domain location=247-281; Score =10.9; E_value=0.38; Accession=PF01535.11; Description=PPR repeat
  Pfam annotation: Domain name=PPR; Domain location=313-347; Score =40.3; E_value=6.5e-09; Accession=PF01535.11; Description=PPR repeat
  Pfam annotation: Domain name=PPR; Domain location=414-448; Score =19.5; E_value=0.012; Accession=PF01535.11; Description=PPR repeat
  Pfam annotation: Domain name=PPR; Domain location=515-549; Score =40.0; E_value=7.9e-09; Accession=PF01535.11; Description=PPR repeat
  Pfam annotation: Domain name=PPR; Domain location=616-650; Score =49.0; E_value=1.6e-11; Accession=PF01535.11; Description=PPR repeat
  Pfam annotation: Domain name=PPR; Domain location=651-685; Score=8.9; E_value=0.67; Accession=PF01535.11; Description=PPR repeat
  Pfam annotation: Domain name=PPR; Domain location=687-720; Score=3.6; E_value=2.8; Accession=PF01535.11; Description=PPR repeat
  Pfam annotation: Domain name=PPR; Domain location=753-787; Score=3.4; E_value=3; Accession=PF01535.11; Description=PPR repeat
  Pfam module annotation: Pfam domain module=PPR::PPR::PPR::PPR::PPR::PP R::PPR::PPR::PPR::PPR::PPR; Domain location=111-145::146-180::212 -246::247-281::313-347::414-448::515-549::616-650::651-685::687 -720::753-787
MYNRTTNLCSIFRLAFSRSKLMHTAGTSICNNVMSKPETQDYLTTQLESLFRACSDASVVQQARQVHTQIIVGGMSDVCALSSRVLGLYVLCGRISDGGNLFFGLELCNALPWNWMIRGLYMLGWFDFALLFYFKMLGSNVSPDKYTFPYVIKACGGLNNVPLCMVVHNTARSLGFHVDLFVGSALIKLYADNGYICDARRVFDELPQRDTILWNVMLHGYVKSGDFNNAMGTFCGMRTSYSMVNSVTYTCILSICATRGKFCLGTQVHGLVIGSGFEFDPQVANTLVAMYSKCGNLFDARKLFNTMPQTDTVTWNGLIAGYVQNGFTDEAAPLFNAMISAGVKPDSVTFASFLPSILESGSLRHCKEVHSYIVRHRVPFDVYLKSALIDIYFKGGDVEMARKIFQQNTLVDVAVCTAMISGYVLHGLNIDAINTFRWLIQEGMVPNSLTMASVLPACAALAALKLGKELHCDILKKQLENIVNVGSAITDMYAKCGRLDLAYEFFRRMSETDSICWNSMISSFSQNGKPEMAVDLFRQMGMSGAKFDSVSLSSALSSAANLPALYYGKEMHGYVIRNAFSSDTFVASALIDMYSKCGKLALARCVFNLMAGKNEVSWNSIIAAYGNHGCARECLDLFHEMLRAGVHPDHVTFLVIISACGHAGLVGEGIHYFHCMTREYGIGARMEHYACMVDLYGRAGRLHEAFDAIKSMPFTPDAGVWGTLLGACRLHGNVELAKLASRHLLELDPKNSGYYVLLSNVHADAGEWGSVLKVRRLMKEKGVQKIPGYSWIDVNGGTHMFSAAEGNHPESVEIYLILNSLLLELRKQGYVPQPYLPLHPQITGNN

SEQ ID NO: 198263 - protein, 54 aa, Glycine max
  Coding DNA Sequence Number=SeqID_81485
  Gene Ontology: Mol. function=RNA-directed DNA polymerase activity
MQGDMLMVRRLLGSQMQPLDDTQRENIFHSRCTINGKLCSLIVDGGSCTNVASS

SEQ ID NO: 198264 - protein, 89 aa, Glycine max
  Coding DNA Sequence Number=SeqID_81486
  Gene Ontology: Mol. function=nucleic acid binding
MMRKEGQEIDTWTEMRRVMQKRLSQGSLTVEEYYNEMGMTLVRTNIEEEAEDTMARFLNGLNPNIRDIVELQKYVKLDDLLHKTVRVEQ

SEQ ID NO: 198265 - protein, 252 aa, Glycine max
  Coding DNA Sequence Number=SeqID_81487
  Gene Ontology: Mol. function=transferase activity
  Homolog annotation: Hit_ID=Q2C9U8; Match level="QueryCoverage=91%, HitCoverage=38%, E-value=2e-45, Identity=40%"; Hit description =Putative glycosyltransferase
  Pfam annotation: Domain name=Glycos_transf_2; Domain location=35-213; Score=-6.7; E_value=0.0057; Accession=PF00535.16; Description =Glycosyl transferase
MGLKGRALVEEKFSSELSSGAWYTQDTPKRDVKLGITITHFNRKAYVLPSIKRVKTELLEDPLYKGKIDFTVVDNSQNITQEESMGVNVIPNKNLGGSGGFMRGLMHYKDAGNYTHVLFMDDDASCEIDTICRAFNILSFAQEDSTAIAGALLREDISYLLIEQGAYFDRVCIPLFHNEDVRSKSTLTNIEHTTRHAGYGAWWFFAFPLEQLKHWSFPFFVRGDDVLFSMTNNFHIVTSNGIACYGEDFSTK

SEQ ID NO: 198266 - protein, 85 aa, Glycine max
  Coding DNA Sequence Number=SeqID_81488
MVSRFHIDKNVKEKCKSLIGKKNVWEYVLDAWRNLVDCPSEQQFDECLKKFEIVCSPWPMVEYAHWALKRVLQNSLGDYVVFEMP

SEQ ID NO: 198267 - protein, 69 aa, Glycine max
  Coding DNA Sequence Number=SeqID_81489
MEEKKEFPKEEFLGFKCVLECSETRYVFFPWLDPLFIVAGVDLDYVLALSLRYSLNAGACIHAKFVLLA

SEQ ID NO: 198268 - protein, 156 aa, Glycine max
  Coding DNA Sequence Number=SeqID_81490
  Gene Ontology: Mol. function=sequence-specific DNA binding; Cellular component=nucleus; Biological process=regulation of transcription, DNA-dependent
  Homolog annotation: Hit_ID=Q93WT0; Match level="QueryCoverage=99%, HitCoverage=32%, E-value=1e-16, Identity=36%"; Hit description =Probable WRKY transcription factor 31
  Subcellular localization annotation: CTP_CleavageSite=46; ConfidenceScore=5.27e-01
MASTTSAVTSMLLSGSMLSSDGLIHPNILESTAALSCSQNTAATLSASAPFPTITLDLTQSATNNSSQLLQGAPQDNQHSLLSPVLAQKFMSSATNIFDQGTETASFVDTVNAATAAITADPKFSAALMAAITSIIGGSHSNINGTSGDIQHGNNN

SEQ ID NO: 198269 - protein, 83 aa, Glycine max
  Coding DNA Sequence Number=SeqID_81491
MDSSKASELAMDFPQYRRSQLSSNTYHALIHLLSHISAYNASIQPLNIPVLLISGTNAIDVVAGFAVNAIATAPCCGGAWAFR

SEQ ID NO: 198270 - protein, 433 aa, Glycine max
  Coding DNA Sequence Number=SeqID_81492
MAAVEWIKKTRKKNVDSDFLDPKDPIGPKDILEVQETIEGVGDKDMDFTSNKMVLDDIVHMMGIEDMSTQANGFDKEQKLMIEFEQVMKGTENLICDSGLIPLNLGLDKTHNDGGEAEPMDYQVEMEEGEISGDLGIDGNSFDVASADALILEQMEVDEFQKPENVTGNMVYPSKIGNQEKEKGYDSKSSLVNALQDENNSGTVEVPTKEDIPTPSNMCRPELSPLLYGNANWSTPLNNNHGSSSVQKNHSSNSAGNHPSTSVEHKVTNTVQKQPRPPKRISFINLAKLSPSLSSLKQSTVTTKESPVQIGTVKSKVYLTKLKTSFKNVNRENGIKLPQLFNSGLPEQAKSSLNKDDYNKAKEMKSKLPEKTSVDVFMTDHSYSESVQEGKMSFDNSQSSKGQKALLSTLAFAAEHESDIKMKYPTGAERNFC

SEQ ID NO: 198271 - protein, 198 aa, Glycine max
  Coding DNA Sequence Number=SeqID_81493
  Gene Ontology: Mol. function=RNA-directed DNA polymerase activity; Biological process=RNA-dependent DNA replication
ELERAKAPPVHLPTSWHYTSYFQPLKLGGDDAHFFVLPRDDKFSAVYQPLYVLLYLRASFYIHRTYFTRCMIMVKQSCLAHLDMYWDQGSSNVLDVQDDTVFITILYHVNSRPMDIAVFNVMTWGPLAGSKSAYFIGIGSKGIVADGIAVEDIVVEGIVVEGIGVEGIVVEGIVVEGIGVEGIVGGNVAFVGDMMGLG

SEQ ID NO: 198272 - protein, 262 aa, Glycine max
  Coding DNA Sequence Number=SeqID_81494
  Homolog annotation: Hit_ID=Q8S7U7; Match level="QueryCoverage=48%, HitCoverage=13%, E-value=5e-11, Identity=26%"; Hit description =Putative pentatricopeptide repeat containing protein
  Pfam annotation: Domain name=PPR; Domain location=168-202; Score=0.8; E_value=6; Accession=PF01535.11; Description=PPR repeat
  Pfam annotation: Domain name=PPR; Domain location=222-256; Score =28.9; E_value=1.8e-05; Accession=PF01535.11; Description=PPR repeat
  Pfam module annotation: Pfam domain module=PPR::PPR; Domain location =168-202::222-256
  Subcellular localization annotation: CTP_CleavageSite=52; ConfidenceScore=5.24e-01
MKEGSTPAGSPVPPRHAPKGSIFVENFQMGCSQKGSFQLQAPFTVPRNHGPRCSCKWGCLKKPRTCSSRWKVKRTGLASRVAFDLVDLGVPLTGDEVRALEKIQEARNMVKKVLVLNSEVSSLVYDEIASGYCERRDFKDLVSFFVEVKCAPSVKAANRVVNSLLTYGMLIGWIGWSCREAKMRNALSCLSVMLSKSLVPHVYTYNALIRLMIARGALPDISTFRVLIAGYCKSRRFDEVKKLIHEMGNCGLVKHSLMENPI

SEQ ID NO: 198273 - protein, 98 aa, Glycine max
  Coding DNA Sequence Number=SeqID_81495
  Subcellular localization annotation: CTP_CleavageSite=15; ConfidenceScore=5.07e-01
ITAIQGVRHSLSHARCVRRKGSVTERNPSTHGGRGALPSEGGSPSDLLFLAGGGLVRANMLSIKRVPTVVSNYQKEETGEAAAAGGCGRNCLKSCCIQ

SEQ ID NO: 198274 - protein, 146 aa, Glycine max
  Coding DNA Sequence Number=SeqID_81496
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=99%, E-value=2e-09, Identity=29%"; Hit description =UPI00006A17C9 related cluster
  Subcellular localization annotation: CTP_CleavageSite=12; ConfidenceScore=5.38e-01
MLVCMIRTRLFAAARVKSCPGMHSSCVIASLSGCARTVGRPPISGGGPGTVRMWSTLKMRTRSPLKVRACNPLKARLYSPLEVRACSALKVRACSPLLARTCSPLKVKACSPLLARTCSPLKVRACSPTKVRTCGPLKVRACSPTK

SEQ ID NO: 198275 - protein, 137 aa, Glycine max
  Coding DNA Sequence Number=SeqID_81497
MDLVDCVVVKGQSVVGIVGKRSNLILMVVFCYRIVGSMPTLLYNSDVSVATLVAMMNLEVAKYGKVVGTNKGGGGGKKRKAKSKGRSLEGRVNSKGECGNGGLRINAPDDAASRDDAKNDSKCLFNSTNEKGVDGSK

SEQ ID NO: 198276 - protein, 88 aa, Glycine max
  Coding DNA Sequence Number=SeqID_81498
MKVEGIWNVNMKFHDGAIRTFSNARFVPSVVVNMISMGKITSQGYKYVDRQALKRNHDSKVKKKLKFSNVVEVLGDTSIGAGVCSLSN

SEQ ID NO: 198277 - protein, 152 aa, Glycine max
  Coding DNA Sequence Number=SeqID_81499
MCHTLCACTSLARKGPFVGSLRQCVELASWLHMWMVWRSRGQCTGGRTGPTVGVGTLVNVVEEAESEGISIAMKGEATVVVIGKRMPRQLPNRSKGVWYRTHVCEEREHNLRRAEEVPPGTTTLSPKVLGVRRCVGKNLSPTSTRGQDRVYK

SEQ ID NO: 198278 - protein, 116 aa, Glycine max
  Coding DNA Sequence Number=SeqID_81500
  Gene Ontology: Mol. function=RNA binding; Cellular component =cytoplasm; Biological process=sex differentiation
  Homolog annotation: Hit_ID=Q9LT41; Match level="QueryCoverage=58%, HitCoverage=22%, E-value=1e-31, Identity=100%"; Hit description=RCD1
  Pfam annotation: Domain name=Rcd1; Domain location=1-109; Score= -50.9; E_value=0.00087; Accession=PF04078.4; Description=Cell differentiation family, Rcd1-like
MNCCTCFFSSAAHIPLYLYPFLNTTSKSRPFEYLRLTSLGVIGALVKVDDTEVISFLLSTEIIPLCLRTMEMGSELSKTVEFSDSLFLVFGELMPSHCLETLLEESACEIIVKPSE

SEQ ID NO: 198279 - protein, 252 aa, Glycine max
  Coding DNA Sequence Number=SeqID_81501
  Gene Ontology: Mol. function=protein binding; Cellular component =intracellular; Biological process=amino acid metabolic process
  Homolog annotation: Hit_ID=Q01FY7; Match level="QueryCoverage=92%, HitCoverage=95%, E-value=2e-74, Identity=60%"; Hit description=[R] KOG3157 Proline synthetase co-transcribed protein
  Pfam annotation: Domain name=Ala_racemase_N; Domain location=10-248; Score=17.8; E_value=6.3e-08; Accession=PF01168.11; Description =Alanine racemase, N-terminal domain
MTSPLVAEGAAMTAFRSVMLRVHQAAERSGSKPERVRVVAVSKTKPVTLIQQLYDAGHRYFGENYVQEIIEKAPQLPQDVEWHFIGHLQSNKVKTLLGGVPNLAMVQSVDNQKVANHLDRMVSTLGRNPLKVLVQVNTSGEESKSGIDPSNCVELAKHVKLSCPNLVYSGLMTIGMPDYTSTPQNFQVFSFVKNQTLSNCRTEVCKALEMPEEECELSMGMSGDFELAIEMGSTNVRIGSTIFGPREYAKKQ

SEQ ID NO: 198280 - protein, 143 aa, Glycine max
  Coding DNA Sequence Number=SeqID_81502
  Homolog annotation: Hit_ID=Q9SZ28; Match level="QueryCoverage=99%, HitCoverage=88%, E-value=5e-34, Identity=47%"; Hit description=STIG1 like protein
  Pfam annotation: Domain name=Stig1; Domain location=7-143; Score =119.2; E_value=1.2e-32; Accession=PF04885.4; Description=Stigma -specific protein, Stig1
MALSIALTMKTITHQEEAKPAFVHHDFPSSSSTPHDQKNNNVHLPSKRVSRFLAQVKNPNAADHCHKDHEVCTLVGAKNSTCCNNKCIDVGYDYHNCGACKMKCKLTDACCRGECVNTNFDKRHCGECNHRCEVGAYCVYGMC

SEQ ID NO: 198281 - protein, 97 aa, Glycine max
  Coding DNA Sequence Number=SeqID_81503
MEATCNDISNVAVTQSSPTMSFNGKRLVVDEIDFFAEKKKKKKSEVDDQMVHHQMELPNTSLDLLITNSTSTSNRSNMEEELSEAKDNTRNKFVVAS

SEQ ID NO: 198282 - protein, 160 aa, Glycine max
  Coding DNA Sequence Number=SeqID_81504
  Homolog annotation: Hit_ID=Q2QYH0; Match level="QueryCoverage=80%, HitCoverage=20%, E-value=2e-23, Identity=43%"; Hit description =Expressed protein
MKIIISIPLEYVWMEKFNRGEVGEGVKFGIREGLDEEVVRGGGDAGDEGLWGAEEGVAAGEGAEVGDGGERGVEVEAIDVDELAELEAVGEDEVGVKVGEEDVGGVKGVGEVGAGESGDDADDLEERGAVVTGDAGVGVHGLQHFQENALGEGSRCYCSE

SEQ ID NO: 198283 - protein, 190 aa, Glycine max
  Coding DNA Sequence Number=SeqID_81505
MYDYHEEERAPDLESILADFMTYQASSKGYCYFMQQQGTQFERNQSSAGYQWESYRQSDYHNKAEGILNLDDLLMKFKDIVESIQDAFRRTETQISKLVDDMTNAAARKEEERVEIEIHQENIHQVTSIYHQLTNEEEKPEVSSTPEYPYWATVGYVGGKDKGRLELSVEDQKISFDIFEATKHSDMGDA

SEQ ID NO: 198284 - protein, 241 aa, Glycine max
  Coding DNA Sequence Number=SeqID_81506
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-22, Identity=31%"; Hit description= UPI00006A17C9 related cluster
MGLQVVTFRGLRAFTFRGIHVLTFIRLHVLTFRGLHVLAFRGLHPLTFIGLHVLTFRGLRALTFRGLHVVTLRGLPALTFRGLHVLTFSGLRALTIRRLHVLTLRRLHALTFKVLHVLTVRGLHALTFRGLHVLTFRVLRTLTFRGLHVLTFRGLHGLTFRGLHVLAFRRMHALTLRGLTTHPHLQRATSSNLQRTTHPHLQRVARPHLQRTARPHLKRATLPHLKKTTRPHLERATRSYL

SEQ ID NO: 198285 - protein, 100 aa, Glycine max
  Coding DNA Sequence Number=SeqID_81507
  Homolog annotation: Hit_ID=Q1S9D3; Match level="QueryCoverage=34%, HitCoverage=6%, E-value=3e-12, Identity=97%"; Hit description =Protein kinase
MVHQDDRLVSSTNLNLVTQSNTSSYLPNYGWCLRELSNENGRLEASQQVSKYTSIDNSTNKHDEEQYLCSARHYWLSSKQLCQNATSTPKINTNTINCSP

SEQ ID NO: 198286 - protein, 468 aa, Glycine max
  Coding DNA Sequence Number=SeqID_81508
  Homolog annotation: Hit_ID=Q9FLL8; Match level="QueryCoverage=84%, HitCoverage=60%, E-value=1e-38, Identity=33%"; Hit description =Arabidopsis thaliana genomic DNA, chromosome 5, P1 clone:MEE6
MVSIGNYEVNLLAREDIEHQLWRVNGFGGNGYSSTVFNVISDATEASESQVRKQLLSPLNGMLLADHFKGDPLDIGAGIYQSRSKAGDHNSNALHEYKKDHIGNNNKIHSMIWTTSCFQEFTNSSCNDNTINHIVSSHHQRAEPWSIKHFKSSPVRNASEETTKTRSQTAALSIPQKNVSSPTFPLSPLGKKSSKNENLGECRNIDVILDNDNFTFNSVEQSLDRTCQGISSAQEIPSTSQLNLNNMQQKSDLFTPDNMINMKEYWTHSGSFPPWDAKLRGTMSRLPIRRSLVGSFEESLLSGRLLSGKVSQKIEGFLAFLNVTGGNFSPQSQKIPFAVTSVDGDKYLLYYSSINLSGKLLSGKSRVAKFQRTLSMDESRSEKPHIRVPMKGRIQLVLTNPERTPIHTFFCNYDLSDMPAGTKVGLGYNPSFKEYNRQLEQLAVTILALYLGLNIKGLCLCDLCSNSC

SEQ ID NO: 198287 - protein, 216 aa, Glycine max
  Coding DNA Sequence Number=SeqID_81509
  Homolog annotation: Hit_ID=Q1SWX1; Match level="QueryCoverage=83%, HitCoverage=42%, E-value=9e-10, Identity=26%"; Hit description=IMP dehydrogenase/GMP reductase
MGSSQAPSLKKRFYQVKVKSLRITSLKELGQLMGQLQRQAFRKAYEAIASLALSYDQPLRCFTFGDFQLSPMVEEFEEILGCPLGGRKPYLFLGFYPSLAKISKIVQISAQELDHRKQVENGVVGVPRRCLEAKARILAAIDAFLAYHDPKESSVVAILADLYDTFDRRCEKSSARIVCCTLALYVWLVSHLFCQEVRHDCPLESHRSCTEKRGAN

SEQ ID NO: 198288 - protein, 265 aa, Glycine max
  Coding DNA Sequence Number=SeqID_81510
MCADYRIGHLRMLPNFSKVGVAELCIFACHLTSRVRINKSCLCTENHLGISACHLTSWSGLTEVVCETKKSRPEDADISRKGVDEHIGADNRKASPHAIGFSGHWIAKVCGQITIGCLCMPPNSWVTSQPEDADISGEGADDDSRPEDADISGKGAGDNSRLEDADISGKGAGDDIANETFSQSRLKDADISENGAGDDVMTLVTVCYRTLSLTDSERVCAGFHIGRLRVPKDSQVTIAKGGAIEKSEAFAPTYPQFVMRNSDLR

SEQ ID NO: 198289 - protein, 78 aa, Glycine max
  Coding DNA Sequence Number=SeqID_81511
MVTSMLQLDSMNLFIKARAWFNPITQGMAILIANTSSTIHRDERLGNMHAMHGKLKWVYDPNMGKTQGSRMSKHVEQK

SEQ ID NO: 198290 - protein, 120 aa, Glycine max
  Coding DNA Sequence Number=SeqID_81512
  Subcellular localization annotation: CTP_CleavageSite=41; ConfidenceScore=5.48e-01
IMATDPTSPPQSDGQSEATSKRSRTTTRLRTLTLRTVDQPRPAVYVDPATGRASGPMREKFHSYLGVVAREKVPIIHNNWKDVPETLKEIVWNDILLITILDFYICKEQHKGSFYFKHEY

SEQ ID NO: 198291 - protein, 43 aa, Glycine max
  Coding DNA Sequence Number=SeqID_81513
VRSSISFRTPGNNSALDPLCSPMNRDEGYETTAGDSCQTTLKN

SEQ ID NO: 198292 - protein, 144 aa, Glycine max
  Coding DNA Sequence Number=SeqID_81514
MAMERVSEFPHTYMDRRPRKRVPKVVDLMKFVYIGYVCFSFHGSLNHGDGMHLRISSQEGSSRKVTLILPIECSFPIEKTHLFFLQFSSAWWLCNVMMKKHPAGKFLLLHGFATSLARKYPDIDSYSCTSAKGRTLPFHHSPAT

SEQ ID NO: 198293 - protein, 59 aa, Glycine max
  Coding DNA Sequence Number=SeqID_81515
  Homolog annotation: Hit_ID=P45512; Match level="QueryCoverage=98%, HitCoverage=9%, E-value=5e-15, Identity=74%"; Hit description =Glycerol metabolism operon regulatory protein
MSYSFILRHSVVRPIFSNCDISCTRPLVTRAAWIIASFSMALKERLDGSSDEAVSLPGR

SEQ ID NO: 198294 - protein, 56 aa, Glycine max
  Coding DNA Sequence Number=SeqID_81516
MASVETSTRAKSQILPVKNGTLRVRSVPLFKGPIWEGANKAFSDNSQGGHISLDGL

SEQ ID NO: 198295 - protein, 244 aa, Glycine max
  Coding DNA Sequence Number=SeqID_81517
  Gene Ontology: Mol. function=transcription factor activity; Cellular component=cytoplasm; Biological process=regulation of transcription, DNA-dependent
  Homolog annotation: Hit_ID=Q6D945; Match level="QueryCoverage=30%, HitCoverage=14%, E-value=1e-34, Identity=95%"; Hit description=Lysyl tRNA synthetase
  Pfam annotation: Domain name=HTH_6; Domain location=124-229; Score =22.6; E_value=1e-05; Accession=PF01418.8; Description=Helix-turn -helix domain, rpiR family
LNDAEDQAERFLQQVNAKDAGDDEAMFYDEDYVTALEHGLPPTAGLGIGIDRLVMLFTNSHTIRDVILFPALRPTGDLPVPRWERAAVVFSLSPWQKAALVFSLSPWERAGVRAPEITMSAKAATLEGRIRQHWDQLSSHEQRLADVLLAAPGQLAMNTATELAHSAGVSKATTTRFFRHLGYESYEAARRQAREMQSSGSPLYLQPVPSASPLASIMQQHLEKEIANLVNSYRTLDSEQLQQA

SEQ ID NO: 198296 - protein, 287 aa, Glycine max
  Coding DNA Sequence Number=SeqID_81518
  Homolog annotation: Hit_ID=Q7WIW7; Match level="QueryCoverage=85%, HitCoverage=53%, E-value=1e-17, Identity=27%"; Hit description =Putative exported protein
MDITRELEAPAQIVPGQPVRVAITWWTDSWFNPPPQWPEFAVKNGELLNTALPSQLVTRKKNGIVWSGIRLERQVSAWQQGVLRLPAIDITATSADQAPVTVHLPALEHPVNWPANTTQADHFLPASQLTLSQQIQQYHAGKDATLRVGDVVDRIVTVEAQDALPGQIPPLLYAISGSESQRLAPVSEALKSERGDVIGAHRVERLRYLPSHSGTLTLPPISLRWWDTVNHQWQTAKLAGETLNVAAARQGGAEQALRGTTGMVTWQSLMWIVIAAAAAGGGWFGRR

SEQ ID NO: 198297 - protein, 218 aa, Glycine max
  Coding DNA Sequence Number=SeqID_81519
  Gene Ontology: Mol. function=binding; Cellular component=integral to membrane
  Homolog annotation: Hit_ID=Q1LEN0; Match level="QueryCoverage=78%, HitCoverage=31%, E-value=1e-12, Identity=27%"; Hit description =Tetratricopeptide TPR_2 precursor
  Pfam annotation: Domain name=TPR_1; Domain location=93-126; Score =29.9; E_value=9.2e-06; Accession=PF00515.18; Description =Tetratricopeptide repeat
  Pfam annotation: Domain name=TPR_2; Domain location=93-126; Score =35.5; E_value=1.8e-07; Accession=PF07719.7; Description =Tetratricopeptide repeat
  Pfam annotation: Domain name=TPR_4; Domain location=41-65; Score=8.8; E_value=3.4; Accession=PF07721.5; Description=Tetratricopeptide repeat
  Pfam annotation: Domain name=TPR_4; Domain location=67-88; Score=3.9; E_value=13; Accession=PF07721.5; Description=Tetratricopeptide repeat
  Pfam annotation: Domain name=TPR_4; Domain location=93-118; Score =8.0; E_value=4.2; Accession=PF07721.5; Description=Tetratricopeptide repeat
  Pfam module annotation: Pfam domain module=TPR_1::TPR_2::TPR_4::TPR _4::TPR_4; Domain location=93-126::93-126::41-65::67-88::93-118
MIAPMLFLLLFWRRQLLMVALLFPALLWSPHSDAAWLDAWVRPDIQGQHAFRRGDYAAAAGHYRDPLWQGIAWYRAGDYPAAASAFRAAPPTAETLLWLGNSYAQQKQWQQALDSYDRALYLHPDWSMALQNRDKISQIVMGIRQQERERQQAQGDAMDDGPDKVVHDLQKNQGINQQQIGAIAGESPQVNQWFDALEVSPTGLLKSLYRNGSGDTTP

SEQ ID NO: 198298 - protein, 121 aa, Glycine max
  Coding DNA Sequence Number=SeqID_81520
VSIYYWPESDIHVKDYGRLDFPCAFTILAYYAPKSDIRVKSYDNSKYYMPESCRSNDFQDYFDDAKESRVKQVPKKQESKCFKNQVSRFKIQEQSSFKNQDSRTIKIKIHDSRFKNQEMTQ

SEQ ID NO: 198299 - protein, 294 aa, Glycine max
  Coding DNA Sequence Number=SeqID_81521
  Gene Ontology: Mol. function=transporter activity; Cellular component= membrane; Biological process=transport
  Homolog annotation: Hit_ID=Q2KVU1; Match level="QueryCoverage=99%, HitCoverage=56%, E-value=1e-158, Identity=91%"; Hit description=ABC transporter, substrate-binding protein precursor
  Pfam annotation: Domain name=SBP_bac_5; Domain location=4-213; Score=- 25.3; E_value=0.00091; Accession=PF00496.12; Description=Bacterial extracellular solute-binding proteins, family 5
NATRTAALLSGEIDFVLDPAAQDLDRLRQSAKVVEGNEYRTIYLGLDQKRPELQYSNIKGKNPFQDIRVREALYRAIDVDAIKRAVMRGLSAPTGTMIAPQVHGWTESLHKRVPYDPEKARALLKEAGYDGTLNFTLDCPNNRYINDEAICQAVVGMWAKVGVKATMNAMPRSTYFPKVQNSDTSAYLFGWGVPTFDAMYTLQNLIRTKGEGADGMYNLGNYSNKELDAIIDRIKTETDAAKRDADIHKVLEVHAKEFGHIPLHDQVIPWAMRKNVSVIHRADNRLVADWVKVD

SEQ ID NO: 198300 - protein, 46 aa, Glycine max
  Coding DNA Sequence Number=SeqID_81522
IRPRAQTSSVALSGWLAKPEDWLSERVKISTSQTCPINLKLRGNDY

SEQ ID NO: 198301 - protein, 49 aa, Glycine max
  Coding DNA Sequence Number=SeqID_81523
MELLLEFWVPLLKNAPPHYVVVDPGYVHGNDAWRRQGSVLNGLMRQVGL

SEQ ID NO: 198302 - protein, 55 aa, Glycine max
  Coding DNA Sequence Number=SeqID_81524
MLIDYVKFLQLQVKVLSMSRLGGAAAVAPLVAEEKNAHPNSLLPFCVSKAKCETR

SEQ ID NO: 198303 - protein, 139 aa, Glycine max
  Coding DNA Sequence Number=SeqID_81525
MTISTSLGHLQRIKRREEQQHHVQELAQSTKAKAAETLTYQKLGKTEAPTTEEGRTPAANSDTQTAQAKTAAETVMVLTTEPSLATVVVLVEVKPEVVEVEMGDSTGVWTVGNDGRGDNDVGGMEKTEKLLKVMTAKEA

SEQ ID NO: 198304 - protein, 84 aa, Glycine max
  Coding DNA Sequence Number=SeqID_81526
MEESFGKVVWGALSVLCVMFVKDERCGSSYDVLMSSCSLVYYRQVPLIEEHAQTCKGQSQWGMLLRNQPSKAMYDCKLVLEDCK

SEQ ID NO: 198305 - protein, 51 aa, Glycine max
  Coding DNA Sequence Number=SeqID_81527
MADGMESSGMGTGDGSGIWLLGCGSPTPSRRRRLGSWLGHLRVKLIHAHDG

SEQ ID NO: 198306 - protein, 131 aa, Glycine max
  Coding DNA Sequence Number=SeqID_81528
MDTRITQLEEDLYHLVLVATNFGFLMLPKGERNGVELNCHHKKGGDCRSKDFAFDVLMMPYDHDVLMPYENALFKFNSRQKSKNNGYNNKKISSVLGREFQIETAKGLAKKFKQKCLFQEIYSLVIDYQRM

SEQ ID NO: 198307 - protein, 254 aa, Glycine max
  Coding DNA Sequence Number=SeqID_81529
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=9e-37, Identity=30%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=21; ConfidenceScore=5.18e-01
TTRPRLQRATRPRHQRAERPRLHRAACPRLQRTTRPHLQRATSPQFQRTMRPHLQRTTRPRLQRATHPHLQRITRPRLQRTTHPPLQRIQVLKFRGLHTLAFKRLQVLAFRGLHVLTFRGLHALAFRGLHVLPFKGLHVLAIRGLHVLAFRGLHVLTFRGLHGLTFRGLHILAFRELHILTFRGLHVLPLRGLHDLPFRGLHVLPFTGLHALAFRGLHALAIRGQHLLAFRELRVLTFRGLHVLPFRGLHALAI

SEQ ID NO: 198308 - protein, 118 aa, Glycine max
  Coding DNA Sequence Number=SeqID_81530
  Homolog annotation: Hit_ID=Q1RWC6; Match level="QueryCoverage=42%, HitCoverage=3%, E-value=1e-13, Identity=75%"; Hit description=ATP -dependent helicase HrpA
MENYEKQMKVLAERLTEMIFNLMDIVGKKEKNKSNIVDVLGHAGSLASLKAAFEKLSGEKRAKENCSTPGALPHNVQVDLEELDLDTVTVSILLQPLVMNFTSTLLLKLTKSMVLSFS

SEQ ID NO: 198309 - protein, 238 aa, Glycine max
  Coding DNA Sequence Number=SeqID_81531
  Gene Ontology: Mol. function=transcription factor binding; Cellular component=intracellular; Biological process=regulation of transcription, DNA-dependent
  Homolog annotation: Hit_ID=Q1RTV3; Match level="QueryCoverage=57%, HitCoverage=37%, E-value=3e-14, Identity=58%"; Hit description=Ras GTPase; Sigma-54 factor, interaction region
  Pfam annotation: Domain name=Ras; Domain location=57-231; Score= -69.1; E_value=0.00042; Accession=PF00071.12; Description=Ras family
MVLMMGVVYWQPPKEALEKVKELVSETLISRYGNDEGALFIPNHECFCAFNCFPFCFVPFFQRVSLKSRPTSVVYELAIVDLEHTGLAPVGIILIGCLTSKISKGDMNDPEVFPFVLLGNKVDIDSGNSRRVNEKKARDRCASRGNIPPSFAMIIIFSYIVNEKKARDRCASRGNIPPSFAMIIIFSYIVTEKKARDRCASRGNIPYFETSAKEGYNIEEAFSCVAKIALEYEHDQDM

SEQ ID NO: 198310 - protein, 79 aa, Glycine max
  Coding DNA Sequence Number=SeqID_81532
MVGDEDLDEKKDLKNCFERRKAKHQMNINLSFQRHLMLQLSDIVLSKWLKRSMILLINSNFMASQVVIVISGVLFLVEI

SEQ ID NO: 198311 - protein, 39 aa, Glycine max
  Coding DNA Sequence Number=SeqID_81533
  Homolog annotation: Hit_ID=Q2PMP0; Match level="QueryCoverage=94%, HitCoverage=2%, E-value=6e-11, Identity=83%"; Hit description =Putative membrane protein ycf1
MSRKYLDWMGIHREILNRPISNPEFRYFSKFVISYDAYR

SEQ ID NO: 198312 - protein, 104 aa, Glycine max
  Coding DNA Sequence Number=SeqID_81534
MANKNISSNETYPLTVIPKTIPKLQNSLRVGKGNIGSKGLSKELIQGRLIWLEAYKNKMPKSSPNMHVKQEVSTRVKPRLLCKQSMGQNTPNKIDDDGSNSRQG

SEQ ID NO: 198313 - protein, 256 aa, Glycine max
  Coding DNA Sequence Number=SeqID_81535
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=5e-32, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RGLHALAFRGLHVLSFRGLHALTLRGLHVLSFRGLHVLAIIGLHIFAFRGLHVLAFSGLHILPVRELHVLAFIGLHALTFKGIHDLAFRGIHVRALRGLNVLTLGELHVVDFRGLHAFAFRGLHVLAIRGLHVLGFRGLHTLAFRGLHILTIRGLHRTTHVLTFRGLHVLAFRGLHVLAIKGLHVLPFRGVHILTFRGLHVLAFTGLHALSFRGLHVLAIRRLHVLPVHRTTRPRLQRVYALSFRGLHVLAIRGLH

SEQ ID NO: 198314 - protein, 110 aa, Glycine max
  Coding DNA Sequence Number=SeqID_81536
RPPITRAFIEKYCSPRQAQGDASQATDAPPPPHQANPAGSLGMGQYLQHLVRQQEANHWGQFRAEVAWPGDWLEAQAGEAPAGAPGDVEEARMDEEMMNLLDFLGGSGAT

SEQ ID NO: 198315 - protein, 254 aa, Glycine max
  Coding DNA Sequence Number=SeqID_81537
  Homolog annotation: Hit_ID=Q47522; Match level="QueryCoverage=14%, HitCoverage=45%, E-value=6e-14, Identity=97%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGIRSCANVVTTYASMYLCQQLLSIFPANTLQFHSVEYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 198316 - protein, 240 aa, Glycine max
  Coding DNA Sequence Number=SeqID_81538
  Homolog annotation: Hit_ID=Q9LY50; Match level="QueryCoverage=46%, HitCoverage=15%, E-value=4e-11, Identity=38%"; Hit description =Receptor kinase-like protein
  Subcellular localization annotation: CTP_CleavageSite=12; ConfidenceScore=5.03e-01
MVNSGASPVHSFASAVDNAMGSIDGDLGAFHVHGFASAVNNAMISTSGSLGALPVYDFASAVNNAMSSTSGSLGALPVYGFASAVNNAMISTSGSLGALPEHGFASAVNDAMSSTSGSLGALPVHGFSSAVDNAIRSRSRADLGRSSSPVHGFAMEDVCGSFRLAELVAATNNFSRDNMISHGRIGFVYKGKLFDGREVAIKRAGTSTSNIKEFQSITLGPLFLTNCLHHKHLVRLLWVV

SEQ ID NO: 198317 - protein, 72 aa, Glycine max
  Coding DNA Sequence Number=SeqID_81539
MTRLVSGGHLRVGPLRFLEARLKSQVYESEKDHVEGRGLDSRVGKSCILDSHCELGLVERESLDTFFSFFLS

SEQ ID NO: 198318 - protein, 152 aa, Glycine max
  Coding DNA Sequence Number=SeqID_81540
MSVHVAQLIADAIYLFAGMPPTRHPLEPDKSNRALGFPALITGLCQSFGVPVTPSRVIRPPITRAFIEKYCTPRQAQGDALQAADAPPPPHQADPAGSFGMEWYLQHLVRQQAANHRGQAGEVPAEAPGNAKEARMDEKMTDLLGFLGGSGA

SEQ ID NO: 198319 - protein, 45 aa, Glycine max
  Coding DNA Sequence Number=SeqID_81541
MESGGRRRYLVVIRTFRQPRRTNPTVFTLVVWRHSSSMTHEILLC

SEQ ID NO: 198320 - protein, 143 aa, Glycine max
  Coding DNA Sequence Number=SeqID_81542
VVPGDMSRGSGDLGDVRRAPGSEPIKEQRPQSKEACVVAGQLWILSDIWNMASGNRLPRDVDVASGSLGDPRRQYEVPIPWHDPTHCYFIGTSRGTRTHASANCGVDTTYTYSISTSGASPSDREPAVDALDFPEGDEDPLPD

SEQ ID NO: 198321 - protein, 109 aa, Glycine max
  Coding DNA Sequence Number=SeqID_81543
MPRQAGCFSLKSYNGPRWAQRLKNVPKWTILPFFEFLAHFLPKHRETLRIAQQLEMLLEGRKDNGAIPGSRAANMYGFDVLAEGIWIESRPLKQFPLRIVEDLIDRSAK

SEQ ID NO: 198322 - protein, 130 aa, Glycine max
  Coding DNA Sequence Number=SeqID_81544
  Gene Ontology: Mol. function=prephenate dehydratase activity; Cellular component=cytoplasm; Biological process=L-phenylalanine biosynthetic process
  Homolog annotation: Hit_ID=Q1RXT6; Match level="QueryCoverage=93%, HitCoverage=35%, E-value=1e-37, Identity=57%"; Hit description =Prephenate dehydratase with ACT region
  Pfam annotation: Domain name=PDT; Domain location=16-129; Score=16.2; E_value=5.2e-11; Accession=PF00800.9; Description=Prephenate dehydratase
MANEFSSSNGRAKLRVAYKGLPGAYTEDVVLKEYPQCETVPCEDFKTSFKAVESWLVDKAVLPIENSTGESIHHNYDLLLGHKLLRGVRKKDLKVVMSHPQALVQCKKMLIDLGIAKISVDDNVAAAKIY

SEQ ID NO: 198323 - protein, 119 aa, Glycine max
  Coding DNA Sequence Number=SeqID_81545
MDLFLLKRGLKSDLDWCGCQFLLKKLKLPLVLDSYTAPSLDWLHESMIYTKRNLYLSVLCTEHMENVNVSLLIMVCGVGKSSKPKASYQSCTDARMHLEAGKAPTDSANDDRPVKKYSL

SEQ ID NO: 198324 - protein, 62 aa, Glycine max
  Coding DNA Sequence Number=SeqID_81546
MENWRTALGNDIRGAPDSKRLAMSFMGLQIKVENGELAYRARQSHSRGSRLEGGGHMNSARQ

SEQ ID NO: 198325 - protein, 95 aa, Glycine max
  Coding DNA Sequence Number=SeqID_81547
  Subcellular localization annotation: CTP_CleavageSite=36; ConfidenceScore=5.36e-01
MGSSQKPSFKKRFYQVKIKSFRGHQFTKVGAINGVNFNSKPSAKPMVVLFPNMEGLVDLAVIDAFLAFHHGKESPVVAILTMYDTFDRGCEKSDT

SEQ ID NO: 198326 - protein, 176 aa, Glycine max
  Coding DNA Sequence Number=SeqID_81548
MASMMEAMLGMRQLMEKNVATAAAVSSTTEVDPTLLATAHHPPSNTVGRERSTLGHNSNPHLGYNRVAYPYGLPPNYMPPVMHDDAGHVSSPILEGEPPQQPDEVHEDHQEYAQGDVDFYPPIPIEGPAPNTLPQPNLTRILGCLPAALPACPELGMGRRSIDHGPSLYSRPSLST

SEQ ID NO: 198327 - protein, 207 aa, Glycine max
  Coding DNA Sequence Number=SeqID_81549
MKIVISIPLINYDFAGGEHHQDSCYFYSINNFDWRQEPAMYNYYEKGRAPDLESVLADFMTYQASSKDSMQQAFKRTETKIGKLVDDMTKVVVRREEEYAKIEAHQERILQVTTIHHQLINEEEKDEVSSTPEYPCMATVGYVVGIDKGRLELSVEDKKISFDLFEAMKHSYMGDAYFEEEEVEQEITSSASTMILQIPLEKELVMW

SEQ ID NO: 198328 - protein, 192 aa, Glycine max
  Coding DNA Sequence Number=SeqID_81550
  Homolog annotation: Hit_ID=Q2HVF5; Match level="QueryCoverage=23%, HitCoverage=10%, E-value=3e-07, Identity=58%"; Hit description =Cyclin-like F-box; F-box protein interaction domain; Galactose oxidase, central
MKISDSFMRHFPKLNNPEVGERQRVIFLWVPTAQKSWLENPWLLLLIVPSIFNAGCPVDTHFRSPTVIKNLAPHFNLKIRCPMSQRPINCYMILHNPCNTTSEIGYECMSKAKVIVWQSSERESSSCSDVGSSSARSGNRHPLPVTGEIPTPIPVNLKVMEVTNRQPALQLGPSQQIPELNLQHHPHPPPRL

SEQ ID NO: 198329 - protein, 155 aa, Glycine max
  Coding DNA Sequence Number=SeqID_81551
  Homolog annotation: Hit_ID=Q2HVF5; Match level="QueryCoverage=69%, HitCoverage=26%, E-value=3e-19, Identity=46%"; Hit description =Cyclin-like F-box; F-box protein interaction domain; Galactose oxidase, central
MDVWVMREYNRGDSWCKLFTLEESRELRSFKCLRPLGYSSDGNKVLLEHDRKRLCWYDLGKKEVTLVRIQGLPNLNEAMICLGTLVTPYFLPRQICRKSPTLGCQRRRSGGTWGWLKLARRVCLEVDSSQREVEENDEGEERAGVQNVEDEENND

SEQ ID NO: 198330 - protein, 176 aa, Glycine max
  Coding DNA Sequence Number=SeqID_81552
  Homolog annotation: Hit_ID=Q1S064; Match level="QueryCoverage=84%, HitCoverage=41%, E-value=1e-29, Identity=43%"; Hit description =Cyclin-like F-box; F-box protein interaction domain
MQRESPNSATSISNPPPTPPIEGDDEIGLVGFEFARDDPVEGVTDEDAHGARAAESVGHAGECLPRVGAERVELDLGVEGAVLQVDEVRDADELVVGTCMVEAEAVDAGGEESGVGVEAAAGEGQRGKNTVLAEGGVPKGDVVGDVGYTEESVAGTEKSDVVAVTHKRVVKKKGRV

SEQ ID NO: 198331 - protein, 164 aa, Glycine max
  Coding DNA Sequence Number=SeqID_81553
  Gene Ontology: Mol. function=chitin binding; Cellular component =extracellular region; Biological process=chitin metabolic process
  Homolog annotation: Hit_ID=Q86AI8; Match level="QueryCoverage=78%, HitCoverage=42%, E-value=1e-17, Identity=34%"; Hit description =Similar to Homo sapiens (Human). Mucin 2
MRGIMHEPQGAPLGTSTLTFRGLDALAFRGLHVLTCRGLHILTFRGLHVLTYKGLHTLTFRGLHILTFRGLHVLTFRGLRVLTFRGLHALAFRGLHTLTFRGLHVLAIRGLHALTIRGLHVLTFRELRVLTFRGLHVLAFRGLHVLTFSGLHSHTLREFKVLCP

SEQ ID NO: 198332 - protein, 548 aa, Glycine max
  Coding DNA Sequence Number=SeqID_81554
  Gene Ontology: Mol. function=transporter activity; Cellular component= membrane; Biological process=sodium ion transport
  Homolog annotation: Hit_ID=A0FKR1; Match level="QueryCoverage=93%, HitCoverage=96%, E-value=0.0, Identity=65%"; Hit description =Vacuolar citrate/H+ symporter
  Pfam annotation: Domain name=CitMHS; Domain location=74-475; Score= -118.2; E_value=0.0087; Accession=PF03600.6; Description=Citrate transporter
  Pfam annotation: Domain name=MFS_1; Domain location=84-455; Score= -54.2; E_value=0.095; Accession=PF07690.6; Description=Major Facilitator Superfamily
  Pfam annotation: Domain name=Na_sulph_symp; Domain location=43-527; Score=26.3; E_value=2.3e-13; Accession=PF00939.9; Description =Sodium:sulfate symporter transmembrane region
  Pfam module annotation: Pfam domain module=CitMHS::MFS_1::Na_sulph _symp; Domain location=74-475::84-455::43-527
MVGEHGTMSLASDDQKTPLLPVHEPMEGTRTSVSFSIKTILTLENLYVILGPMLSLFICLFVKLDAPPTSQKMLGVIAWVFAWWVTQAVPLPVTSMCPLFLFPIFGIASADSVAHSYMDDVITLVLGSFILALAVERYNVHRRLALNVTLLFCGDPVNPALLLLGLCATIFFVSMWLHNVATAVMMMPVATGIVQRLPPVHEQSEAVNKFCRAVILTVVYATPIGGISTLTGTGVNLIIIGMWKSLFPEAKPISFNTWFFYGFPVAVLILICFWCIICLLYVPKGSGRALSAYLDRSHLKRDLEALGPMAFAEKMVLSVFGLLIILWMTRRITDDIPGWGSLFHGLVGDGSVSVMVAVLLFIIPNMKQEGEKLMSWNDCKKLPWNLILLLGAGFAIADGVQSSGLADVLSRALDFLEDAPYLAIVPAVSLICSIITEFITSNDATATLLVPLLYHIARTMHVHPLLLMVPGGIATEFAFWLPTSTPSNVVGFATGHIEIKDMLKVGVPLKVAGIVVLSLLMPSLGDLPAISVLLDKCFEKINWVEKEF

SEQ ID NO: 198333 - protein, 149 aa, Glycine max
  Coding DNA Sequence Number=SeqID_81555
  Gene Ontology: Mol. function=transporter activity; Cellular component= integral to membrane; Biological process=sodium ion transport
  Homolog annotation: Hit_ID=Q8LG88; Match level="QueryCoverage=98%, HitCoverage=28%, E-value=2e-19, Identity=37%"; Hit description =Tonoplast dicarboxylate transporter
  Subcellular localization annotation: CTP_CleavageSite=62; ConfidenceScore=5.01e-01
MSLISLCPVAKPTTFDGVEVGSQKANSVAIPPGIIRIRGSGTRRVAVAALEVMNSVTMLHIRLTTVTVAKCGVSCKKSTTLDSTSDRPLDCIPSAMANPAPRNKMRFQAKFMGPANNQELQFQSPVDIVALDGKSKNKGSQKEVMTSSM

SEQ ID NO: 198334 - protein, 114 aa, Glycine max
  Coding DNA Sequence Number=SeqID_81556
  Gene Ontology: Mol. function=cysteine protease inhibitor activity; Biological process=defense response
  Homolog annotation: Hit_ID=Q9FQ13; Match level="QueryCoverage=83%, HitCoverage=81%, E-value=3e-24, Identity=54%"; Hit description =Cystatin-like protein
  Pfam annotation: Domain name=Cystatin; Domain location=26-113; Score =57.2; E_value=5.6e-14; Accession=PF00031.11; Description=Cystatin domain
MRHHCLLLLSLVLVSYAARRSESALGGWSPIKDVNDSHVAEIANYAVSEYDKRSGAKLTLVKVSKGETQVVVGTNYRLVLKVKNGSTTTSYQATVLEKPWLHFRNLTSFKPLRS

SEQ ID NO: 198335 - protein, 183 aa, Glycine max
  Coding DNA Sequence Number=SeqID_81557
  Gene Ontology: Mol. function=protein binding; Cellular component=cell division site; Biological process=embryonic development via the syncytial blastoderm
  Homolog annotation: Hit_ID=Q2A9P5; Match level="QueryCoverage=99%, HitCoverage=50%, E-value=2e-65, Identity=69%"; Hit description=Mo25 family protein
  Pfam annotation: Domain name=Mo25; Domain location=1-183; Score= -68.6; E_value=3.4e-06; Accession=PF08569.1; Description=Mo25 protein family
MKGLFKSKPRTPADVVRQTRDLLLFVDRSPETRESKREEKLFGFASIIELDMPSSGIIRAVVEFMSELFKNIRELKSILYGNSESEPVSEACAQLTQEFFKEDTLRLLIKCLPKLNLEARKDATQVVANLQRQQVQFKLIASDYLEKNMDLMDILIVGYENQDMALHYGAMLRECIRHQIVAK

SEQ ID NO: 198336 - protein, 67 aa, Glycine max
  Coding DNA Sequence Number=SeqID_81558
MTQVLRVGEHLRRVMDSDDCSHDWRVQFYVYPTPTRDVLRGRCFLKKRIIGMEEESQVQEQISEAFK

SEQ ID NO: 198337 - protein, 138 aa, Glycine max
  Coding DNA Sequence Number=SeqID_81559
  Gene Ontology: Mol. function=protein binding; Cellular component=cell division site; Biological process=embryonic development via the syncytial blastoderm
  Homolog annotation: Hit_ID=Q2A9T4; Match level="QueryCoverage=94%, HitCoverage=42%, E-value=2e-52, Identity=73%"; Hit description=MO25 protein-related
  Pfam annotation: Domain name=Mo25; Domain location=1-138; Score= -34.4; E_value=1e-07; Accession=PF08569.1; Description=Mo25 protein family
MPYGVVLFQELLTRHKSTVAEFLSKNYEWFFAEYNTKLLESSNYITRRQAVKLLGDMLLDRSNSAVMTRYESSKSIQIEAFHVFKLFAANQHKPADIVGIFVANKSKMLRLLEDFKIDKEDEQFEADKAQVMREIEAL

SEQ ID NO: 198338 - protein, 105 aa, Glycine max
  Coding DNA Sequence Number=SeqID_81560
MFKAHDIMLTIKHRGGSTERERSRWIKGGGDVPVGDDGGAIILFGGGRRHASQSDLTTVAEWIYCIVDDYVVEAEPVSLSIEGKNKHSIHGSCKASSFMESPSWA

SEQ ID NO: 198339 - protein, 699 aa, Glycine max
  Coding DNA Sequence Number=SeqID_81561
  Gene Ontology: Mol. function=amino acid transporter activity; Cellular component=membrane; Biological process=amino acid transport
  Homolog annotation: Hit_ID=Q9SHH0; Match level="QueryCoverage=68%, HitCoverage=83%, E-value=1e-138, Identity=60%"; Hit description=Very similar to amino acid transporter
  Pfam annotation: Domain name=AA_permease; Domain location=100-516; Score=-10.2; E_value=1.9e-05; Accession=PF00324.11; Description =Amino acid permease
  Pfam annotation: Domain name=PMEI; Domain location=564-693; Score =32.8; E_value=1.2e-06; Accession=PF04043.6; Description=Plant invertasepectin methylesterase inhibitor
  Pfam module annotation: Pfam domain module=AA_permease::PMEI; Domain location=100-516::564-693
MTYPIRTESWNLVKVSHCSHQRTLFDGDDGTGVVLVLIGAPPKLLAVEQVRLLPREVIREREILPRSPGRHVSAPQGPAPEPVERRARAPGAPTHQRAPHESLPHVVGSDLAGLREARLHAGPAIVLSYAASGFSALLSALCYTEFAVDIPVAGGSFSFLRIELGDFLAFVAAGNILLEALVGAAGLGRSWSSYFASMVKSDPDFFRIHVPSFKPGFDMLDPLAVAVLLIANGIAVSGTRRTSLLTWLTSVITVFIIAFIIVVGFVHGKASNLTPFLPYGVDGVFNAAAVVYWSYSGFDMVATMAEETKNPSRDIPIGLVGSLSMITVIYCLMALSLVTMVNYTQIDVDAAYSVAFVQIGMSWAKYLVSLCALKGMTTSLLVGSMGQARYTTQIARSHMIPPFFALVHPKTGTPVNATLLTTISSSVIALFSSLDVLSSVFSISTLFIFMLMAVALLVRRYYVRESTAKSDLVRVLVCLFVIIGSSVVGAALWHSGKLGWIGYTVAACVWFLGTLGMSFLPKQRAPKAYWRFLICTAVMFVYYFFVAVHATYDVDHQDNGLEGKNDEGVGDNNTNQGSNVTHKVINHRDVIQLSLSITFRAVEHNYFTIKKLLIKHDLMKRETIVFYDCLETIDETLDKLREVHHNIELYPNMKTLYTDDLKTLINAAITNQVTCLDGFSHDDVDKHVRETNLREKVRL

SEQ ID NO: 198340 - protein, 231 aa, Glycine max
  Coding DNA Sequence Number=SeqID_81562
  Gene Ontology: Mol. function=transcriptional activator activity; Cellular component=nucleus; Biological process=positive regulation of transcription
  Homolog annotation: Hit_ID=Q2HT28; Match level="QueryCoverage=98%, HitCoverage=43%, E-value=2e-55, Identity=54%"; Hit description =Transcription initiation factor IIF, alpha subunit
MHGDDWEHEEIFTDDDEAVGNDPEEREDLAPEVPAPPEIKQDEEEEDEDNEEGEGLSKSGKELKKLLGKASGLNESDAEDDDDDDDDVDDDVGVPPVIATKQKDALKEEPIDNSPSKPTATGPARGTPSSKSSKGKRKLNEETKPSNTATPKKEPKLSAKDVNGSASKSSAPPKGTPPLSSKGGSSTTTTASGPVSEEEIRAVLRQKTPVTTQDLVAKFKARLRCSEMLDA

SEQ ID NO: 198341 - protein, 516 aa, Glycine max
  Coding DNA Sequence Number=SeqID_81563
  Gene Ontology: Mol. function=transferase activity
  Homolog annotation: Hit_ID=Q2HT39; Match level="QueryCoverage=68%, HitCoverage=96%, E-value=1e-122, Identity=58%"; Hit description =Membrane bound O-acyl transferase, MBOAT
  Pfam annotation: Domain name=MBOAT; Domain location=35-327; Score= -31.3; E_value=0.00046; Accession=PF03062.9; Description=MBOAT family
MEMEGEIKNFIMVWSIASATMCYCHRIGKLIPEGTSRLIALFPAIGILLLLPLRLISVHLGGPSAFFLGWLSTFKLILFAFGKGPLSSNPPLSLPHFVPIACLPIKFEHDPKHQIPQKKHKSPFSYASTSMVIILAALIPLYGKKEYFHPKFVFFLYGLHMYIGLEFIFATVSAATRKLIGVQLEPQFKEPYLCTSLQDFWGRRWNIMVNRVLHPTVYDPVKNLSARVLGRKWAPLPAILASFAVSGMMHELVFYYIKREKRTWEVWEPSWDATCFFLIHGVCVAMEVGIKKSLRGKKQWQVPRVLSWMLTLLFVLYTAMAFFLPALARCRVYEKATRELTALTQFLMDVYAKAEILSAKPFHFIAAALPTNAFFHVGQDFVPILHGPPSGLIDLGFRNRVQYFLEAHDPTADFPPGVPERWIDSGHGIQPQQQCHERLVHSQLLEVVGAHGVHRVLPLDQALQPIGFGVDGGDFPVEGADAVGAVEDEKACLEEGFMGKGCFDSHTLHTDTVTVV

SEQ ID NO: 198342 - protein, 320 aa, Glycine max
  Coding DNA Sequence Number=SeqID_81564
  Gene Ontology: Mol. function=transcriptional activator activity; Cellular component=nucleus; Biological process=positive regulation of transcription
  Homolog annotation: Hit_ID=Q2HT28; Match level="QueryCoverage=99%, HitCoverage=59%, E-value=1e-135, Identity=74%"; Hit description =Transcription initiation factor IIF, alpha subunit
  Pfam annotation: Domain name=TFIIF_alpha; Domain location=18-320; Score=146.5; E_value=7e-41; Accession=PF05793.3; Description =Transcription initiation factor IIF, a
MSTDLQLKSSCSGCGSTTDLYGSNCKHMTLCLGCGKTMAAKRAKCVDCGATLTRLIREYNVRASSPNDKNYFIGRFINGLPDFSKKKSAENKWSLQKDGLHGRQITDTLREKYKNKPWLLEDETGQSQFQGHLEGSQSATYYLLMKERKEFVAIPAGSWYNFNKVAQYKQLTLEEAEEKMKNRKKTADGYQRWMMKAANNGPAAFGEHGKFDDNESNTGGGRSHKKTDEDDEGHVSDKGEEDEEEESERKSRLGLNKRAGDDDEEGPRGGDHDLDDDDVEKGDDWEHEEIFTDDDEAVGNDPEEREDLAPEVPAPPEIKQ

SEQ ID NO: 198343 - protein, 262 aa, Glycine max
  Coding DNA Sequence Number=SeqID_81565
  Subcellular localization annotation: CTP_CleavageSite=43; ConfidenceScore=5.67e-01
MASFSITGPIKCKRITSFFPLSFSTTYNSCNISIPRNITRKVRARSNTLSLFSYQSSMHRSLYYEKQRGLSLIAFDGNNSESEGEDGHHGLDSVMKLYSAFKNKKIHELSADERRRVSNFLSFFETFQGRTQVLEFFSYLTSILGNNIQIIFKPTPHEGVNAGLQWKFEWDKIHLPLWKGFSLHISHTYHGRAVIRNIETFMEPLLHLRPFGLKMKIGLREFVEKIASFMVSEFGNKAKRILYLVLAVSSLTAFLFFMKLAL

SEQ ID NO: 198344 - protein, 97 aa, Glycine max
  Coding DNA Sequence Number=SeqID_81566
MDHTAALYTYFSKVKFPKSNVYIRRKRKLKYRDKFSHEKSNDSAAGDDKNEGDMLVAMDMKSTILDAKETKAKKNMQKVENSKDDTFEKKIKRENLW

SEQ ID NO: 198345 - protein, 175 aa, Glycine max
  Coding DNA Sequence Number=SeqID_81567
  Gene Ontology: Mol. function=Rho GDP-dissociation inhibitor activity; Cellular component=cytoplasm; Biological process=actin cytoskeleton organization and biogenesis
  Homolog annotation: Hit_ID=Q705X3; Match level="QueryCoverage=95%, HitCoverage=70%, E-value=5e-64, Identity=74%"; Hit description=Rho GDP dissociation inhibitor 2
  Pfam annotation: Domain name=Rho_GDI; Domain location=45-175; Score= -79.0; E_value=0.0036; Accession=PF02115.7; Description=RHO protein GDP dissociation inhibitor
MGFDEKVKDNDGAGDDDASHRVHAAKAGTDHESGHEGGGTFSRYRSESSIAATEDEDDEEERKIELGPQCTLKEQLEKDKDDESLRRWKEQLLGSVDINSVGETLEPNVKILSLAIKSADRPDIVLAIPEGGNPKGLWFTLKEGSRYRLMFTFQVENNIVSGLKYTNTVWKTGVK

SEQ ID NO: 198346 - protein, 129 aa, Glycine max
  Coding DNA Sequence Number=SeqID_81568
  Gene Ontology: Mol. function=protein binding; Cellular component =cytoplasm; Biological process=ubiquitin cycle
  Homolog annotation: Hit_ID=Q8S938; Match level="QueryCoverage=63%, HitCoverage=83%, E-value=3e-29, Identity=68%"; Hit description=Rurm1 protein
  Pfam annotation: Domain name=Urm1; Domain location=39-129; Score =168.7; E_value=1.4e-47; Accession=PF09138.1; Description=Urm1 (Ubiquitin related modifier)
MSISSFKNYGWVMVAFVAVVVSDEETMEEQLEIGRRRRGGLELLCDSKKIHNVNIEQHNGEDKLIMKDLLAWVRTNLIKERPEMFMKGNTVRPGVLVLVNDCDWELSGQLNTSLEDKDVVVFISTLHGG

SEQ ID NO: 198347 - protein, 302 aa, Glycine max
  Coding DNA Sequence Number=SeqID_81569
  Homolog annotation: Hit_ID=Q45TX7; Match level="QueryCoverage=99%, HitCoverage=100%, E-value=2e-58, Identity=51%"; Hit description =Putative shrunken seed protein
  Pfam annotation: Domain name=Pex16; Domain location=1-295; Score =170.0; E_value=5.8e-48; Accession=PF08610.1; Description=Peroxisomal membrane protein (Pex16)
MEAYKRWVRQNKEFVHSMESLANGLTWLLPERFSESEIGPEAVTTILGIITALNEHIIDTAPKQNITGSVKPYSFPYPLCLSALKDLETLVEVVAQQYYGDDKKWNFLAVTEATKVLVRLSLFRKSGYKMLLQGGETPNDEEHSDSFTSQHHIGLKPDVHHRPGYMKNNLGANPMNLEGRALSALVRFGEKVKGSDSVWLRRVEHQQATMEPTRNSILSLMTSPVAGGKERMFHLSAPEKDEVKRRKLLFVLYLMRDPFFSKQRLESTEKVLEPIPVMGFLTAKLVELIIGAQTRYTYMSGS

SEQ ID NO: 198348 - protein, 231 aa, Glycine max
  Coding DNA Sequence Number=SeqID_81570
MDSMMSTRTLGTLTNPPCPGIILLGDGVDEAFYSVPRGKGHCGKGNNGGHNKRVLEVHRRASGIAFGRESGEYNRIRNLEQVTSRRTIHSSFIKGVSHEYLEFVDEGGLLEEAFSPPSLREGVSCKFLEFINEGGMSEDFFYKPLASEFVVCDLLYMLKKMQSQLSFADSAKERELELNFIEQVENIIRYKFQNKWLLEEAFTPLSFEGFSYEFIDEGVRTSSRSFLLQNL

SEQ ID NO: 198349 - protein, 231 aa, Glycine max
  Coding DNA Sequence Number=SeqID_81571
  Gene Ontology: Cellular component=spliceosome; Biological process =nuclear mRNA splicing, via spliceosome
  Homolog annotation: Hit_ID=Q1SPA7; Match level="QueryCoverage=79%, HitCoverage=81%, E-value=2e-23, Identity=73%"; Hit description =Cwf15/Cwc15 cell cycle control protein
  Pfam annotation: Domain name=Cwf_Cwc_15; Domain location=1-231; Score= 283.5; E_value=4.1e-82; Accession=PF04889.3; Description=Cwf15Cwc15 cell cycle control protein
MTAAEEFTSGGREVRKDTYIESESEGYYKELPTVLTAGTNWVFYLSRKEGQDTQDELKRRNLRDELEDRERRHFSSKNKSYDDRDHGKGSHLFLEGSKRDIEDRIVARSVDADDSDVEVKSDDDSDEDDDDEDDTEALLAELEQIKKERAEEKLRKERQQQEEELKVKEAELLRGNPLLNNPTASFNVKRRWDDDVVFKNQSRGETKTAKRFINDTIRNDFHRKFLHKYMK

SEQ ID NO: 198350 - protein, 67 aa, Glycine max
  Coding DNA Sequence Number=SeqID_81572
MHKPVQAVCKRKFLSDENTRDARFRLGSLHSFGGMIGFGLLKGRHTESGMIGFGLLKGRHTENLLAE

SEQ ID NO: 198351 - protein, 182 aa, Glycine max
  Coding DNA Sequence Number=SeqID_81573
  Gene Ontology: Mol. function=RNA-directed DNA polymerase activity; Cellular component=nucleus; Biological process=RNA-dependent DNA replication
  Pfam annotation: Domain name=RnaseH; Domain location=36-150; Score= -25.7; E_value=0.014; Accession=PF00075.14; Description=RNase H
MALITQEIGGYGITSSTCPYWQIRRCNRDPFMFLHRTAPPPTRAAGGVLRDWKGEFILGFSDALIECSSALEAELWAIKIGMQTVVARGYRNLIVESDSLKAIQIINAHKGDFLRSSIQHMTRMVDRICWNHVYRETNSVADGFAKHGLSLSQDQSIRVFDSAPDFIESRLYGDRIGKIYCR

SEQ ID NO: 198352 - protein, 281 aa, Glycine max
  Coding DNA Sequence Number=SeqID_81574
  Gene Ontology: Mol. function=ribonuclease H activity; Cellular component=nucleus; Biological process=RNA-dependent DNA replication
  Pfam annotation: Domain name=RnaseH; Domain location=124-249; Score= -15.2; E_value=0.0015; Accession=PF00075.14; Description=RNase H
  Pfam annotation: Domain name=zf-CCCH; Domain location=40-65; Score =28.9; E_value=1.8e-05; Accession=PF00642.15; Description=Zinc finger C-x8-C-x5-C-x3-H type (and similar)
  Pfam module annotation: Pfam domain module=RnaseH::zf-CCCH; Domain location=124-249::40-65
MALITQEIGGYGITSSTCPYWQIRRCNRDPFMFLHRTAPPPTSTCKYWMNGNCKFGDQCRSLHSWSDVEATFVGTQHVFLVFCWIGLGCNEFVAEFIHFANMQILPQDDNPRPTRLVWWTPPPRGFFKLNCDGAFTVYGNKGAAGGVLRDWKGEFILGFSDALIECSSALEAELWAIKIGMQTVVARGYRNLIVESDSLKAIQIINAHKGDFLRSSIQHMTRMVDRICWNHVYRETNSVADGFAKHGLSLSQDQSIRVFDSAPDFIESRLYGDRIGKIYCR

SEQ ID NO: 198353 - protein, 170 aa, Glycine max
  Coding DNA Sequence Number=SeqID_81575
  Subcellular localization annotation: CTP_CleavageSite=51; ConfidenceScore=5.05e-01
MDPTEPNHNNSFSAAGDFGLWWLENKEVGNARCTQQYCCFVFSSSSVNLVRSSYLLRELPSSPRGAPKARFSSSSPRTDPLGVLPEVPEEPFPESFRKKCSSGSNQTSFGRTLLLKDSRKTSSGNFPEEVVHPEEFRKTRTSGRPFKVPEDLSGRTPSSGIFPEEPLLPG

SEQ ID NO: 198354 - protein, 440 aa, Glycine max
  Coding DNA Sequence Number=SeqID_81576
  Gene Ontology: Mol. function=protein-arginine omega-N symmetric methyltransferase activity; Cellular component=cytoplasm; Biological process=regulation of protein binding
  Homolog annotation: Hit_ID=Q1SPA4; Match level="QueryCoverage=99%, HitCoverage=72%, E-value=0.0, Identity=68%"; Hit description=SAM (And some other nucleotide) binding motif
LVESTFLWQLHDLHSIEATVSDGIQLTPPGLDSVLSVKRQQYAMHCNPIQEEIKLLSEPFKIFEFDFWKRPESSGETELCVKATNDGRIHAVVSWWVLQLDREGTIYYSTAPRWISSPTITSPVGWCDHWKQCVWFVPGSGISIFKGEEIHLHATHTETSISYNLDTQVPTSEILNHRCMTGDLQLVLPPERVAIYGDKGWRLSMLKAVQSMGRDHPLCLVADDSVFLPLLVAQLSEASHVMSLLPGLKERGLQYLQAAAHANGLSRNCIEVLEKRVDLLIAEPFYVGHDGMLPWQNLRFWKDRTTLNDILSEDALIIPSKGILRACAISLPVLSETFDVMEFDFSKQICLCQGKSQVKFTKTGVCHGFVLWIDWVMDLQNSVVISTGPDRRYWKQGVKLLGTPRTVGPQRSRNVQACSAVLEACFNPLQGELKIILDFL

SEQ ID NO: 198355 - protein, 389 aa, Glycine max
  Coding DNA Sequence Number=SeqID_81577
  Gene Ontology: Mol. function=pepsin A activity; Cellular component =cellulose and pectin-containing cell wall; Biological process =proteolysis
  Homolog annotation: Hit_ID=Q1SPA3; Match level="QueryCoverage=99%, HitCoverage=81%, E-value=1e-162, Identity=72%"; Hit description =Peptidase aspartic, active site
  Pfam annotation: Domain name=Asp; Domain location=55-375; Score= -147.1; E_value=6.4e-05; Accession=PF00026.14; Description=Eukaryotic aspartyl protease
  Subcellular localization annotation: CTP_CleavageSite=34; ConfidenceScore=5.37e-01
MDTGSDLVWFPCAPFKCILCEGKPNASPPVNTTRSVAVSCKSPACSAAHNLASPSDLCAAARCPLESIETSDCANFKCPPFYYAYGDGSLIARLYRDTLSLSSLFLRNFTFGCAYTTLAEPTGVAGFGRGLLSLPAQLATLSPQLGNRFSYCLVSHSFDSERVRKPSPLILGRYEEEEEEEKVGGGVAEFVYTPMLENPKHPYFYTVGLIGISVGKRIVPAPEMLRRVNNRGDGGVVVDSGTTFTMLPAGFYNSVVDEFDRGVGRVNERARKIEEKTGLAPCYYLNSVAEVPVLTLRFAGGNSSVVLPRKNYFYEFLDGRDAAKGKRRVGCLMLMNGGDEAELSGGPGATLGNYQQQGFEVEYDLEEKRVGFARRQCASLWERLNRDKN

SEQ ID NO: 198356 - protein, 88 aa, Glycine max
  Coding DNA Sequence Number=SeqID_81578
MAVSLGVCIRGRVRERKRVAIRVLGNTEIMELYGSVSMTLGGIGTRGKDPQRQDWNLESVSTQNLLDSLRRAREKTTQTEREQGNEYG

SEQ ID NO: 198357 - protein, 127 aa, Glycine max
  Coding DNA Sequence Number=SeqID_81579
  Gene Ontology: Mol. function=methyltransferase activity; Cellular component=cytoplasm; Biological process=regulation of protein binding
  Homolog annotation: Hit_ID=Q1SPA4; Match level="QueryCoverage=99%, HitCoverage=18%, E-value=6e-54, Identity=80%"; Hit description=SAM (And some other nucleotide) binding motif
MSSSTQRMFQLKLDPITGNSEWVVIEDNDDGDESFAHNFHQPLLATTSYLDMLNDSPRNTAFRQAIQKTITKPCHVLDIGAGTGLLSMMAARAMGDEGRVTACESYLPMVKLMKKVLRINGMEGRVK

SEQ ID NO: 198358 - protein, 353 aa, Glycine max
  Coding DNA Sequence Number=SeqID_81580
  Pfam annotation: Domain name=zf-CCHC; Domain location=58-75; Score =16.2; E_value=0.0021; Accession=PF00098.13; Description=Zinc knuckle
MDSLVTRVLGVPTLVRGENSVIAFETSAAPTETLAMVASRERGGRGNKGGHSSRGGHPQCTYCKKPGHIQEKCYTLHGYPDSVAPVTKFEKSESKFSDEEYQDYLRLKSINQAQSSSGPSVSTTCISQSVKGQNPWIIDSATGQNQLCLLCELLGLARYTSSSGEFMNNGNGKSGETCAENTTDGKVFNEDTHVYCVNDLAVQSEMDFSTLLANDMCQRFHPSLPIPLPPSNGKEHGISGAEAGQIDEIFYPPNGTQQFSYEDLNIWLSTVLPGGVDIATSPRFVVTTLRGRVANPHWVVNEHAFDLDNLIFVEPNDDAQSEEDLDDDDGDGDDDESDDIHGDDPIRGLNMLL

SEQ ID NO: 198359 - protein, 140 aa, Glycine max
  Coding DNA Sequence Number=SeqID_81581
MVTAIGLGYGFVILDTAEKYRENGTLMQLQLQLQLLLHVVLMRVIGYSVCSCCEVNKREWRMDQQQGGIEVVEEIRPRWCSPAGIPTIKSEVVWGECKGKLKGLFFRVKELKDFGNKKESNLAALLRNMENQHQQTQVAG

SEQ ID NO: 198360 - protein, 421 aa, Glycine max
  Coding DNA Sequence Number=SeqID_81582
MSTQQLKRFNSMERRPRMLKDFLSENLNSCSSSGFESLPRKPTNNNNNSMHSLIEMELKSSSSSSSSPFQTLINTIRSISLFTPKSPSVLSLPRSLSRKLSSSRRRTRRRRSRVCSDVNITTAVKIKDIIRWKSFRDIVVEPSPLPPPPPPLDFMVGSTNTTTCSSCSSGSSWIKSDFLTLEEAQNDNVEAAGKRFSFISHLLVGSKNSWAKETLTCQEEQHSPVSVLQVGEDEFSPFDQSLANIQRRKQKFIQTVQKLESLAKFDLANLDQCLSLDDNSGYDEEYEEDDADNEVDIEEQDWIEEKAKQLLNCVKARGSADGCRDYLDTLLLDFFREELSGGRNQYKNEEEFELETLRITEDWINGSFAFDAGHVDKHAYIKDMERRDQWSRFEEEQEELAFEIETAILHSLVADLLDLDG

SEQ ID NO: 198361 - protein, 254 aa, Glycine max
  Coding DNA Sequence Number=SeqID_81583
  Gene Ontology: Mol. function=metal ion binding; Cellular component =integral to membrane; Biological process=ubiquitin cycle
  Homolog annotation: Hit_ID=Q2QXP1; Match level="QueryCoverage=58%, HitCoverage=49%, E-value=2e-25, Identity=39%"; Hit description=Zinc finger, C3HC4 type family protein, expressed
  Pfam annotation: Domain name=PHD; Domain location=151-196; Score=2.4; E_value=0.033; Accession=PF00628.19; Description=PHD-finger
  Pfam annotation: Domain name=zf-C3HC4; Domain location=152-193; Score= 45.2; E_value=2.2e-10; Accession=PF00097.15; Description=Zinc finger, C3HC4 type (RING finger)
  Pfam module annotation: Pfam domain module=PHD::zf-C3HC4; Domain location=151-196::152-193
MASRQFLNSRTYPKVARPGEMERERQRKRLAICKTNFFWGLWPGLGNWFCEVGTMGIDTNLVTTVIGFGLSATFIVFVCARIICGRLRERTRTIYEIEAITDIERAEYHGNDPAPAFVAAIPTLNFNHEAFSSIETTQLSLVSGLYSLIRRCVICLAEYKEKELLRIIPKCGHTFHLSCIDMWLRKQSTCPVCRLSLQNALETKHVRHATFTIRHSLDESNTAERNTDSDQRLVELDSSNDSQQPTLGEPEARQ

SEQ ID NO: 198362 - protein, 234 aa, Glycine max
  Coding DNA Sequence Number=SeqID_81584
  Gene Ontology: Mol. function=protein serine/threonine kinase activity; Cellular component=mitochondrion; Biological process =fructoselysine metabolic process
  Homolog annotation: Hit_ID=Q10SM2; Match level="QueryCoverage=79%, HitCoverage=54%, E-value=5e-70, Identity=68%"; Hit description =Expressed protein
  Pfam annotation: Domain name=Fructosamin_kin; Domain location=40-229; Score=-26.2; E_value=2e-10; Accession=PF03881.5; Description =Fructosamine kinase
  Subcellular localization annotation: CTP_CleavageSite=28; ConfidenceScore=5.21e-01
MSSSTCFPSLPRLLRPSFTKTKSSPKFSMSMSKDPVREWILSDGKATEITKISPVGGGCINLASRYDTDAGSFFVKTNRSIGPSMFEAEALGLGAMYETGTIRVPKPYKVGPLPTGGSFIIMEFIQFGASRGYQSDLGRKLAEMHKAGKSSKGFGFDVDNTIGSTPQVNTWSSDWVQFYGEHRLGYQLKLALDQYGDRTIYDKVTISCFHILLGGVTIEQVSSRVLLEVRMQYL

SEQ ID NO: 198363 - protein, 58 aa, Glycine max
  Coding DNA Sequence Number=SeqID_81585
MEVSRRSSGNRRWARGMHVPKNDMLRSGTWDALKETTQIWVSEIGAVVVGGAGDGGRR

SEQ ID NO: 198364 - protein, 253 aa, Glycine max
  Coding DNA Sequence Number=SeqID_81586
  Gene Ontology: Mol. function=hydrolase activity, hydrolyzing O -glycosyl compounds; Cellular component=cell wall; Biological process= carbohydrate metabolic process
  Homolog annotation: Hit_ID=Q10SM5; Match level="QueryCoverage=61%, HitCoverage=50%, E-value=1e-37, Identity=53%"; Hit description =Glycosyl hydrolases family 16 protein, expressed
  Pfam annotation: Domain name=Glyco_hydro_16; Domain location=31-225; Score=43.6; E_value=1.3e-10; Accession=PF00722.11; Description =Glycosyl hydrolases family 16
MDPDIIDIPPPTKNNVSNSMKQNEMSKVCFDGSNSHWEMYLDTIEIPPLVKQNSSISMKQKERIEGRKRKRSNTLPKPVPTAPPPTPSPSPTTTAAACGGAPPTCFNSGTLSALIRCPSGDTSGLNFNLYLSSLEGNKSQDEIDFEFLGRDRNIVQTNYFSEGVGNMEKVHVLGFDASDGFHEYGIVWGSDAIEWRVDGNLVRRLCFCTLRCGMQVGLMKGSGVGSTVGLLLLNESLHFLFVVGNFTLCVVSV

SEQ ID NO: 198365 - protein, 231 aa, Glycine max
  Coding DNA Sequence Number=SeqID_81587
  Gene Ontology: Mol. function=nucleic acid binding; Cellular component= nucleus
  Homolog annotation: Hit_ID=Q6R4Q7; Match level="QueryCoverage=85%, HitCoverage=41%, E-value=3e-52, Identity=59%"; Hit description =Splicing factor-like protein
  Pfam annotation: Domain name=RRM_1; Domain location=77-141; Score =63.8; E_value=5.6e-16; Accession=PF00076.12; Description=RNA recognition motif. (a.k.a. RRM, R
MFQHRNHDDFATVAGFAFVYMEDERDAEYAIRRLDRTEFGRKGRRIRVEWTKQERDSRRSGGDSRKSSSNSRPSKTLFVINFDPVNARTRDLERHFDSYGKILNIRIRRNFAFIQFESQEDATRALEATNLSKFMDRVITVEYAIRDDDDRDRRNGYSPDRRGHDSPDGRYGRGRSPSPYRRGRGSPDYGHGSNPSSRPEPRGSPKYDRAESPINGRYDSRSPPPRDRSRS

SEQ ID NO: 198366 - protein, 341 aa, Glycine max
  Coding DNA Sequence Number=SeqID_81588
  Homolog annotation: Hit_ID=Q1T6R1; Match level="QueryCoverage=18%, HitCoverage=15%, E-value=3e-12, Identity=55%"; Hit description =Pathogenesis-related transcriptional factor and ERF
  Pfam annotation: Domain name=AP2; Domain location=35-99; Score=121.5; E_value=2.4e-33; Accession=PF00847.10; Description=AP2 domain
  Subcellular localization annotation: CTP_CleavageSite=50; ConfidenceScore=5.65e-01
MAGAEATKYASSATSPTITASNNSMATKSNKPISVRRFIGVRQRPSGRWVAEIKDSSQHVRLWLGTYDTPEEAARAYDEAARALRGENARTNFAPVSQLVNGQLGQQSGFNNNNNLLSTGSDIGKHGLSFASLKAKLSKNLQNIMARASDHNNNNNNKSSKSRVSDHFTFASIFHRRSYQIPEGDMMKNIEKVVQPSIIVPPMEQSGGDYNSCVANWESASSVSDCSSEWVGFGNNNSKLGLESDGSEIGEASVGDQGFLEQLMGWVESPDVSDEGSRSKRFKVSSSVLVPPTFTGSPYDCGSPYTGYASPYNSGYASPYNNNGCASPCNGYASPYYNNKK

SEQ ID NO: 198367 - protein, 565 aa, Glycine max
  Coding DNA Sequence Number=SeqID_81589
  Gene Ontology: Mol. function=binding; Cellular component=vacuole, cell cycle-correlated morphology; Biological process=vacuole fusion, non-autophagic
  Homolog annotation: Hit_ID=Q1S1P5; Match level="QueryCoverage=94%, HitCoverage=95%, E-value=0.0, Identity=81%"; Hit description=IMP dehydrogenase/GMP reductase
  Pfam annotation: Domain name=Arm; Domain location=190-230; Score =14.8; E_value=0.17; Accession=PF00514.13; Description=Armadillobeta -catenin-like repeat
  Pfam annotation: Domain name=Arm; Domain location=231-271; Score =16.6; E_value=0.089; Accession=PF00514.13; Description=Armadillobeta- catenin-like repeat
  Pfam annotation: Domain name=Arm; Domain location=272-312; Score =34.7; E_value=3.1e-07; Accession=PF00514.13; Description =Armadillobeta-catenin-like repeat
  Pfam annotation: Domain name=Arm; Domain location=313-354; Score =15.4; E_value=0.15; Accession=PF00514.13; Description=Armadillobeta -catenin-like repeat
  Pfam annotation: Domain name=Arm; Domain location=356-394; Score=6.8; E_value=1.7; Accession=PF00514.13; Description=Armadillobeta-catenin -like repeat
  Pfam annotation: Domain name=Arm; Domain location=397-434; Score =16.6; E_value=0.093; Accession=PF00514.13; Description=Armadillobeta- catenin-like repeat
  Pfam annotation: Domain name=Arm; Domain location=435-475; Score =29.3; E_value=1.3e-05; Accession=PF00514.13; Description =Armadillobeta-catenin-like repeat
  Pfam annotation: Domain name=Arm; Domain location=476-518; Score=7.8; E_value=1.3; Accession=PF00514.13; Description=Armadillobeta-catenin -like repeat
  Pfam annotation: Domain name=HEAT; Domain location=201-232; Score =6.8; E_value=6.4; Accession=PF02985.12; Description=HEAT repeat
  Pfam annotation: Domain name=HEAT; Domain location=241-273; Score =1.0; E_value=33; Accession=PF02985.12; Description=HEAT repeat
  Pfam annotation: Domain name=HEAT; Domain location=399-436; Score =7.7; E_value=4.9; Accession=PF02985.12; Description=HEAT repeat
  Pfam annotation: Domain name=HEAT; Domain location=445-477; Score =5.9; E_value=8.3; Accession=PF02985.12; Description=HEAT repeat
  Pfam annotation: Domain name=HEAT; Domain location=483-520; Score =2.0; E_value=24; Accession=PF02985.12; Description=HEAT repeat
  Pfam module annotation: Pfam domain module=Arm::Arm::Arm::Arm::Arm::Ar m::Arm::Arm::HEAT::HEAT::HEAT::HEAT::HEAT; Domain location=190 -230::231-271::272-312::313-354::356-394::397-434::435-475::476 -518::201-232::241-273::...
  Pfam module annotation: Domain location=399-436::445-477::483-520
MVEATQASKDNHVVAFEARSTEDWLLHAQELVPVALANAREVKGFPGRWKMIISNLEQIPSRLSDLSSHPCFSKNALCKEQLQAVSKTLKEAVELAELCVKEKYEGKLRMQSDLDALIGKLDLNLKDCGLLIKTGVLGEATLPLTVLGSMAESDIATHNNIRELLARLQIGHLEAKHKALDRLYDVMKEDEKNVLAVFGRSNISALVQLLTATSPRIREKTVTVICSLVESGSCEKWLVSEGVLPPLIRLVESGSAVGKEKATLSLQRLSMSAETTRAIVGHGGVRPLIEICQSGDSVSQAAAACTLTNVSAVPEVRQALAEEGIVRVMISLLNCGILLGSKEYAAECLQNLTLSNEYLRKSVISEGGVRSLLAYLDGPLPQESAVGALKNLIGSVSEETLVSLGLVPCLVHVLKSGSLGAQQAAASIICRVCSSMEMKKIVGEAGCIPLLIKMLEAKANNAREVAAQAISSLMVLSQNRREVKKDDKSVPNLVQLLDPSPQNTAKKYAVSCLGSLSPSKKCKKLMISYGAIGYLKKLTEMDIPGAKKLLERLERGKLRSLFSRK

SEQ ID NO: 198368 - protein, 104 aa, Glycine max
  Coding DNA Sequence Number=SeqID_81590
  Gene Ontology: Mol. function=sequence-specific DNA binding; Cellular component=nucleus; Biological process=regulation of transcription, DNA-dependent
  Homolog annotation: Hit_ID=Q3Y4G8; Match level="QueryCoverage=76%, HitCoverage=32%, E-value=5e-38, Identity=100%"; Hit description=MADS- box protein
  Pfam annotation: Domain name=K-box; Domain location=19-95; Score =69.9; E_value=8.2e-18; Accession=PF01486.8; Description=K-box region
MAHLVYMLKTLERYQKCSYGAVEVSKPGKELESSYREYLKLKARFESLQRTQRNLLGEDLGPLNTKDLEQLERQLDSSLKQVRSTKKIIHRKLIKVVLISCCID

SEQ ID NO: 198369 - protein, 156 aa, Glycine max
  Coding DNA Sequence Number=SeqID_81591
  Gene Ontology: Mol. function=protein binding; Biological process =ubiquitin cycle
  Homolog annotation: Hit_ID=Q1S0J2; Match level="QueryCoverage=80%, HitCoverage=44%, E-value=7e-45, Identity=62%"; Hit description =Cyclin-like F-box; Galactose-binding like
MYYTIFVHNRFHTVAYLQQIWWLEVEDDVDFQFPPGKYSVFFRLQLGRSSKRLGRRVCKTDDIHGWDIKPVKFQLTTSDGQRAVSQSHLDNPGHWVLYHAGNFVSKSPNDLMKIKFSLTQIDCTHTKGGRKSVYSGNELRHLSPELTFVIWVTGGS

SEQ ID NO: 198370 - protein, 72 aa, Glycine max
  Coding DNA Sequence Number=SeqID_81592
MGLRLKKWDGIGKLDKEVRSPTLTFQHVPVFVPDTRWVKICYLIPVPSGIRDVYGNEYEMGSDIPVPNPDSN

SEQ ID NO: 198371 - protein, 371 aa, Glycine max
  Coding DNA Sequence Number=SeqID_81593
  Gene Ontology: Mol. function=GTPase inhibitor activity; Cellular component=protein complex; Biological process=red or far red light signaling pathway
  Homolog annotation: Hit_ID=Q1S1Q2; Match level="QueryCoverage=100%, HitCoverage=55%, E-value=2e-62, Identity=77%"; Hit description=Helix- turn-helix, AraC type; Proteasome component region PCI
  Pfam annotation: Domain name=PCI; Domain location=281-371; Score =44.6; E_value=3.4e-10; Accession=PF01399.17; Description=PCI domain
MGYNDFGEFYYAHGQLGDAFKSYVRTRDYCTTSKHIVHMCMSAILVSIEMGQFPHVTSYVSKAEQSPDALEAVTVAKLRCAAGLANLEAKKYKLAARKVCSLALYFLSQSRLDPSSMVYEIPDLEAQRCELDVGSFLGVNCKRIACIIPESHELPVVFELCVSGAATDEAGHVPKTGLGHARTNCVTAVRNFIFCFDLPVSVCGAAISQGVRIPGDKLGHFLETGPELGSHYNDVIAPQDVATYGGLCALATFDRAELKASSPLYCCDDNSNFRNFLELVPEVRELINDFYSSHYASCLEYLGNLKANLLLDIHLHDHVETLYDQIRHKALIQYTLPFVSVDLNMMANAFKTTVAGLEKELEALITDNQIQ

SEQ ID NO: 198372 - protein, 277 aa, Glycine max
  Coding DNA Sequence Number=SeqID_81594
  Homolog annotation: Hit_ID=Q9CB00; Match level="QueryCoverage=45%, HitCoverage=22%, E-value=1e-07, Identity=32%"; Hit description=Ara4 -interacting protein
MPCIFKNKIKVKVWGRKYGGNLNEAINAHFLEVDRHMYGNVDSSDGGLPRGHFQQEDDDLAHALLLSLEVFEYSFYFDNSISPFPVFLNFSCIEFRLQSKRPNRGKWGGISSEELNEALFAETALFGEISNHSSHHISSLPNLQHHPEQNVDPKAQCLSTSMSQLLNDSRLLKQQQVWILACDGCVIKDSEYLESLRADKQKELSSLNKAESHSSKEQESYKKMLVKKELRKILDKKEVRLSKEPPLSDEVITIVVRMPVDKLEVKLALEYDEILTA

SEQ ID NO: 198373 - protein, 85 aa, Glycine max
  Coding DNA Sequence Number=SeqID_81595
MRPLVLSGTSSIENATYFVGVCSSDKSNAFTQKAKNDYSLQTNEKLQRTNKTSGGRKGMAGDGDMDTSCGPQCPLLSILIFHISN

SEQ ID NO: 198374 - protein, 446 aa, Glycine max
  Coding DNA Sequence Number=SeqID_81596
  Gene Ontology: Mol. function=methyltransferase activity; Cellular component=cellulose and pectin-containing cell wall
  Homolog annotation: Hit_ID=Q8H636; Match level="QueryCoverage=99%, HitCoverage=74%, E-value=1e-114, Identity=44%"; Hit description =Dehydration-responsive protein-like
  Pfam annotation: Domain name=DUF248; Domain location=1-441; Score =810.3; E_value=1.1e-240; Accession=PF03141.7; Description=Putative methyltransferase
  Pfam annotation: Domain name=Methyltransf_11; Domain location=58-153; Score=33.4; E_value=7.8e-07; Accession=PF08241.2; Description =Methyltransferase domain
  Pfam annotation: Domain name=Methyltransf_12; Domain location=58-151; Score=10.5; E_value=0.051; Accession=PF08242.2; Description =Methyltransferase domain
  Pfam module annotation: Pfam domain module=DUF248::Methyltransf _11::Methyltransf_12; Domain location=1-441::58-153::58-151
MPYNKIADRKGHQGWMKLEGPHFIFPGGGTMFPDGAEQYIEKLGQYIPINGGVLRTALDMGCGVASFGGYLLAQNILTMSFAPRDSHKSQIQFALERGVPAFVAMLGTRRLPFPAFGFDLVHCSRCLIPFTAYNVSYFIEVDRLLRPGGYLVISGPPVQWPKQDKEWSDLQAVARALCYELIAVDGNTVIWKKPAAEMCLPNQNEFGLDLCDDSDDPSFAWYFKLKKCVTRMSSVKGEYAIGTIPKWPERLTASPLRSTVLKNGADVYEADTKRWVRRVAHYKNSLKIKLGTSAVRNVMDMNAFFGGFAAALNSDPVWVMNVVPSHKPITLDAIFDRGLIGVYHDWCEPFSTYPRTYDLIHVASMESLVKDPASGRNRCTLLDLMVELDRILRPEGTVVVRDTPEVIEKVARVAHAVRWKPTIYNKEPESHGREKILVATKTFWKS

SEQ ID NO: 198375 - protein, 89 aa, Glycine max
  Coding DNA Sequence Number=SeqID_81597
  Gene Ontology: Mol. function=sequence-specific DNA binding; Cellular component=nucleus; Biological process=regulation of transcription, DNA-dependent
  Homolog annotation: Hit_ID=Q39400; Match level="QueryCoverage=61%, HitCoverage=21%, E-value=1e-19, Identity=89%"; Hit description=MADS4 protein
  Pfam annotation: Domain name=SRF-TF; Domain location=9-59; Score =98.7; E_value=1.8e-26; Accession=PF00319.9; Description=SRF-type transcription factor (DNA-binding and dimerisation domain)
MGRGRVQLKQIENKISRQVTFSKRRTGLRKKANEISVLCDAQVALIVFNAKGKLFEYSSESSLLQSQNKIVLRNVLNCAAVITISSQSL

SEQ ID NO: 198376 - protein, 117 aa, Glycine max
  Coding DNA Sequence Number=SeqID_81598
MDLEIVQADDIQDDEDSKFSKIIQDSIDDEIVKDSMDTKDDEDSIFSKIVQDSMDLKVVQDSIDAEDEASIDILNLPTDCGFALNKFPDDDDDESSDEKGLKVEVRALIKIYLPKFY

SEQ ID NO: 198377 - protein, 103 aa, Glycine max
  Coding DNA Sequence Number=SeqID_81599
MATEEAHEDLKPIIVALRKPLPMGDPMEMMGGKAKDEFGVRIVNDGVGLLRLGSMVVLGGGGTCLGEVGVFVFVQVSWVVQETKSEVQEAYALTMVARVGSYH

SEQ ID NO: 198378 - protein, 248 aa, Glycine max
  Coding DNA Sequence Number=SeqID_81600
  Gene Ontology: Mol. function=DNA binding; Cellular component=nucleus; Biological process=regulation of transcription
  Homolog annotation: Hit_ID=Q1S9D9; Match level="QueryCoverage=83%, HitCoverage=86%, E-value=2e-80, Identity=70%"; Hit description=No apical meristem (NAM) protein
  Pfam annotation: Domain name=NAM; Domain location=14-141; Score =244.0; E_value=3.2e-70; Accession=PF02365.6; Description=No apical meristem (NAM) protein
MERLNFIKNGVSRLPPGFRFQPTDEELVFQYLKCKIFSCQLPASIIPEINVSKNDPWDLPGNCDEQERYFFSSKEAKYRNGNRMNRTTNSGYWKATGSDKKISSSISNIGFAGLRKTLVFYEGKSPNGSRTDWVMHEYRLVSLETIPSNSSQNYANEIGDWILCRIFMKKRSIESDNNNTAPRKNNAVTNYAQVAQPRFFDFLSVHNSAPPVPIQYSSTSSSCSSSNNVVEASSPNNHEETSSGYAHF

SEQ ID NO: 198379 - protein, 195 aa, Glycine max
  Coding DNA Sequence Number=SeqID_81601
  Gene Ontology: Mol. function=zinc ion binding; Cellular component =endoplasmic reticulum
  Homolog annotation: Hit_ID=Q1S9E2; Match level="QueryCoverage=97%, HitCoverage=40%, E-value=1e-57, Identity=64%"; Hit description=Zinc finger, DHHC-type
MDSEEISIWKAMIKTPASIALIIYSFISVWFVGGLTVFHTYLISKNQSTYENFRYRYDQQANPYDKGVAANFREIFCSSIPPSKNNFRSKILIPKEPSESSRRRTVESLSPMMRKTAGDLELGTTPGYNEFEEEEEESDYADEFTNDEEHGKVSGIGDDMSVDLTRMLHTEGGQREVASLLRHSLWERSSKENGT

SEQ ID NO: 198380 - protein, 78 aa, Glycine max
  Coding DNA Sequence Number=SeqID_81602
  Gene Ontology: Mol. function=metal ion binding; Cellular component =mitochondrial intermembrane space protein transporter complex; Biological process=protein import into mitochondrial inner membrane
  Homolog annotation: Hit_ID=Q1S9E0; Match level="QueryCoverage=74%, HitCoverage=75%, E-value=4e-25, Identity=86%"; Hit description=Zinc finger, Tim10/DDP-type
  Pfam annotation: Domain name=zf-Tim10_DDP; Domain location=1-63; Score=97.6; E_value=3.7e-26; Accession=PF02953.6; Description =Tim10DDP family zinc finger
MQEEQQRAMVNEMVAKLTSECWDKCITGTPGNKFSSSESNCLSNCAQRYLEMSMLIMKRFQERNKAVRMVMADDLWLM

SEQ ID NO: 198381 - protein, 181 aa, Glycine max
  Coding DNA Sequence Number=SeqID_81603
VVVRRHDEGACDGQQGCCHRERGEGSGTMWRTRSLPSHFKGVPSQEYACEGGAVVGVRTTISLKDKQATTRRGSDGEHITPKTALEDPIEGIGLESHVGKCGVYKALGSLTTKASYVMWFSQADIAVFVYESKTNQRVSAEPTHVHIGAVECGGMLGFICKVRNSSLTLEVRDSSMGFIQP

SEQ ID NO: 198382 - protein, 221 aa, Glycine max
  Coding DNA Sequence Number=SeqID_81604
  Gene Ontology: Mol. function=zinc ion binding; Biological process =ubiquitin cycle
  Homolog annotation: Hit_ID=Q1SR15; Match level="QueryCoverage=90%, HitCoverage=78%, E-value=5e-75, Identity=67%"; Hit description=Zinc finger, RING-type; RINGv
  Pfam annotation: Domain name=zf-C3HC4; Domain location=155-218; Score= 18.9; E_value=0.0018; Accession=PF00097.15; Description=Zinc finger, C3HC4 type (RING finger)
MVMCYIDASIKKYWECINYSSIFRRGDAHSIPSSIQGAASITSAASLDNSLSDMYRSPPRPLPYDAEPRYFRSQRDGLVSRREKGSSHSNEETEPLRSDADLDPESLNSGDKWNESACEAGSKEYHSKSSLRLQSTKYSTGVGLVYASSEEEDVCPTCLEVENTLLKEQDLWRFLLSKLFLLAEYTKENPKIMTKCSHHFHLGCIYEWMERSDNCPVCGKQ

SEQ ID NO: 198383 - protein, 172 aa, Glycine max
  Coding DNA Sequence Number=SeqID_81605
  Gene Ontology: Mol. function=protein serine/threonine kinase activity; Cellular component=integral to membrane; Biological process=protein amino acid phosphorylation
  Homolog annotation: Hit_ID=Q6L3I5; Match level="QueryCoverage=91%, HitCoverage=14%, E-value=4e-11, Identity=35%"; Hit description =Leucine Rich Repeat family protein
LGECTRIGGKTPSSLFSYKFNDLSDNLHNSVGIIPVNSHNRRLQPVRINVLSEVAEGRWYCSGEEVKHFEAREGGKTLLMDWQARQNIVGEVEVLEHDDSNKGGDNAAEDDEKGVGEGGKWEAPDGNRDGERVTSDAVPPTWVGGRGVPVGEGIFRIEKLPFCFEEEESVLG

SEQ ID NO: 198384 - protein, 42 aa, Glycine max
  Coding DNA Sequence Number=SeqID_81606
MEVTEAKSHPSVGKNDPPKIKGIPKNLAWKNIKSDGFMKLGE

SEQ ID NO: 198385 - protein, 866 aa, Glycine max
  Coding DNA Sequence Number=SeqID_81607
  Gene Ontology: Mol. function=sequence-specific DNA binding; Cellular component=nucleus; Biological process=regulation of transcription, DNA-dependent
  Homolog annotation: Hit_ID=Q1S1R1; Match level="QueryCoverage=90%, HitCoverage=100%, E-value=0.0, Identity=75%"; Hit description=START domain, putative
  Pfam annotation: Domain name=HALZ; Domain location=220-251; Score =6.3; E_value=0.084; Accession=PF02183.8; Description=Homeobox associated leucine zipper
  Pfam annotation: Domain name=Homeobox; Domain location=177-225; Score= 29.8; E_value=3.9e-06; Accession=PF00046.19; Description=Homeobox domain
  Pfam annotation: Domain name=START; Domain location=367-591; Score =297.9; E_value=1.9e-86; Accession=PF01852.10; Description=START domain
  Pfam module annotation: Pfam domain module=HALZ::Homeobox::START; Domain location=220-251::177-225::367-591
MFVPLGLIKASLVQLLRIPRTVWEERFGISVNESHPMDLMAKPPYDYDKSGSGGARINNFSDIPYNNNNVTNTTTTNNNNNDRMPFGAISQPRLVTTTPTLAKSMFNSPGLSLALVRDLQQTSIDGQEDVNRMAENSFEPNGLRRSREDEHESRSGSDNMDGGSGDEHDAADNPPRKKRYHRHTPQQIQELEALFKECPHPDEKQRLELSRRLCLETRQTQLERHENTLLRQENDKLRAENMSIRDAMRNPMCSNCGGLAIIGEISLEEQHLRIENARLKDELDRVCALAGKFLGRPVSSLPSLELGMGGNGFAGMPAATLPLAQDFAMGMSVSMNNNALAMVSPPTSTRPAAAGFDRSVERSMFLELALAAMDELVKMAQTGEPLWMRNVEGGREILNHEEYVRNFTPSIGLRPNGFVSEASRENGMVIINSLALVETLMDSNRWAEMFPCIIARTSTTEVISSGINGTRNGALQLMHAELQVLSPLVPVREVNFLRFCKQHAEGLWAVVDVSIDSIRESSGAPTFVNGRRLPSGCVVQDMPNGYSKVTWVEHAEYEESQVHQLYRPLLSSGMGFGAQRWVATLQRQCECLAILMSSAAPSRDHSAITAGGRRSMVKLAQRMTNNFCAGVCASTVHKWNKLNAAANVDEDVRVMTRKSVDDPGEPPGIVLSAATSVWLPVSPHRLFDFLRDERLRSEWDILSNGGPMQEMAHIAKGQDHGNAVSLLRASAINSNQSSMLILQETCIDAAGSLVVYAPVDIPAMHVVMNGGDSAYVALLPSGFAIVPDGPGSRGPHQNGPTSSTTTTTNGGDNGVTRVSGSLLTVAFQILVNSLPTAKLTVESVETVNNLISCTVQKIKAALHCES

SEQ ID NO: 198386 - protein, 260 aa, Glycine max
  Coding DNA Sequence Number=SeqID_81608
  Gene Ontology: Mol. function=zinc ion binding; Cellular component =integral to membrane; Biological process=defense response to bacterium
  Homolog annotation: Hit_ID=Q949G4; Match level="QueryCoverage=91%, HitCoverage=94%, E-value=6e-98, Identity=74%"; Hit description=N3 like protein
  Pfam annotation: Domain name=MtN3_slv; Domain location=10-98; Score =149.7; E_value=7.6e-42; Accession=PF03083.6; Description=MtN3saliva family
  Pfam annotation: Domain name=MtN3_slv; Domain location=132-218; Score= 128.2; E_value=2.3e-35; Accession=PF03083.6; Description=MtN3saliva family
  Pfam module annotation: Pfam domain module=MtN3_slv::MtN3_slv; Domain location=10-98::132-218
MAINHETWAFVFGLLGNVISFMVFLAPLPTFYQIYKKKSTEEFQSLPYVVALFSSMLWIYYALVKKDASLLLITINSFGCVIETIYLAIFLIYAPSKTRLWTIKLLLMLNVFGFGAMLLSTLYLTTGSKRLTVIGWICLVFNISVFAAPLCIIKRVIKTKSVEFMPFSLSFFLTINAVMWFFYGLLLKDYYVALPNTLGFLFSIIQMVLYLIYRNAKTPDLPMKLQELNSHTIDVGKLSRMEPSEPNHLTKNGTLTEREI

SEQ ID NO: 198387 - protein, 409 aa, Glycine max
  Coding DNA Sequence Number=SeqID_81609
  Gene Ontology: Mol. function=transferase activity; Cellular component= Golgi apparatus; Biological process=metabolic process
  Homolog annotation: Hit_ID=Q75ID3; Match level="QueryCoverage=73%, HitCoverage=94%, E-value=2e-87, Identity=50%"; Hit description =Expressed protein
  Pfam annotation: Domain name=FTCD_N; Domain location=110-305; Score =212.6; E_value=8.8e-61; Accession=PF07837.3; Description =Formiminotransferase domain, N-terminal subd
MGSSGYGRYASGLSGFGGCAMELSRFGGCTTELSEVWCICDEVVEVANDGVPPCRSMLNLIVRDKEKEREVVSFDDWGGGRGKFDDGIASVCDRGEEEAPFHCRLEDQSILLCCKFFVSESRNNATLNAIERAARSNPETVIVNMFHDRAYNRARYDLVSYVLHDCTGNPIYSPLHQTVIAMAEATFNAVNLEFHEGAHPRLGAVDDIVFHPLGHASLDEAAWLAKAVAADIGNRFSVPVFLYAAAHPTGKELDAIRRELGYYRPNSRGSQWAGWAMPETLPLSPDEGPNVVSRAKGITMIGARPWVTLYNVPILCTDVSVARRIARKVSARGGGLPTMQTIALVHEDSTEIACMLLDSKQVGADRVQNRVEMLAAQEGLDIEQGYFTDISPEMIVEKYMKLINSANKS

SEQ ID NO: 198388 - protein, 52 aa, Glycine max
  Coding DNA Sequence Number=SeqID_81610
MKEGQAIKVQSMKVTVGQESPIHTHVALTICVLKNKIGMVILRMIEAYGCKK

SEQ ID NO: 198389 - protein, 321 aa, Glycine max
  Coding DNA Sequence Number=SeqID_81611
  Gene Ontology: Mol. function=transcription regulator activity; Cellular component=nucleus; Biological process=regulation of transcription
  Homolog annotation: Hit_ID=Q9SP39; Match level="QueryCoverage=22%, HitCoverage=23%, E-value=6e-30, Identity=90%"; Hit description=BHLH transcription factor GBOF-1
  Pfam annotation: Domain name=HLH; Domain location=171-221; Score =34.0; E_value=5.1e-07; Accession=PF00010.16; Description=Helix-loop -helix DNA-binding domain
  Subcellular localization annotation: CTP_CleavageSite=44; ConfidenceScore=5.54e-01
MAAFSYQYHPFLVDPAFFPNNLNTPNSPPPPLPSQFQQLPHETSSFNVTNQETSCVDQSSKITISDNEPSVTKNLSPQSSMVVDKLETGEQVTQKVNIPVDKKRRTRNGSSFTSNPQSKDTATEGKNKKQRKNNGGLKEEDKAKEEKKDQRKCPEEPPTGYIHVRARRGQATDSHSLAERVRREKISERMKVLQRLVPGCDKVTGKALMLDEIINYVQSLQNQVEKLNSMASPSPLPSMSHCNSPNNQATTFADTTTMTPTNIFHTTSDYLLDNSVSFFLQGQRPNVLSEEDTGSHFWDAEDQRQKFLHPYGFSNNLCSFH

SEQ ID NO: 198390 - protein, 45 aa, Glycine max
  Coding DNA Sequence Number=SeqID_81612
MAPHIRQNTMFWITFLSSMGRAKEVGGGRMLSGIVTREEEVARLS

SEQ ID NO: 198391 - protein, 335 aa, Glycine max
  Coding DNA Sequence Number=SeqID_81613
  Homolog annotation: Hit_ID=Q06XL8; Match level="QueryCoverage=42%, HitCoverage=17%, E-value=8e-48, Identity=69%"; Hit description=KUP2
MSIEDDGSNSNESSSYRLTVIGTTGFTIQLGYESGRESVQQACVSVGFPIVQSVTDVIEMELVMTERRVRFSIEDEPESDARSEIRVQMQEELEDLYAAQEAGIAFILGHSHVRAKQGSSVLKKLALNFGYNFLRRNCRGPDVALKVPPVSLLEVGMIRRYTNNSFSSKSGGLLHDTTNHSKVNRSMKFRVSAKQEKQEEKKKQSLFNSVTKALDFSQVRSAEDAQLIEEAREATRSGERMSREQYGALRRKIGGTYKDFFKSYVEGLKCWILILPKPKEKVEARVSDREYQATFPHTASMIDLAAKMIREGRGLELMPMEVDPTAPNNCLLVSV

SEQ ID NO: 198392 - protein, 70 aa, Glycine max
  Coding DNA Sequence Number=SeqID_81614
  Subcellular localization annotation: CTP_CleavageSite=46; ConfidenceScore=5.24e-01
MVAASASETEASQTLIKIWARQRGGGEFRGRSRLGFRTRFRRRRVRGSVWRGAREEGSEALRVVEGVDEG

SEQ ID NO: 198393 - protein, 174 aa, Glycine max
  Coding DNA Sequence Number=SeqID_81615
  Pfam annotation: Domain name=C2; Domain location=9-100; Score=11.0; E_ value=0.024; Accession=PF00168.20; Description=C2 domain
MGASSGTVLEITVISCENLRVTEDPYVVVRAESLKCCTTKMAKDSGSNKTGLFSWNEKLMLNMPMHARSITFEVQCNRFKGLRPVGVARIAVSDFLGGAAVSENCLHELSYRLRDWEGKGNGVIHFGVRVVPPEERSNAAVKPVKGMTVSKDSGDYKSNEVVGVPFWWNYPNVI

SEQ ID NO: 198394 - protein, 180 aa, Glycine max
  Coding DNA Sequence Number=SeqID_81616
  Pfam annotation: Domain name=C2; Domain location=10-91; Score=15.0; E_ value=0.011; Accession=PF00168.20; Description=C2 domain
MEAKPQARTLEITVMSGENICVDRSSGAENVYVVVRAESLNSCTTKTVNEDKGVHAWNEKLLLDIPTHARSVTFEVQCKKYKGVRPIGVARIALSDFLSNDTKIVSESVPQMYCYGLRNWEGRQNGVIHFSVKVVSLAGDKYLCSETKQEKDIIGIEHSSLVELPKCSCLKFFFPIFRWR

SEQ ID NO: 198395 - protein, 191 aa, Glycine max
  Coding DNA Sequence Number=SeqID_81617
  Pfam annotation: Domain name=C2; Domain location=10-91; Score=12.9; E_ value=0.017; Accession=PF00168.20; Description=C2 domain
MEVKPQARTLEITVMSGENISMDRSSVAENVYVVVRAESLNSCRTKMVNEEGGVHAWNEKFLLDIPLYAKSVTFEVQCKKYKGVRPIGVARIALSDLLSNNTKVVSEGSVPQMLCYGLRNSEGRPNGVIHFSVRMVAPRDNLYSLTKQEKDITTMSSKGIEHEVMGIQVDPKISPHVAIGIPVWWSYQSVI

SEQ ID NO: 198396 - protein, 111 aa, Glycine max
  Coding DNA Sequence Number=SeqID_81618
  Gene Ontology: Mol. function=pseudouridine synthase activity; Biological process=RNA processing
  Homolog annotation: Hit_ID=Q9LU60; Match level="QueryCoverage=58%, HitCoverage=13%, E-value=6e-16, Identity=53%"; Hit description =Arabidopsis thaliana genomic DNA, chromosome 5, P1 clone:MWD22
MLYISEQTVDRSVKGLSADRSARISGVSLTSNFNEKVLNECEENSNGDFGIDPMCTNCPNLAPKGSSCGQAFSLLHHRYDSDEEGLWLHCIRYSGPGWTYECPYPDWAKLG

SEQ ID NO: 198397 - protein, 172 aa, Glycine max
  Coding DNA Sequence Number=SeqID_81619
  Gene Ontology: Mol. function=pseudouridine synthase activity; Cellular component=cytosol; Biological process=RNA processing
  Homolog annotation: Hit_ID=Q1S9F1; Match level="QueryCoverage=99%, HitCoverage=62%, E-value=2e-76, Identity=91%"; Hit description =Pseudouridine synthase
MKRKREGKEGMDNIVWQTPANPPHPNDYVFRNGIRYVRPYYFEFIAHVKNRWAGKTIVDLFAEEFKGRPYEYYVSAVKCGRIQVDGEMVPVSYIVKSSQKISHFLHRHEPPVMACEVPVLQKDIDVLTVCKPASVPFALNFIYAKAVNFSRCTHVVNIVRTLLLAFFKLSMG

SEQ ID NO: 198398 - protein, 448 aa, Glycine max
  Coding DNA Sequence Number=SeqID_81620
  Gene Ontology: Mol. function=protein binding; Cellular component =nucleus; Biological process=defense response
  Homolog annotation: Hit_ID=Q2QR00; Match level="QueryCoverage=83%, HitCoverage=47%, E-value=6e-48, Identity=34%"; Hit description=NB -ARC domain containing protein, expressed
  Pfam annotation: Domain name=LRR_1; Domain location=155-176; Score =13.6; E_value=0.74; Accession=PF00560.23; Description=Leucine Rich Repeat
  Pfam annotation: Domain name=LRR_1; Domain location=178-200; Score =10.9; E_value=2.7; Accession=PF00560.23; Description=Leucine Rich Repeat
  Pfam annotation: Domain name=LRR_1; Domain location=202-224; Score =15.8; E_value=0.16; Accession=PF00560.23; Description=Leucine Rich Repeat
  Pfam annotation: Domain name=LRR_1; Domain location=249-270; Score =3.1; E_value=74; Accession=PF00560.23; Description=Leucine Rich Repeat
  Pfam annotation: Domain name=LRR_1; Domain location=272-295; Score =9.7; E_value=4.4; Accession=PF00560.23; Description=Leucine Rich Repeat
  Pfam annotation: Domain name=LRR_1; Domain location=320-342; Score =0.5; E_value=2.3e+02; Accession=PF00560.23; Description=Leucine Rich Repeat
  Pfam annotation: Domain name=LRR_1; Domain location=369-391; Score =6.6; E_value=16; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=155-176::178-200::202 -224::249-270::272-295::320-342::369-391
MPSYLRHCFAFFSLYPKDFGFTGALIANLWAALGLLRSPVGSQKMENIARQYVDELHSRSFLEDFVDLGHFYYFKVHDLVHDLALYVSKGELLVVNYRTRNIPEQVRHLSVVENDPLSHVVFPKSRRMRTILFPIYGMGAESKNLLDTWIKRYKYLRVLDLSDSSVETLPNSIAKLQHLRALHLTNNCKIKRLPHSICKLQNLQYLSLRGCIELETLPKGLGMLISLRKLYITTKQSILSEDDFASLSNLQTLSFEYCDNLKFLFRGAQLPYLEVLLIQSCGSLESLPLHILPKLEVLFVIRCEMLNLSFNYESPMPRFRMKFLHLEHCSRQQTLPQWIQGAADTLQTLLILHFPSLEFLPEWLATMTRLKILHIFNCPQLLYLPSDMLGLTALERLIIDACPELCRKCHPQFGEYWSLIAHIKHISIGETKARQRLFRIQSQLRLRL

SEQ ID NO: 198399 - protein, 177 aa, Glycine max
  Coding DNA Sequence Number=SeqID_81621
MDKEEREILSNEEQKLYFILNVGIMKGYKDILLQFLEEEEDVMEGVQVNVYDKFLEEEEDVMEGIQVNVYDKGRHRFKLMLNKMIQVGLVTGELSPVWHTQLTFSCEELTWWQDPSSHSSSGRDKYLAKEERELLVEHWNWKRLRVEYFLEDEDVMEGIQVNVYFKGGHELEMILNK

SEQ ID NO: 198400 - protein, 357 aa, Glycine max
  Coding DNA Sequence Number=SeqID_81622
  Gene Ontology: Mol. function=protein binding; Cellular component =membrane; Biological process=defense response
  Homolog annotation: Hit_ID=Q2L360; Match level="QueryCoverage=99%, HitCoverage=48%, E-value=8e-63, Identity=38%"; Hit description =Putative CC-NBS-LRR resistance protein
  Pfam annotation: Domain name=NACHT; Domain location=197-357; Score= -26.9; E_value=0.0072; Accession=PF05729.3; Description=NACHT domain
  Pfam annotation: Domain name=NB-ARC; Domain location=150-357; Score= -59.1; E_value=1.6e-06; Accession=PF00931.13; Description=NB-ARC domain
  Pfam module annotation: Pfam domain module=NACHT::NB-ARC; Domain location=197-357::150-357
MAEIYVSNIAASLLGKLASHVYEEASRAYVVYEDLQGIKDSLSIVNGVLLGAEEKKELRQGLREWLRQIQNVCYDAEDVLDEFECQKLRKQVVKASGSTSMKVGHFFSSLNPLVFRLRVTRRIKDVRERLDKIAADGNKFGLERIGGDHRLVPRREMTHSHVDASGVIGRGNDREEIIKLLMQPHPHGDGDGDKSLCVIPIVGIGGLGKTTLAKLVFNDKRMDELFQLKMWVCVSDDFDIRQMIIKIINSAAYASAPAIATQENISSLDIEQLQSRLRYKLSGQKFLLVLDDTWNDDRAKWTELKDLIKVGAAGSKIIVTTRSNSIASMIGTVPSYILEGLSIENCLSLFVKWAFKE

SEQ ID NO: 198401 - protein, 58 aa, Glycine max
  Coding DNA Sequence Number=SeqID_81623
MSPQIASNDCAWRTMAPTKEFRSDRWVNDMSPQIASNDCAWRTMAPTKEFRQIVVSSK

SEQ ID NO: 198402 - protein, 160 aa, Glycine max
  Coding DNA Sequence Number=SeqID_81624
GLHVRGKPTPNIKVFAVVRAESITSHTTAMVTTTTTNGSDNGFQYLWNEKFWVELGPRARCVTIEVKCRTETGVVRDVGVARIAVSDFLGGSSVPDHCLQSLCYRLRDWDGRENGVVNFSVRVAPPPTPPPPPPPPPPAEGAEIYCSSSTSGTGVVTGIP

SEQ ID NO: 198403 - protein, 133 aa, Glycine max
  Coding DNA Sequence Number=SeqID_81625
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q9SWS7; Match level="QueryCoverage=99%, HitCoverage=36%, E-value=3e-57, Identity=84%"; Hit description =Chloroplast SRP receptor homolog, alpha subunit CPFTSY
  Pfam annotation: Domain name=SRP54; Domain location=62-133; Score= -53.9; E_value=2.7e-07; Accession=PF00448.13; Description=SRP54-type protein, GTPase domain
MALLVSDFGPRITIKIVENLREDIFSGKLKSGNEIKEALKRNVLELLTSKGSKTELQLGYRKPAVIMIVGVNGGGKTTSLGKLAYRLKNEGAKILMAAGDTFRAAASDQLEIWAERTGCEIVVAESEKAKASS

SEQ ID NO: 198404 - protein, 664 aa, Glycine max
  Coding DNA Sequence Number=SeqID_81626
  Homolog annotation: Hit_ID=Q84MH1; Match level="QueryCoverage=86%, HitCoverage=91%, E-value=1e-169, Identity=53%"; Hit description =Expressed protein
  Pfam annotation: Domain name=RAP; Domain location=592-649; Score =76.0; E_value=1.2e-19; Accession=PF08373.1; Description=RAP domain
  Subcellular localization annotation: CTP_CleavageSite=62; ConfidenceScore=5.30e-01
MEGLLNSLLNQSCLKPFGFTPRLGYTFPVITRTGNLNRKPESCTLRSYCTQLGRDSTGTSSRGASVAALDSDDKGEESSTDWELEFLGELDPFGYRAPKKREKEQRSKLLEATDGMDWCVRARKKALESIEARGMAHLVEDMVTVKKKKKKDKKKLESKKKVVKKIEKIEDLDFVLEEDLLQPMKPEIDVGDLKRRVSMFNDGMFIEKKEKTKEAFVNRLSQFSGPSDHRKEINLNKAITEARTADDVLEVTYETIVAVAKGLSPSPLSPLNIATALHRIAKNMEKVSMMRTRRLAFARQREMSMLVSIAMTALPECSAQGVSNISWALSKIGGELLYLSEMDRIAEVALTKVGEFNSQNIANIAGAFAAMQHSAPDLFSVLSERASDIIHTFQEQELAQLLWAFASLYEPADPIFDSLDIVFKDHSQLRGCTGERTSNNHEQIRVDRSGASNGSPVLTLTRDQLGTIAWSYAVFGQMDRSFFSHVWKTLSHYEERRISELYREDIMFASQVHLVNQCLKLEFPHLQLSLCGDLEDKVALARKTKRFNQKITSSFQKEVGRLLLSTGLEWVKEYVVDGYTLDAVIVDKKLALEIDGPTHFSRNTGVPLGHTMLKRRYITAAGWKVASVSSQEWEELQGAFEQVEYLRNLLKNHLEEGYAKTTFD

SEQ ID NO: 198405 - protein, 160 aa, Glycine max
  Coding DNA Sequence Number=SeqID_81627
  Homolog annotation: Hit_ID=Q941L2; Match level="QueryCoverage=72%, HitCoverage=66%, E-value=7e-11, Identity=34%"; Hit description=BON1 -associated protein 1
  Pfam annotation: Domain name=C2; Domain location=5-88; Score=24.1; E _value=0.0005; Accession=PF00168.20; Description=C2 domain
MSRTVEITVLSAENLQMNKKPIRGNAFVTVQSDASNDTSATTVDSEGGSYPSWNEKLVMDVPLHARFITVEVKCKTSSAGSNSIGVARIPVSDFVGGLWDGKVRRNGVVNISVRVKVAQQQQQQQQHSCNSNSMSLSSAVTGVPVAGNGSTGVVTGIPAI

SEQ ID NO: 198406 - protein, 155 aa, Glycine max
  Coding DNA Sequence Number=SeqID_81628
  Subcellular localization annotation: CTP_CleavageSite=46; ConfidenceScore=5.04e-01
MKTTIIHCIALHCIAPCISVVFFTGNRVVCVLRERRVRRGNRFGCEATKVAENRQKKTRLTHTREKRERIVTTYCYSGGGVDIFCGDAVFMPFSVSGRFYAYGLHVSVAALAGFGGLWLSEPWLELVIAFARGVLNPGPGISLYDMIIIILILLS

SEQ ID NO: 198407 - protein, 122 aa, Glycine max
  Coding DNA Sequence Number=SeqID_81629
MKRTHTECEGEDGYGYEDDDSPNRTRFHETNKTARRWEVGGWKYLSSHGMEEVVKERKKRGVFLVFTDLQKKKKKKKKKEGSHSYKDITSCEERSQRGTNSRRFEKKTKEERENEVSVTGLR

SEQ ID NO: 198408 - protein, 38 aa, Glycine max
  Coding DNA Sequence Number=SeqID_81630
AVCLLIYEFPEHKRNGSLGGSQVVKEFYKDNGNLKWVA

SEQ ID NO: 198409 - protein, 57 aa, Glycine max
  Coding DNA Sequence Number=SeqID_81631
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q9SWS7; Match level="QueryCoverage=97%, HitCoverage=13%, E-value=4e-12, Identity=86%"; Hit description =Chloroplast SRP receptor homolog, alpha subunit CPFTSY
LHTNYSLMEELISCKKSVAKVVPGAPNVFMCREFFGDSTGSGWDYRFEYVATSERIQ

SEQ ID NO: 198410 - protein, 72 aa, Glycine max
  Coding DNA Sequence Number=SeqID_81632
MNSLFMNRYGTLHGGSVGSLVEILSNACARTVVAKDKELFLGEISISYLSATPANQSEAEDVRKQAASTSTN

SEQ ID NO: 198411 - protein, 204 aa, Glycine max
  Coding DNA Sequence Number=SeqID_81633
MFYYCPSTGKRFYSYSDLMCYVNYAKKTKLGLYALAWDFPAIFVNVSCVVDIFCLSCCISAVTAVEGTELLKRKRTENDTTPVPEPKKTSTILSLPKDSKCYSSSGDDSSSDDLLSDDSSSDDSSSEDSSSDDSSSDDLSSDDSSSDDSSSDDDSSDPSISNESIKKDEDYAESVGSCSVESVGSCSVDSETSDATSGTTQVLK

SEQ ID NO: 198412 - protein, 250 aa, Glycine max
  Coding DNA Sequence Number=SeqID_81634
  Gene Ontology: Mol. function=fructose-2,6-bisphosphate 2-phosphatase activity; Cellular component=6-phosphofructo-2-kinase/fructose-2,6 -biphosphatase 1 complex; Biological process=fructose 2,6 -bisphosphate metabolic process
  Homolog annotation: Hit_ID=O81398; Match level="QueryCoverage=79%, HitCoverage=35%, E-value=2e-84, Identity=80%"; Hit description =Fructose-6-phosphate 2-kinase/fructose-2,6-bisphosphatase
  Pfam annotation: Domain name=PGAM; Domain location=64-215; Score =125.8; E_value=1.2e-34; Accession=PF00300.12; Description =Phosphoglycerate mutase family
MVYSSIRTSTVETDKLGRVVVNNISGYLPGRIVFFLDSEIFIFNRVGLGFLDQIKVNTHLTPRPILLTRHGESQDNVRGRIGGDTAISEAGELYSKKLAKFVGKRLKSERAASIWTSTLQRTILTATPIVGFPKIQWRALDEINAGVCDGMTYAEIKKNMPEEYESRKKDKLRYRYPRGESYLDVIQRLEPVIIELERQRAPVVVISHQVVCKSLSYIHACKDFIWLTVLIRELEKSSLLVNDDEYAEDI

SEQ ID NO: 198413 - protein, 506 aa, Glycine max
  Coding DNA Sequence Number=SeqID_81635
  Homolog annotation: Hit_ID=Q1T2D5; Match level="QueryCoverage=30%, HitCoverage=16%, E-value=3e-11, Identity=29%"; Hit description=Chromo
MRAFSEAVNHHEIGARVSLLASWSHIGLLADETLGDELADILLHGGPKQGNEVVIVGKPNLLLMENETASNSKVGGLTKLFQEFEVRHKKRIMVTCIDIDMRQVIAQKLGEVVLLFRCLADLRHKIFKALVISNDYEGTTPMAMPDMLVSRMNGSAKLVETRTGASFIASLRWRKASWASVDQGRPVKHGINLNGIGGDAGGKDHMSQDVIEDDRYESTKFWAHPRSPCKFDGTLVGGPVSRSSCHLSSSPKGQVKRTNSGAIESTPSTTCGCGGRWGGGEGARLAPGIVGYNRIKVITTKKLYPLLAMNPKEHWSLVSSDNNQEVIPTFCNEPKSVITTKKLYPFLAMNPNAVSLLSPVINQEANSASCNEPKSVGTESKLLGVAPDDALGGMRLKWAGVPLDAQDDVRSTKAQHKQVWRKLVVLDSEWSMRANTMAEKSVIIASHDLKGINGYGGHARHYIEAQVRGFKGQSNPLLIAVVTQTPIPVSAAPGEQMVKEAKTDWS

SEQ ID NO: 198414 - protein, 198 aa, Glycine max
  Coding DNA Sequence Number=SeqID_81636
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=54%, E-value=4e-16, Identity=30%"; Hit description =Integrase, catalytic region
MWDQVEDEYLVHPETNGQTEPFQATYGKAPPSIPQYLEGSFKVEVMDELMTTRAQLHFDFLCRLSKAQAAMKRIIDSHRRNVVYNVGDWFSSKHGTNPPELHPLPPLHSENQHVVKPLSILDWKLDNDNTPPIQKVLIQWANLASKDTSWEEWNTLHTSYNLGDKVILPEEGVDSNPNPGRSRSKRVHKTPPYLQDYA

SEQ ID NO: 198415 - protein, 138 aa, Glycine max
  Coding DNA Sequence Number=SeqID_81637
  Gene Ontology: Mol. function=carbohydrate binding; Biological process= fructose 2,6-bisphosphate metabolic process
  Homolog annotation: Hit_ID=Q93XR7; Match level="QueryCoverage=70%, HitCoverage=11%, E-value=1e-28, Identity=68%"; Hit description =Fructose-6-phosphate 2-kinase/fructose-2,6-bisphosphatase
MGTGASKDADEGSKEERERLDHAGGQLYVSLKMENHKLTGDLVPHVYGSVPLVGSWDPSKAVILIPNLFFLWFVCYWLFMERESMSMWELSFVVPPNHAYVEKRKESVALGNGFVAFTMRRVSGIEVSWQFCERNGVW

SEQ ID NO: 198416 - protein, 76 aa, Glycine max
  Coding DNA Sequence Number=SeqID_81638
MEKSDKMNFKEKKEKKGYITWEDNVINYSSDSEKKIISLGIMMKDYENGEEQSRYIDSNFSKHMACIKVYSYFSPR

SEQ ID NO: 198417 - protein, 60 aa, Glycine max
  Coding DNA Sequence Number=SeqID_81639
MEINSPKLMRKLGKGIRKAFGGVGTRKFPAVQMIFKKELLLGSVHCSSLGRMSINNERPM

SEQ ID NO: 198418 - protein, 147 aa, Glycine max
  Coding DNA Sequence Number=SeqID_81640
  Homolog annotation: Hit_ID=Q9ZUZ3; Match level="QueryCoverage=44%, HitCoverage=57%, E-value=3e-12, Identity=50%"; Hit description =Putative auxin-regulated protein
  Pfam annotation: Domain name=Auxin_inducible; Domain location=18-117; Score=85.2; E_value=2e-22; Accession=PF02519.5; Description=Auxin responsive protein
MDLAKGKWKQNMIFKAWERCRLTSRPHLKLKSLSENDDDDHHEKKKKKNSQIAPHGCFSVHVGPERKRFVVKTKYVNHPLFQMLLEEAEHEYGFESDGPIWLPCNVDLFYKVLAEMDGEENHNNNNNIIFHGSRRSFTTMAKNISGL

SEQ ID NO: 198419 - protein, 90 aa, Glycine max
  Coding DNA Sequence Number=SeqID_81641
  Gene Ontology: Mol. function=catalytic activity; Biological process =cellular metabolic process
  Homolog annotation: Hit_ID=Q6K7R8; Match level="QueryCoverage=93%, HitCoverage=23%, E-value=5e-07, Identity=38%"; Hit description =Putative dTDP-4-dehydrorhamnose reductase
MSKVKILVVGGTCYLGQHLLQVYAHANANANANISGTPFVFDLAFTHHSSPPPHPLLDAIPSSLPFQVDLKTGLGFEAISNTFGQVLFSP

SEQ ID NO: 198420 - protein, 176 aa, Glycine max
  Coding DNA Sequence Number=SeqID_81642
  Gene Ontology: Mol. function=catalytic activity; Cellular component =intracellular; Biological process=cellular metabolic process
  Homolog annotation: Hit_ID=Q6K7R8; Match level="QueryCoverage=97%, HitCoverage=54%, E-value=2e-65, Identity=68%"; Hit description =Putative dTDP-4-dehydrorhamnose reductase
  Pfam annotation: Domain name=Epimerase; Domain location=2-159; Score=- 65.9; E_value=0.079; Accession=PF01370.11; Description=NAD dependent epimerasedehydratase family
  Pfam annotation: Domain name=RmlD_sub_bind; Domain location=2-176; Score=-149.9; E_value=0.00031; Accession=PF04321.7; Description=RmlD substrate binding domain
  Pfam module annotation: Pfam domain module=Epimerase::RmlD_sub_bind; Domain location=2-159::2-176
MVPRACEIDPATAHAINLPSSLVKWLQSFEKRTTLLIHLSTDQVYEGEKSFYKEEDIAVPVNVYGKTKVAAEQFISENCPNFAILRCSIIYGPQTVSPVPKSLPNQWIDGALAKVEKVEFFQDEFRCPIYVKDLVNIILALTTQWISEGKQMQLLLNVGGADRVSRVQMAEAVAQF

SEQ ID NO: 198421 - protein, 262 aa, Glycine max
  Coding DNA Sequence Number=SeqID_81643
  Homolog annotation: Hit_ID=Q2QQY1; Match level="QueryCoverage=20%, HitCoverage=24%, E-value=3e-15, Identity=69%"; Hit description=SAM domain family protein
  Pfam annotation: Domain name=SAM_1; Domain location=198-258; Score =51.9; E_value=2.1e-12; Accession=PF00536.20; Description=SAM domain (Sterile alpha motif)
  Pfam annotation: Domain name=SAM_2; Domain location=194-260; Score =45.6; E_value=1.7e-10; Accession=PF07647.7; Description=SAM domain (Sterile alpha motif)
  Pfam module annotation: Pfam domain module=SAM_1::SAM_2; Domain location=198-258::194-260
MAELPAPEAQLNGGAPATTANSSEPIGSKRQRRPSVRLGDIGDQPYDSHPRRAAAKTWRLAFDHPRHSSSAAAAARPSKIRPLTNLTPAAAVAELGETLESDGNVDSVLIGSWKVKDSKKRGGGAKRIRSNWISRIDGGEDDDDDIIVDEDGYHHRDFSAEHSESPMREEHSPIMENLGVDEEREVQHYHERNGNSGSGDGVRVWLNGLGLGRYAPVFEIHEVDDEVLPLLTLEDLKDMGISAVGSRRKMFCAIQKLGKGFS

SEQ ID NO: 198422 - protein, 87 aa, Glycine max
  Coding DNA Sequence Number=SeqID_81644
MKEGEGGVMRRVQGFAQWTTRLLPLQECEGGGTMWRARSQSGEGAIVTGAIILQQKYAKLLQLSVFSCVLGPIQSKFFWGFPGKAGY

SEQ ID NO: 198423 - protein, 184 aa, Glycine max
  Coding DNA Sequence Number=SeqID_81645
  Gene Ontology: Cellular component=chloroplast thylakoid membrane
  Subcellular localization annotation: CTP_CleavageSite=44; ConfidenceScore=5.25e-01
MSSFVALQGLHGSLLSSQFLGQDTLTHFHPRNKASSTIQNKPTTAQQPSAKFDMLQIVGGRGLCNGEAGLKQELKKQVGVDEKGQTSATSGKEQEEEEESTSENPPPLKRSQGSKNLKLALSKKPKPPELPLLLPGMIAIVKNPNNPFYMYCKIVQRITDGKAGVLLEGGNWDRLITFTLEELE

SEQ ID NO: 198424 - protein, 169 aa, Glycine max
  Coding DNA Sequence Number=SeqID_81646
  Gene Ontology: Mol. function=acyltransferase activity; Cellular component=integral to membrane; Biological process=phospholipid biosynthetic process
  Homolog annotation: Hit_ID=Q9FPM8; Match level="QueryCoverage=78%, HitCoverage=32%, E-value=1e-28, Identity=47%"; Hit description=JD1
  Pfam annotation: Domain name=efhand; Domain location=19-47; Score =12.0; E_value=0.64; Accession=PF00036.22; Description=EF hand
  Pfam annotation: Domain name=efhand; Domain location=92-120; Score =33.5; E_value=7.2e-07; Accession=PF00036.22; Description=EF hand
  Pfam module annotation: Pfam domain module=efhand::efhand; Domain location=19-47::92-120
GRVQYHDFLRVLRLKACPLSAKIFSFIDVEKSGTITFRQFLYGSAHVMSQPGFHQACEEAFAGCGGAVKAYVVEQELRDFIQPVILNWSEDEVHELFMVFDNDNDGRIDKNDFLSCLRKTPLLIAFFTLQLQQKEFEARSVLHSWMSVTWAVFTPIQQLEFWFRDHADI

SEQ ID NO: 198425 - protein, 112 aa, Glycine max
  Coding DNA Sequence Number=SeqID_81647
MDSLIGHMRNDVFKFLIHAAITNGSNNKQQKGHRPYLDEEQKSNTSREKKRTQRREKQQLARKKNNHLVLEKQRGSQKNEEGGRKDRRWKKETKRLKEERRRRKAREIGKKK

SEQ ID NO: 198426 - protein, 122 aa, Glycine max
  Coding DNA Sequence Number=SeqID_81648
MEGIGIQDATCRGSTRGFLLDGQCQGPGYVTFKVYLTEQKVCCSSLDVPSSMYYFLKDKGWTHLHLGDVAECRLVFNHWRKSLKIEAEWKYLCETFSFTVDMEIVFEFIDLDVNRVLYWPCL

SEQ ID NO: 198427 - protein, 150 aa, Glycine max
  Coding DNA Sequence Number=SeqID_81649
MPSSHTLHQKSKKRKQIVDDLLSSTLNANVDEALTMILEDFLIKVDVVKEEDVRGVLPHKIRPRKPHPQDQAPIAAENTALQLGNKENDNVWEESWLRHKGYAMIRTLPVNGLKDLKVGVLMDKEALLWNYTLLEQIFEVEDVETILRTH

SEQ ID NO: 198428 - protein, 322 aa, Glycine max
  Coding DNA Sequence Number=SeqID_81650
  Gene Ontology: Mol. function=nucleic acid binding
  Homolog annotation: Hit_ID=Q1SDY9; Match level="QueryCoverage=57%, HitCoverage=50%, E-value=2e-29, Identity=56%"; Hit description =Peptidase S8 and S53, subtilisin, kexin, sedolisin; Zinc finger, CCHC- type
MASRLETETETLFSRRRPLRKRMSQSLTWRSRVARRESRSLWVLSFPFGRVSGWHVLESETASLRVWEIEWRRWRERGFDVEAFGNSAEKSVRGKKLHAEKVVEARILRTHKACALPELHLDGVGIAMDLVAFDLPQSLWDTVKNGSNPTPLLGNPTIAQMRNQNDEVAKESNALVIIQTALHDIFIKILKLETTKEAWDQLKEEFQGSERSKRMQGQNLRREFEDVKMKENESGTKKEENGKNFHLVLIATGTIILNILVGIGQISNVESAIDMVMQRRFVKIKQTNKYNKPKLLSMKNKMKSIYLLPLAVQQVITEKYGS

SEQ ID NO: 198429 - protein, 86 aa, Glycine max
  Coding DNA Sequence Number=SeqID_81651
  Gene Ontology: Mol. function=unfolded protein binding; Biological process=protein folding
  Homolog annotation: Hit_ID=P27323; Match level="QueryCoverage=47%, HitCoverage=5%, E-value=1e-14, Identity=90%"; Hit description=Heat shock protein 81-1
MGCRAEAENILGIHEDSQNKGKIVELLRYHSTKSGDEMTSLKDYVTRMKEGGSHVIRGFKIQRRSNPQTRLCIVGGFTCRPCDLRR

SEQ ID NO: 198430 - protein, 131 aa, Glycine max
  Coding DNA Sequence Number=SeqID_81652
  Gene Ontology: Mol. function=ATP-dependent helicase activity; Cellular component=cytoplasm; Biological process=RNA metabolic process
  Homolog annotation: Hit_ID=Q1S896; Match level="QueryCoverage=86%, HitCoverage=26%, E-value=3e-53, Identity=90%"; Hit description =Helicase, C-terminal
  Pfam annotation: Domain name=DEAD; Domain location=3-131; Score=84.9; E_value=2.5e-22; Accession=PF00270.19; Description=DEADDEAH box helicase
MVKPYQIADYPSWLCFSGKDVIGLAQTGSGKTGAFALPILHALLEAPRPKDFFACVLSPTRELAIQIAEQFEALGSEIGVKCAVLVGGIDMVQQSIKIAKQPHIIVGTPGRVIDHLKHTKGFSLSRLKYLV

SEQ ID NO: 198431 - protein, 371 aa, Glycine max
  Coding DNA Sequence Number=SeqID_81653
  Gene Ontology: Mol. function=ATP-dependent helicase activity; Cellular component=nucleus; Biological process=rRNA processing
  Homolog annotation: Hit_ID=Q1S897; Match level="QueryCoverage=84%, HitCoverage=38%, E-value=1e-101, Identity=63%"; Hit description =Helicase, C-terminal
  Pfam annotation: Domain name=DEAD; Domain location=219-368; Score =90.3; E_value=5.7e-24; Accession=PF00270.19; Description=DEADDEAH box helicase
  Pfam annotation: Domain name=ResIII; Domain location=215-344; Score= -30.6; E_value=0.017; Accession=PF04851.6; Description=Type III restriction enzyme, res subunit
  Pfam module annotation: Pfam domain module=DEAD::ResIII; Domain location=219-368::215-344
  Subcellular localization annotation: CTP_CleavageSite=38; ConfidenceScore=5.27e-01
MQSLCSAKTNKYTYEKTLNATVPATTANSSQRKPKRKRASARSDPELDRLDALPWNSALPPQNDDDDDAFSLFIGSNELEGGFLSLEEVDEAEYGLSIPEPEVNKRKTKKKKSEQNENLKKQQQDGIDGACSNAVVEAELDESVKSKEKKKKKNKTTNKKKDATVDQTVEQSDAGLDTNVKDDGGEEDVDETECYAWNELRLHPLLMKAICKLGFKEPTPIQKACIPAAAHQGKDVVGAAETGSGKTLAFGLPILQRLLEEREKAANMDEERGEEPEKYAPTGFLRALIIAPTRELALQVTDHLKAVAKHINVRVIPIVGGILAEKQERLLIAKPDIVVGTPGRLWELMSAGEKHLVEVIVNAMHYEFGYQ

SEQ ID NO: 198432 - protein, 120 aa, Glycine max
  Coding DNA Sequence Number=SeqID_81654
  Gene Ontology: Mol. function=cytochrome-b5 reductase activity; Cellular component=cellulose and pectin-containing cell wall; Biological process=electron transport
  Homolog annotation: Hit_ID=Q8W2K4; Match level="QueryCoverage=78%, HitCoverage=34%, E-value=3e-36, Identity=70%"; Hit description =Cytochrome b5 reductase isoform II
  Pfam annotation: Domain name=NAD_binding_1; Domain location=1-95; Score=82.9; E_value=9.7e-22; Accession=PF00175.11; Description =Oxidoreductase NAD-binding domain
MIAGGSGITPMFQLIRAILENPKDKTKVNLVYANVTVDDILLKEELDNFTNKFPQRFEVYHVLNKPPEQWNGGIGFISKEIIKSHCPEPAHDIQVELTTNYSMPIKNRIHIFYSCVDHIT

SEQ ID NO: 198433 - protein, 384 aa, Glycine max
  Coding DNA Sequence Number=SeqID_81655
  Gene Ontology: Mol. function=ATP-dependent helicase activity; Cellular component=nucleolus; Biological process=RNA metabolic process
  Homolog annotation: Hit_ID=Q1S897; Match level="QueryCoverage=92%, HitCoverage=42%, E-value=1e-130, Identity=68%"; Hit description =Helicase, C-terminal
  Pfam annotation: Domain name=Helicase_C; Domain location=108-178; Score=78.4; E_value=2.2e-20; Accession=PF00271.21; Description =Helicase conserved C-terminal domain
MRPNAAIIDLTNPSILAAKLEESFIECREEDKDAYLYYILTVHGQGRTIVFCTSIAALRHISSISWRQCLDSSCPNAAACTFEDVYLCKLHAINGLGMCGGWGICLSMQTSCNKRSGHVRGVGDAMDRFRENENGILVATDVAARGLDIPGVRTVVHYQLPHSAEVYVHRSGRTARASAEGCSIALISSRDTSKFASLCKSFSNDNFQRFPLENSYVPEVLKRLSLARQIDKITRKESQEKAEKNWFDRNASSVELVTENYDSEEEQVNKHKQMKISSRQLKKLQEAGVTPLMQEQLQQLARQKLSDHQGSGLGKKGKLVVIGQDCVDALQALRSAGEEVRMDVKDLAGKQRNMQNLKRKRKEEKKRLRDQRRKQKKKLKYGNE

SEQ ID NO: 198434 - protein, 122 aa, Glycine max
  Coding DNA Sequence Number=SeqID_81656
  Homolog annotation: Hit_ID=Q1RSK5; Match level="QueryCoverage=71%, HitCoverage=11%, E-value=2e-11, Identity=40%"; Hit description =Ovarian tumour, otubain
MKRNLVCINTLIVLMPTILLRSGQYRVGKIDLLMHGSHHHELTKSLVGHPYAGRLTSDEKIIIVDMTKSMVKPRNILLTLKEHNANSYTTIKQVYNARNAYRSSIRDSDIEIQQLMKLLEGD

SEQ ID NO: 198435 - protein, 150 aa, Glycine max
  Coding DNA Sequence Number=SeqID_81657
  Gene Ontology: Mol. function=nucleic acid binding
  Homolog annotation: Hit_ID=Q2HRL0; Match level="QueryCoverage=76%, HitCoverage=21%, E-value=1e-30, Identity=46%"; Hit description=RNA -processing protein, HAT helix
MDVVLMKGPYTIRNMPLILQEWRPDFDLKKDMLSTIPIWVELPKLPLHLWGETSLNKIGSAIGIPLVTDECTTHRLRVSYARILVEVDITQKMLDEITITDNKGLKRKQPIEYEWRPKFCEKCQTIGHQCDGATKHKIWKPKPKKVDPDK

SEQ ID NO: 198436 - protein, 115 aa, Glycine max
  Coding DNA Sequence Number=SeqID_81658
  Gene Ontology: Mol. function=RNA-directed DNA polymerase activity; Biological process=RNA-dependent DNA replication
MSFGLNNAGATYQRAMVALFHDTMHQEIEVYVDDLIAKTKTEEEHLINLQKLFERLRKCRNVPFRGRARARLTGALSKGGKMRGVATNVYLWKTSEKPKETGQNENSRFGSCIYV

SEQ ID NO: 198437 - protein, 130 aa, Glycine max
  Coding DNA Sequence Number=SeqID_81659
  Gene Ontology: Mol. function=chitin binding; Cellular component =extracellular region; Biological process=chitin metabolic process
  Homolog annotation: Hit_ID=O44238; Match level="QueryCoverage=75%, HitCoverage=31%, E-value=1e-08, Identity=31%"; Hit description =Endostyle-specific protein
MVAITPARFPQPPFSRGYDSNAMCAYHGGAPGHSIEHCMTLKCKDGPLGTSTLAFRGLHVLVIRGLHALTFRGLHVLAFRGVHALTFRGLHVLVIRGLQVLAIRGLQVLAIRGLHALTFRGLRVLAIVGS

SEQ ID NO: 198438 - protein, 54 aa, Glycine max
  Coding DNA Sequence Number=SeqID_81660
MKRSKIEAENAVGLVRQQKLCQGKNPLPETRLRVEQRPTRSLPPITFTDEDFEG

SEQ ID NO: 198439 - protein, 113 aa, Glycine max
  Coding DNA Sequence Number=SeqID_81661
MYTSMPLTRASEYFCKKTSPLTTTSSLIANNEDTNIILQGNQPCEQESTIKGMPVVGASEKGNPTNVAKMHSLKQRNAKEMEDLRKENVTCREKYLKIQEDQNTNSIVIATTH

SEQ ID NO: 198440 - protein, 153 aa, Glycine max
  Coding DNA Sequence Number=SeqID_81662
  Gene Ontology: Mol. function=RNA-directed DNA polymerase activity; Cellular component=intracellular; Biological process=RNA-dependent DNA replication
MLGINPKFHCHRLAICSKARPVAERKRKLGSEREKAMDEEAKKLLSVGFIREVQYTTWLANVVMVKKSNGKWKICTDYTNLNKAFPKDSYPISSIDYLVDGASIFPMLNFLDAYFGIVQIPAKSSLHDQTFLQSTEKVGGNKVEGGMDDFETS

SEQ ID NO: 198441 - protein, 87 aa, Glycine max
  Coding DNA Sequence Number=SeqID_81663
  Subcellular localization annotation: CTP_CleavageSite=31; ConfidenceScore=5.11e-01
MKDTTAGAAVETAAGYGIKPSSSDGSHLLVRRAMQFTMFVVGFAVLWMFLYNTASPFGFHGFSHYFIDESAKLCALHLELVVVNGGE

SEQ ID NO: 198442 - protein, 109 aa, Glycine max
  Coding DNA Sequence Number=SeqID_81664
MDEDQQNRKKIANTMIKINKKSKGNVQHYSYYGSGEKMKKNKKVAAAGVSLSEAYALSELGESGRKSVIHARAQRTIGSLSKSFISSRVQRAQLAKRKSTNSRLAGKWS

SEQ ID NO: 198443 - protein, 59 aa, Glycine max
  Coding DNA Sequence Number=SeqID_81665
MGTSRREELSHSERARVRVMRRKRMRVVKYMLMEQDPTPLDEVFVPHDTIAQTQVICIG

SEQ ID NO: 198444 - protein, 336 aa, Glycine max
  Coding DNA Sequence Number=SeqID_81666
  Gene Ontology: Mol. function=DNA binding; Biological process =regulation of transcription
  Homolog annotation: Hit_ID=Q8LFS2; Match level="QueryCoverage=98%, HitCoverage=93%, E-value=2e-86, Identity=45%"; Hit description =Regulatory protein
MKDTSAGDTVENAAGDGIKAWSSGSHLWVRRVMHVTMFLAGLAVLWMFLYNSASPFEFPTSSDYFSAESSKFGSMHQADYDPKLESVLANASMKDKTVIITILNDAWAEPGSMFDLFLESFRLGNETQWLLNHLVAITWDQKTYARCLAMHKHCYQLGTKGGNFTGEVFFMAPNYLQMMWRRTEFLGSVLEMGYNFVFTDTDIMWLRDPFKIFYKDADFQIACDVFNGNSSDLNNFPNGGFKYVRSNNRTIWFYKFWFYSRNVYPGHHEQSVLNNIKMHPLVSRMKLKMRLLSTSYFGGFCQLAEDFNRVSTMHANCCVGLESKVNDLKILLEDWK

SEQ ID NO: 198445 - protein, 72 aa, Glycine max
  Coding DNA Sequence Number=SeqID_81667
MHWMLLLSIVENIMLEWLKMICIQLMFSCNQSECKSHGCWHFIVQEKLGESRERERGNSGPLQYPIDRFSPP

SEQ ID NO: 198446 - protein, 74 aa, Glycine max
  Coding DNA Sequence Number=SeqID_81668
  Subcellular localization annotation: CTP_CleavageSite=46; ConfidenceScore=5.11e-01
MKKNTSAVKNAGGIKAWSFRSHQLLVRRVMQLTMFIAGLHVCWVFLSNSASSIEFHTFSHYFIAQLTKSPLLLQ

SEQ ID NO: 198447 - protein, 402 aa, Glycine max
  Coding DNA Sequence Number=SeqID_81669
  Gene Ontology: Mol. function=DNA binding; Biological process =regulation of transcription
  Homolog annotation: Hit_ID=Q8LFS2; Match level="QueryCoverage=99%, HitCoverage=52%, E-value=1e-53, Identity=51%"; Hit description =Regulatory protein
DNFTGEAFFMTADYLQMMWRRIEFLGTVLDMGYNFVFTDTDVMWLRDPFKLFYKDVDFQIACDFFNGNSHDLNNFPNGGFNYVKSNKRTILFYKFWFNSRNVFPKLHDQDVLNKIKKDSFVSNMKLKIRFLSTSYFGGFCQHAEDFNKVSTMHANCCFGLDNKVNDLKNLLDDWKKYVALPENEKNQSHPSWSVSCRASVERFKQRKQKNKGRFRRQALAVTEQAADMISPNSIVHCSGFLPVFDFDFQDMTEHKFYKDVDFQIACDVFNGNSSYLNNFPDGGFKYVKSNNRTIWFYKFWFYSRNDYPGHHEQSVLNNIKMHPLVSRMKLKMRLLSTSYFGGFRQLAEDFNRVSTMHANCCVGLENKVNDLKILLEDWKKYMAMSENEKKHSHPSWSVPQLC

SEQ ID NO: 198448 - protein, 145 aa, Glycine max
  Coding DNA Sequence Number=SeqID_81670
MAKEWRPTLKMLIFPLDGQWNYNSWFEADHFVDNEPHIPSFYFDLPLVLTQYLVLSYMCVPSTLFSSLSCSSSSTSFMIDIAMIVEEIFAQPIVREYILPSPGNEIPLLAYPLYNLVIQTEFLLPRHPIDWSSILEDYTDGANDE

SEQ ID NO: 198449 - protein, 146 aa, Glycine max
  Coding DNA Sequence Number=SeqID_81671
MEGRHKDERLIEKLKAHIELSRQPSPIEPNVPFLDTHVSTKGSCVDNWYGLYIDEHCPYLVALGRVYVGKSTLHNMLLIDDVWKAGVEEVHDATASALIPIEEFKLVEQTLNTFVAWSRCLVKPVSLKDSLGPKKLVHHISLKSKE

SEQ ID NO: 198450 - protein, 149 aa, Glycine max
  Coding DNA Sequence Number=SeqID_81672
MEAENKGGEVNGNEKNDTGMLNVYSAESHSWRHLCEPPSLFANSLHSYSGVVVVLGFHTSSVAVGNQIRVILVNRKVVQANQAVCDAPDVGSCGGPPVRPRSVATNTILNQQGQNAIDQKTSSLALDMYTLQERGAIEPCNRKLQYLLD

SEQ ID NO: 198451 - protein, 72 aa, Glycine max
  Coding DNA Sequence Number=SeqID_81673
MAPDSKNDLRRKGVQNLRKPVGSEQSILSGNKLGSPEEAIGTCILTLSCGFILKLERTFYVPSFFSKLYFCS

SEQ ID NO: 198452 - protein, 144 aa, Glycine max
  Coding DNA Sequence Number=SeqID_81674
METHELRKNASFRFPPHYGISRIAQACFLLISDTSRDFIYCASKDAKYLKAANQRLHVIKYCNFNDIIIIINFWSDEIIIIYLFNSSTSITQQQVAEIIGTLEEEWRNELEEENKMESRENEIGVEGGHQNGVIPKGIAVLSPN

SEQ ID NO: 198453 - protein, 139 aa, Glycine max
  Coding DNA Sequence Number=SeqID_81675
MSSLVMWANGKMRGGVRALVGEELGFVGSCRRCKSFWRRLMGWCLIMSKTSCCGKMINFGQGGLSYPRLQPNFHHKYGINVVVGFRSLLHNLWRSYNTLNQHHYTRVGRFRTWSGSLFDVLLYGQYGAIEIRLCFEKKF

SEQ ID NO: 198454 - protein, 512 aa, Glycine max
  Coding DNA Sequence Number=SeqID_81676
  Gene Ontology: Mol. function=acyltransferase activity; Cellular component=integral to membrane; Biological process=metabolic process
  Homolog annotation: Hit_ID=Q7XEP2; Match level="QueryCoverage=95%, HitCoverage=92%, E-value=0.0, Identity=68%"; Hit description =Acyltransferase family protein, expressed
  Pfam annotation: Domain name=Acyltransferase; Domain location=280 -409; Score=38.9; E_value=1.7e-08; Accession=PF01553.11; Description =Acyltransferase
  Pfam annotation: Domain name=Hydrolase; Domain location=19-213; Score= -3.2; E_value=0.088; Accession=PF00702.16; Description=haloacid dehalogenase-like hydrolase
  Pfam module annotation: Pfam domain module=Acyltransferase::Hydrolase; Domain location=280-409::19-213
MALSTFPTVNKCTSIGREKHTVVADMDGTLLIGRSSFPYFALVAFEAGGILRLLFYVLASPIAALLYYFISESAGIQVLIFASMAGMKVSSIESVARAVLPKFYAGDVHPESWRVFSSCGKRCVLTANPRVMVEPFLKEFLGADMVLGTEIASYKGRATGLICKPGILVGKKKADALKKAFGEEKPDIGLGDRQTDAPFMALCKEGYIVPPKPEVKSVSTDKLPKPIIFHDGRLVQKPTPLIALLTILWMPIAFPLACLRMAAGSLLPMHLVYYAFWALGVRVIIKGNPPPKVTKSNPNPNPNNNNDSGVLFICSHRTLLDPIFLSAALGRPIPAVTYSVSRLSEIISPIKTVRLNRDRAIDAAMIKKLLQEGDLAICPEGTTCREPFLLRFSALFAELTDELVPVAMVNRMSMFHGTTARGWKGMDPFYFFMNPSPAYEVTFLNKLPKELTCGAGKSSHDVANYIQRVIAATLSYECTGFTRKDKYRALAGNDGVVVEKGHILKANKVMGC

SEQ ID NO: 198455 - protein, 107 aa, Glycine max
  Coding DNA Sequence Number=SeqID_81677
  Subcellular localization annotation: CTP_CleavageSite=19; ConfidenceScore=5.02e-01
MAKHKSKSRSKNPQISLVRVSIRSRRWHCQSSFVGSGIGHNLVDVVVVVVECDGRQIVELDFHGGSVHKVASIISEMPDLECGDGVASHHSEGINGAKIQNLKKFKD

SEQ ID NO: 198456 - protein, 105 aa, Glycine max
  Coding DNA Sequence Number=SeqID_81678
  Pfam annotation: Domain name=zf-CCHC; Domain location=87-104; Score =7.8; E_value=0.051; Accession=PF00098.13; Description=Zinc knuckle
MKFFFLRLTSVKGVHEYIMQMRYILAQLKKLEVDMFESFLQEERLLMEMGESALLTTTYGKDKATESKLIKCGIVKIPPQAYIKKVAKCLFCKKKGDMKKNCPRF

SEQ ID NO: 198457 - protein, 84 aa, Glycine max
  Coding DNA Sequence Number=SeqID_81679
MDPGSFSVPCTIATNKIKTIVAKSHPSVEKEDPLKRNIIPKDPGKTMMSMKKGVGTTIQALGYEVGDYTRESLQKGKSPCSRVV

SEQ ID NO: 198458 - protein, 137 aa, Glycine max
  Coding DNA Sequence Number=SeqID_81680
MDTSTPTTSVVGRCKVRNLRLGLHQSLNLLGQCLNMLSKGKSNCFSFHLVDRPLHDSPIPIIVVGIGAHVPYHLDGISLHYREAPLKRGAGTLGPISDGVLWKYINAFVLQTTKRIVPFQFVRGDRVILVSPPLRIA

SEQ ID NO: 198459 - protein, 542 aa, Glycine max
  Coding DNA Sequence Number=SeqID_81681
  Gene Ontology: Mol. function=protein phosphatase type 2A regulator activity; Cellular component=protein phosphatase type 2A complex; Biological process=signal transduction
  Homolog annotation: Hit_ID=Q8L6I6; Match level="QueryCoverage=81%, HitCoverage=89%, E-value=0.0, Identity=72%"; Hit description =Hypothetical protein B'zeta
  Pfam annotation: Domain name=B56; Domain location=126-522; Score =1005.0; E_value=2.5e-299; Accession=PF01603.10; Description=Protein phosphatase 2A regulatory B subunit (B56 family)
VDASACGFSQLEWLVNKFRKDHSTYGNWDILPLEIVVLFDLKGFSQVVCSGSEVHEKGGGAITSPSTTSTSSRSSDLARFHYGNSTASPLSGLNSNSFPGLNHGDKFPHAVNSKLNGSLAASSYEALPSFKDVPNSEKQNLFIRKVQMCCFVFDFTDPTKNLKEKDIKRQTLVELVDYVSSANSKFTEIMMQEIVKMVSVNLFRTWTSPLRENKVLEAFDVEDEEPLMDPAWPHFQIVYELLLRFVASPETDAKLAKRYVDHSFVLKLLDLFDSEDPRERDYLKTVLHRIYGKFMVHRPFIRKAINNIFYQFIFETEKHNGIAELLEILGSIINGFALPLKEEHKLFLARVLIPLHKPKCIPIYHQQLSYCITQFVEKDCKLADTVIQGLLKYWPITNSSKEVMFLGELEEILEVTQPAEFQRCMVAERALFLWNNDHIENLIKQNCKIILPIVLPALEKNARNHWNQAVQSLTINVRKIFADTDPELLEECLRKFKEDEAQEKALKLKREATWKRLEEIAAMKAASNEPVLVSPRTASSSG

SEQ ID NO: 198460 - protein, 90 aa, Glycine max
  Coding DNA Sequence Number=SeqID_81682
  Homolog annotation: Hit_ID=Q6Z236; Match level="QueryCoverage=48%, HitCoverage=7%, E-value=2e-07, Identity=52%"; Hit description =Pentatricopeptide (PPR) repeat-containing protein-like
MLQGFVKVWDLNDARGVFDTMPEKNVISFTTMIDGYAKAGDMATVTNHHEPREGGAQQSKKKLNGEEKLVRKMMLFRKTHSQGPANGLTS

SEQ ID NO: 198461 - protein, 477 aa, Glycine max
  Coding DNA Sequence Number=SeqID_81683
  Homolog annotation: Hit_ID=Q6F3A8; Match level="QueryCoverage=25%, HitCoverage=11%, E-value=1e-15, Identity=43%"; Hit description =Putative cell wall protein
  Subcellular localization annotation: CTP_CleavageSite=78; ConfidenceScore=5.83e-01
MPSLTSPANVFTFGNNSNQNNGPAASSPTFSSPFPPLTNNFTGQNIFSSSSLAGSISSVSANVTSTSTDTATSTPAVVAASNSSSSTQVSSSSPTTSFFKFGSTPSAPTSLLVSSSGSEPLENKSGTGSVIFGSSSAAIGSTGSDIFGFSTPAMTGNSQSLGSVFGTTSGSVPGTQVSSGTSGFSTSSESQSVAFGSSASASLFGLTGSTTFSSGSSLFSSSSSVPNNFNAGTTSGQSTPAASSETNPVSSSSGMSSSVFGLSSWQPSKSSFGSSFSSSSSPSSGFSFGSSFSSSSSSTPGFSFGGTSTSSVTSSSSPMMFGSSAVASTPQFSFTSATATTNTQPAFGSSTPAFTFGGSALAPVNNDQMSMEDSMAEDTVQATPPATPVFGQQPAPLQSNFAFGALAPTGVSPFHFATQQNIAPQNPSPFQASGSLEFNAGGSFSLGTGGADKAGRKYVKVRHNRPRKKLHFINATN

SEQ ID NO: 198462 - protein, 68 aa, Glycine max
  Coding DNA Sequence Number=SeqID_81684
MPTSLTDKSSEAKKISHDHESAMDFLQAVGEKFMTFDKEHKSLFEKTKYDGTSVSWCTRTHHKVGALL

SEQ ID NO: 198463 - protein, 239 aa, Glycine max
  Coding DNA Sequence Number=SeqID_81685
  Homolog annotation: Hit_ID=Q9AV08; Match level="QueryCoverage=36%, HitCoverage=21%, E-value=1e-17, Identity=48%"; Hit description =Putative flavin-containing monooxygenase
MNNITTIKFNSNGLTLFEKEVVKVEKKGTEWVVEWKRKSQKGDSLSREGLDAAIVCSGHSAEPKLAEVLGIDTWHGVHMHSYNYRVPQPFNNQVVILIGLFDISRDIAHVAKEVHTATRLNPDLAGMKFGDYGNIMFHTTFVLVTHVFTLARRRHHRGKAFVTTTFVRPLTLILMSSMKPTRCTGLPLEHNHHQQQHDKHSNANTEDNTRVPNPYQSHATQLANKFKVQGDKLVLGKVD

SEQ ID NO: 198464 - protein, 281 aa, Glycine max
  Coding DNA Sequence Number=SeqID_81686
  Gene Ontology: Mol. function=hydrolase activity; Biological process =metabolic process
  Homolog annotation: Hit_ID=Q9LK21; Match level="QueryCoverage=100%, HitCoverage=63%, E-value=2e-76, Identity=56%"; Hit description =Arabidopsis thaliana genomic DNA, chromosome 3, TAC clone:K17E12
  Pfam annotation: Domain name=Abhydrolase_3; Domain location=156-281; Score=-16.7; E_value=1.4e-06; Accession=PF07859.3; Description =alphabeta hydrolase fold
MPSVAVKLYSVFFKFLLKHRLHNRIQTTSEPSDPFGVTTRPEESVAPANPSFSDGVATKDIHIDPLTSLSIRIFLPESALTPPEPHSNPRSDPLPRSARADPVSRRSSYGPPLREEHRSSSFGGSSGVEGLNLMSDGVYRGYAPGKRGERRRLPVMLQFHGGGWVSGGSDSVANDAFCRRIAKVCDVVVVAVGYRLAPENRYSAAFEDGVKVLNWLAKQANLAECSKSMVGGKSGGHNVGGEFKKSDSHKHIVDSFGASMAEPWLAAHADPSRLLLFSDDC

SEQ ID NO: 198465 - protein, 175 aa, Glycine max
  Coding DNA Sequence Number=SeqID_81687
  Gene Ontology: Mol. function=hydrolase activity; Cellular component =nucleus; Biological process=metabolic process
  Homolog annotation: Hit_ID=Q9LK21; Match level="QueryCoverage=97%, HitCoverage=37%, E-value=2e-87, Identity=90%"; Hit description =Arabidopsis thaliana genomic DNA, chromosome 3, TAC clone:K17E12
  Pfam annotation: Domain name=Abhydrolase_3; Domain location=1-141; Score=12.8; E_value=1.7e-08; Accession=PF07859.3; Description =alphabeta hydrolase fold
MASSCGANIADYVARKAVEGGKLLDPVKVVAQVLMYPFFIGSVPTRSEIKLANSYFYDKAMCTLAWKLFLPEEEFSLDHPAANPLVPGRGPPLKLMPPTLTVVAEHDWMRDRAIAYSEELRKVNVDAPVLEYKDAVHEFATLDVLLKSPQAQVCAEDIAIWAKKYISLRGHEFSY

SEQ ID NO: 198466 - protein, 82 aa, Glycine max
  Coding DNA Sequence Number=SeqID_81688
MRFVVAFREEFYKLYLPTLGDIKERALTILDEIEGKVINTDSIESEQLESSEKHYRVATVKSVIASTRKSIIEKLESSEIDD

SEQ ID NO: 198467 - protein, 224 aa, Glycine max
  Coding DNA Sequence Number=SeqID_81689
  Homolog annotation: Hit_ID=Q1RU78; Match level="QueryCoverage=31%, HitCoverage=39%, E-value=2e-15, Identity=61%"; Hit description =Repetitive proline-rich cell wall protein 1.-related
MRKASTLQCSLWRFGVSLLLVASFICASSVMATSEVSGNEVDTDGKLVNEEPAKTSLQGYDEEEKFKGLFPKSIPIVKPIPKLVKPIPIPVYKPIPKPIPLVKPISKPIPIIKSISNEEEKFKGLPKPIPVIKPIPKLIPVVKPIPVPIYKPTPKLIPIIKPIPIVKPVPKPFTVQKPIPAIDPESFLKPKPFFEKPIPKLPLDPKFKKPLLPPFPIQKPISSP

SEQ ID NO: 198468 - protein, 112 aa, Glycine max
  Coding DNA Sequence Number=SeqID_81690
MDLGVAQFHHTFVGFDDAKVESNKVAYKVTSTNIQRLSASRLIQGQTNKIKKKDKASNNLIGVNVCIHDFDDVKEESNKAASNDKAFASRIIQECFNKQSHVSRFIKDQALP

SEQ ID NO: 198469 - protein, 132 aa, Glycine max
  Coding DNA Sequence Number=SeqID_81691
MTLLPPLPSPPLFIILFSCRNLTFFRDAHPPTGLRQDQLGVYAVHGILRIPSTYTINFTLLPKFLSLYGKSHESWLKEIKESPSVYVTPSLILKHIFDRNPPQAGAIILLVSLFKVGNGESKPPRLKCDMTN

SEQ ID NO: 198470 - protein, 116 aa, Glycine max
  Coding DNA Sequence Number=SeqID_81692
MVLLHVLELRTELWLPGPEPPKQIRNGEAEEMKWEKLNGRQDEVEAERIASSATIPLDKISKVCRGSDLPLRPCSGLCLHIVIAISMAVRHYGTPWLSFIPTPLQILFLDKGNLPL

SEQ ID NO: 198471 - protein, 388 aa, Glycine max
  Coding DNA Sequence Number=SeqID_81693
  Gene Ontology: Mol. function=protein kinase activity; Cellular component=plastoglobule; Biological process=protein amino acid phosphorylation
  Homolog annotation: Hit_ID=Q01FN3; Match level="QueryCoverage=78%, HitCoverage=20%, E-value=1e-109, Identity=64%"; Hit description=[R] KOG1235 Predicted unusual protein kinase
  Pfam annotation: Domain name=ABC1; Domain location=185-305; Score =155.2; E_value=1.8e-43; Accession=PF03109.7; Description=ABC1 family
  Subcellular localization annotation: CTP_CleavageSite=55; ConfidenceScore=5.71e-01
GFIFQLRFRASMDSIYASSSCTVPHLLRRETLFSPRASNSVLLRRAKKARRERVSCSAATTGSGVGSNGAVSRALQGLSNNSNTALEQLDIERGVCIPFRKYSPEICLSIYDTPCIQAMLGLKLGKDEEVVPYRARQLRNLLCDLGPSFIKAGQVLANRPDIIREDYMNELCILQDDVPSFPNQEDLGQPLEAVFSKISSGTIAAASLGQVYRATLRATGEDVAIKVQRPGIEPIIYRDLFLFRTLASFLNGISIQKLGCNAELIVDEFGEKLLEELDYTLEARNLEDFLENFKNDPTVKIPQVYKQFSGQRVLVMEWIDGIRCTNPQAIKEAGIDVDGFLTIGVSAALRQLLEFGLFHGDPHPGNIFAMRDGRIAYVDFGNVAVLSQ

SEQ ID NO: 198472 - protein, 250 aa, Glycine max
  Coding DNA Sequence Number=SeqID_81694
  Gene Ontology: Mol. function=RNA-directed DNA polymerase activity; Cellular component=nucleus; Biological process=RNA-dependent DNA replication
MEKIVSPCGCNFAPHRQSKDSIVITQEVIHSMRSRKGGKGLMTIKIDLEKMLWRGEALESFNPSRVIRQGDPISPYLFVLCMERLSQMINVAVDSNLWKPIQLGRKGPKLSHLVFVDDLILYVEAFMNQVEINVNWNVREEISQGPGFQQTDNLGKYLGIQLHHKRTDNVMGTSFESQPNMVVVMSVYVVNKEKAGSNLWSGIKVVWDSFIENADCVHDPSVPFNFWYGNCLTPYGQLDRWATRELTHDD

SEQ ID NO: 198473 - protein, 167 aa, Glycine max
  Coding DNA Sequence Number=SeqID_81695
  Gene Ontology: Mol. function=RNA-directed DNA polymerase activity; Biological process=RNA-dependent DNA replication
MNNEGVWLDNPDELEKMVTKFCSDLFQEKDVHEEFCLKGRFPKLDESEVEMLRCSIFNEEVKKTIFHMESFKARGEDGFHNVFYQSQWKVVEPSLCSIIKDLFHNPSRALCKRYAKTQSYMQCGTMSVKNLAERLGIHNKTDDTLVSQVTFTRLKGPLKPGVFAHKA

SEQ ID NO: 198474 - protein, 90 aa, Glycine max
  Coding DNA Sequence Number=SeqID_81696
  Homolog annotation: Hit_ID=Q1RY42; Match level="QueryCoverage=47%, HitCoverage=4%, E-value=7e-12, Identity=76%"; Hit description =Ribosomal RNA methyltransferase RrmJ/FtsJ
MDPSYNHAGWKQERDKGYLPSYTDIRYNEQMEDLMDQAYERFLIRKEGSAKQRKLIKKSYDAKAQLLEEIRKMRDYNVILQTSMNNATDN

SEQ ID NO: 198475 - protein, 212 aa, Glycine max
  Coding DNA Sequence Number=SeqID_81697
  Homolog annotation: Hit_ID=Q67X40; Match level="QueryCoverage=69%, HitCoverage=81%, E-value=1e-31, Identity=44%"; Hit description =Integral membrane family protein-like
  Pfam annotation: Domain name=DUF588; Domain location=48-197; Score =173.6; E_value=4.9e-49; Accession=PF04535.3; Description=Domain of unknown function (DUF588)
MKSEVSAVTRVVDKNKGIDKGKGVTWAVSVSEKDSFSSTKAAPFSRWKKGIAVTDFVLRLGAIGAAMGSAVTMGTNEEQLPFFTQFLQFHAQWSDFPVFQFFVFANGVISGYAILSLPFSYVCIVQPHAVRPRLLLMTFDTVMMGLISVAAAGAAAIVYVGHNGSQDANWMAFCQGFTNFCQAASEAVVLSFVAAAFFLCLVPLSALALKSN

SEQ ID NO: 198476 - protein, 153 aa, Glycine max
  Coding DNA Sequence Number=SeqID_81698
MKSDNLDKNAISEKEATKTNLHKLDKRHNPDKCQPLPKRPRRLLGPKGQDRELIQARYLAQFVKRLDNHQVEARPGGHQEEQYTNNNGVSDNLHKNRNPPNRLEGINLVNQDDPVVVSIIIANFMVSKVLIDQASWKLACGASMEAGSLSFNE

SEQ ID NO: 198477 - protein, 54 aa, Glycine max
  Coding DNA Sequence Number=SeqID_81699
MEQHGKGFNKTISLFYPFKDVKDGALLGKEYITIEEEAVDEEQGAAEQGDDAYV

SEQ ID NO: 198478 - protein, 107 aa, Glycine max
  Coding DNA Sequence Number=SeqID_81700
MDQDGNQNHVCYCHGAWFVVKLNLQAIVHFFLAFLSNVENPSHTVVQKLEGTVLNMVIFIVLIALITFLLHSTCASPPFSSSSTLSSLASLAAIRSCRHWFMTYVQR

SEQ ID NO: 198479 - protein, 73 aa, Glycine max
  Coding DNA Sequence Number=SeqID_81701
MCDGIIDTLLNIQGKTKDGLNTRQDLTEMGIRDQLHPRSNEEVIEFCSKYIEKEKLVGLSKSRHDEKVRGKGS

SEQ ID NO: 198480 - protein, 107 aa, Glycine max
  Coding DNA Sequence Number=SeqID_81702
  Subcellular localization annotation: CTP_CleavageSite=43; ConfidenceScore=5.31e-01
SSTSNVFYGLSQMFVTTSNTPPSAYNLALPSSCYRPSLSTQMRDMGHEDEEEEDDNNNNNDDDDNNGGGDHVPQQQHTIIREHPRTRRGRDHRPRGQQTQTNSGTTR

SEQ ID NO: 198481 - protein, 109 aa, Glycine max
  Coding DNA Sequence Number=SeqID_81703
ILRPGRFDTNDGGRYPYVHEKPEEENSIGSKLIAKKNYGVVGGTSHASLSLKADNLASLHYMQLFNAVSTLKIMMAKAASHMCHGCFPRAVIPNPKTRDQSVVVVGAHF

SEQ ID NO: 198482 - protein, 269 aa, Glycine max
  Coding DNA Sequence Number=SeqID_81704
  Homolog annotation: Hit_ID=Q6K5G3; Match level="QueryCoverage=94%, HitCoverage=35%, E-value=3e-77, Identity=60%"; Hit description =Ankyrin repeat-like protein
MPNTYFPLRWESTGDQWWYASPIDCAAANGHYDLVRELLRIDNNHLFKLTSLRRIRRLEVVWDGEEEQQFSDVAKCRSQVAQKLLLECESKRGSSSSSKNSLIRAGYGGWLMYTAASAGDLSFVQLLLERNPLLVFGEGEYNVTDIFYAASRGRNCEVFRLVFDFAVSPRFITGKGGVLEEHVGGDVPPVYKWEMSNRAVHAAARGGSVEILVEYLANCSDVLAYRDAQGSTLLHSAAGRGQVEVLIEYKMLWMHAVTNTWHRILSLIT

SEQ ID NO: 198483 - protein, 426 aa, Glycine max
  Coding DNA Sequence Number=SeqID_81705
  Homolog annotation: Hit_ID=Q6K5G3; Match level="QueryCoverage=70%, HitCoverage=42%, E-value=1e-59, Identity=44%"; Hit description =Ankyrin repeat-like protein
  Pfam annotation: Domain name=Ank; Domain location=71-105; Score=20.5; E_value=0.0059; Accession=PF00023.20; Description=Ankyrin repeat
AQLAAVETIVSASPALISLQNNAGETFLHKAVSGFQSTSFRRLDRQVELLRQLVSGKKFHIEEVINAKNTDGRTALHIATIGKIHTDLVKLLMTAPSINVNVSDANGMTPLDYLKQNPNPAASNVLIRKLIAAGGMFHHHSSRKAIASHMKMHSIGGSPGTSFRISDTQIFLYTGVENASDASTDQGSAGMSSTSSEHTAYDSAAENRPSTTSKRPSVAAGLKRVLQWPLVKDKKSEGIRKSIDEGSLDSCRKWDISDEIPTPLRQKFFRHSALPNNKRNLSVRSYQSSPNAKKRFASGLVHVKVSRRSSSSSFSISSFSSPRSIDNKQKGFCVDNDVAGPSCSSHKNDKSTNSGKRASVSKKLRGHYFCFSKASVDKEQESHCYKDHDVFAGYCQIQKRKRCRINAKLHCRDLRASSAFIVCKFF

SEQ ID NO: 198484 - protein, 288 aa, Glycine max
  Coding DNA Sequence Number=SeqID_81706
  Gene Ontology: Mol. function=hydrolase activity; Biological process =metabolic process
  Homolog annotation: Hit_ID=Q9LK21; Match level="QueryCoverage=97%, HitCoverage=63%, E-value=9e-74, Identity=55%"; Hit description =Arabidopsis thaliana genomic DNA, chromosome 3, TAC clone:K17E12
  Pfam annotation: Domain name=Abhydrolase_3; Domain location=156-283; Score=-3.7; E_value=2e-07; Accession=PF07859.3; Description =alphabeta hydrolase fold
MPSVAVKLYSVFFKFLLKHRLQNRIQTTSDHSDPFGVTTRPEESVAPANPSFSDGVATKDIHIDLLTSLSIRIFLPESALTPPEPHSKPRPDPEPRSARANPVSRRNSYGPPLREELRSNSFGGRSGVDGLNLMSDGVYRGYAPGKRGEQRRLPVMLQFHGGGWVSGGSDSVANDAFCRRIAKVCDVVVVAVGYRLAPENRYPAAFEDGVKVLNWLAKQANLAECSKSMGGGKSGGHGVGGEFKKSDSHKHIVDSFGASMVEPWLAAHADLSRLLLFCHDCVSYFDSI

SEQ ID NO: 198485 - protein, 56 aa, Glycine max
  Coding DNA Sequence Number=SeqID_81707
MTAKDDGKGDEKGLSGQPLGRGPKQLEWANSHSPRLAQINSHARKRAKTVSSYNTV

SEQ ID NO: 198486 - protein, 203 aa, Glycine max
  Coding DNA Sequence Number=SeqID_81708
  Gene Ontology: Mol. function=carboxylesterase activity; Cellular component=nucleus; Biological process=metabolic process
  Homolog annotation: Hit_ID=Q0ZPU8; Match level="QueryCoverage=77%, HitCoverage=35%, E-value=3e-80, Identity=91%"; Hit description=CXE carboxylesterase
  Pfam annotation: Domain name=Abhydrolase_3; Domain location=1-153; Score=41.0; E_value=2.5e-10; Accession=PF07859.3; Description =alphabeta hydrolase fold
MVVGALCPRCVLLGASCGANIADYVARKAVEGGKLLEPVKVVAQVLMYPFFIGSVPTRSEIKLANSYFYDKAMCMLAWKLFLPEEEFSLDHPAANPLVPGRGPPLKLMPPTLTVVAEHDWMRDRAIAYSEELRKVNVDAPVLEYKDAVHEFATLDVLLKSPQAQLCGFYETMTAFKVLICKAELCPLRTGLHFAGIFITTNYV

SEQ ID NO: 198487 - protein, 55 aa, Glycine max
  Coding DNA Sequence Number=SeqID_81709
MTTTMPSKTVVEKGESSLQKRCFLPPSLLKNMVITKMPPIKQQRRILNTDVEGAS

SEQ ID NO: 198488 - protein, 156 aa, Glycine max
  Coding DNA Sequence Number=SeqID_81710
  Homolog annotation: Hit_ID=Q1SDA6; Match level="QueryCoverage=26%, HitCoverage=11%, E-value=3e-14, Identity=82%"; Hit description=Myb -like DNA-binding domain, putative
MDKPPIQTVQVLDDSTDPAIKLNNCPAIMFPKDRILWTQDELLRSQYQLGAMMDSFKHMGISFGIEKGKVDNGGGRNFDQVHYGQWRRFVEIIAEKYRIVEMREQLQAKVEKNLKQLQKLWKEMKTRRVALDKGLIDRAMAGIMVGVFSKDVGLQI

SEQ ID NO: 198489 - protein, 131 aa, Glycine max
  Coding DNA Sequence Number=SeqID_81711
MEGFKLVSEVVPDFEGLIVKVKGQRIQGTIPKHFLNVFSSYISAYDDFVPNVGLLFKNCVDIVRSRQHTNYLIDVVGAITAVSNEREYAFAHEVRKFITIELIDMRFTFIPTMMFSLLQKRVFTTLFLRQF

SEQ ID NO: 198490 - protein, 100 aa, Glycine max
  Coding DNA Sequence Number=SeqID_81712
MREEWRDGVGVTEKEKEEVVLTKKKSKRNERQFGGFLLLSHDPKQFGGFLLLSHDPKCRRIKIVQAHGDNKVEEDNYLDSDSSALIIETFDTSTQQVKCI

SEQ ID NO: 198491 - protein, 58 aa, Glycine max
  Coding DNA Sequence Number=SeqID_81713
  Homolog annotation: Hit_ID=Q1S7H5; Match level="QueryCoverage=81%, HitCoverage=3%, E-value=5e-09, Identity=60%"; Hit description=PWWP; Regulation of nuclear pre-mRNA protein
MPPSRRKGRKKSNSDAAACQQFKLGDLVLAKVKGFPAWPTMNNRTLSWIACCTDFPLL

SEQ ID NO: 198492 - protein, 299 aa, Glycine max
  Coding DNA Sequence Number=SeqID_81714
  Gene Ontology: Mol. function=zinc ion binding; Cellular component =nucleus; Biological process=proteolysis
  Homolog annotation: Hit_ID=Q1SPG0; Match level="QueryCoverage=60%, HitCoverage=46%, E-value=2e-45, Identity=47%"; Hit description=Zinc finger, SWIM-type
MTLEGEDGEYSEDVDDCELLGFLSERITYSETLVGKLWSRHMFAHELVLELNEGQGWRSENDYRRMYHGVVVRRCVVCMWMSRLRDGFIRKDIHNQQARMRKWKTTHVGGALKYLSLLCQKDPIMVVTYFDERERLQYLFWCDAESQMNYKVFGDVLAFDVTYKKNKYLCPFVIFLGVNHYNHTIVFVVVVVTNEMEEIYVWLLEQFLQAMNGKAPSPVINNGDVAMKNAIKIVFPNVDHRLCAWHLMRNAANHVRDKGVLKYLKSFMLSDIEVVEFEERWTDMVGKYELQDGVNFVHY

SEQ ID NO: 198493 - protein, 178 aa, Glycine max
  Coding DNA Sequence Number=SeqID_81715
  Gene Ontology: Mol. function=oxidoreductase activity; Cellular component=membrane; Biological process=metabolic process
  Homolog annotation: Hit_ID=Q0LYB2; Match level="QueryCoverage=69%, HitCoverage=50%, E-value=5e-27, Identity=53%"; Hit description=NAD -dependent epimerase/dehydratase:Short-chain dehydrogenase/reductase SDR
MVINVTSTVTLKSLPLLAVYTGSKAAVNAFTESLALELQPFNVQVRLVLPGLAPTTDFGKNARPRMENTLLEPYQPMFDGIIAGMQQPQPTTKAQDVAAAVWRAATDPAAPMRIPAGEDAEASMKQYVPPDRRAPASFAAGQTTVQAAPQARTSASLRTYPVPAAAARRWRPAPPSAA

SEQ ID NO: 198494 - protein, 211 aa, Glycine max
  Coding DNA Sequence Number=SeqID_81716
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=75%, HitCoverage=7%, E-value=5e-43, Identity=52%"; Hit description=RNase H, putative
MASSVEFTGYRRRFRLGYKPTCADVRRIALEKRGRYMGQPQGLQVKGDPDVNFKQLVNQAEEGEDEDWGLPPELKIMVEQEDREVKPHQQETEIVNLGVGEERKEAKVGTGMSTHIRDELVALLRDYQDIFAWSYQDMPDLSLNIQKLRRMKPNMSLKIKEEVKKKFDIGFLAMAQYPEWVANIMPVPKKDGREGANVRGLSGSKSSQSKG

SEQ ID NO: 198495 - protein, 57 aa, Glycine max
  Coding DNA Sequence Number=SeqID_81717
MTLSDMAEEVHDKAREIGIVVVGGGAAEATLSVNLEFLATTLGSQERLAIAKFVESC

SEQ ID NO: 198496 - protein, 110 aa, Glycine max
  Coding DNA Sequence Number=SeqID_81718
  Gene Ontology: Mol. function=nucleic acid binding; Cellular component= nucleus; Biological process=DNA replication
  Homolog annotation: Hit_ID=Q7XZT4; Match level="QueryCoverage=94%, HitCoverage=37%, E-value=1e-42, Identity=81%"; Hit description=RPA 32kDa
  Subcellular localization annotation: CTP_CleavageSite=51; ConfidenceScore=5.69e-01
MFSGSQFDATTAFSGGGFTSSQPSTLNDSSPAPSNSRETPGLVPVTVKQISEASQSGDEKSNFVINGVDLNNVTLVGMMFEKVERNTDVSFVLDDGTGRIKCRRWYLVKY

SEQ ID NO: 198497 - protein, 148 aa, Glycine max
  Coding DNA Sequence Number=SeqID_81719
  Gene Ontology: Mol. function=nucleic acid binding; Cellular component= nucleus; Biological process=DNA replication
  Homolog annotation: Hit_ID=Q7XZT4; Match level="QueryCoverage=93%, HitCoverage=47%, E-value=2e-42, Identity=62%"; Hit description=RPA 32kDa
  Pfam annotation: Domain name=RPA_C; Domain location=28-143; Score =56.3; E_value=9.8e-14; Accession=PF08784.1; Description=Replication protein A C terminal
MIILLEDWWPVTNFDEIPFHFIDCIHNHLRSKIKVEGITSANPSSGSSLETPVKSAPNRSQASNPVCAQHSVDGLKGIDKLVMDYLEQHSDRRVTHPTFYLSDGRGIHVDELSRELKLPIEKIKLSLKTLADDGEIYSTIDDDHYKKA

SEQ ID NO: 198498 - protein, 142 aa, Glycine max
  Coding DNA Sequence Number=SeqID_81720
  Homolog annotation: Hit_ID=Q6CQF3; Match level="QueryCoverage=39%, HitCoverage=59%, E-value=3e-08, Identity=70%"; Hit description =Kluyveromyces lactis strain NRRL Y-1140 chromosome D of strain NRRL Y- 1140 of Kluyveromyces lactis
RCGCSVESRYGIESSKWAIFGKQNWRCGMNRKLGYGAQLRANLDPTKGVGRLRQQDGGHGSRNPLRTPMSRRARRSLQNPGREPGRSGSSVQILGGGKVPCERHFAHGLVDPKGRGEARLIALCARTPKGNRPAHPGNGSVR

SEQ ID NO: 198499 - protein, 90 aa, Glycine max
  Coding DNA Sequence Number=SeqID_81721
  Homolog annotation: Hit_ID=Q76C99; Match level="QueryCoverage=81%, HitCoverage=9%, E-value=5e-10, Identity=36%"; Hit description=Rf1 protein, mitochondrial precursor
  Pfam annotation: Domain name=PPR; Domain location=11-45; Score=30.7; E_value=5.2e-06; Accession=PF01535.11; Description=PPR repeat
  Pfam annotation: Domain name=PPR; Domain location=46-80; Score=41.8; E_value=2.4e-09; Accession=PF01535.11; Description=PPR repeat
  Pfam module annotation: Pfam domain module=PPR::PPR; Domain location =11-45::46-80
MKEEGIKADLVTWNSLVLGYSMTCYSEEALAVINRIESLGLTPNVVSWTAMISGYCENENYMDALQFFSQMQEENVSPLSRVASVAFNNK

SEQ ID NO: 198500 - protein, 54 aa, Glycine max
  Coding DNA Sequence Number=SeqID_81722
SCPAQVVISTHRLLVPENIAKSDDKGIPHCTFLGLGDAAGDRFHRGGESMLCAQ

SEQ ID NO: 198501 - protein, 362 aa, Glycine max
  Coding DNA Sequence Number=SeqID_81723
  Gene Ontology: Mol. function=serine-type endopeptidase inhibitor activity; Cellular component=membrane; Biological process=detection of mechanical stimulus during sensory perception of sound
  Homolog annotation: Hit_ID=Q6K5G3; Match level="QueryCoverage=96%, HitCoverage=49%, E-value=1e-120, Identity=61%"; Hit description =Ankyrin repeat-like protein
  Pfam annotation: Domain name=Ank; Domain location=18-48; Score=3.7; E_ value=9; Accession=PF00023.20; Description=Ankyrin repeat
  Pfam annotation: Domain name=Ank; Domain location=193-225; Score=5.8; E_value=4.6; Accession=PF00023.20; Description=Ankyrin repeat
  Pfam annotation: Domain name=Ank; Domain location=227-256; Score =17.4; E_value=0.05; Accession=PF00023.20; Description=Ankyrin repeat
  Pfam annotation: Domain name=Ank; Domain location=260-293; Score =28.2; E_value=2.9e-05; Accession=PF00023.20; Description=Ankyrin repeat
  Pfam module annotation: Pfam domain module=Ank::Ank::Ank::Ank; Domain location=18-48::193-225::227-256::260-293
MPTTYFPLRWESTGDQWWYASPIDCAAANGHYDLVRELLRIDNNHLFKLTSLRRIRRLEVVWDDEEQQQFSDVAKCRSQVAHKLLLECDSKRRSSSKNSLIRAGYGGWLIYTAASAGDLSFVQQLLERNPLLVFGEGEYNVTDIFYAASRGKSCEVFRLVFDFAVSPRFVTGKGGVLEEHVGGDVPPVYKWEMSNRAVHAAARGGSVEILVEFLANCSDVLAYRDAQGSTLLHSASGRGQVEVVKYLTSSFDIINSTDHQGNTALHVAAYRGQLAAVEALVSASPALISLRNNAGETFLHKAVSGFQSTSFRRLDRQVELLRQLVSGKKFHIEEVINVKNTDGRTALHIATIGKFTLILLSS

SEQ ID NO: 198502 - protein, 220 aa, Glycine max
  Coding DNA Sequence Number=SeqID_81724
MSSTSSEHTAYDSAAENRPPTTSKRPSVAAGLKRVLQWPLVKDKKAEGIRKSIDEGSLDSCRKWDITDEIPTPLRQKFFRHSALPNNKRNLSVRSYQSSPNAKKRFASGLVHVKVSRRSSSSSFSISSFSSPRSTDNKQKGFCVDNDVAGPSCSNHQNDKSTNSGKRTSVSKKLRGHYFCFSKASVNKEQESYCYKDHDAIVKYRRGKDAAPMQNYTVKI

SEQ ID NO: 198503 - protein, 57 aa, Glycine max
  Coding DNA Sequence Number=SeqID_81725
  Homolog annotation: Hit_ID=Q1SN45; Match level="QueryCoverage=89%, HitCoverage=3%, E-value=5e-10, Identity=68%"; Hit description=AAA ATPase
MGGKIQTEHNDGGGPPQFVVNGQNYHGIGNLLHIPGETPKSVNSMFMIPKMKFKAVR

SEQ ID NO: 198504 - protein, 224 aa, Glycine max
  Coding DNA Sequence Number=SeqID_81726
MGNLEGRHLLCWVVRWVTNIGDTKWILTKPLGLENTYPDAVKLLNAFDIVFLMDSTYKTNRHTLSLLDIVGVTSIGLNFSIALNVKAKFKTYVTPKEAWDQVMDAWGSVMNSPIESDYEDYVTKFDVVCESWCEFIKVKSVHWTLKRLLQTSMRDLYELGRSMFIGLDTLHYGCILKTTHGLPYAYELDRYALYCIPLQSIHMCWTTLSFNDMGSNDQHEELSY

SEQ ID NO: 198505 - protein, 221 aa, Glycine max
  Coding DNA Sequence Number=SeqID_81727
  Gene Ontology: Mol. function=RNA-directed DNA polymerase activity; Biological process=DNA integration
  Homolog annotation: Hit_ID=Q1T010; Match level="QueryCoverage=50%, HitCoverage=8%, E-value=6e-17, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MNEGKSVADYFTRLLTVTNYMKTNGEQLTTLMIVEIKAMRTLTPRFDDILVAIEQAKDLEEMQVQELQGALEAQEIRMDERNIERFNTEQALQAQASKKNDGGCSNHMSGRKEWFIKSKVKFGGNSVVIAEGEYTSHESLNDYDEEGMLHEVTAPYTYLNIIGPIRGFEEITPKEAWSRRKPDLSHLKISGFLCYEHVLEQVNKKLDGRTDSMIFLGYHPT

SEQ ID NO: 198506 - protein, 434 aa, Glycine max
  Coding DNA Sequence Number=SeqID_81728
  Gene Ontology: Mol. function=zinc ion binding; Cellular component =plastid; Biological process=peroxisome organization and biogenesis
  Homolog annotation: Hit_ID=Q85V22; Match level="QueryCoverage=98%, HitCoverage=97%, E-value=0.0, Identity=78%"; Hit description =Histidine amino acid transporter
  Pfam annotation: Domain name=Aa_trans; Domain location=22-421; Score =543.8; E_value=1.8e-160; Accession=PF01490.8; Description =Transmembrane amino acid transporter protein
  Pfam annotation: Domain name=Trp_Tyr_perm; Domain location=35-415; Score=-279.4; E_value=0.068; Accession=PF03222.4; Description =Tryptophantyrosine permease family
  Pfam module annotation: Pfam domain module=Aa_trans::Trp_Tyr_perm; Domain location=22-421::35-415
MTEEELLRQKAINDWLPITSSRNGKWWYSAVHNVTSMVGAGVLSLPYAMSELGWGPGVTVLVLSWIITLYTLWQMVEMHEMVPGKRFDRYHELGQYAFGEKLGLYIVVPQQLVVEIGVNIVYMVTGGKSLQKFHDTVCDSCKKIKLTFFIMIFASVHFVLSHLPSFNSISGLSLAAAVMSLSYSTIAWAASAHKGVQENVQYGYKAKSTSGTVFNFFSALGDVAFAYAGHNVVMEIQATIPSTPEKPSKGPMWRGVVVAYIVVGLCYFPVALIGYWMFGNSVEDNILISLEKPKWLIAMANMFVVIHVIGSYQIYAMPVFDMIETVMVKKLNFKPSSTLRFIVRNVYVAFTMFVGITFPFFSGLLGFFGGFAFAPTTYFLPCIMWLAIYKPRRFSLSWWANWICIVFGILLMILSPIGGLRSIIISAKDYKFYS

SEQ ID NO: 198507 - protein, 105 aa, Glycine max
  Coding DNA Sequence Number=SeqID_81729
MAKQLAEQPSANFSGNAQTNPKEHCQAITTRSGRMLGEVSDENKDEVEEEKDIEKDSGEENREKYERKDENDKEKEKLKGKRMSEKNLSNVRFPYILHGKEEREA

SEQ ID NO: 198508 - protein, 93 aa, Glycine max
  Coding DNA Sequence Number=SeqID_81730
  Gene Ontology: Mol. function=DNA binding; Cellular component=nucleus; Biological process=regulation of transcription
  Homolog annotation: Hit_ID=Q0PJD5; Match level="QueryCoverage=65%, HitCoverage=32%, E-value=2e-25, Identity=87%"; Hit description=MYB transcription factor MYB60
MEPTQKNMCKLEGMLASNMPAEPSTPEHGPGNWRAVLAKTGFSRCSKSCRLRSTNYLRPGIKQGNFSEQEEKMIIHLQDLLGNRYKSIFQAPT

SEQ ID NO: 198509 - protein, 261 aa, Glycine max
  Coding DNA Sequence Number=SeqID_81731
  Gene Ontology: Cellular component=plastid; Biological process =peroxisome organization and biogenesis
  Homolog annotation: Hit_ID=Q85V22; Match level="QueryCoverage=97%, HitCoverage=57%, E-value=1e-100, Identity=69%"; Hit description =Histidine amino acid transporter
  Pfam annotation: Domain name=Aa_trans; Domain location=1-248; Score =73.2; E_value=8.3e-19; Accession=PF01490.8; Description =Transmembrane amino acid transporter protein
MYICSYSTIAWVASVDKRVHNHIDVAVEYGYKASTSAGTVFNFLNALGDVAFAYAGHNVVLEIQATIPSSPEKPSKGPMWRGVLIAYLVVGLCYFPVALVGYWVFGNSVDDNILITLNKPTWLIVTANMFVVIHVIGSYQLYAMPVFDMIETVMVKKLHFEPSWLLRFVVRNVYVAFTMFVGITFPFFGALLGFFGGFAFAPTTYFLPCIMWLAIYKPRKFSLSWITNWICIVLGLLLMILSPIGGLRSIILNAKTYGFYQ

SEQ ID NO: 198510 - protein, 86 aa, Glycine max
  Coding DNA Sequence Number=SeqID_81732
MKVVGLEFSIRKKLVNQQMKDMTQLAKKVKSCILMRIMKLAKYRLKAQVEKDEGLSGEGQSPRVEKDEGPEAETLSRLLIVAEGPN

SEQ ID NO: 198511 - protein, 126 aa, Glycine max
  Coding DNA Sequence Number=SeqID_81733
  Gene Ontology: Mol. function=protein serine/threonine kinase activity; Cellular component=intracellular; Biological process =protein amino acid phosphorylation
  Homolog annotation: Hit_ID=Q1SC20; Match level="QueryCoverage=93%, HitCoverage=23%, E-value=1e-53, Identity=87%"; Hit description =Protein kinase; Nuclear transport factor 2
MSGLEELRKKLAPLFDAEKGFSSSSTLDPCDSYTFSDGGTVNLLSRSYGVYNINELGLQKCTSRSVDETDHSEKTYKCCSHEMRIFGAIGSGASSVVQRAIHIPTHRILALKKINIFEKTDIEIIP

SEQ ID NO: 198512 - protein, 114 aa, Glycine max
  Coding DNA Sequence Number=SeqID_81734
MDGTQDSGNTDRGEIRASLHGLTQYMDDNWDDTSHVGIGHDALFLAYITHDILFQRTSSHTVLVLGLTLPLSLLSLHGLTQYMDDNWDDTSHVGTRHDALTNHGYNSALVKNVK

SEQ ID NO: 198513 - protein, 182 aa, Glycine max
  Coding DNA Sequence Number=SeqID_81735
  Gene Ontology: Mol. function=nucleotide binding; Cellular component =intracellular; Biological process=small GTPase mediated signal transduction
  Homolog annotation: Hit_ID=Q9LYJ3; Match level="QueryCoverage=85%, HitCoverage=97%, E-value=1e-78, Identity=96%"; Hit description=ADP -ribosylation factor-like protein
  Pfam annotation: Domain name=Arf; Domain location=17-163; Score =261.2; E_value=2.2e-75; Accession=PF00025.11; Description=ADP -ribosylation factor family
  Pfam annotation: Domain name=Miro; Domain location=22-115; Score= -9.2; E_value=0.043; Accession=PF08477.3; Description=Miro-like protein
  Pfam module annotation: Pfam domain module=Arf::Miro; Domain location= 17-163::22-115
MDLRWISDLEVREDGVVVHEAVQQVVCEEGNEDSDGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKIIELGEDESVRKNTGK

SEQ ID NO: 198514 - protein, 364 aa, Glycine max
  Coding DNA Sequence Number=SeqID_81736
  Gene Ontology: Mol. function=protein serine/threonine kinase activity; Cellular component=intracellular; Biological process =protein amino acid phosphorylation
  Homolog annotation: Hit_ID=Q1SC20; Match level="QueryCoverage=99%, HitCoverage=68%, E-value=0.0, Identity=90%"; Hit description=Protein kinase; Nuclear transport factor 2
  Pfam annotation: Domain name=Pkinase; Domain location=1-177; Score =79.5; E_value=1e-20; Accession=PF00069.15; Description=Protein kinase domain
  Pfam annotation: Domain name=Pkinase_Tyr; Domain location=1-177; Score=-113.2; E_value=1.6e-05; Accession=PF07714.7; Description =Protein tyrosine kinase
  Pfam module annotation: Pfam domain module=Pkinase::Pkinase_Tyr; Domain location=1-177::1-177
MDGGSLADILRMHRRIPEPILSSMFQKLLHGLSYLHGVRHLVHRDIKPANLLVNLKGEPKITDFGISAGLENSVAMCATFVGTVTYMSPERIRNENYSYPADIWSLGLALFECGTGEFPYTANEGPVNLMLQILDDPSPSPLKNKFSPEFCSFVDACLQKDPDTRPTAEQLLSHPFITKYEDAKVDLAGFVRSVFDPTQRMKDLADMLTIHYYLLFDGPDDLWQHTRNLYSESSIFSFSGKQHRGPSNIFTSLSSIRTTLVGDWPPEKLVHVVERLQCRTHGEDGVAIRVSGSFIIGNQFLICGDGIQVEGLPNFKDLGIDIPSKRMGTFHEQFIVEPTSLIGCEPTSLIGCYTIVKQELYINQ

SEQ ID NO: 198515 - protein, 123 aa, Glycine max
  Coding DNA Sequence Number=SeqID_81737
  Homolog annotation: Hit_ID=Q1S785; Match level="QueryCoverage=52%, HitCoverage=8%, E-value=2e-13, Identity=53%"; Hit description =Integrase, catalytic region
MIKPPFSQNSGVLAQCEVSVKNNLEKFDEKSNNAIFLGYSLSSKTYRIYNLRTQVIKESMHVLFDEHTNTPEKRKIANLEEEIQKTKISKHAPNTAPSSESPKKSDEELSKEAQNGKVQKGKT

SEQ ID NO: 198516 - protein, 165 aa, Glycine max
  Coding DNA Sequence Number=SeqID_81738
  Homolog annotation: Hit_ID=UPI00006A17C9; Match level="QueryCoverage =63%, HitCoverage=99%, E-value=2e-09, Identity=33%"; Hit description =UPI00006A17C9 related cluster
VDSRGSHEGYTPSPWVLVTLTVERTTRPRLERTTRPHHQRAARPHLQRTTCLRLERAARPHLGGLHALTSRGLHVLALRGLHALTLGTTYPHRQRTTRPRLERTTRPHHQRAARPHLQRTHVFTLGGLHALTFRGLLILTFRGLHVLAIRRLHVPHFQRGACPHL

SEQ ID NO: 198517 - protein, 177 aa, Glycine max
  Coding DNA Sequence Number=SeqID_81739
  Gene Ontology: Mol. function=protein dimerization activity
  Homolog annotation: Hit_ID=Q9ZWT4; Match level="QueryCoverage=99%, HitCoverage=29%, E-value=1e-42, Identity=43%"; Hit description =Transposase
MHKRCLKFCDDLLDQSQHIEKVFDKQSAEIIAKNRLRLKTSIDVVRWFTFQACAFRGNDESLQSLNRGNFIELVNLMASYSSKVANVVLEKAPGNAQYISPSIQKEILYIFARRKQISSVLSRHCLDIQNLHGQGYNGASNMRGEWNGLQALFLKDCPYALYSLSCSSPTTCSSYSC

SEQ ID NO: 198518 - protein, 129 aa, Glycine max
  Coding DNA Sequence Number=SeqID_81740
  Gene Ontology: Mol. function=DNA binding; Biological process=DNA integration
  Homolog annotation: Hit_ID=Q2AA34; Match level="QueryCoverage=61%, HitCoverage=16%, E-value=1e-15, Identity=51%"; Hit description =F7F22.15, related
MTKIYLTISVQKQHIPPLPFPPRAVSNKKMEEAEKEILETFRKVEVNIPLLDAIKQIPKYAKFSKELCTNKRKLKGSERISMGRNVSALIGKSIPQIPEKCKDPGPLQSTDVVIHLANRSVHGNPLITI

SEQ ID NO: 198519 - protein, 116 aa, Glycine max
  Coding DNA Sequence Number=SeqID_81741
  Gene Ontology: Mol. function=nucleoside-triphosphatase activity
  Homolog annotation: Hit_ID=Q1M2R7; Match level="QueryCoverage=77%, HitCoverage=7%, E-value=6e-26, Identity=64%"; Hit description=PDR -like ABC-transporter
MQCIRIARGELGLGNVEKRGLEKLQNDIHSPHVTIYESLLYSARVRLSLEVNSETRKMFIEEVMELVELNLLREALRKRLTIAVEVVANPSIKFMDEPTSGLDARATAIVMRTVRI

SEQ ID NO: 198520 - protein, 286 aa, Glycine max
  Coding DNA Sequence Number=SeqID_81742
  Gene Ontology: Mol. function=nucleoside-triphosphatase activity; Cellular component=integral to membrane; Biological process=response to salicylic acid stimulus
  Homolog annotation: Hit_ID=Q5W273; Match level="QueryCoverage=96%, HitCoverage=81%, E-value=2e-55, Identity=42%"; Hit description=PDR -like ABC transporter
  Pfam annotation: Domain name=ABC2_membrane; Domain location=3-219; Score=0.3; E_value=0.0019; Accession=PF01061.14; Description=ABC-2 type transporter
  Subcellular localization annotation: CTP_CleavageSite=58; ConfidenceScore=5.31e-01
MHNHFMFNAKPAYGNNIGLAGATLRILTFTTFLALMFGTMFWDLGSKTIRKQNLFNVMGSMYNAILFLGIQNGFSVQPVVAIERTVFYRERTGGMYLAILYVVAQFCISNPINIMQTNAPFTSSVVIELQYIVVQAITYGIIVYAMIRFEWTASKFFWYLFFMYFTFLNFAFYGMMTDRNTKPTHCFNYGYCIVWSLEPVFGICCPTTYGTIGHVLLLGAVTSQFGDVTSEVELNETVKEFLRRYFGYRDDFVGVPAGVVVGLAVLFVTIFAFSVKVFMIVDHGLV

SEQ ID NO: 198521 - protein, 156 aa, Glycine max
  Coding DNA Sequence Number=SeqID_81743
  Gene Ontology: Mol. function=nucleic acid binding; Cellular component= intracellular; Biological process=regulation of transcription
  Homolog annotation: Hit_ID=Q9ZQ18; Match level="QueryCoverage=96%, HitCoverage=43%, E-value=6e-23, Identity=44%"; Hit description =Putative C2H2-type zinc finger protein
MTQSKNSITSPSGIATTSSPSCGLCGKDYKSSKAHAEHLKSRGHMMRASEGTSHADEKAIIKPLPQRVVNRPPPRREVDNSENEECEDEWEEVDPEEDLVDEARAAKSLTDLNVNEHGENVDMEEDADDFEELDPSCCFMCDQEHKTIEDCMAQAS

SEQ ID NO: 198522 - protein, 83 aa, Glycine max
  Coding DNA Sequence Number=SeqID_81744
MKKGEDSSLARKCNECDQPEYLRFDCPVLKRRMEKSDKRNFKEKKEKKAYITWEDNDLDSSSDSENEIINLGLMANDYESGEE

SEQ ID NO: 198523 - protein, 159 aa, Glycine max
  Coding DNA Sequence Number=SeqID_81745
MKIKHQSKALNLVVAFDVVNNDDEISEEDEEELAFLTKRVKRLLIKRKGLRRNFSKKDFRQGESSKHVRCFECNKPCHIKTTWPFLKKNFKRSDPKKKAMMATWDYTDSSSSEKNEEHATNLCLMADLDKDEKCAYLKGLLFDAQKENEKLRWIMRIFL

SEQ ID NO: 198524 - protein, 246 aa, Glycine max
  Coding DNA Sequence Number=SeqID_81746
MMEAMMSMRNMMEVNAATSVTASTTTKRDSTHLPSFNQVSHLISDVVGQGDEAVENAYGLHYVQVQSKSCFPPYGLPPNYTLPTVVYAPSENISNSAPIFIKSQQPQLNHTFAHVYQSMGETHDAPQDHTLTDFRVYPGYTTEGHALSSVPVPNALRVPQYQPPSQPLCFAMEEGPPVVVKNEKFNHTEERLRVIEGGGNYGFADMSELCLVPDVVIPLKFKVPDFDKYKGTSCPKNHLKMYCRKM

SEQ ID NO: 198525 - protein, 118 aa, Glycine max
  Coding DNA Sequence Number=SeqID_81747
MDANNDFFMVNFDIEEDKMKVYLHLSRIQREGAPIKSHLLFAYDRYLFFKANDSEAMVVKRILQEYVVASEHLKVNDLIDIPNAKWNLRLLNQILDMRDVQAVLLVPMMDITSHDAMV

SEQ ID NO: 198526 - protein, 103 aa, Glycine max
  Coding DNA Sequence Number=SeqID_81748
  Subcellular localization annotation: CTP_CleavageSite=47; ConfidenceScore=5.13e-01
MDALHDHHHKGKVIWDFSQQMMVHSSKASSSKSPSPFSLSNEYGLVMSEYHRDTNQKSVQQKMKVLKVNMDINITNDNIIKAQWTPEQDITLLELVNQFGLKK

SEQ ID NO: 198527 - protein, 808 aa, Glycine max
  Coding DNA Sequence Number=SeqID_81749
  Gene Ontology: Mol. function=ATP-dependent helicase activity; Cellular component=nucleus; Biological process=mRNA catabolic process, nonsense-mediated decay
  Homolog annotation: Hit_ID=Q1SEE4; Match level="QueryCoverage=89%, HitCoverage=95%, E-value=0.0, Identity=71%"; Hit description =WW/Rsp5/WWP; Helicase, C-terminal
  Pfam annotation: Domain name=DEAD; Domain location=224-394; Score =257.7; E_value=2.3e-74; Accession=PF00270.19; Description=DEADDEAH box helicase
  Pfam annotation: Domain name=Helicase_C; Domain location=463-539; Score=127.5; E_value=3.7e-35; Accession=PF00271.21; Description =Helicase conserved C-terminal domain
  Pfam annotation: Domain name=ResIII; Domain location=220-389; Score= -1.7; E_value=6.4e-05; Accession=PF04851.6; Description=Type III restriction enzyme, res subunit
  Pfam annotation: Domain name=WW; Domain location=21-51; Score=37.2; E_ value=5.5e-08; Accession=PF00397.16; Description=WW domain
  Pfam module annotation: Pfam domain module=DEAD::Helicase _C::ResIII::WW; Domain location=224-394::463-539::220-389::21-51
MAATATVSLMGPRYAPPDPTLPKPWRGLVDGKTGYLYFWNPETNVTQYERPSSSSASQSKFSSVPSSSVQVQQSSQGSQRGRSPDFSDRYDRNGTGGSNDAGSRNNQSSKGGSYTSHDVSNGTNVAGNGNSSVRGHGASDAGAGLSAESYRHRHEISVTGDNVPPPLASFGSTGFPSELLRESATWSVRKKRPLLMRYLASASIGGLHMRDDASSDINSSITPTPIQAQSWPIALQGRDIVAIAKTGSGKTLGYLIPAFIHLKRSGNNSKMGPTALVLSPTRELATQIQDEAMKFGKSSRISCACLYGGAPKGPQLRDIDRGADIVVATPGRLNDILEMRRISLNQVSYLVLDEADRMLDMGFEPQIRKIVNEVPNRRQTLMFTATWPKEVRKIAADLLVKPVQVNIGNVDELVANKSITQHVEVLPPMEKQRRLEHILRSQDQGSKIIIFCSTKKMCDQLARNLTRHFGAAAIHGDKSQAERDHVLSQFRTGRSPVLVATDVAARGLDIKDIRVVVNYDFPTGVEDYVHRIGRTGRAGATGLAYTFFGDQDAKYASDLIKVLEGANQKVPPELRDMSSRSGGGMGRSRRWGSGGRGGHGDSGYGGRNNDSGYGGRGNDAGYGGRGSDSNYGGRGTAASGRGGGRGFDHDSQRNDRGRSPDKGSSWSDRFKSVNRDRSRSPDRAALPQHSQGGSFHKAMMERGGGGGDRNKSFNRDRSRSPSPHRQEKCPAVRDRSPVYSFHQSMMGRGQSSPSSQRQRARSPHRNSPPSQGDGRYAGSHSSYNGEVEEGMIPEEEGMIGQDDPVNVN

SEQ ID NO: 198528 - protein, 152 aa, Glycine max
  Coding DNA Sequence Number=SeqID_81750
  Gene Ontology: Mol. function=transporter activity; Cellular component= integral to membrane; Biological process=transport
  Homolog annotation: Hit_ID=P93389; Match level="QueryCoverage=87%, HitCoverage=45%, E-value=4e-18, Identity=42%"; Hit description =Phosphate/phosphoenolpyruvate translocator
  Subcellular localization annotation: CTP_CleavageSite=53; ConfidenceScore=5.52e-01
MPTFWVVSSLVPVVGGVALASMTEVSFNWIGFTTAMASNVTNQSRNVLSKKLMTNEEASQGLNVRELCVRSVLAAFCFHAYQQIRLKFKLNHFFNVNDIITSLGAQTSHIKNWACTCWSFLVLKGKEDQVSPKDKLRLHNPSKKKGNRQREK

SEQ ID NO: 198529 - protein, 939 aa, Glycine max
  Coding DNA Sequence Number=SeqID_81751
  Gene Ontology: Mol. function=polyribonucleotide nucleotidyltransferase activity; Cellular component=membrane fraction; Biological process =mRNA catabolic process
  Homolog annotation: Hit_ID=Q1SC44; Match level="QueryCoverage=88%, HitCoverage=96%, E-value=0.0, Identity=73%"; Hit description =Peptidase S8 and S53, subtilisin, kexin, sedolisin; Acylphosphatase; Transcription ...
  Homolog annotation: Hit description=termination factor NusA; Polyribonucleotide nucleotidyltransferase
  Pfam annotation: Domain name=KH_1; Domain location=593-649; Score =30.0; E_value=8.1e-06; Accession=PF00013.19; Description=KH domain
  Pfam annotation: Domain name=PNPase; Domain location=271-351; Score =75.6; E_value=1.6e-19; Accession=PF03726.4; Description =Polyribonucleotide nucleotidyltransferase, RNA binding domain
  Pfam annotation: Domain name=RNase_PH; Domain location=354-487; Score= 152.7; E_value=9.7e-43; Accession=PF01138.11; Description=3' exoribonuclease family, domain 1
  Pfam annotation: Domain name=RNase_PH; Domain location=45-173; Score =87.3; E_value=4.7e-23; Accession=PF01138.11; Description=3' exoribonuclease family, domain 1
  Pfam annotation: Domain name=RNase_PH_C; Domain location=176-240; Score=38.0; E_value=3.3e-08; Accession=PF03725.5; Description=3' exoribonuclease family, domain 2
  Pfam annotation: Domain name=RNase_PH_C; Domain location=490-567; Score=62.6; E_value=1.3e-15; Accession=PF03725.5; Description=3' exoribonuclease family, domain 2
  Pfam annotation: Domain name=S1; Domain location=656-728; Score=58.2; E_value=2.7e-14; Accession=PF00575.13; Description=S1 RNA binding domain
  Pfam module annotation: Pfam domain module=KH_1::PNPase::RNase _PH::RNase_PH::RNase_PH_C::RNase_PH_C::S1; Domain location=593 -649::271-351::354-487::45-173::176-240::490-567::656-728
MRRTNTLLRTLPHFLTWRAFRFRTFATTKHLETFTEQFEIGSSVITLETGKIARFANAAVVLAMENTNVLSTVTASKANDAVRDFLPLTVDYQEKQFAQGVIPTSFMRREGAPRERELLCGRIIDRPIRPLFPPGFYHEVQVMASVLSSDGKQDTDVLAANATSAALMLSDIPWGGPIGMVRIGRICGQFIVNPTMDELKLSDLNLVYACTKDKTLMIDVQAREISDKDLEAGLRLAHPEAVKYIEPQIRLAAKAGKSKKEYKLSMLSDNTMEKVRNIAEAPIEAVFTNPSYGKFERGEALENIAQDVKRVLEEEGDEESLKVLSKAVDTVRKKVVRKRIIAEGYRLDGRQLDEVRPLYCEAGYVSMLHGSALFSRGETQVLCTVTLGAPTDAQRLESVVGPPTKRFMLHYSFPPFCINEVGKRGGLNRREVGHGTLAEKALLAVLPPEDDFPYTVRVNSEVMASDGSTSMATVCGGSMALMDAGIPVREHVAGVSVGLVSELDPSTGEIADYRILTDILGLEDHLGDIDFKIAGTRKGVTAIQLDIKPAGIPLDIVCECLEPAHKARLQILDHMEQEINVPRNKNDSTSPRLATLKYNNDALRRLIGPMGALKRKMEEETGARMSVGDGTLTIVAKNQSVMDKILEKIDFIVGRQIEVGGIYTGIVTTIKEYGAFVEFNGGQQGLLHISELSHEPVSQVSEVVSVGQKLSLMCIGQDVHGNIKLSLKATSPRPGGLETNDAVEESVASAKETANIWAPVGNVSSTQEQNSAHELSLGNLELGNAKSQTSQVPVILIRSAAECDEEEKSSSLNLSSKSPHVDNGVQLDRKSKSRSQNAKSRRSQDVDAPSSHSGPLPYKKSKPSMQKESKSDIQKPKGDAQEPKDKVTAEDLKLGTQVTAKVSQIRAHGLVLDLGGGLRGMYRFEVGVMFVSSFLMISC

SEQ ID NO: 198530 - protein, 99 aa, Glycine max
  Coding DNA Sequence Number=SeqID_81752
MVGNCEKVAGRPEKTIKNHWNTTKGCDELAMITAHSMCSMEVATAMRQCKTMDSRRRQCSFELVNQFGLKKWSQIAKLLSSRTVGSSVVKDGTIISSQI

SEQ ID NO: 198531 - protein, 272 aa, Glycine max
  Coding DNA Sequence Number=SeqID_81753
  Gene Ontology: Mol. function=DNA binding; Cellular component=nucleus; Biological process=regulation of transcription
  Homolog annotation: Hit_ID=Q1S4I9; Match level="QueryCoverage=91%, HitCoverage=74%, E-value=2e-80, Identity=63%"; Hit description =Homeodomain-related
  Pfam annotation: Domain name=Myb_DNA-binding; Domain location=14-61; Score=44.3; E_value=4.1e-10; Accession=PF00249.21; Description=Myb -like DNA-binding domain
  Pfam annotation: Domain name=Myb_DNA-binding; Domain location=67-112; Score=43.7; E_value=6.4e-10; Accession=PF00249.21; Description=Myb -like DNA-binding domain
  Pfam module annotation: Pfam domain module=Myb_DNA-binding::Myb_DNA -binding; Domain location=14-61::67-112
MGRHSCCLKQKLRKGLWSPEEDEKLFNYITRFGVGCWSSVPKQAGLQRCGKSCRLRWINYLRPDLKRGMFSQQEEDLIISLHEVLGNRWAQIAAQLPGRTDNEIKNFWNSCLKKKLMKQGIDPATHKPLLSAQEHIIIKEEKETILETPPPMLLPMSQGILASSQESPLVVNNSSYCDGGLNVTEAASREVFMSKNAALDPLSYFEFQMGYNPIRQFDQNHVGTNSSYGFSSLPCLNSSSDHGNVSVAAEFSDNNSASKISSLMKESSSNSS

SEQ ID NO: 198532 - protein, 78 aa, Glycine max
  Coding DNA Sequence Number=SeqID_81754
MTLMIPQLFLKPMQVLWDAIVFGVYNDNVPLYIKHEDLGEITHGGRCLNVVIIQLWIMHMNELSMRSGNVSMYGFLEP

SEQ ID NO: 198533 - protein, 221 aa, Glycine max
  Coding DNA Sequence Number=SeqID_81755
MSFSGDEGDDQRIHPSMSRVKAPLDADVDPSFSSLATGHLEASIEPRAYAGDPYVIIHDSSTEIIIVASCEEGGGIRHRRRKREVPNGGTVDESDTLVGEEDVGNRVEREVLANPEYDWVDEKALATYKDHCRRTFHGDLEKKLIAKLDMLHSSNILCSALLKVRNDDSGNSIMITEDHLCHGYKQGVKLHANASSKQLAEESPNLPSGGASNPIFMAPGH

SEQ ID NO: 198534 - protein, 117 aa, Glycine max
  Coding DNA Sequence Number=SeqID_81756
MLVLLVRMMKKSYETLMTMKTKMTRTTIGCNLLINHHQYNLPTISQHTCLYMLKHQQGHKLKNNGRSNYLRRTLLTRAMPKSAYYYNNLQVEHPEAANWLGEIPKDKWTIAFSSRQC

SEQ ID NO: 198535 - protein, 425 aa, Glycine max
  Coding DNA Sequence Number=SeqID_81757
PFLEKIDQEVILPMLKVLATDVFDGTQDLQEHFQTFRTQFSSSKSKRRKVAGLLDVKQQKEGLLVATFFYSLVLRRPWNIEEICARVEKHIEMEEDAVVPKILPKNEETAFTLKPNLGGVRMENIGETGSILNFTQLKAQRGGLPKAYDPLNEGTHQTSLMVMTIDKECITDTSPIITFTTKDAESIEPHDDDPMDGNAKRKATIIFRVADTCPPIYGCRRNNFIQHDHGKTEFKSLMAMVSTPCLCMKYPMDQYRIGGEVPWIHIDKEGIDANPNKCNAIMEMRSPKTIEKALSGAELRYQKIKKAVLAIVGRHYFGRINGLMLEESLTFDFKANNNQAKYEALLVGMRLGLDVGAKNLRAKSDSTILARIKKPGNNKLVIQETISCPNIDDLKVCMIIEEKSWTTSIKAYVEENFFPEEPDEA

SEQ ID NO: 198536 - protein, 181 aa, Glycine max
  Coding DNA Sequence Number=SeqID_81758
  Gene Ontology: Mol. function=RNA-directed DNA polymerase activity; Biological process=RNA-dependent DNA replication
  Homolog annotation: Hit_ID=Q0ZCD0; Match level="QueryCoverage=87%, HitCoverage=13%, E-value=4e-10, Identity=26%"; Hit description =Integrase
MERSMIDAVSGGALGDMTPVEARNLIEKMASNSQQFSARNDVIVLRGVHDVATDSSSSAENKKLEGKLDALVNLVTQLAINQKSASAPIIVARVCGLCYSADHHTDLCPSLQQSRVNEQPEAYAANFYNRPPQQQNQQQQNNYDLSSNRYNPGWRNHPNLRWANPPQQQQQQQQPVPPFQN

SEQ ID NO: 198537 - protein, 42 aa, Glycine max
  Coding DNA Sequence Number=SeqID_81759
SHEEEYLYLRACHSVWNSLETQADSHGGELPVHNWVTSTLTA

SEQ ID NO: 198538 - protein, 100 aa, Glycine max
  Coding DNA Sequence Number=SeqID_81760
MSKETNEEEAIHSVSFDLEGSSSATRKNIHPSKSGEKEGMISSMKEVTESLKEFVEMTKKKMKNKKMEIKEAQEVVHEVVSELDNIPNFNGALRHRAIDC

SEQ ID NO: 198539 - protein, 66 aa, Glycine max
  Coding DNA Sequence Number=SeqID_81761
MPEVEREHCRAIRKVPQHSRVKKGVQIATRPTWAFQGVPTEVGAFWWKQSSSPRRAGRQPPPSFPL

SEQ ID NO: 198540 - protein, 171 aa, Glycine max
  Coding DNA Sequence Number=SeqID_81762
  Gene Ontology: Mol. function=unspecific monooxygenase activity
  Homolog annotation: Hit_ID=O04892; Match level="QueryCoverage=86%, HitCoverage=32%, E-value=6e-27, Identity=63%"; Hit description =Cytochrome P450 like_TBP
RGGRCKTQGASPGGAVVGADLGGTGEARLIALCARTPKGNRPAHPGNGSAGGRVQRLEEHRTSRGVRQGKSAKWIRNLGKRIGSEGWARGSQSRTRRLSVDCSSCFRGESGSSRAGRGTDWERGPSGPSSPGVEQSTQNCALNVKVKKFNQARVNGGSNYDSLKVAKCLVI

SEQ ID NO: 198541 - protein, 69 aa, Glycine max
  Coding DNA Sequence Number=SeqID_81763
  Subcellular localization annotation: CTP_CleavageSite=40; ConfidenceScore=5.13e-01
MVQLWFGNRVKHLPVWKKTGGPFGPANYLQFGASMKLICRSDASSPNEFGAMRSDCLVQFSILAFYGAP

SEQ ID NO: 198542 - protein, 273 aa, Glycine max
  Coding DNA Sequence Number=SeqID_81764
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=73%, HitCoverage=25%, E-value=3e-35, Identity=40%"; Hit description =Probable Na/H antiporter [imported]-Arabidopsis thaliana
PLTGLGRVAVTAATINEFYNWAMFVLLIPFATHSEKPCVSDVDYDLCHFLLLCVAPFTYPVDREITDKNEWDNYKLSYVFIGIMFCAHITEMLGTHSIVGALVFGLILPREKFVDMLMERSDDLVSTYLEPLLFIGCGVRFDFTTFKKRKLRDAMIITLLSCCTKIVSTVIATGFYRMPFRDGVALGELLNTKGLLPLVMLNILQVTDCFHYMRIDDCFRKLDISVTVRRFSSMVSFPVSAMEFQVLASEHVFRKSPFKEHEIDIGNDNPTAS

SEQ ID NO: 198543 - protein, 174 aa, Glycine max
  Coding DNA Sequence Number=SeqID_81765
MILSSTLAKTFLTQLQLEHFHCQSYNEENEEGRRSIKLTNSKKEEKEEEEEKKCGCGYSHEQHELLSLSLQQLFTNAFVTLSFSKSPNQLFSQIFNSPRFLDTDSTSNLDNECSLDSLVNDCDKQLAKEGDTYAEGGDTFVEEEEGDTYEVDFDKLECATFSPNQVLHWPPTRE

SEQ ID NO: 198544 - protein, 299 aa, Glycine max
  Coding DNA Sequence Number=SeqID_81766
  Gene Ontology: Mol. function=kinase activity
  Homolog annotation: Hit_ID=Q9LYA2; Match level="QueryCoverage=82%, HitCoverage=34%, E-value=1e-42, Identity=42%"; Hit description =Kinase-like protein
MALSLINSSLWVVLAYDTVALCFRAKVISRNTDSDSSSDSEADDVKARPANAAKAPENLGSEAQLDEMTMAAASLERNQSVSGLDQLDDNSQHKPSSFDSDCQQDGDSAATERQFSPDKLYRAAVLKKRFLDTILKAREKTLTQGEKGDPEKLRQEREKLEMEQKKEKARLQAEAKAAEDARKQAEEEAAAEARRKRELEREAARQALLQMEKTVEINENSRILEDLELLRAVPTEQLPSSVDETSPAHSQDGLGSFKFGSSNPLEQLGLYIKADDEEEEGEPPCIPNPVNDVEEGEID

SEQ ID NO: 198545 - protein, 472 aa, Glycine max
  Coding DNA Sequence Number=SeqID_81767
  Gene Ontology: Mol. function=kinase activity; Cellular component =intracellular
  Homolog annotation: Hit_ID=Q9LYA2; Match level="QueryCoverage=90%, HitCoverage=55%, E-value=8e-80, Identity=42%"; Hit description =Kinase-like protein
  Pfam annotation: Domain name=Bromodomain; Domain location=177-266; Score=119.0; E_value=1.3e-32; Accession=PF00439.15; Description =Bromodomain
MAKSRLSGGYFGNALDTAGESEGSGSSGRIDTEITVSEDSSIPARKCISLNSSRHDVFGAPVQVVPLSNMPLSHRKDLGQRLRSELEQIRLLQKKIEQQRTTAVVLSSSSDILSCSNGNNGHRVERDKKPAMSSSAPRNKAKPGNKNQKPRGWNRGSSGKFESAVQSASPSTANAMLMKDCELLLKRLMNHQYAWVFNTPVDVVKLNLPDYFTIIKRPMDLGTVKNKLASGEYAGPLEFADDVKLTFSNAMDYNPSGNDVHLMADTLNKYFELRWKAIEKKLQKSDFLPLPANPDNSEGVKTKRQAPLSKKRKIASLPPQPEVMPPTKKVMSDQEKHDLGRELESQLGEMPMHIIDFLKEHSSNGRECGDDEIEIDIDDLSDDTLFTLRKLLDDFLQKKQKNKAKVEACEVEVLNDSGPSNSSLQPFKGNDPADEEVDIGGNEPPVSSYPHVEIEKDTTYGMNKSLSPGSSN

SEQ ID NO: 198546 - protein, 1551 aa, Glycine max
  Coding DNA Sequence Number=SeqID_81768
  Gene Ontology: Mol. function=methyltransferase activity; Cellular component=intracellular; Biological process=DNA methylation
  Homolog annotation: Hit_ID=O49022; Match level="QueryCoverage=99%, HitCoverage=99%, E-value=0.0, Identity=75%"; Hit description =Cytosine-5 DNA methyltransferase
  Pfam annotation: Domain name=BAH; Domain location=755-889; Score =180.3; E_value=4.8e-51; Accession=PF01426.8; Description=BAH domain
  Pfam annotation: Domain name=BAH; Domain location=929-1069; Score =158.1; E_value=2.3e-44; Accession=PF01426.8; Description=BAH domain
  Pfam annotation: Domain name=DNA_methylase; Domain location=1114 -1543; Score=132.3; E_value=1.3e-36; Accession=PF00145.8; Description= C-5 cytosine-specific DNA methylase
  Pfam module annotation: Pfam domain module=BAH::BAH::DNA_methylase; Domain location=755-889::929-1069::1114-1543
  Subcellular localization annotation: CTP_CleavageSite=26; ConfidenceScore=5.09e-01
MGSASLLNPSQPGVKKNDKSKQKSVVSKTEEEVMFKDKQKKRSLSESSEQTAAMRKMPKRAAACKNLKEKSFLIYEKSCLIETEKDHIVEEESLAVRMTAGQDNGCPNRRITEFILHDETGKSQPLEVLEVDDLFITGLVLPLEASSGKKKEKGVKCEGFGRIESWDISGYEDGSPVIWLSTEVADYDCQKPAASYKKVYDLFLEKARACVEVYKKLAKSSGGDPDISLDELLAGMVRSMSGSKCFSGAASIKDFVISQGEFIYKQLVGLDMTSKANDRMFADIPALIALRDESKKQVHAQVMPSNGSLRIDSGVGDEENKNQMDSVASVNEEDEDAKLARLLQEEEYWQSMNQKKNSRSASASNKYYIKINEDEIANDYPLPVYYKTSLQETDEFIVFDNDYDIYDTQDLPRSMLHNWSLYNSDARLVSLELLPMKPCSDIDVAIFGSGIMTSDDGSGFHLDTEAGKSSSVGSGAQVADGMPIYLSAIKEWMIEFGSSMIFISIRTDLAWYRLGKPAKQYAPWYDTVLKTARLAISIITLLKEQSRVSRLSFGDVIRKVSEFDKKDGSYISSDPLTVERYVVVHGQIILQLFAEFPDDKIRKSAFVTGLTNKMEERHHTKWLVKKKKVVPRSEPNLNPRAAVGPVVSKRKAMQATTTRLINRIWGEYYSNHLPEDAKEGIASELKDEDEVEEQEENEDDDNEETILLEGTPKAHSASKQTKKFSAETEIRWEGEPEGKTSSGYPVYKQAIIRGEVISVGRSVLVEVDETDEFPDIYYVEYMFESKIGRKMFHGRMMQRGCQTVLGNAANEREVFLTNECRDLGLHDVNQTVVVNIQNRPWGHQHRKDNIIADRVDRAQAEERKKKGLPTEYYCKSLYWPERGAFFSLPLDTLGLGSGVCPSCKIQDAEKEKDVFKVNSSKSGFLLKGTEYSLNDYIYVSPFEFEEMIEQGTHKSGRNVGLKAYVVCQVLEIVVKKEIKEAEIKSTQVKIRRFFRPEDVSNEKAYCSDIQEVYYSDETHIISVESIEGKCQVRKKNDIPECSALGRMFQNVFFCELLYDPATGSLKKLPAHVKVKYSSGQTSDAAARKRKGKCIEGDDVLESPNEGKTLNEKRLATLDIFAGCGGLSEGLQQSGVSSTKWAIEYEEPAGDAFKANHPEALVFINNCNVILRAVMEKCGDTDDCISTSEAAELAAKLDEKEISSLPMPGQVDFINGGPPCQGFSGMNRFNQSSWSKVQCEMILAFLSFADYFRPRYFLLENVRNFVSFNKGQTFRLTLASLLEMGYQVRFGILEAGAYGVSQSRKRAFIWAASPEDVLPEWPEPMHVFSAPELKITLSENVQYAAVRSTANGAPLRSITVQDTIGDLPAVGNGASKGNMEYQNDPVSWFQKKIRGDMVVLTDHISKEMNELNLIRCQKIPKRPGADWRDLPEEKIKLSTGQVVDLIPWCLPNTAKRHNQWKGLFGRLDWQGNFPTSITDPQPMGKVGMCFHPDQDRILTVRECARSQGFPDSYQFAGNIIHKHRQIGNAVPPPLASALGRKLKEAVDSKSST

SEQ ID NO: 198547 - protein, 285 aa, Glycine max
  Coding DNA Sequence Number=SeqID_81769
  Gene Ontology: Mol. function=electron carrier activity; Cellular component=mitochondrion; Biological process=electron transport
  Homolog annotation: Hit_ID=Q1SNF6; Match level="QueryCoverage=99%, HitCoverage=100%, E-value=1e-120, Identity=73%"; Hit description =Cytochrome c, monohaem
  Pfam annotation: Domain name=Cytochrom_C1; Domain location=72-275; Score=459.2; E_value=5.2e-135; Accession=PF02167.6; Description =Cytochrome C1 family
MAGGVIQQILRRKLHPRFTNSPLLSPIVAKKDDAGSSGSQSLRALALIGAGLSGLFSFSTMAAADEAEHGLACPSYPWPHKGILSSYDHASIRRGHQVYTEVCASCHSMSLISYRDLVGVAYTEEEVKAMAAEIEVVDGPNDEGEMFTRPGKLSDRFPQPYANEAAARFANGGAYPPDLSLITKARHNGQNYVFALLTGYRDPPAGVSIREGLHYNPYFPGRAIAMPKMLNDGAVEYEDGTPATEAQMGFKWIFVLSLALLQAAYYRRLRWSVLKSRKLVLDVVN

SEQ ID NO: 198548 - protein, 55 aa, Glycine max
  Coding DNA Sequence Number=SeqID_81770
MSSLSRQSHTRFRCFPQSHDTLPLSPSKCDGDQDVLEYLFQNIFRSNHSEMEYSF

SEQ ID NO: 198549 - protein, 316 aa, Glycine max
  Coding DNA Sequence Number=SeqID_81771
  Gene Ontology: Mol. function=nucleoside-triphosphatase activity; Cellular component=integral to membrane; Biological process=transport
  Homolog annotation: Hit_ID=Q9C6W5; Match level="QueryCoverage=83%, HitCoverage=41%, E-value=1e-104, Identity=65%"; Hit description =White-brown complex homolog protein 14
  Pfam annotation: Domain name=ABC2_membrane; Domain location=52-258; Score=186.3; E_value=7.3e-53; Accession=PF01061.14; Description=ABC -2 type transporter
MIILRFQFCHEHRKKKKVGMTGIELLKRHANEPSNSLHFVGSENQWTTSWWEQFMVLLKRGLTERRHESYLGLRIFQVLSVSILSGLLWWHSDPSHIHDQVGLLFFFSIFWGFYPLFNAVFAFPLERPMLMKERSSGMYHLSSYYVARMVGDLPMEFVLPTIFVAISYWMGGLKPSLVTFVLTLLIMLFNVLVSQGIGLALGAILMDVKQATTLASVTMLVFLLAGGYYIRHIPFFIAWLKYISFSHYCYKLLVGVQYSVNEVYQCRQGLHCRIRDFLAIKCLRLDSLWGDVAVLAVMLIGYRVVAYLALRMGLHH

SEQ ID NO: 198550 - protein, 500 aa, Glycine max
  Coding DNA Sequence Number=SeqID_81772
  Gene Ontology: Mol. function=hydrolase activity
  Homolog annotation: Hit_ID=Q6ZK44; Match level="QueryCoverage=61%, HitCoverage=80%, E-value=1e-130, Identity=65%"; Hit description =Kelch repeat-containing protein-like
  Pfam annotation: Domain name=Kelch_1; Domain location=165-211; Score =13.0; E_value=0.13; Accession=PF01344.15; Description=Kelch motif
  Pfam annotation: Domain name=Kelch_1; Domain location=309-370; Score =18.1; E_value=0.032; Accession=PF01344.15; Description=Kelch motif
  Pfam annotation: Domain name=Kelch_2; Domain location=165-211; Score =11.9; E_value=1; Accession=PF07646.5; Description=Kelch motif
  Pfam annotation: Domain name=Kelch_2; Domain location=255-307; Score =29.8; E_value=9.9e-06; Accession=PF07646.5; Description=Kelch motif
  Pfam annotation: Domain name=Kelch_2; Domain location=308-370; Score =6.5; E_value=5.2; Accession=PF07646.5; Description=Kelch motif
  Pfam module annotation: Pfam domain module=Kelch_1::Kelch_1::Kelch _2::Kelch_2::Kelch_2; Domain location=165-211::309-370::165-211::255 -307::308-370
  Subcellular localization annotation: CTP_CleavageSite=57; ConfidenceScore=5.37e-01
MALIFQANNPKKPMASLTAGFHRHNNHRSHSSSASKIIIFFCLSAFLGLAIIANLFRASLSTHYLSIATNWVDTNAPVLILKLAATPHNSNNKLNPKVSLQVEDCFVLPLNIGFPVLMSVKFEHLRGKDGKIAQRMGPQRFLSATFADLPAPEWQWEQMPSAPVPRLDGYSIQIKNTFYVFAGYAHLDHVHSHIDVFDFSINKWVDQIKMPNEMAHSHLGIASDGRHCNKEMETFATIASPQTNAVDATIVVVVMWYAPATQLWKGRLHVMGGSKENRHTPGRDHWSLAVKDGETLEQQWRDEVPIPRGGPHRACIAVNDRLFVIGGQEGDFMAKPGSPIFKCSRRHEVVYGDVYMLDDEMKWKILPPMPKPDSHIECAWVIVNNSIIITGGTTEKHPVTKRMMLKWSVIGKLPYRIKTTLTGFWDGWLYFTSGQRDRGPDNPQPKKGKVGVERKDYLSMSYKASWGVGTKPYGMRNISLILEASTIDFEFSKRATYGGF

SEQ ID NO: 198551 - protein, 66 aa, Glycine max
  Coding DNA Sequence Number=SeqID_81773
  Gene Ontology: Mol. function=actin binding; Cellular component=F -actin capping protein complex; Biological process=actin cytoskeleton organization and biogenesis
  Homolog annotation: Hit_ID=Q9M9G7; Match level="QueryCoverage=94%, HitCoverage=40%, E-value=3e-17, Identity=49%"; Hit description =Probable F-actin capping protein subunit beta
MIKDGSKTGQGRRGYLEEGAWDAIHVIEMSMKLSVADGHLCNMGRMIEEMESKLRNSLDQVIVSKE

SEQ ID NO: 198552 - protein, 108 aa, Glycine max
  Coding DNA Sequence Number=SeqID_81774
  Homolog annotation: Hit_ID=Q1SD40; Match level="QueryCoverage=41%, HitCoverage=11%, E-value=8e-11, Identity=71%"; Hit description =Peptidase A1, pepsin
MARADRLLFSAKIMYKLGISSSKINLLLPILKEFAKITREGSLALVALPFDGILGLGFQDTSVGKVTPVVLEAWFKERSNMLTECSKCKLSEEFEANGYKVRAKRKAR

SEQ ID NO: 198553 - protein, 131 aa, Glycine max
  Coding DNA Sequence Number=SeqID_81775
  Homolog annotation: Hit_ID=Q9SZY4; Match level="QueryCoverage=48%, HitCoverage=11%, E-value=3e-18, Identity=68%"; Hit description =Nitrate transporter
MSLMKLLRGGVRLRRSSVVGDGGGHGEVQLEGDAGRRGEEGNLRGFQCYVAQRPRHPGKRYRYKRSFGSPIVHIFQVIAASIKKRKMQLPYNVGSLYEDTPEASRIEHTEQFRFLEKAAIVAILFPRKQGY

SEQ ID NO: 198554 - protein, 232 aa, Glycine max
  Coding DNA Sequence Number=SeqID_81776
  Gene Ontology: Mol. function=nucleoside-triphosphatase activity; Cellular component=integral to membrane; Biological process=transport
  Homolog annotation: Hit_ID=Q7XA72; Match level="QueryCoverage=96%, HitCoverage=47%, E-value=4e-82, Identity=69%"; Hit description=White- brown complex homolog protein 21
  Pfam annotation: Domain name=ABC_tran; Domain location=1-188; Score =99.4; E_value=1.1e-26; Accession=PF00005.17; Description=ABC transporter
MAMLDPSGSGKTTLLTALAGRLDGKLSSAITYNGHPFSSSMKRNIGFVSQDDVLYPHLTVLESLTYAVMLKLPKSLTREEKMEQVEMIIVDLGLSRCRNSPVGGGAALFQGISGGERKRVSIGQEMLVNPSLLLLDEPTYGLDSTMAQRIMAMLQSLARAYRTVVTTIDQPSSRLYWMFDKVVMLSDGYPIFTGQTDQVMDYLESVGFVPVFNFVNPTDFLLDLANVTWEEV

SEQ ID NO: 198555 - protein, 141 aa, Glycine max
  Coding DNA Sequence Number=SeqID_81777
MGEAEEVQEKMKADMEAMKEQMATMMEAMMSMKKIMEANAVIVAATSAVAKVNPMLPSGLKQMNHPTSNMHAFPPYGLPLNYTPPNVVYIPNEDVNNSTPILIKSQQPQSDHAHVSRPMEETHEIPHHDLAHFRALPRICC

SEQ ID NO: 198556 - protein, 318 aa, Glycine max
  Coding DNA Sequence Number=SeqID_81778
RNLHKGLANLQDGSIDVAVVKEFYANLYTTEEQAPKQAKVRGHLIKIDADSLNEFLQTPVGQPWKLLRKDLMTLAQTWSVFFYSNLAPTSHTSDLNMDRARLVYGLVTKMDMNIGALISGQISFIAQSNSTRLRFPALITALCRVRGVTSDSLTYENLSPTINLAYIKKNCWNVDDLTVNFRGVRKARVRPADVPSSTTLPAPSTSATPTPAPPSSSTQDSQWSILLVEQFIEKVSWPRTLSSVMREGEGPSAQGIGKTGCCYSREISIDFTKSTLSSGGSIFSSTVADPPTLVLDLPVDPPTPLLEILEEGTQDQET

SEQ ID NO: 198557 - protein, 417 aa, Glycine max
  Coding DNA Sequence Number=SeqID_81779
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=72%, HitCoverage=82%, E-value=1e-101, Identity=64%"; Hit description =Matrix metalloproteinase MMP2
  Pfam annotation: Domain name=PG_binding_1; Domain location=76-138; Score=49.5; E_value=1.1e-11; Accession=PF01471.9; Description =Putative peptidoglycan binding domain
  Pfam annotation: Domain name=Peptidase_M10; Domain location=163-327; Score=52.4; E_value=1.5e-12; Accession=PF00413.14; Description =Matrixin
  Pfam module annotation: Pfam domain module=PG_binding_1::Peptidase _M10; Domain location=76-138::163-327
MKPFLRSIFLLFLILLDQSISASAFFNGLLNIEKWPFSEKSLKWGKVGKETIDSINDYLKKELESPPALPKQINIEVEGLSVVKYYLSDYGYIESSGPFNNIFDQETMSAIKTYQEFSNLPVTGVPNKQLKQQMLSLRCGVPDVNIDYNFTDDNTSYPKAGHRWFPNRNLTYGFLPKNQIPDNMTKVFRDSFARWAQASGTLSLTETTYDNADIQVGFYNFTALSIEVQVYGGSLIFLQPDSSKKGVVLMDGNMGWLLPSENASLSKDDRVLDLETVAMHQIGHLLGLDHSPKEDSVMYPYILSSQSQQRKVQLSDSDKANIHLQFANSASHAVLRKKKKLRRVPTGCLRWREGVLCGRKEEGQTRKDWKKGIKEKIRKLNQVSRETKSIIAGVKFKNYTKFHKEDPYMFQMLDSFE

SEQ ID NO: 198558 - protein, 72 aa, Glycine max
  Coding DNA Sequence Number=SeqID_81780
  Subcellular localization annotation: CTP_CleavageSite=41; ConfidenceScore=5.03e-01
MASLVSLSKSLMALAISIGNRQSNWRVPWSDAAATPFPVARLQEVTEVAGALKGSCNCHWRVAWKLQLPLAI

SEQ ID NO: 198559 - protein, 104 aa, Glycine max
  Coding DNA Sequence Number=SeqID_81781
  Gene Ontology: Mol. function=transporter activity; Cellular component= integral to membrane; Biological process=transport
  Homolog annotation: Hit_ID=Q2PF01; Match level="QueryCoverage=54%, HitCoverage=9%, E-value=5e-10, Identity=50%"; Hit description =Putative cytosolic factor
MSCKSFTNFREHSNHDICHGPLIKPPIHPMVIEKLDTVNTIIVSYLIIYLTNNQGLSQAKIYSSGAASGEVRWTKQRWGARKYRCCHRNHSEAGSKTYSGIFSY

SEQ ID NO: 198560 - protein, 110 aa, Glycine max
  Coding DNA Sequence Number=SeqID_81782
  Homolog annotation: Hit_ID=UPI000069ED77; Match level="QueryCoverage =97%, HitCoverage=60%, E-value=3e-07, Identity=31%"; Hit description =UPI000069ED77 related cluster
MGDWFWVAGCGLGLGVIWQLALVLGEWRQLVDNSSYACTGMGDWFWVAGCGLGLGVIWQLALVLGEWRQLVDNSSYACTGMGDWFWVAGCGLGLGVIWHLLSFLGSGDNL

SEQ ID NO: 198561 - protein, 438 aa, Glycine max
  Coding DNA Sequence Number=SeqID_81783
  Gene Ontology: Mol. function=metalloendopeptidase activity; Cellular component=proteinaceous extracellular matrix; Biological process =peptidoglycan metabolic process
  Homolog annotation: Hit_ID=Q93Z89; Match level="QueryCoverage=59%, HitCoverage=71%, E-value=1e-104, Identity=72%"; Hit description =Matrix metalloproteinase MMP2
  Pfam annotation: Domain name=PG_binding_1; Domain location=103-165; Score=30.1; E_value=8e-06; Accession=PF01471.9; Description=Putative peptidoglycan binding domain
  Pfam annotation: Domain name=Peptidase_M10; Domain location=190-352; Score=51.3; E_value=3.3e-12; Accession=PF00413.14; Description =Matrixin
  Pfam module annotation: Pfam domain module=PG_binding_1::Peptidase _M10; Domain location=103-165::190-352
MKPYLRAIFLVFLILLDQSSISASASFNFNGLRNIAKLPSVEKLLKLGEPAKKTTDIANEILKKLFEYYKDDLPLKSPPPPPMYRLQPKSDLPAPNAPPKQINITGLYIVKDYLSDYGYIESSGPFNDSFDQEIISAIKTYQNFSNLQVTGGLNKELIQQMLSIRCGVPDVNFDYNFTDDNISYPKAGHRWFPNRNLTYGFLPENQIPDNMTKVFRDSFARWAQASGTLSLTETTYDIADIQVGFYNFTALGIEVEVYGGSLIFLQPDSSKKGVVLMDGNIGWLLPSENATLSKDDRVLDLETVAMHQIGHLLGLEHSPKEDSVMYPYILSSQQRKVKLSNSDKANIHLEFAKHDSDLTSPNSHDSASHAINSVLCKFIYFLEESKVGKRNTSSNSFERCCERRKNSGECPLVVCGGEKECCAEEKKRGKQGKTGRKE

SEQ ID NO: 198562 - protein, 48 aa, Glycine max
  Coding DNA Sequence Number=SeqID_81784
MHACSKQTARNRQFDWRVPLGRASALQQGAQELRLLQDAGVTGKSSLL

SEQ ID NO: 198563 - protein, 138 aa, Glycine max
  Coding DNA Sequence Number=SeqID_81785
MGSFLKFFREGAVIYMFCMHAPRKSPVELASLLSVNKSQVAMVILSCIGNRQFDWRVPLGRLRRSSFAGVRPCSFAGVRQAMQVCRVQWSAVQEGTTNRDGNLHLTEIVSVAGELWTVLCSSYYVVSLLFLLRDFSVS

SEQ ID NO: 198564 - protein, 140 aa, Glycine max
  Coding DNA Sequence Number=SeqID_81786
MGSSQKPSFKKRFYQVKIKSLEVTSLREVGQLMGQLQRQAFRKPMYYDQPLRCFTFEDFQLVPTVKEFEEIRGCPLGGRKPYLFSGLYPSTTRVAKVVKISAQELNRVKQNRNGVVGVPRKCLEERAKTLENQGDWAFFY

SEQ ID NO: 198565 - protein, 152 aa, Glycine max
  Coding DNA Sequence Number=SeqID_81787
  Gene Ontology: Mol. function=metalloendopeptidase activity; Cellular component=proteinaceous extracellular matrix; Biological process =peptidoglycan metabolic process
  Homolog annotation: Hit_ID=Q1SAT9; Match level="QueryCoverage=63%, HitCoverage=26%, E-value=1e-20, Identity=52%"; Hit description=H+ -transporting two-sector ATPase, delta (OSCP) subunit; Peptidase, metallopeptidases
  Pfam annotation: Domain name=PG_binding_1; Domain location=62-126; Score=44.6; E_value=3.3e-10; Accession=PF01471.9; Description =Putative peptidoglycan binding domain
  Subcellular localization annotation: CTP_CleavageSite=35; ConfidenceScore=5.46e-01
MSFSAAQDVSVSISFVPAAVGVIARQIPSWLRLIRASKFFSNMLNKFKSFFNMFKELKLGNIAKGVSNVKQYLDLFGYLNSTLHSNFSDDFTLDLQSAIIKYQKNFNLNVTGQIDRKTYNIISQQRCGVPDIINGTTTMSMGNSNKTPFYAV

SEQ ID NO: 198566 - protein, 99 aa, Glycine max
  Coding DNA Sequence Number=SeqID_81788
  Gene Ontology: Mol. function=metalloendopeptidase activity; Cellular component=proteinaceous extracellular matrix; Biological process =peptidoglycan metabolic process
  Homolog annotation: Hit_ID=Q1SHN7; Match level="QueryCoverage=50%, HitCoverage=14%, E-value=6e-11, Identity=63%"; Hit description =Peptidase M10A and M12B, matrixin and adamalysin; Peptidase, metallopeptidases
  Pfam annotation: Domain name=Peptidase_M10; Domain location=1-97; Score=-5.7; E_value=1.3e-06; Accession=PF00413.14; Description =Matrixin
ITFLELDGKGGTVGGADRNYSLGVGSVYLDSEEEWVVRGENEEGDVDLESVVMHMIGHLLGLGHSSVEEAVMYPIVLPEKKTELSYDDLQRIHQIYHVK

SEQ ID NO: 198567 - protein, 92 aa, Glycine max
  Coding DNA Sequence Number=SeqID_81789
REIVAKTNSLTRAKREIGAKRDVKIRKPFLSLICTELRGSEENYSLLRGLKSVNFRERRVEQGAKFSSFREISEFLSDCEIPRGGGDIPTPL

SEQ ID NO: 198568 - protein, 222 aa, Glycine max
  Coding DNA Sequence Number=SeqID_81790
  Subcellular localization annotation: CTP_CleavageSite=35; ConfidenceScore=5.06e-01
MKNYLSKTLSLFSVLLFLGSCTPLKTALNKKFPPVSTIDQQYTSVEKNLSELTDFSPHIGVNIDRDIILQYLPPEIKKAAEAINDENILVQNVTPKLSFDKQGIFVEADFSVRFPKYSIEATGNFKGVTAVSSKSDSLYLRSALTSLKIESIQFLKHPKISQKVLAKLLSPILKNYIDNVNGQIFKKPTIINIGWGQSYQLSLKEMFKNPDTEIIADSIRIS

SEQ ID NO: 198569 - protein, 102 aa, Glycine max
  Coding DNA Sequence Number=SeqID_81791
MAIQGDDSEAGQKMEKHKQKLTPKPTLEPVFDFVEHEEINEETEDDKEEETPIKEKEKEKEKEKKLKNEKQKEEVVDDEMRKGKSEANTEKKKDNYPNEGKE

SEQ ID NO: 198570 - protein, 103 aa, Glycine max
  Coding DNA Sequence Number=SeqID_81792
  Gene Ontology: Cellular component=integral to membrane
  Homolog annotation: Hit_ID=Q7N123; Match level="QueryCoverage=99%, HitCoverage=43%, E-value=7e-17, Identity=51%"; Hit description =Similar to putative transport protein YgdQ of Escherichia coli
MAVDEFADRSGSEHHHADGDHHCRHHDEQMVGKAHGGNHRIQAEDNIQQHDLHDRAEEAVHLGVVLFFRPFDGFVDLFTGFPDQEQPAQKQDQIASGYAVLHH

SEQ ID NO: 198571 - protein, 83 aa, Glycine max
  Coding DNA Sequence Number=SeqID_81793
  Homolog annotation: Hit_ID=UPI00005FA08F; Match level="QueryCoverage =42%, HitCoverage=14%, E-value=4e-12, Identity=91%"; Hit description =COG0861: Membrane protein TerC, possibly involved in tellurium resistance
MLALAFLILVGFTLMLESFQVHVPKGYIYFAMFFSMSDPQDEKVGNGSVCAGDGGWPGGVFQRLRDGDQRRQHDPDARQTGDR

SEQ ID NO: 198572 - protein, 67 aa, Glycine max
  Coding DNA Sequence Number=SeqID_81794
SHVQSGGYECGYYVMHWMWNIVSGGLKNDWSMWFLDGTALDNETITTIRQKWVAYFLKVQSNQCTKS

SEQ ID NO: 198573 - protein, 172 aa, Glycine max
  Coding DNA Sequence Number=SeqID_81795
  Homolog annotation: Hit_ID=Q47522; Match level="QueryCoverage=30%, HitCoverage=64%, E-value=5e-24, Identity=100%"; Hit description=LacZ protein
MALEFDLYFSFTMDMLFDSFIIVRLPSAVYITATPSLVVVGCSPFRFFILTYGPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 198574 - protein, 79 aa, Glycine max
  Coding DNA Sequence Number=SeqID_81796
MQCHRMQGIGVSPPATSDSAYRLFENEASRRFYHHILQAHKGEHSITRISKIEGSSICCLERQLGLSSGMLPRLGLLRG

SEQ ID NO: 198575 - protein, 117 aa, Glycine max
  Coding DNA Sequence Number=SeqID_81797
MAPRKLASKRSRKDKAAEGTSSAPEYDSHRFRSAEHQQRFEAIKGWSFLRERHVQLRDDEYTDFQEEIVRRRWASLVTPMANAVHVSSTFEFGAVLHDCLSADPQGNPLFSPFFGAP

SEQ ID NO: 198576 - protein, 86 aa, Glycine max
  Coding DNA Sequence Number=SeqID_81798
GVVLAEVLLADSRFTRPDMGFHPTKLNFVPSDADEAPLDVSICLHAFGIVGCGSFSGVKSCEREEPFLPGLFVGTLEDFKVPHVNH

SEQ ID NO: 198577 - protein, 65 aa, Glycine max
  Coding DNA Sequence Number=SeqID_81799
MVPRKLLPERNVVVYYTEFDEFKEELERRHWDEELTSFVDGSIDVAIVKEFYANLYDPEDKSPKK

SEQ ID NO: 198578 - protein, 173 aa, Glycine max
  Coding DNA Sequence Number=SeqID_81800
  Gene Ontology: Mol. function=chitin binding; Cellular component =extracellular region; Biological process=chitin metabolic process
  Homolog annotation: Hit_ID=UPI000044A8F0; Match level="QueryCoverage =72%, HitCoverage=99%, E-value=1e-19, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGPLKESASCFLVRLKSFGTCTYWLAFRGLHVLTFRGLHALAIRGLHVLTFRGLHALAIRGLHVLTFRGLHVLTFRGLHALAIRGLHVLTFRGLHALAIRGLHVLTFVGLHALTFRGSHILANRGLHALTFKGLHVLANRGLHTLTSRGLHIRTSPLEGYVSSFSVCSISTP

SEQ ID NO: 198579 - protein, 152 aa, Glycine max
  Coding DNA Sequence Number=SeqID_81801
MVNETGIVVLLRPFWVSAGKEKATVRRVFLLALIYFAIPNGENARNWVANLVLKFHDDPTVNEFEIIVFLRQVLWAAGKRKGFGEEKRENENEGKKRHRQSKTDLTSLFIPKEGIPNQLQRLMCELDNTPNNLGCGRKEVHHTRIIGITFEI

SEQ ID NO: 198580 - protein, 337 aa, Glycine max
  Coding DNA Sequence Number=SeqID_81802
  Homolog annotation: Hit_ID=Q5XM22; Match level="QueryCoverage=26%, HitCoverage=64%, E-value=8e-12, Identity=48%"; Hit description =Resistance-like protein HAAS-2
  Subcellular localization annotation: CTP_CleavageSite=62; ConfidenceScore=5.24e-01
MRSSPPPLCRSVDNDAGGWVTSRKGTVALATATRKCSRFPAVKLDKAGISASGAARTLGVAPAMAKEHLLSAESKVVGASSVRASVCVVPSVRAPTVDIDLYHRKSLCDFPLVLSVLAMIMFRARGLSRTLGKVIGRTLGREVVEHVDHATDEVHEQPKEGTVDDAQGPFHSFKALYVDEVVDLLVYLLEVNSEKARAETLQYRCTLFANKSVTHVYVVFFNAFCDLSQTGSYAWRAVALVHMYEKLNDASKRRTRQLAEYIITLYSVGSISIFLLLLLLLLLKIIMRGNHVLVVGSLGRHYQCRRITIPPDPATPSLCIEDIDDRWIRFSEYLALM

SEQ ID NO: 198581 - protein, 54 aa, Glycine max
  Coding DNA Sequence Number=SeqID_81803
MVVATTSSELKRSLTHPSIVRQTHGIYGRGVLGSPTLPASVLGVQLIYLLGNFT

SEQ ID NO: 198582 - protein, 191 aa, Glycine max
  Coding DNA Sequence Number=SeqID_81804
  Gene Ontology: Mol. function=oxidoreductase activity, acting on the CH-OH group of donors, NAD or NADP as acceptor; Cellular component =mitochondrion; Biological process=malate metabolic process
  Homolog annotation: Hit_ID=P37225; Match level="QueryCoverage=98%, HitCoverage=28%, E-value=8e-73, Identity=72%"; Hit description=NAD -dependent malic enzyme 59 kDa isoform, mitochondrial precursor
  Pfam annotation: Domain name=malic; Domain location=123-191; Score= -25.0; E_value=4.3e-06; Accession=PF00390.9; Description=Malic enzyme, N-terminal domain
MWKLVRYAAASNLARSRRFSAAIPGPCIVHKRGADILHDPWFNKCFILAETTQLLTVYLLDTGFPLTERDRLGLRGLLPPRVISFEQQYDRFMNSFRSLENNTQGQPDKVVSLAKWRILNRLHDRNETLYYRVLIDNIKEFAPIIYTPTVGLVCQNYSGLFRRPRGMYFSAKDKGEMMSMIYNWPAHEVLH

SEQ ID NO: 198583 - protein, 156 aa, Glycine max
  Coding DNA Sequence Number=SeqID_81805
  Gene Ontology: Mol. function=serine-type endopeptidase activity; Cellular component=cytoplasm; Biological process=negative regulation of enzyme activity
  Homolog annotation: Hit_ID=Q9LLL8; Match level="QueryCoverage=93%, HitCoverage=33%, E-value=4e-27, Identity=33%"; Hit description=Xylem serine proteinase 1 precursor
MAEAVSVIPNQYRKLHTTRSWDFIGLPLTAKRKLKSESDMILALLDTGAKYFKNGGRADPSDILSPIDMVGHGTHTASTAAGNLVPDASLFGMRCHRPGWQVEGIQTMCMTLGIGAFHAMRKGIITLVALIDRDFRSTIELGSGKNVTVSSEYGTH

SEQ ID NO: 198584 - protein, 338 aa, Glycine max
  Coding DNA Sequence Number=SeqID_81806
  Gene Ontology: Mol. function=acyltransferase activity; Cellular component=integral to membrane; Biological process=metabolic process
  Homolog annotation: Hit_ID=Q5Z801; Match level="QueryCoverage=66%, HitCoverage=47%, E-value=5e-63, Identity=51%"; Hit description =Putative JD1
  Subcellular localization annotation: CTP_CleavageSite=30; ConfidenceScore=5.13e-01
MADDSDLTSPLLSSSSSSSSDHVVVTVHPSAAPPRNPFRVLGTDDDDDDDLSVPPPSTLDPFRNRTPAIEGLYEWAKTVLCLPLAALRLAIFGLCLALGYVATKVALQGWKDKENPMPKWRCRVMWITRLCARCILFSFGGKGDSYQWIKRKGKPAPREIAPIIVSNHVSYIEPIFYFYELFPTIVAAESHDSIPFVGTIIRAMQVIYVNRFLPSSRKQAVREIKKSAFKELNNREGPLAIDFLEYYYFPREQQQMAGTLSPSNLVEYLPVIYPLDDKETAVHFRERQLKIRTPNQESLYKAQIAESRSLGSILQSDGLINGDVAHRIQAGGWNGGLL

SEQ ID NO: 198585 - protein, 530 aa, Glycine max
  Coding DNA Sequence Number=SeqID_81807
  Gene Ontology: Mol. function=phospholipase D activity; Cellular component=membrane; Biological process=phosphatidylcholine metabolic process
  Homolog annotation: Hit_ID=Q9AWB6; Match level="QueryCoverage=76%, HitCoverage=84%, E-value=9e-88, Identity=55%"; Hit description =Phospholipase PLDb2
  Pfam annotation: Domain name=PLDc; Domain location=294-329; Score =29.5; E_value=1.2e-05; Accession=PF00614.12; Description =Phospholipase D. Active site motif
  Pfam annotation: Domain name=PLDc; Domain location=439-466; Score =39.5; E_value=1.2e-08; Accession=PF00614.12; Description =Phospholipase D. Active site motif
  Pfam module annotation: Pfam domain module=PLDc::PLDc; Domain location=294-329::439-466
MDNYGSLQHPYGYPNPPHDLYAQPPYPYPYPPNPPYTNNFNYSYPPPPPPPHSSSPYSSHIDYSSYPPPPSTSSHGSFDYPMPQPPHTYLYPSDSYDLPHSSSAYPTLDDRMNNEDPSRVSDNSDDSVHSQSLQIVPAQLKGSLRVMLLHGNLDIWVHGATNLPNMDMFHKTLEDMFGRLPAEVHFVVKDSDVVGSQLIGVVAIPVEQIYSGKGGTVTLYQDAHVPNGCLPNVVLENEEGVRVLLLVWDDPTSRNILGYKVDGVMATRDEETRRFFKHSSMQVLLCPRIAGKRNSWVKQQKTVIVDADAGNNKRKIVAFVGGLDLCDGRYDTPHHPMFRTLQTLHKDDYHNPTFTGNTGGCPREPWHDLHSKIDGPAAYDILKNFEERCASNAPSVGDDNPESWHVQIFRSIDSNSVKGFPKEPKNASSMAFSRTNPRFMIYVHSKGMIVDDEYVILGSANINQRSIEGTRDTEIAMGAYQPHHTWARRQYYPRGQPYPCICKEAVSGFEPMTNKSPRHNFTAAPGLALR

SEQ ID NO: 198586 - protein, 754 aa, Glycine max
  Coding DNA Sequence Number=SeqID_81808
  Gene Ontology: Mol. function=identical protein binding; Cellular component=cytoplasm; Biological process=negative regulation of enzyme activity
  Homolog annotation: Hit_ID=Q84WS0; Match level="QueryCoverage=98%, HitCoverage=94%, E-value=0.0, Identity=55%"; Hit description =Putative subtilisin-like serine protease
  Pfam annotation: Domain name=PA; Domain location=353-452; Score=81.4; E_value=2.8e-21; Accession=PF02225.12; Description=PA domain
  Pfam annotation: Domain name=Peptidase_S8; Domain location=103-595; Score=49.5; E_value=1.2e-11; Accession=PF00082.12; Description =Subtilase family
  Pfam annotation: Domain name=Subtilisin_N; Domain location=12-100; Score=36.7; E_value=7.8e-08; Accession=PF05922.7; Description =Subtilisin N-terminal Region
  Pfam module annotation: Pfam domain module=PA::Peptidase _S8::Subtilisin_N; Domain location=353-452::103-595::12-100
MVTNSVAVMNKQTYIIHMDKTKIKATVHSQDKTKPWFKSVIDFISEASSSSEEEEAPQLLYVYETSMFGFAAQLSNKQLEYLNQIDGFLSAIPDELLTLHTTYSPHFLGLQNGKGLWSASNLASDVIIGVLDTGIWPEHISFQDTGLSKVPSRWKGACEVGTNFSSSCCNKKLVGARVFLQGYEKSAGRINETLDYRSARDAQGHGTHTASTAAGNMVSNASFFGLAGGSASGMRYTSRIAAYKVCWRLGCANSDILAAIDQAVADGVDVLSLSLGGIAKPYYNDSIAIASFGATQKGVFVSCSAGNSGPSSSTAGNVAPWIMTVAASYTDRSFPTQVKLGNGKVFKGSSLYKGKKTSQLPLVYRNSSRAQRTAQYCTKGSLDPKLVKGKIVACERGINSRTGKGEEVKMAGGAGMILLNSENQGEELFADPHVLPATSLGSSASKTIRSYIFHSAKAPTASISFLGTTYGDTAPVMAAFSSRGPSSVGPDVIKPDVTAPGVNILAAWPPTTSPSMLKSDKRSVLFNIVSGTSMSCPHVSGIAALIKSVHKDWSPAAIKSALMTTASTSNNKGAPISDNGSNNSAFADPFAFGSGHVNPERASDPGLVYDITTKDYLNYLCSLKYTSSQIAILSKGNFKCAKKSALHAGGLNYPSFAVLFDTSARNASVTYKRVVTNVGNPSSSYAVKVEEPKGVSVTVEPRNIGFRKIGDKLSYKVSFVSYGRTAVAGSSSFGSLTWVSGKYAVRSPIAVTWQ

SEQ ID NO: 198587 - protein, 174 aa, Glycine max
  Coding DNA Sequence Number=SeqID_81809
  Gene Ontology: Mol. function=serine-type endopeptidase activity; Cellular component=cytoplasm; Biological process=negative regulation of enzyme activity
  Homolog annotation: Hit_ID=Q9LLL8; Match level="QueryCoverage=99%, HitCoverage=23%, E-value=6e-55, Identity=58%"; Hit description=Xylem serine proteinase 1 precursor
MSHRVNKEAEFAYGAGEVNPTRAMNPGLVYDMDDFAYIQFLCHEGYDGSSLSVLVGSPVNCTSLLPGLGHDAINYPTMQRSVQNNTGTTVGVFRRRVTNVGPAPTAFNATIKSPKGVEITVKPTSFNFSHTLQKKSFKVVVKAKPMASMQIMSDSLIWRSPRYIVRSPIVIYSP

SEQ ID NO: 198588 - protein, 46 aa, Glycine max
  Coding DNA Sequence Number=SeqID_81810
MMHAPNSTLRCNVGTVLSLSRPPGCARNSPPPIGDQPGSPKVFPTR

SEQ ID NO: 198589 - protein, 199 aa, Glycine max
  Coding DNA Sequence Number=SeqID_81811
GSTRRKKSMSPFLVRDLGAQKFPRLYKESIRHGKPRLDWLAKLKVVSEESFEAPEEDEEVQTLKSELGKAKLAKEKFKLAATHVRKECVGLREENAITARALEQETKRARKEEYGRNKIRGALWGSNSELKLRREERDQSRAHSMTNMLAIIAKYQEELGLATAHEHRIADEYAQIYAEKEARGRVIDSLHQEATMWMD

SEQ ID NO: 198590 - protein, 233 aa, Glycine max
  Coding DNA Sequence Number=SeqID_81812
  Gene Ontology: Mol. function=nucleic acid binding; Cellular component= nucleus; Biological process=DNA integration
MSAMDMIKSLSSKPEKFTGENFFCWQQQMKFWLTELDLYSVISKREIKTSTSSTDIVQTDATIKHDVSDKDILCHGRILSALADNIYKIFCHTKTSVELWEALELKYGSAEKGLSRYSCEKMIEFQMIDGKSISDQIHEFENIVYDMKLKGIVLPDIMLVAFMISKLPPSWTDFARSLKHKHESFTFDDLLVCLRIEDKHRSSQKHLQKSDSHSKAYLVESSSKPFSKSFKRH

SEQ ID NO: 198591 - protein, 111 aa, Glycine max
  Coding DNA Sequence Number=SeqID_81813
MHIVVVKQGQDHLELPSGVETKHERQKPIKVLKDGCKWGWGHDRPIVAPFSARNKQRMSLQGSPVSFVSSPGRATPAPNYKNDERGGVFTFKNFFSPLSKAIPTGLTNLQP

SEQ ID NO: 198592 - protein, 55 aa, Glycine max
  Coding DNA Sequence Number=SeqID_81814
MELASLCLQIKHPFEKIGPFEFLDGFRCSISSVTIYNDPESDIRVKSYDHFHFSR

SEQ ID NO: 198593 - protein, 80 aa, Glycine max
  Coding DNA Sequence Number=SeqID_81815
  Subcellular localization annotation: CTP_CleavageSite=26; ConfidenceScore=5.06e-01
GVPVAPSKVIRPPTNRAFIKKYCVSRQAQGKTPQQPGDGRQRATDAPPSPLKFTSGHPQKGLSIAYTTWPANRRPSPKPK

SEQ ID NO: 198594 - protein, 84 aa, Glycine max
  Coding DNA Sequence Number=SeqID_81816
MILHENRRPNSLKIVPSGVIDCRNLPFGGKAMWGSRARLPRKEGAWSRHQRLFEENVRKTGKGKVLAPHASVTRDDNLQSSVQI

SEQ ID NO: 198595 - protein, 110 aa, Glycine max
  Coding DNA Sequence Number=SeqID_81817
  Gene Ontology: Mol. function=prephenate dehydratase activity; Biological process=L-phenylalanine biosynthetic process
  Homolog annotation: Hit_ID=Q6JJ29; Match level="QueryCoverage=68%, HitCoverage=16%, E-value=1e-28, Identity=80%"; Hit description =Prephenate dehydratase
TTILCTNRPCKTSIVFVHDKGTSMLFKVLFVFTFCNINLTKIESRPHRNRPIRLVDDTNVGTSKHLEYLFYIDFEASMAEGSGKGKREDAWTQETLGDRVSEKNKVARKW

SEQ ID NO: 198596 - protein, 155 aa, Glycine max
  Coding DNA Sequence Number=SeqID_81818
  Gene Ontology: Mol. function=unspecific monooxygenase activity
  Homolog annotation: Hit_ID=O04892; Match level="QueryCoverage=50%, HitCoverage=13%, E-value=8e-11, Identity=56%"; Hit description =Cytochrome P450 like_TBP
QNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGVRQGKSAKWIRNLGKRIGSEGWARGSQSRTRRLSVDCSSCFRGES

SEQ ID NO: 198597 - protein, 431 aa, Glycine max
  Coding DNA Sequence Number=SeqID_81819
  Gene Ontology: Mol. function=oxidoreductase activity, acting on single donors with incorporation of molecular oxygen, incorporation of two atoms of oxygen; Cellular component=intracellular
  Homolog annotation: Hit_ID=Q8ZQM7; Match level="QueryCoverage=96%, HitCoverage=99%, E-value=1e-178, Identity=69%"; Hit description =Putative cytoplasmic protein
  Pfam annotation: Domain name=DUF1479; Domain location=13-431; Score =833.7; E_value=9.3e-248; Accession=PF07350.2; Description=Protein of unknown function (DUF1479)
MKLKRKQTECEMNTTFTSEQQPDDFKQHVRLMKQALRAQIGDVEGLFEQVRSKIVSEIAAARAEEKQHGTAWPQVSFVDLAAGRISEQTKDHIRRRGCVVVKQTFSREQALAWDADMLNYLDDNDFDRVYQGPGDNFFGNLDASRPEIYPIYWSDAQMSARQSEAMAQTQAFLNRLWKFESAGTRWFDPDVSIIYPDRIRRRLPGTTSKGLGAHTDSGALERWLLPAYQQVFSKIFSNQFDQYDPWDAAHRTDVQEYQSGTTTKCSVFRTFQGWTALSDMQPGQGLLHVVPVPEAMAYLLLRPLLKDVPEEELCGVAPGKVLPVSERWHPELIAGLCSIPALQAGDSVWWHCDVIHAVAPVENQQGWGNVMYIPAAPMCDKNADYAQQVAQALATGVSPGDFPKEDYEASWRGRFTPQDLNENGRRSLGLA

SEQ ID NO: 198598 - protein, 113 aa, Glycine max
  Coding DNA Sequence Number=SeqID_81820
  Gene Ontology: Mol. function=kinase activity; Biological process =carbohydrate metabolic process
  Homolog annotation: Hit_ID=Q0G1Q6; Match level="QueryCoverage=66%, HitCoverage=16%, E-value=2e-12, Identity=56%"; Hit description =Carbohydrate kinase, FGGY
  Subcellular localization annotation: CTP_CleavageSite=35; ConfidenceScore=5.15e-01
MRSGVRQYLAKSSQLINKAADKPNRGSRTGSSERRCMWRVAISFWVWIPAPRWLKRWRLIWKRRRCRPAVNDANLAGCGQCDSQARRSGGESGGARGGREADRPGQRQLSGRC

SEQ ID NO: 198599 - protein, 159 aa, Glycine max
  Coding DNA Sequence Number=SeqID_81821
  Homolog annotation: Hit_ID=Q66AC5; Match level="QueryCoverage=91%, HitCoverage=67%, E-value=3e-25, Identity=44%"; Hit description =Hypothetical protein precursor
MNIVAVHPERSRYVRGLNLNAATGTQTSAALHAQRCGDRGAGGCHGAEYQSGAHRFGGRRASAGLLRRQLRAENLSRHPAGCRSARGGCRHAGGRTEQRSAAGGGQIRCRLAAAGAAGQTAGRGAAGANGCIPVTGRRSASGHAAAVANRPGDHRHRFA

SEQ ID NO: 198600 - protein, 156 aa, Glycine max
  Coding DNA Sequence Number=SeqID_81822
MRLLPPRSKKERIKIYPQDEGQPLMVKEECKEVSVSSKRLAKKESHFAIKINIKEASPPRQPPHLFLCKKTLVSTVTPLGLEIIAQLKELLDEGLVRKSLNPCALLVPKIDIMRHQIPMIGGVEGKSPEFQEPLDLRSNPFQGGGNDAILPPKGIG

SEQ ID NO: 198601 - protein, 120 aa, Glycine max
  Coding DNA Sequence Number=SeqID_81823
MAKRAFAKRDTQWLSARKNPEEDELLGSLSVPLQVIKRTASAHPLSERSALSQNPLMCAKGFRFAPSARATSACTRVWPWLEAFACLGSSRERKVQVPESFERFCYVKICRDESSKRKPF

SEQ ID NO: 198602 - protein, 65 aa, Glycine max
  Coding DNA Sequence Number=SeqID_81824
MGLRKRVENGELHKAITTHGSKLEGGGHMNENTIHGAPEKGGGRMNENAIHWAPKKGLARPNDPP

SEQ ID NO: 198603 - protein, 140 aa, Glycine max
  Coding DNA Sequence Number=SeqID_81825
  Gene Ontology: Mol. function=protein binding
  Homolog annotation: Hit_ID=Q1T2V8; Match level="QueryCoverage=91%, HitCoverage=14%, E-value=3e-33, Identity=58%"; Hit description =Leucine-rich repeat
  Pfam annotation: Domain name=LRRNT_2; Domain location=31-76; Score =41.1; E_value=3.7e-09; Accession=PF08263.3; Description=Leucine rich repeat N-terminal domain
MKIELVSSVVVVSFYWIWLCNNILVVSGLCLDNQKSLLLEFKNNVTFVDTVDRNSSRLNSWKASNDCCKWMGVTCDEDGHVIGLDLSGELISGGFDNSTSLFDSLWIQQVREINSPESVRGFLYGTDSNRDLSVDKVGYS

SEQ ID NO: 198604 - protein, 98 aa, Glycine max
  Coding DNA Sequence Number=SeqID_81826
HTHTRVKPLPTTLKYAYLKDKEKFPVIISASLAAEQEEKLLLVLKKHKKAIGWTLADIYGISPSTYESLIQDFFKIKPCLTMKGFKSFKAHVIDYQYM

SEQ ID NO: 198605 - protein, 188 aa, Glycine max
  Coding DNA Sequence Number=SeqID_81827
MTDLVSAEDDVNLRVSTGLSAAIDERCRRRHSKKVYTDNHSGISARQRDSKVSMPYLVSAEDDVNLHVSTGLSAAIDEGRRRRHSKKVYTDNHSGISARQRDSKVSMTDLVSAEDDVNLRVSTGLSAAIDERCRRRHSKKVYTDNHSGISARQRDSKVSMTDLVSAEDYVNLRVSTGLLAAIDEGRRR

SEQ ID NO: 198606 - protein, 101 aa, Glycine max
  Coding DNA Sequence Number=SeqID_81828
MVICTFHQPRANEPADTQTNIVFCTFGHPGTASQVAGRDTLWSPAPFVNQGERVRRYQDDVGRPILIIFKIFASFYSCRPETFKPDDARDSSLLGRDDQVQ

SEQ ID NO: 198607 - protein, 134 aa, Glycine max
  Coding DNA Sequence Number=SeqID_81829
MTTLTQTWKTLVLSNVLPRDHNSDLPLPKCQLVYAILTRMSVHVAQVIADAIYLFAAFIEKYYTPRQAQGDAHQAADAQPPPRQADPAGSLGVERYLQHLVLQQSAGQGSTPFVCPTPEQFGAEVAWPGDWLDA

SEQ ID NO: 198608 - protein, 75 aa, Glycine max
  Coding DNA Sequence Number=SeqID_81830
MNTLVSACQSDLGSPNDETLGSLDNKGRVRVTVGCLRMPPDSWVTITKGGVVDKSKAFAPTYPQFVMRNSDLRSS

SEQ ID NO: 198609 - protein, 158 aa, Glycine max
  Coding DNA Sequence Number=SeqID_81831
MGDLEEVQEQMKADMLTLKEQMASMIEVMLGMKQLMESNAETAAIASTAVEADPALSTAVYHPVPNMVGRERSTPRHINNLHPRYNRGAYPYGLPPNYTPPAMHEDVDHVSPLILEGEPPRHPDMIHENPRERAQGDVDSYSPFPTKGPVPNALPQPC

SEQ ID NO: 198610 - protein, 159 aa, Glycine max
  Coding DNA Sequence Number=SeqID_81832
  Gene Ontology: Mol. function=DNA binding; Biological process=plasmid partitioning (sensu Bacteria)
  Homolog annotation: Hit_ID=Q8U907; Match level="QueryCoverage=99%, HitCoverage=47%, E-value=2e-77, Identity=93%"; Hit description =Replication protein B
  Pfam annotation: Domain name=RepB; Domain location=1-155; Score=37.8; E_value=3.9e-08; Accession=PF07506.2; Description=RepB plasmid partitioning protein
KARFAQKLQMRFPRDTIMAAMSLHKGDLSNMLSVVGRIPEDLVDLIGPAPTVGRRNWMDLADQLSSSQVKEAARAYVSEPAVASLPSEERFKALLDFLKPKAQAKKTGVWSSDTGRRLAKVVESDRKLDISIDKNEAPEFAEFVLEHLQTLFAEYRSKQ

SEQ ID NO: 198611 - protein, 195 aa, Glycine max
  Coding DNA Sequence Number=SeqID_81833
  Gene Ontology: Mol. function=DNA binding; Cellular component =intracellular; Biological process=DNA replication
  Homolog annotation: Hit_ID=Q8KY09; Match level="QueryCoverage=89%, HitCoverage=40%, E-value=6e-63, Identity=67%"; Hit description=RepC
  Pfam annotation: Domain name=RP-C; Domain location=2-195; Score=42.1; E_value=1.3e-14; Accession=PF03428.4; Description=Replication protein C
MNSTCVTTPFGRRAMSFGVLATQFAAQKNRKCEAVDKWKLYRSVCEARPLLGVTDRSLAVLNALLSFYPKNELSSEAGLVVFPSNTQLSLRAHGMAEQTLRRHLSALVEAGLIIRRDSPNGKRYARKHRGGEISEAYGFSLAPLLARKTEIEELAERIIRERLDLQRLRETISLCRRDIPETLRNDCCQRPDRDL

SEQ ID NO: 198612 - protein, 74 aa, Glycine max
  Coding DNA Sequence Number=SeqID_81834
MENGELANSARESIRGAPDSMAINLRGSRLDGGGHMNSARQSIHGSPNKIENGELANSARQSIRGAPDSMVVDT

SEQ ID NO: 198613 - protein, 51 aa, Glycine max
  Coding DNA Sequence Number=SeqID_81835
MVAELGQQTVELSTLITHAANDKSSNLFLQNWPECNFIEHLLDSYLASVLL

SEQ ID NO: 198614 - protein, 91 aa, Glycine max
  Coding DNA Sequence Number=SeqID_81836
ADKPAIEAMPQLFYPTRPRTSNACQRKKYSESMSDNLARASSAREYQIELQQVGINTATSPMLNEIAFIFQSFRAKKFERGSLPCHSEGRS

SEQ ID NO: 198615 - protein, 72 aa, Glycine max
  Coding DNA Sequence Number=SeqID_81837
MAGSLKALRIWSSPTKGSKWAWKEGENEGETHVATTIPIRPSFPPTQRCHYLANNKPSPYPPLSYPQRPSLN

SEQ ID NO: 198616 - protein, 129 aa, Glycine max
  Coding DNA Sequence Number=SeqID_81838
  Gene Ontology: Mol. function=transferase activity, transferring acyl groups, acyl groups converted into alkyl on transfer; Cellular component=cytoplasm; Biological process=tricarboxylic acid cycle
  Homolog annotation: Hit_ID=Q5H3R3; Match level="QueryCoverage=91%, HitCoverage=26%, E-value=7e-51, Identity=81%"; Hit description =Citrate synthase
RQLVGEGLQLLGARALAVDQQVGHFDVARLFRQLFDRVAAVQQHALVAVDVGDGGLAAGRRGETGIVCEIPRFLGQLRDVHAIVAKGGFDDGQNDRLIAGVERDLIKIGHCVRSFMGRRLPKRIGQARE

SEQ ID NO: 198617 - protein, 179 aa, Glycine max
  Coding DNA Sequence Number=SeqID_81839
  Gene Ontology: Mol. function=hydrolase activity, acting on glycosyl bonds; Biological process=metabolic process
  Homolog annotation: Hit_ID=Q8PH70; Match level="QueryCoverage=42%, HitCoverage=96%, E-value=5e-35, Identity=85%"; Hit description=50S ribosomal protein L31 type B
  Pfam annotation: Domain name=Ribosomal_L31; Domain location=102-179; Score=48.3; E_value=2.5e-11; Accession=PF01197.9; Description =Ribosomal protein L31
DAEKWLQADSDRARFYELISRKTRGLSEDSKGGRWYTADALAMAWALNPEGQLQVESRPLNVELNGTFSRGATIVDWNRQTGQPDNCDLLMAYDQQRFEALADIHPNYRDVVFHDVTSDFKILTRSTMATKETIKWEDGNDYPLVKVEISSASHPFYTGKHKVIDTSGRIDKFQKRYAR

SEQ ID NO: 198618 - protein, 343 aa, Glycine max
  Coding DNA Sequence Number=SeqID_81840
  Gene Ontology: Mol. function=nucleotidyltransferase activity; Cellular component=chloroplast; Biological process=glycogen biosynthetic process
  Homolog annotation: Hit_ID=UPI000068C8B6; Match level="QueryCoverage =99%, HitCoverage=80%, E-value=1e-109, Identity=57%"; Hit description= glucose-1-phosphate adenylyltransferase
  Pfam annotation: Domain name=Hexapep; Domain location=239-256; Score =11.2; E_value=3.7; Accession=PF00132.14; Description=Bacterial transferase hexapeptide (three rep
  Pfam annotation: Domain name=Hexapep; Domain location=298-315; Score =15.2; E_value=0.25; Accession=PF00132.14; Description=Bacterial transferase hexapeptide (three rep
  Pfam annotation: Domain name=NTP_transferase; Domain location=1-192; Score=41.4; E_value=9.8e-13; Accession=PF00483.13; Description =Nucleotidyl transferase
  Pfam module annotation: Pfam domain module=Hexapep::Hexapep::NTP _transferase; Domain location=239-256::298-315::1-192
KGFVDILAAEQNVENESWYQGTADAVRQSMKHLEKYDYDYILILSGDQLYQMDFREMLDYHIKKGGDVTIATIPVNAKDATGFGILKSDDEGNITSFVEKPGMDILGDWKSEVSDHNKHEGKEFLASMGIYIFTKSILKKMFDEGAGDDFGKDIIPNSIGKYATLSYQYEGYWTDIGTIESFYEANIDLCQDFPQFNLFSSSPIYTRARMLPPSKINGSYVSKAVFGDGCIIMADKIENSVIGNRTRIDKGSTIVNSYVMGSDFYQNTTEIVMNDRNGRPNMGIGKYCYIEKAILDKNCYIGDNVRIIGGKHLQDGDFGTHSVQDGIVVVKKGAILPPGTHIG

SEQ ID NO: 198619 - protein, 32 aa, Glycine max
  Coding DNA Sequence Number=SeqID_81841
MEVTRTSQCFASLTYHIRGWAIYLVEARWDIQ

SEQ ID NO: 198620 - protein, 135 aa, Glycine max
  Coding DNA Sequence Number=SeqID_81842
MSLPSAIHESSTLESGTPRMSLPSAVRQFSILPFIRSPHECHCLAPFMCPPPLSWEPRKCHCLAPFMCPPPLNLEPRKCHCLATFMCPPPSNLEPRKCHCLALFMCPPPSSLEPRECHCLALFANSPFSPFFGAP

SEQ ID NO: 198621 - protein, 43 aa, Glycine max
  Coding DNA Sequence Number=SeqID_81843
MGKGKVPKDQSKQDQKVILARTPEAQYQQKVLEGEIAKIEDIS

SEQ ID NO: 198622 - protein, 42 aa, Glycine max
  Coding DNA Sequence Number=SeqID_81844
MGSTGIRIPSLSLAGEQHTKVEKKSRGIAKEWQEHIELVEQI

SEQ ID NO: 198623 - protein, 39 aa, Glycine max
  Coding DNA Sequence Number=SeqID_81845
MSQNIQQVTPFAGPSQITIGNGQGLNINSSGLLGNDGVY

SEQ ID NO: 198624 - protein, 340 aa, Glycine max
  Coding DNA Sequence Number=SeqID_81846
  Gene Ontology: Mol. function=protein binding; Cellular component =integral to membrane; Biological process=defense response to fungus
  Homolog annotation: Hit_ID=Q1S5Q4; Match level="QueryCoverage=99%, HitCoverage=74%, E-value=4e-60, Identity=29%"; Hit description =Leucine-rich repeat
  Pfam annotation: Domain name=LRR_1; Domain location=114-136; Score =10.2; E_value=3.5; Accession=PF00560.23; Description=Leucine Rich Repeat
  Pfam annotation: Domain name=LRR_1; Domain location=13-30; Score=5.9; E_value=22; Accession=PF00560.23; Description=Leucine Rich Repeat
  Pfam annotation: Domain name=LRR_1; Domain location=138-160; Score =18.3; E_value=0.027; Accession=PF00560.23; Description=Leucine Rich Repeat
  Pfam annotation: Domain name=LRR_1; Domain location=162-184; Score =16.2; E_value=0.12; Accession=PF00560.23; Description=Leucine Rich Repeat
  Pfam annotation: Domain name=LRR_1; Domain location=186-208; Score =17.1; E_value=0.064; Accession=PF00560.23; Description=Leucine Rich Repeat
  Pfam annotation: Domain name=LRR_1; Domain location=210-233; Score =5.5; E_value=26; Accession=PF00560.23; Description=Leucine Rich Repeat
  Pfam annotation: Domain name=LRR_1; Domain location=293-314; Score =5.3; E_value=29; Accession=PF00560.23; Description=Leucine Rich Repeat
  Pfam annotation: Domain name=LRR_1; Domain location=317-339; Score =12.0; E_value=1.6; Accession=PF00560.23; Description=Leucine Rich Repeat
  Pfam annotation: Domain name=LRR_1; Domain location=38-62; Score=8.7; E_value=6.9; Accession=PF00560.23; Description=Leucine Rich Repeat
  Pfam annotation: Domain name=LRR_1; Domain location=64-86; Score=3.4; E_value=66; Accession=PF00560.23; Description=Leucine Rich Repeat
  Pfam annotation: Domain name=LRR_1; Domain location=89-111; Score =13.6; E_value=0.72; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =114-136::13-30::138-160::162-184::186-208::210-233::293-314::317 -339::38-62::64-86::89-111
MGLIPHQLGNLSNLQHLNLGYNYALQIDNLNWISRLSSLEYLDLSGSDLHKQGNWLQVLSGLPSLSELHLESCQIDNLGPPKGKTNFTHLQVLDLSINNLNQQIPSWLFNLSTTLVQLDLHSNLLQGQIPQIISSLQNIKNLDLQNNQLSGPLPDSLGQLKHLEVLNLSNNTFTCPIPSPFANLSFLRTLNLAHNRLNGTIPKSFELLRNLQELRLSWTNLFLSVNSGWVPPFQLEYVLLSSFGIGPNFPEWLKRQSSVKVLTMSKTVLNVANNSISGTISPFLCGKENATDKLSVLDFSNNVLYGDLGHCWVHWQALVHLNLGSNNLSGVIPNSMGYLS

SEQ ID NO: 198625 - protein, 268 aa, Glycine max
  Coding DNA Sequence Number=SeqID_81847
  Gene Ontology: Mol. function=two-component response regulator activity; Cellular component=intracellular; Biological process=two -component signal transduction system (phosphorelay)
  Homolog annotation: Hit_ID=Q8F2E4; Match level="QueryCoverage=72%, HitCoverage=49%, E-value=1e-30, Identity=37%"; Hit description =Response regulator receiver domain
  Pfam annotation: Domain name=EAL; Domain location=172-268; Score= -99.3; E_value=0.00047; Accession=PF00563.11; Description=EAL domain
  Pfam annotation: Domain name=Response_reg; Domain location=36-153; Score=12.3; E_value=0.00039; Accession=PF00072.14; Description =Response regulator receiver domain
  Pfam module annotation: Pfam domain module=EAL::Response_reg; Domain location=172-268::36-153
MPHALFYPVGECDEPNRRSIQQIQQIKHGGGAMRECTLLILDDDANAAKIIASEAQSLGFEVRIFDDATQFIEASLTEKPSHLAIDIIMPGVQGMSLLQTLAQNACQSSIMLTSGIGSDILPAAQLAAIEQNLNIRGILQRPFHQHILRNMLSDQVSIDLHAHTSNDASHQSFIVDANTIDEAIRNHEFEVFYQPQIDLVTGKVMGFEGLLRWRHPGLGIKLPELFIPIAEKTGQIEQLTQIVVETGFHFIRSLGKSLSFSLNIHPKP

SEQ ID NO: 198626 - protein, 205 aa, Glycine max
  Coding DNA Sequence Number=SeqID_81848
  Gene Ontology: Mol. function=nucleoside-triphosphatase activity; Cellular component=nucleus; Biological process=DNA replication initiation
  Homolog annotation: Hit_ID=Q1S047; Match level="QueryCoverage=97%, HitCoverage=23%, E-value=1e-104, Identity=96%"; Hit description=MCM; Nucleic acid-binding, OB-fold
  Pfam annotation: Domain name=AAA_3; Domain location=60-201; Score= -12.5; E_value=0.0076; Accession=PF07726.2; Description=ATPase family associated with various
  Pfam annotation: Domain name=AAA_5; Domain location=60-191; Score =0.8; E_value=0.0015; Accession=PF07728.4; Description=ATPase family associated with various
  Pfam annotation: Domain name=MCM; Domain location=2-204; Score=326.4; E_value=5.1e-95; Accession=PF00493.13; Description=MCM235 family
  Pfam annotation: Domain name=Mg_chelatase; Domain location=40-205; Score=-142.3; E_value=0.0058; Accession=PF01078.11; Description =Magnesium chelatase, subunit ChlI
  Pfam module annotation: Pfam domain module=AAA_3::AAA_5::MCM::Mg _chelatase; Domain location=60-201::60-191::2-204::40-205
MQVAQLKELSKRPDIYEILTNSLAPNIWELDDVKKGLLCQLFGGNALKLASGANFRGDINILLVGDPGTSKSQLLQYIHKLSPRGIYTSGRGSSAVGLTAYVTKDPETGETVLESGALVLSDRGICCIDEFDKMSDNARSMLHEVMEQQTVSIAKAGIIASLNARTSVLACANPSGSRYNPRLSVIDNIHLPPTLLSRFDIAQKL

SEQ ID NO: 198627 - protein, 377 aa, Glycine max
  Coding DNA Sequence Number=SeqID_81849
  Gene Ontology: Mol. function=carbohydrate binding
  Homolog annotation: Hit_ID=Q6ZLH2; Match level="QueryCoverage=82%, HitCoverage=61%, E-value=3e-83, Identity=48%"; Hit description =Lipase-like protein
  Pfam annotation: Domain name=DUF620; Domain location=95-363; Score =460.9; E_value=1.6e-135; Accession=PF04788.3; Description=Protein of unknown function (DUF620)
MMGRLAPLSEEPINEENEGYNNSNSKKCLQSWRNWNWIKTHFSLAFNKKSNLKILLSVLGCPLFPVPVSSSAQYIIQHFRAATGCRKLEGTVKNVFTTGKVTMDVVDELGSTSGGINLEKGCFVMWQMVPDKWQIELVLGGQKVVAGSNGAIAWRHTPWLGVHAAKGGVRPLRRALQANFISLQGPLCSETELICTHNCILGLDPLAVSAVFCAAQYMGEKEISGMDCFVLKLSADQKDLVERSDNTAEMIKHAIFGYFSQRSGLLVYLEDSYLTRIQAPGSHPTYWETTMSTKIEDYRIVDGVMIAHAGSSTALITRFGDNLKAGPSITRLEESWTIDDVAFNVPGLSLDCFIPPQELQRDCSSDDELDWRSFTLA

SEQ ID NO: 198628 - protein, 575 aa, Glycine max
  Coding DNA Sequence Number=SeqID_81850
  Gene Ontology: Mol. function=phosphoric monoester hydrolase activity; Cellular component=integral to membrane; Biological process=metabolic process
  Homolog annotation: Hit_ID=Q08891; Match level="QueryCoverage=89%, HitCoverage=84%, E-value=0.0, Identity=62%"; Hit description=Male sterility protein 2
  Pfam annotation: Domain name=Epimerase; Domain location=123-452; Score=-60.2; E_value=0.033; Accession=PF01370.11; Description=NAD dependent epimerasedehydratase family
  Pfam annotation: Domain name=NAD_binding_4; Domain location=125-431; Score=366.8; E_value=3.5e-107; Accession=PF07993.2; Description=Male sterility protein
  Pfam annotation: Domain name=RmlD_sub_bind; Domain location=189-401; Score=-173.4; E_value=0.0075; Accession=PF04321.7; Description=RmlD substrate binding domain
  Pfam module annotation: Pfam domain module=Epimerase::NAD_binding _4::RmlD_sub_bind; Domain location=123-452::125-431::189-401
  Subcellular localization annotation: CTP_CleavageSite=39; ConfidenceScore=5.46e-01
MGVLSIGYSFSSSLLTKLIFGVPQNNERCPSRRKACVVYCQGGGNVIKSSSGLSSVLTERSALVGTDHAAAVLMDAGSLVLSQNGKSQAEILVKDLVPYDGPTTLIGVEDGIGIVKFLGGKKFFITGATGFLAKVFIEKILRTEPDVGKMYLLIKAKNKQAAMERLQNEIINTELFRCLQEIHGKSYQAFMLSKLVPVVGNICEHNLGLDEGISDVIAEEVDVIVNSAANTTFDERYDTAININTIGPCRLMNIAKKCKKLKLFLHVSTAYVNGQRQGRIMERPFSIGECIAREKYISEVSPKYLPTLDIEGEINLVSNYKGDIEDNLLAQKMKEIGLERARRYGWQDTYVFTKAMGEMMIDKLRGDIPVVVMRPSVIESTFSEPFPGWMEGNRMMDPIVLCYGKGQLTGFLVDPNGVLDVVPADMVVNATLAAMARHGVSQKPDINVYQIASSVVNPLVFQDLARLLYEHYSSSPCIDSKGRPIQVPLMKLFSSTEEFSGHLWRDAIQKRGLTAVASSKGKMSQKLENMCRKSVEQAKYLANIYEPYTFYGGRLDTHLISHSSTSGNNSSSSLI

SEQ ID NO: 198629 - protein, 42 aa, Glycine max
  Coding DNA Sequence Number=SeqID_81851
MAAIFASRCSRDKLLKCINYIWHWLCAWNEYCSHMEVLVHHK

SEQ ID NO: 198630 - protein, 362 aa, Glycine max
  Coding DNA Sequence Number=SeqID_81852
  Gene Ontology: Mol. function=RNA-directed DNA polymerase activity; Cellular component=chromatin; Biological process=chromatin assembly or disassembly
  Pfam annotation: Domain name=Chromo; Domain location=260-310; Score =22.4; E_value=0.0016; Accession=PF00385.14; Description='chromo' (CHRromatin Organisation MOdifier
  Pfam annotation: Domain name=rve; Domain location=52-211; Score=26.3; E_value=3.8e-05; Accession=PF00665.16; Description=Integrase core domain
  Pfam annotation: Domain name=zf-H2C2; Domain location=1-34; Score =17.7; E_value=0.0016; Accession=PF09337.1; Description=His(2)-Cys(2) zinc finger
  Pfam module annotation: Pfam domain module=Chromo::rve::zf-H2C2; Domain location=260-310::52-211::1-34
MGIAKTLAQISDNFTWSGIKDDVRNFVLTCVDCQQTKYDHYKQPGLLCPLLIPSRPWEDLPLDFIGGLPAFRGHTVVLVVVDRFFKGIHLGTMRLIIQPSMWSQLFMEIVSKLHGMPHNLVSDRDPLFISRVWQKLFKLSGTKLRMSSAYHPQSDEQTEWSYNTFTHSGIQMTLYEITFGKYPPTIPQYIVGTSNIDVVDELLVNREEMFASLRKKLLKAQQTMKHFADDKRRDVSFQAPDILNLIAELPSSSINNEPIVSPLVILNTKWESLNNTPKLRVLVQWNGLLPDDASWESWDDLKEKYHFEDKVLFEGHGNVMEGKQQASLEMQQAELQLESQLADMNQRPKRVVTKPQYLKDFV

SEQ ID NO: 198631 - protein, 338 aa, Glycine max
  Coding DNA Sequence Number=SeqID_81853
  Homolog annotation: Hit_ID=Q1SW19; Match level="QueryCoverage=34%, HitCoverage=18%, E-value=2e-13, Identity=35%"; Hit description =Disease resistance protein
  Subcellular localization annotation: CTP_CleavageSite=64; ConfidenceScore=5.17e-01
FPHNTWRNDSTISSVNHSSDVLYPPTSVATHCPRKTIRYPTSTAHPHPHSRSPYASVSPIIKPPSAIDSGCRNLFKVTDRVKFDDMSARVHHPCTNSRKRPSTSFVDPAKPNKLPNIEVKKNLTGMAVQQNTREVELDLQVGAIGKCCQNEAQNLNPRGFDSFNLDGVVISGPVKLSPGAKHILKPSQNQDNSTPVHSAIPIAVTTDCVFLKDADSRTADEGDDMNEGIRTLPDALGCAALLCQIIHFIETLMPHHRIESEVQQIKSVVDGIMQRVQNYNSLNQLFSKKDKAVMEGPAERIVISVVGMRGLGKTTLASRVFNNGKAGKVDERLVEEVI

SEQ ID NO: 198632 - protein, 251 aa, Glycine max
  Coding DNA Sequence Number=SeqID_81854
MAKSTRSKSNMERIEEAIAKLASNHLNVSNKLDELIQCISIIEANQHQPSSPSSSSTIPSPVPSTSHLPKMKFDVPRFDRSDPFGWMFKINQFFTYHITPETDRLIIASFVMEGPPIAWFQWMMRSGQITLWHRFLQALEALFASLQYEDPTGRFAANPSSLFPTTSPSTLLPPPAKLPPLPLKRLSLEEMAVHRENGLCFNWDEKLSRGHRCSFKFFLLIVDAEDVAVGIKPIEEELSPSNDISDLPRPK

SEQ ID NO: 198633 - protein, 651 aa, Glycine max
  Coding DNA Sequence Number=SeqID_81855
MSQGDAYKRKLQNSVHSFTKQGTVGNKKVKLDDIDASSALEKKLGLKTLSEENKEKVKNWDSVGKQQKVVVSPIGGILKNHKHIYGSTSIGSNIQDGTEETHCDVQVPPSDKHVRFSAEDSVLGPEKRSSFDETVFSLSSDMPASSFGEEKLTGNDEGTVNLEENRNGNTAINTDKRKEVCPMVESKQFSNTLGLVAVQNLLKPCTSEEKSKHLEEKSESLSNVTICDNNNLDRFDGGNTTTVHVSSYGDLSRSLSELQGGQSSGISTQPCESEAFSYTGKFIDHLGGPSFQSTNAHTRTYLEPSPSYSASCNEVNNRPEFPLHTYGNDDNNGQALGDRSLSGTFSADMIDNSFLLPGWGRGSIRNNCMEQNFYGLPLNSHGDLINFSSSGKIGMNQPETSCTLRSSLSGLPVNNVIHQSSQECLSIGKRHVVQKTLQDSVNPFPHYSGRLGVRELHGRERGDIYQHNSGWCSNHYVQPLDSELNLMRNPFIEQNQNQNQLEKVPNHEEYGMVSPRGSSGLVSPSCSQPTMRLMGKDVPIGRSSKEKQQFVGGVLWAEEESRRHYSVDAARDNSLLGRCYMPDSASGSQLQRQTENVFQSVKILSKQALQSTLLMNGPNSEFLNQRSNHISQNGSLGVSRNASTNLHTISQ

SEQ ID NO: 198634 - protein, 264 aa, Glycine max
  Coding DNA Sequence Number=SeqID_81856
  Homolog annotation: Hit_ID=UPI000016338B; Match level="QueryCoverage =61%, HitCoverage=8%, E-value=3e-27, Identity=49%"; Hit description =RNA binding / structural constituent of ribosome
MAPHSKKPQKKKKKNDSVDKPKIDKASKKIFKPKKREQNDAVVAAKSEALSLQLEDEVPDFPRGGEFSAKGRSDYDEFSAEDPSRKTRKKKKGRSASSKSNEGADDWGSLSGDGITGKLPRRVNRITLKNITPGMKLWGVVAEVNEKDLVVSLPGGLRGLVHASDAVDPIFDDKIELVSCVVLRLDDDKKEKGSRKIWLSLRLSLLHKNYNLDVVQEGMAENIYILLKGKPVPVVPKIKITKHQGAILQENHQQKQKTTRPKPN

SEQ ID NO: 198635 - protein, 359 aa, Glycine max
  Coding DNA Sequence Number=SeqID_81857
DYTSKMRSVDVFKCWPFPAAGLSRNQVESRLPPMSTPKLRRWSDELAELRSDLAGAGGTEERLNQRYESESEKEEEDKVELVCPVCQDFNASTLTAVNAHIDGCLTRTVREERQWMRRSKSKVPKRRSIAEIFELKEDMEEEKPLLPEIDTELKRLPFDEVSIMVTKFRWLSERLETLRSNGISFDSVKSVVGNSNSTAEEEESEMLCPVCRVFNSATVMAANTHINGCQATAMKNNELWGKPSLNNPKPKEPKKRSLADILTVTPQIDGDGKLLVEAEKDDEEIGEEFEKHGFSGARIKSKKSTNNNVTKKRKLKKVIMRKKNKVEKCGVVTLNEESKKINKKRKKKKKLNKEFTAKK

SEQ ID NO: 198636 - protein, 122 aa, Glycine max
  Coding DNA Sequence Number=SeqID_81858
  Subcellular localization annotation: CTP_CleavageSite=48; ConfidenceScore=5.47e-01
MAVVAVMAGWRKMAFFFCFLSAVGVGLTRPNPTRTTFHLRENPTASLPCTSRVPPAPHTRTQPRHPQPHAHAAATTSGSDAPAQTAATSSGSDAPVTNGGLQREVLAEKTKLSRRRRRRRFS

SEQ ID NO: 198637 - protein, 266 aa, Glycine max
  Coding DNA Sequence Number=SeqID_81859
  Gene Ontology: Mol. function=RNA-directed DNA polymerase activity; Cellular component=membrane; Biological process=RNA-dependent DNA replication
  Homolog annotation: Hit_ID=Q1SRI1; Match level="QueryCoverage=80%, HitCoverage=36%, E-value=4e-33, Identity=32%"; Hit description=RNA -directed DNA polymerase
MNDMEMKKLVKSKRIEYGTNQLGWVGDINKCSQNFFIEDNVATNKLIERCIPIGANPRRCQMWDPLINKCERKLARWKQRHLSFRGRVTLIQVPKKVVDKLVCLQRKFLWGGGADHNKIAWVKWDTVCFPKDKGGLGIKDVNTFNLALLAKWKWHLFQHQGQLWARVLESKYGRWRGLNEAPRSSTESIWWRDLKMVSHHPEHGEALQRSTAWRVGCGDRIKFWEDDWIRDNRALVAKYPRLYLISNQQNHTIQQMGGHKDKGWEW

SEQ ID NO: 198638 - protein, 255 aa, Glycine max
  Coding DNA Sequence Number=SeqID_81860
  Gene Ontology: Mol. function=RNA binding; Cellular component =intracellular; Biological process=mRNA processing
  Homolog annotation: Hit_ID=Q9LHM6; Match level="QueryCoverage=98%, HitCoverage=13%, E-value=5e-85, Identity=64%"; Hit description=Pre -rRNA processing protein RRP5
  Pfam annotation: Domain name=S1; Domain location=176-247; Score=47.1; E_value=5.8e-11; Accession=PF00575.13; Description=S1 RNA binding domain
  Pfam annotation: Domain name=S1; Domain location=82-159; Score=2.0; E_ value=0.15; Accession=PF00575.13; Description=S1 RNA binding domain
  Pfam module annotation: Pfam domain module=S1::S1; Domain location =176-247::82-159
MLVNARVKSILENGVMLSFLTYFTGTVDLFHLQNIYPGTNWKDKCSESQKVVSRILFIDPSSRAVGLTLNPHLVQNRAPPSHVKIGDIYDNSKVVRVDRGLGLLLEVPSIPEPTPAFVSISDIAEEEVQKLEKKYKEGNRVRVRILGLRYLEGIATGVLKVVIASALEEEVFTHSDVKPGMVVKAKILSVDSFGAIVQIPGGVKALCPLRHMSELEISKPGKKFKVGAELVFRVLGCKSKRVTVTHKKTLVCFYM

SEQ ID NO: 198639 - protein, 89 aa, Glycine max
  Coding DNA Sequence Number=SeqID_81861
  Gene Ontology: Mol. function=galactosyltransferase activity; Cellular component=membrane; Biological process=protein amino acid glycosylation
  Homolog annotation: Hit_ID=Q1SXJ8; Match level="QueryCoverage=95%, HitCoverage=67%, E-value=1e-15, Identity=51%"; Hit description=LGC1, related
  Subcellular localization annotation: CTP_CleavageSite=59; ConfidenceScore=5.38e-01
MANSSMKFLNMIVIFLVLISQGNSITECTLRSLSVSQSMTGVKVQGKPEWSVSITNTCPCAQRMVYLNCTDFQTSEPITPSVLTVSPNA

SEQ ID NO: 198640 - protein, 86 aa, Glycine max
  Coding DNA Sequence Number=SeqID_81862
MLDAPEPLKLLRHMTVLRRSGPPLQWKVETLNPAIGGKGVVQPWYDFLEEMDFDDGDEISIYYRYYEKIWDIIIKRQENWEDSDNN

SEQ ID NO: 198641 - protein, 727 aa, Glycine max
  Coding DNA Sequence Number=SeqID_81863
  Gene Ontology: Mol. function=nucleic acid binding; Cellular component= intracellular; Biological process=DNA integration
  Homolog annotation: Hit_ID=Q1RXN8; Match level="QueryCoverage=95%, HitCoverage=53%, E-value=0.0, Identity=48%"; Hit description =Peptidase S8 and S53, subtilisin, kexin, sedolisin; Integrase, catalytic region; Zinc finger, CCHC-type
  Pfam annotation: Domain name=rve; Domain location=465-628; Score =155.8; E_value=1.2e-43; Accession=PF00665.16; Description=Integrase core domain
  Pfam annotation: Domain name=zf-CCHC; Domain location=225-242; Score =30.7; E_value=5.1e-06; Accession=PF00098.13; Description=Zinc knuckle
  Pfam module annotation: Pfam domain module=rve::zf-CCHC; Domain location=465-628::225-242
MGTRFDVEKFTGENDFSLWRIKMQALLVHQGLDDALQGASKLPSTLSDKEKKDLLNKAHSTIILSLGDEVLREVAEEKSAAGIWLKLESLYMTKSLANKLYLKKRLHQLKMEEGSSIKEHVSLFTKAVLDLKSVDVRIDEEDQAVMLLRSLPSSFENLVDTMLFGRDTLTLEEVKTTLNSRELKKKITENKGEGGDPEALMARGRLEKRDSKSKNKRRSKSRNKKACYYCKKEGHFRKECPERKKKNNGKYNDESDIAVVADGYESAEVLSISTKKHSEEWILDSGWSFNMTPNLEWFSSYKEIDGGKVLMGNNMACNVIGIGTIKLKMQDGSVKLLPDVRHVPKLKRNLLSLGMLDQSGCSFKGEGGTLKVFKGSLQIMKGTRQNGLYKLQGNTILNSAGLVSISEPNASKLWHYRLGHVSEKGLEELHKQGLIGNGNYQKLSFCEHCVYGKQNRVSFHNATHTTQGILDFVHSNVWGPARVPSLEGAKYFITFIDDWSRKVWTYLLKHKNQAFKCFKQWKLLIENQTGRHVKLLRTDNGLEYLSEEFNEFCKDNGIRRHKTVRFTPQQNDLAERMNMTILERVRSMLSNAKLAKIFWGEAVNTTCYLINRCPSSAIEFKTPEERWTGKAPSYENLRIFGCTVYVHSNEGKLEPRAKKGIFLGYLEGVKGYKVWLLDPAGPKSIISRDVLFREEDMIADYQQKSDSVQKGVQAEQNRHSDQGIRLE

SEQ ID NO: 198642 - protein, 124 aa, Glycine max
  Coding DNA Sequence Number=SeqID_81864
MQAHTARMLRTEVVKKEQNNKNIIVVQGNLRPLHPHCSRFFLHYLITTTQHTTAKLLGKLPDHQVILKKGVLVMFEKNLDISLGLCNGTRLIVNELDFVAMNICAIKTSHLLMVTYIDYMQCLL

SEQ ID NO: 198643 - protein, 174 aa, Glycine max
  Coding DNA Sequence Number=SeqID_81865
  Gene Ontology: Mol. function=peptidase activity; Cellular component =anchored to membrane; Biological process=proteolysis
  Homolog annotation: Hit_ID=Q1SAR4; Match level="QueryCoverage=97%, HitCoverage=42%, E-value=3e-53, Identity=62%"; Hit description =Eukaryotic aspartyl protease, putative
  Subcellular localization annotation: CTP_CleavageSite=43; ConfidenceScore=5.20e-01
AAVVSGHGTVSTPLFSQNGQVFYFLTLEAFSVGRNRIEFGSPRSGGKGNIIIDSGTTLTVLPNGVYSKLESAVAKTVKLKRVRDPNQVLGLCYKVTPDKLDASVPVITAHFRGADVTLNAINTFVQVADDVVCFAFQPTETGAVFGNLAQQNLLVGYDLQKNTVSFKHTDCTKQ

SEQ ID NO: 198644 - protein, 637 aa, Glycine max
  Coding DNA Sequence Number=SeqID_81866
  Gene Ontology: Mol. function=nucleic acid binding; Cellular component= intracellular; Biological process=DNA integration
  Homolog annotation: Hit_ID=Q1RXN8; Match level="QueryCoverage=97%, HitCoverage=54%, E-value=0.0, Identity=49%"; Hit description =Peptidase S8 and S53, subtilisin, kexin, sedolisin; Integrase, catalytic region; Zinc finger, CCHC-type
MNSTILERVRCMLSNAKLAKSFWGEAVNTTCYLINRCPSSEIEFKTPEERWTGKAPSYENLRIFGCTIYVHSNEGKLEPRAKKGIFLGYSEGVKGYKVWLLDLAGPKSIISRDDLFREEDMIADYQQKSDSVQKGVQAEQNRHSDQGIRLEVEKLAQTSSPVEDRNEASHDEPMISSIPKPVDTSYNLPAKQKVVGCKWIFKRKPEETGMDSYRYKARLVARGFTQREGIDYNEIFSPVVKHTSIRIILALVAVHNLELEQMDVKTTFLHGNLEETIYMSQPEGYEVKGKEEMVCLLKKSLYGLKQSPRQWYKRFDSFVVSNGFSRSSYDSCVYFRRLKPDCFIYLLLYVDDMLIASANMEAIKELKNLLQFEFEMKDLGAARRILGMDIIRKRNEGLLYLSQSSYVQKLLRRFNMLDSKPVSTPIAGHFKLSITHSPQTEDEIKYMSRIPYSNATGSLMYAMVCTRPDLAYSASIVSRFMENPGKQHWSVVKWILRYLKGSKSIGLVYGRNSERINGLSGYVDADYAGDIDKKRSLTGYLFTLYGSVISWKANLQSVVALSTTEAEYIALTEAIKEAIWLKGLVHELEGKTVPVEVWSQGEVEVRKVAGANNPADMLTKEGELAGPNIEDPRWRLL

SEQ ID NO: 198645 - protein, 110 aa, Glycine max
  Coding DNA Sequence Number=SeqID_81867
MEQESLLKAWERLQEMIRSFPHQGITQQRQPNNLPSQLEPNPKKEDVDDVMTRSKRIQEDSEEKEGSSSKVADDVLTKEDQTLEKIEDPTNGNPIPKKEGEEKGRDTNIS

SEQ ID NO: 198646 - protein, 216 aa, Glycine max
  Coding DNA Sequence Number=SeqID_81868
  Gene Ontology: Mol. function=peptidase activity; Cellular component =membrane; Biological process=proteolysis
  Homolog annotation: Hit_ID=Q1SAR7; Match level="QueryCoverage=100%, HitCoverage=49%, E-value=2e-64, Identity=53%"; Hit description =Eukaryotic aspartyl protease, putative
MSRSSSLALVLLCLYNLSFLEAINGGFSVEMIHRDSSRSPFFRPTETRFQRVANAMRRSINRANHLNQSFVFPNSPKTTVISALGEYLMSYSVGTPSLQVFGIVDTGSDIIWLQCQPCKKCYKQITPIFDSSKSKTYKTLPCPSNTCQSVQGTSCSSRKNCLYSIDYADGSHSQGDLSVETLTLGSTSGSPVQFPGTVIGCGRDNAIGFEEKNSGI

SEQ ID NO: 198647 - protein, 454 aa, Glycine max
  Coding DNA Sequence Number=SeqID_81869
  Gene Ontology: Mol. function=zinc ion binding; Cellular component =intracellular
  Homolog annotation: Hit_ID=Q6RZU6; Match level="QueryCoverage=74%, HitCoverage=23%, E-value=9e-94, Identity=53%"; Hit description =Hypothetical protein H9-8
  Pfam annotation: Domain name=zf-TRAF; Domain location=238-294; Score =46.6; E_value=8.3e-11; Accession=PF02176.8; Description=TRAF-type zinc finger
MSVRIRKCFFGLCLDQEVLPSMELPTTDVDLEPKKIEPEKNEGPLFHCDFCDTEVVHKLAQMFLPGLACACVDNTTGGPFKTPGSVAVDLRKEMIEFVTQKSESFVAESVILEGGPDGGALEHPFDIICYFVDEFVSSKRNLLSQVSGWLLSDKREDKIDDFVQEMEMNGFWPLDRRETLAKTLIKNVDVKSSFHCSMSFKSARDLANHADDGCNFRPVICRNEGCDARFSAGHLKEHDSACDFKIVPCEQKCTDSILRREMDRHCITVCPMKLVNCPFYAVGCRSAIAQSMIRKHCSDDIESHLLLMLKGIHQEASGEDLKRRVEQILQTTSFLKLIMSYNESKSVAWLTGMASSRSKLAEARDVRSYKNIVKDLEVKLGPLEVIAKEKTSAETVAENEDSEDNRTKTKDKEQHTQTLNSLDKAEVSAILEKTCAGNAVNKVDSEHKENGKQG

SEQ ID NO: 198648 - protein, 122 aa, Glycine max
  Coding DNA Sequence Number=SeqID_81870
  Homolog annotation: Hit_ID=Q5Z6G3; Match level="QueryCoverage=43%, HitCoverage=13%, E-value=1e-14, Identity=62%"; Hit description =Putative RNA polymerase I, II and III 16.5 kDa subunit
  Pfam annotation: Domain name=RNA_pol_Rpb8; Domain location=8-103; Score=3.3; E_value=1.5e-07; Accession=PF03870.5; Description=RNA polymerase Rpb8
MLRYCASQVTRIEARSEKFDMFMHLDINSEIYPLKVGQKFALVLVSTLNPDGTPDTGYYTQFTISLSFFCDWELLSFIISLEFKLELGLMVSIDMVDVTSLKSGVIQFICGPVVICSEMTLA

SEQ ID NO: 198649 - protein, 64 aa, Glycine max
  Coding DNA Sequence Number=SeqID_81871
MLANTEEYIEGQFTGNLGEILNSSIFTLASTPYFVSGLLEELGIIFLSDIRDPTIEKCNNISSD

SEQ ID NO: 198650 - protein, 99 aa, Glycine max
  Coding DNA Sequence Number=SeqID_81872
MYQLYDFLELIRSLTSLLTDQHNTQADQPNSGNNELKDMVTTLTSTVDGDEAPSTVNGGITLHGNLLNAPHGNLFTTSSSSQQQWWLKKKKNLFPATSS

SEQ ID NO: 198651 - protein, 83 aa, Glycine max
  Coding DNA Sequence Number=SeqID_81873
AVKVKLSMLSVAVVVASIRDMQMVVFDGREDVLRWAQSVAHENRFVVVIVRKKEFIRDTGTKKCGCPFKLRCKPVVGGEGWMM

SEQ ID NO: 198652 - protein, 256 aa, Glycine max
  Coding DNA Sequence Number=SeqID_81874
MDCFQLANIVWGEAGESDDHIVPYPEASEDLNDKKEWNQEASATKLIEQRRIEAKTDFHQGKLGSSSKLDIIEGSSASESGTKSWPDLSLSNAAKTDQGSLGAEVSKNLEETTQLEKDVEKQGDFVNYAWDNIGSFDDLDRIFSNDDPIFGHVSLENSDELWSSKDVSNSAVPILLEAPNPTSALSNRSEPLEIKAEYVQQNDQSFSPRFKKIGNSSSHDIANAPANTFNVGYDRDRIAPADKEQQVCQAILENDQ

SEQ ID NO: 198653 - protein, 202 aa, Glycine max
  Coding DNA Sequence Number=SeqID_81875
  Gene Ontology: Mol. function=RNA-directed DNA polymerase activity; Cellular component=extracellular region; Biological process=RNA -dependent DNA replication
MTYKREFWKEDVDWVDRIQDFQEALHKCNKEVLGNIFNRLNDTLISLIPKIDPVVNMMHFRPINLCNVSYKTVTKILSARLIRVMEELVDPYQCSFIPNRHIGNNISIAQGIIGLPEIFISMVLWNGEALEKLIPSRGVRQGDPISPYLFVLCIERIFHLINYDVKEKMWKSIQLSRSAPKLSHLAFANDLLQFRRSYCGTI

SEQ ID NO: 198654 - protein, 283 aa, Glycine max
  Coding DNA Sequence Number=SeqID_81876
MVEESGSVRIIGSLVEGILDNNLVRFFVNANGVWNVEQLSSELPLDIVQKILIMKPPCSSNNDYYLEWNDSSDGKFSTRETYIGILNRCCMLCEIVITGQNKCGYLLVSLITLFFQNNLDKGDMNLNVESNCLEAVKLLDDVSFSGNQFEELLLEISKVKAPFKQCVIVHISKEASHLAYSFAKFGLSESSDVCFCNSVPSFVVNSLMEDVDVINSQLERWEIGLDVWPPAVARDGDLVEAKMVLHCNLGRADPDAIIQSYPCICKDVSGFESMTNRSNQKHT

SEQ ID NO: 198655 - protein, 581 aa, Glycine max
  Coding DNA Sequence Number=SeqID_81877
MTNDFYMFLGLSCLFSACSFNRNTLLLCRPILWNDFGQNNQLKARKKSQGKQEVKALQEFYGSWSPSSTTCGQFQNQQSSVIQSSPSSILGKRNQLQGPETLYQDIRNTYVTSSAYENLTNTYSSMSTLPQAQSGVLMRQPLLSGYEASLGVMNPVSKSVDLVKPLTMTPQEKIEKLRRRQQMQAMLAIQKQQQEFSHQSTLSLGPDPEIEDLRTTLDPPTEQDDSNTISLAIDDLFVEDTILYMLQDVISKLDVNIRLCIRDSLFRLAQSAMQRNYASDTSSTNNSSREELKVAAREERSSQNSGKTQNVKWWQFKGNKHLNFKKKLLEEDNGKSQSSTNLFWDGMSKKFGRYARIADVETKTNPIDRTVAHLLFHRPLDLTGNYPDKLESPISAKIQYESKEANLEKFPMGCLPDEDMKSNQQISPQVLEAQPQDQFKNSHCRDSSENASNNDLADAGDQVYVCFWFDRLVMDSNPETSLHMQGLKCVRTTCKMILEAMTLPHWCPCHTNPDQGCSAKPSLPPPSRRPSPLLEAKHPTQFPISLRSTIHNFMMFETCKDEASGAPCSVLCSHLWFYFFH

SEQ ID NO: 198656 - protein, 138 aa, Glycine max
  Coding DNA Sequence Number=SeqID_81878
  Gene Ontology: Mol. function=chromatin binding; Cellular component =chromatin; Biological process=chromatin assembly or disassembly
  Pfam annotation: Domain name=Chromo; Domain location=88-138; Score =31.0; E_value=4.1e-06; Accession=PF00385.14; Description='chromo' (CHRromatin Organisation MOdifier
MTLRLAPPSCLVRVKGFELSARSNAKLAPNYYGPFPVEDKIGVVAYKLKLPLGSMVHNVFHVSQLKKFNGTTTAGNFSPSPLLDTSQKEPAAIIDKMTVKRGNRVVTKVLVQWKHQLPEDATWEFFYDLKQKFPHFNP

SEQ ID NO: 198657 - protein, 68 aa, Glycine max
  Coding DNA Sequence Number=SeqID_81879
MFSFSVLRSSFLSYWLRFSCLGHLILWFQHMAMVQIQTKDFLSCFDLRGNPTELNETNEFDTSEFNPV

SEQ ID NO: 198658 - protein, 200 aa, Glycine max
  Coding DNA Sequence Number=SeqID_81880
  Gene Ontology: Mol. function=RNA-directed DNA polymerase activity; Cellular component=chromatin; Biological process=RNA-dependent DNA replication
MEHLEKSYTSSLKFDLLMKNEPYRVVHYVEIVAGVEGSEELDLDSRTNDDNRLGRNMKVYVDDMVVKFDDLLTRIKDLEGIHANPDKCQAILEIRSPKNMKEAQRLVGRIAFLSTFLLRIPKRAKSIMNLLKKTKNFEWNDGYKETFRQLKVTLMIPPVLSKPSTNKRLIVYLLVFAEAISAGPTNDKATKALALGLQKN

SEQ ID NO: 198659 - protein, 41 aa, Glycine max
  Coding DNA Sequence Number=SeqID_81881
MKHYLSWAQALASAWGFMLVVALMCCCLSTKPRQDSDIISV

SEQ ID NO: 198660 - protein, 152 aa, Glycine max
  Coding DNA Sequence Number=SeqID_81882
MRTSLLPLSTSKSHILDQGLAIEILAMPKRANTLPKVDFSKRCWYHRNRGHLTKECSILKDKVENLIKLGYLWILSTSINSISLTTTIGKIETEEERGIAITTLKLRDVEAKYNIEKGRKKSLNHSRHVISTIVVGFTGGGAMPSAQKKHLR

SEQ ID NO: 198661 - protein, 32 aa, Glycine max
  Coding DNA Sequence Number=SeqID_81883
MECNVTTSPKSARDTTLHPKGIHLSEEWEDGK

SEQ ID NO: 198662 - protein, 117 aa, Glycine max
  Coding DNA Sequence Number=SeqID_81884
MSVWCATHPFGSRKEAYHFHVYPCVAWKGSGESGSTSPTFGEGGLRISSVAEKSLDSPLPMKDESTFGVEAKEIVTEMKVLEDTSNTSSFNPRTSKSTPSVSLDKASAKITITKRVG

SEQ ID NO: 198663 - protein, 356 aa, Glycine max
  Coding DNA Sequence Number=SeqID_81885
  Gene Ontology: Mol. function=transition metal ion binding; Biological process=DNA integration
  Homolog annotation: Hit_ID=Q1T192; Match level="QueryCoverage=49%, HitCoverage=36%, E-value=5e-16, Identity=28%"; Hit description =Polynucleotidyl transferase, Ribonuclease H fold
MEKVALAWANVSWRLRRYFHSHKIFVQTNCPTGKVLRKPELASRRMAWSIDLSKYKIHYEPRGSIQAQSLADFHGSEVGVILEGPKTGYGVQVEHIHRDINNKADELARLGTSLRLGKLKTFILHTLPVPSVSAKECLQVEGEKPESKKNKIVEYLLKGTLLEDKEKAKKLRTQAARNKLTMSSENFMKAFMACIRGEAWKLDPLVCLRVASHHFPMTIRHLGNGYLKTLSYGFGTNIKHMVTSVEHPQTIDQAEVANKVILVELKKQLHNVKGRWAEELFEVLWHTVGKISLRRQNFMEVENNEVLRVNLDLVEQEISSRKLEVKPRKTHQNVSWLLTGKDPFGFGIAYRMKTAS

SEQ ID NO: 198664 - protein, 257 aa, Glycine max
  Coding DNA Sequence Number=SeqID_81886
  Gene Ontology: Mol. function=RNA-directed DNA polymerase activity; Biological process=RNA-dependent DNA replication
MEETHEAPRDHNLVNFEPHLGYAAEGQAFCSVPLTNTLGGPQYRPQPQTLHFEVGRAPSAMVERERFDHIEERLRAIEGGGDYAFADMAELCLVPDVVIPPKFKESLTGAAVIWYTNLEPSRVHSWKDLMVSFIRQYQYNSDMAPNRMQLQNMCKKEHESFKEYAQRWRDLEAQVAPLMMEREMITMIVDMLLVFYYEKMVGYMPSSFTDLVFADERIEVGLRRGKFDYPALLNKKSGANGENKKEGETHVVIAVPT

SEQ ID NO: 198665 - protein, 44 aa, Glycine max
  Coding DNA Sequence Number=SeqID_81887
MELERSLHFGVMTIMYSRDEGANTPAPLNLFQLEVRVDPCPSLK

SEQ ID NO: 198666 - protein, 188 aa, Glycine max
  Coding DNA Sequence Number=SeqID_81888
  Gene Ontology: Mol. function=nucleic acid binding; Biological process= DNA integration
MIVVGRDPNDQYMPITFVVETETKETWRWFLNVLFEDIGSVETNKWVFISDQQKGLQQFFLEFSTPIEHSFCLRHLYNNFKKKFGGGIMLRDLMMGPAKVTYEHLWKNKMQQIKDINEATYHWLYNLERKAWSSDKPIITMCERIIMYLMNRFATLRDKLKYYKGKVMPKPLKRLDWEVEKLGNWVTA

SEQ ID NO: 198667 - protein, 109 aa, Glycine max
  Coding DNA Sequence Number=SeqID_81889
MEVDLPVGWKPLNLERYDGTIDPDEHLDTFLTQANLYTNDGTIIGLPSKSVDRFETLVQHFSSQYATSRSHCLTFAALVSLRQADDESLRKFMDRSTKLLSKLKTSILK

SEQ ID NO: 198668 - protein, 113 aa, Glycine max
  Coding DNA Sequence Number=SeqID_81890
  Subcellular localization annotation: CTP_CleavageSite=80; ConfidenceScore=5.28e-01
MGDLRILPAHPISHFWQHSGNIKGSKAKSVEPVLYLASLFSTPTLLPAALTSSSTSWVTPPTSSLSPPCKGGASPLSSSCPMMVKCKCEVPAIIFTSRSVNHLGEGFGDVHTG

SEQ ID NO: 198669 - protein, 103 aa, Glycine max
  Coding DNA Sequence Number=SeqID_81891
EPVQVIEVTSSEEDPEEDPEELPPKPAVDALDFLEGDEDPLPEVDSPEDVMSAYEADSTEESGPGGIATSGATTLDTFALDDTMYFAKLPYFWITLDDECTYD

SEQ ID NO: 198670 - protein, 558 aa, Glycine max
  Coding DNA Sequence Number=SeqID_81892
  Gene Ontology: Mol. function=nucleic acid binding
  Homolog annotation: Hit_ID=Q1S3K9; Match level="QueryCoverage=94%, HitCoverage=82%, E-value=1e-144, Identity=52%"; Hit description=IQ calmodulin-binding region
MMLEGSVELETVLSLRSPTEDMENDDLFGKPMSTKSRDACSDWLEKNFYSSLLETQNQRNQAALRLQKVYKSFRTRRQLADCAVLAEQRWWKALDFAELKRSSISFFDIEKPETAISRWSRATKRAAKVGKGLSKDMKARKLALQHWLEAIDPRHRYGHNLQFYYVKWLRCDSYQPFFYWLDIGDGKEVLSDRCTRTKLQQQCIKYLGPVERKCYEVVIENGRLLYKISGKPVETTEDAKWIFVLSTSKTLYVGKKNKGTFQHSSFLAGGATLSAGRLVAEDGVLKTFSTPKAVWPHSGHYLPTKENFEELMSFLKENNVDLTDVKKNPVEEEEFAKINQDLFRDNPSEVMEPPNIETESSNTLAEDLPNLRNEDSNADSNHQQPLSRLSVRLGSKITKLEIPKRVTVYDIFGELANGPRTKFYSPTAVSECGYETAEESFINEEEFMVSKSNMFAEDEDEIDENTIPKEKILKRIDSHKGRKSYQLANHLSTKWTTGAGPRIGCMRDYPLELQNLILEQQNLSPRTRTTAPSPRIPPLSRFSPRVAFPPPLADAPSA

SEQ ID NO: 198671 - protein, 151 aa, Glycine max
  Coding DNA Sequence Number=SeqID_81893
  Homolog annotation: Hit_ID=Q9LD90; Match level="QueryCoverage=33%, HitCoverage=9%, E-value=2e-14, Identity=76%"; Hit description=H/ACA ribonucleoprotein complex subunit 4
MWVTMDDVMDAQWVYDNYRDESYLRRVVMPLEILLTSYKRLVVNDSAALFVFYIDHHHSCSLSAYLIVGELMSLLSCHVSQPTLLRASEARLMGASSKGGKCTESPPTFICRKRRKNRRKPVMKNIPDSGVVFTFEEGISTSHVCLKGQQP

SEQ ID NO: 198672 - protein, 346 aa, Glycine max
  Coding DNA Sequence Number=SeqID_81894
  Gene Ontology: Mol. function=nucleic acid binding; Cellular component= membrane; Biological process=DNA integration
  Homolog annotation: Hit_ID=Q1SEE1; Match level="QueryCoverage=99%, HitCoverage=36%, E-value=3e-92, Identity=62%"; Hit description =Integrase, catalytic region; Zinc finger, CCHC-type; Peptidase aspartic, catalytic
YLHISDQGRNKLDPKSKKCTFIDCVTYKDRDNKNTSNSKQSGLVYTEVDDVPETPMNETTMLEESIENNNEQQVDTPEPSTSAPVLRRSSQPHVPNRKFLNYILLTDEGELENYKEACHNIDSSKWKLAMKDEMKSKSLISNQTWELAELPMGKKALHNKWVYQVKNEHDGSKRYKVLLVVKGFQQKEGVDYTEIFAPVVKLNTIKFVLSIIASKELYLEQLDVKTAFLHEDLDEEIYMHQPEGFSEEGKKNMVKYINRVLQRFNMGNAKLVSTPFASHFRLSKDQSPQIEEEKEFMAKVLYASATRSLMYAMVCTRPDIRHAVGVVSGFMSNPGKAHWAAVKWIL

SEQ ID NO: 198673 - protein, 161 aa, Glycine max
  Coding DNA Sequence Number=SeqID_81895
MAIVESVGKIPLQDPLEEEFCVADLTWTKFAHAAKNGLVKPEAIAFVAPTWAGPLPIVFGRDSNMETSNTYSQAKFEVPCHNQVVEAVFQDYFDDAKESRVKQVPKNQESKSFKNQVSKNQDSRIIKIKIQDSSKESILKIQESREDSIKISTKKVFQNID

SEQ ID NO: 198674 - protein, 87 aa, Glycine max
  Coding DNA Sequence Number=SeqID_81896
MAQKPKNTKTFLAIYTEQSGRLSKNNHMFKTWKRIVTQCERGIWSGRSSVGSERRSDNEGTVENVWAPRTAQWRHKGVGSQDGIVEA

SEQ ID NO: 198675 - protein, 573 aa, Glycine max
  Coding DNA Sequence Number=SeqID_81897
  Homolog annotation: Hit_ID=Q69K57; Match level="QueryCoverage=99%, HitCoverage=99%, E-value=1e-123, Identity=48%"; Hit description=Smr domain-containing protein-like
  Pfam annotation: Domain name=DUF1771; Domain location=413-478; Score =70.0; E_value=7.4e-18; Accession=PF08590.1; Description=Domain of unknown function (DUF1771)
  Pfam annotation: Domain name=PAM2; Domain location=18-35; Score=18.0; E_value=0.027; Accession=PF07145.5; Description=Ataxin-2 C-terminal region
  Pfam annotation: Domain name=Smr; Domain location=491-573; Score =65.2; E_value=2.2e-16; Accession=PF01713.11; Description=Smr domain
  Pfam module annotation: Pfam domain module=DUF1771::PAM2::Smr; Domain location=413-478::18-35::491-573
  Subcellular localization annotation: CTP_CleavageSite=47; ConfidenceScore=5.71e-01
MSLSKKGSQTDTKLSSLNKATYLNPNAAEFVPFALRSSPSGSTSSVDAAARFTTAGSLGKAVLDRSESSISNNSDDEAHQYWRCQLPDDITPDFKVMGEDESQGLNNLSLAGLSINDDNESSMFPSSKGSRYILNEQLELSPQHLNGNTFADKLRFSNSTYREEPSSGSILNSSAKPWDRQIGNTDLHVTSGQEELVYDENSGHGFLNDVFAGNSLVNDTDLNPLEFLASLFPGFASESLAEVFFANACDLHLTIEMLTQLEIQVDGGFNQNPSPKTLSSPNLSAMDFPALTSSNGQNTSKYAADNVQQSGIPYISSDKDMLMFKSGSSIPSRGSVDFASAVRKLASQDSGIWKYDKNGSGDASTGSSRGLNALASAYNGGQGRVNIGDRLQSRGSARAAPVWLETGDAVANMYSELREEARDHARLRNAYFEQARQAYLIGNKALAKELSVKGQLHNMHMKAAHGKAQESIYRQRNPVAPENGRGHQRMIDLHGLHVSEAIHVLKHELSVLRSTARAAEQRLQVYICVGTGHHTRGSRTPARLPIAVQRYLLEEEGLDFTEPQPGLLRVVIY

SEQ ID NO: 198676 - protein, 133 aa, Glycine max
  Coding DNA Sequence Number=SeqID_81898
MVRIRGLGRALGHVIGKGDRDDFDYVAQRRRPTAFARRQQVPMTVAHDESVLPAPDVEADVFPDDPMAPADVEDTGADIPADTGAQAAEDEHEGFPGGPSDPSMLTQYTDHVACSVWMRDERPELKLSFHGRK

SEQ ID NO: 198677 - protein, 199 aa, Glycine max
  Coding DNA Sequence Number=SeqID_81899
MIVIMITVAGDSDSHVGGNHSGHDDDHDGGGNGNHNGGSNSGHVDSVNGGSNRHVSGDDGGHGDDHDSNDNNDNHVGGDNDGHNSDHGGGGCGNSGKVVVTILTNDKRWHGRADNEIHNHENDDLSKKSRGKEKMSDSKSSWSLLTESSEGGISIDTTHEFSGPSSCIVSINNYNDCDRKGFEYKKNQDQVINNGESRS

SEQ ID NO: 198678 - protein, 115 aa, Glycine max
  Coding DNA Sequence Number=SeqID_81900
MTIAATIDAINMTTIAATVVIAVATTVVIVVMTTVVATNMTVTVAGNGNHDDDHECDDCDNDGSCSDDLDLEESVQAEGGRKPWTIKEDLKTWILRRKGDLAWTINEGIFVGEDY

SEQ ID NO: 198679 - protein, 83 aa, Glycine max
  Coding DNA Sequence Number=SeqID_81901
MSHFQGFFKGSIKTSYYGERHRSQDYLKITKKERIGSLFSTESLRWILRILLRLKCSSPCGGLATSKDGSWWPPIAWWWSRRS

SEQ ID NO: 198680 - protein, 114 aa, Glycine max
  Coding DNA Sequence Number=SeqID_81902
MAKYMQMEELSEYRSLRGEEVKAAQEKKKRILSTNQDWSSTLSLDVSPEEEQPPLRKNAPTEEAPRFMHYVEVKTKAKEMKELDLDSRTNDDNRVKPLEETSNSQLSPKEGQVT

SEQ ID NO: 198681 - protein, 117 aa, Glycine max
  Coding DNA Sequence Number=SeqID_81903
  Gene Ontology: Mol. function=G-protein coupled receptor activity; Cellular component=membrane
  Homolog annotation: Hit_ID=O04214; Match level="QueryCoverage=69%, HitCoverage=21%, E-value=6e-28, Identity=90%"; Hit description =Putative G protein coupled receptor
MCLLLSLSKQGHNRYALQFLRHNRVYMLDQARFSSMDPSKGFFCYAQGYSTHFFCVASFLWTTTIAFTLHRTVVKHKTDVEDLEAMFHLYVWEHINVDGIASDAGYVPIVVGLPTLV

SEQ ID NO: 198682 - protein, 65 aa, Glycine max
  Coding DNA Sequence Number=SeqID_81904
MKTQGFRSDEEEHGKRERERKEAYRESEVEDELEGELAELLEEEVAHYNEAGTGQRQARRSDVHR

SEQ ID NO: 198683 - protein, 133 aa, Glycine max
  Coding DNA Sequence Number=SeqID_81905
  Gene Ontology: Mol. function=methyltransferase activity; Biological process=DNA methylation
  Homolog annotation: Hit_ID=Q75LK9; Match level="QueryCoverage=97%, HitCoverage=51%, E-value=3e-48, Identity=67%"; Hit description =Expressed protein
MDPNVPAQLLEYDKRFGQYGSEYTFYDYNHPEDIPSELKHSCKVVVADPPYLLNHAYLSKECLEKVAETIHLLVQPGESFLLLLTGEVQKERAAEILGLHPCGFRPQHSSKLGNEFRLFSNYDPGTRLGGWEK

SEQ ID NO: 198684 - protein, 132 aa, Glycine max
  Coding DNA Sequence Number=SeqID_81906
  Subcellular localization annotation: CTP_CleavageSite=33; ConfidenceScore=5.08e-01
MKNKNAKMQNNHKNNANENERKTTMKRMRTGVKSEARRVTITNEGNAVRQERSANSEKTYEITNAYLTNVEDVDTGVLDIFGEERVHENANLVHVDEKAEVAKLGVDGDNGKHEARVKGAIDDGYLGMGNVF

SEQ ID NO: 198685 - protein, 263 aa, Glycine max
  Coding DNA Sequence Number=SeqID_81907
  Homolog annotation: Hit_ID=Q9LY84; Match level="QueryCoverage=32%, HitCoverage=21%, E-value=2e-11, Identity=41%"; Hit description=Early nodule-specific protein-like
  Subcellular localization annotation: CTP_CleavageSite=57; ConfidenceScore=5.31e-01
MAERLTAVQNFGFLVKIPIAESLTPVVLLGWSFRVLFTCLSSSSFVASVVQGKRFVKPSKVTKDIHTDRTFTGKSMSFDAFSSVLNYLDLHASSAPHRCLWLSGISRSIAYNWSRPNMKIGVRIIHASSSYRNWSKEAWILRQDVCAGCCSFGIAGNDPKGGTPFTFEIQVAQFNQFKARIGKFFKQEGRNSFREHFPRLEDFAKAIYIFDIGKNDIVAAINRVGHEDSHAVISDIVDYFENQIQVKTPHQFLGLPQGAWFQD

SEQ ID NO: 198686 - protein, 107 aa, Glycine max
  Coding DNA Sequence Number=SeqID_81908
MTMWVSTERFPTDFGRKEKENNNFRQEDDKEKSELKEIDTFGESKKGLKRAITLARRTRIRGGNNGLKMFVQLTNSSNNLSSQSYTTSTYKIDHVSREVLSGVLDTV

SEQ ID NO: 198687 - protein, 1586 aa, Glycine max
  Coding DNA Sequence Number=SeqID_81909
  Gene Ontology: Mol. function=RNA-directed DNA polymerase activity; Cellular component=chromatin; Biological process=chromatin assembly or disassembly
  Pfam annotation: Domain name=Chromo; Domain location=1486-1540; Score= 48.0; E_value=3.1e-11; Accession=PF00385.14; Description='chromo' (CHRromatin Organisation MOdifier
  Pfam annotation: Domain name=RVP_2; Domain location=397-529; Score= -30.4; E_value=0.00023; Accession=PF08284.2; Description=Retroviral aspartyl protease
  Pfam annotation: Domain name=RnaseH; Domain location=929-1050; Score=- 27.1; E_value=0.019; Accession=PF00075.14; Description=RNase H
  Pfam annotation: Domain name=rve; Domain location=1184-1340; Score =127.2; E_value=4.6e-35; Accession=PF00665.16; Description=Integrase core domain
  Pfam annotation: Domain name=zf-H2C2; Domain location=1125-1166; Score=9.2; E_value=0.022; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1486 -1540::397-529::671-840::132-222::929-1050::1184-1340::1125-1166
MPARKITIAAFTRMEARVNALEGEISMVRSSLVSFQEEVKENHANLIAMLEKHFGKSLDDEGTGSAVSKNKEAPEKKTETPKGSRADKMNEFHQSAKKVELPSFEGEDPAGWISRAEVYFRVQNTAPEVKVSLAQLCMDGPTIHFFNSLIGEDEDLTWESLKIALLERYGGHGDGDVYEQLTELKQEGSVEDYITEFEYLIAQIPRLPEKQFQGYFLHGLQPEIRGRVRTLATMGEMSRMKLLQVTRAVEKEVKGGNGSGFGRGPKNGPYRSNSHGGNKGVSDWVMVKNKEGGVSSSMRSGLRGDKQAQGDNRHTGPRDRGFTHLSYNELMERKRKGLCFKCKKPFNPGHQCSEKHLRVLIVDDECEEDGEAKVLAVEVEGGEEDEQGEMSMLDLHHIAHENHQTMKFQGIIKGVEVLILVDSGASHNFISQKLVHHMDWPIEQTQKMKVKLGNGVQREAQGRCRELEMYIGSHKLRPNLQLFKLGGIDVVLGMEWLKTLGDTIINWKQHTLSFWEEGRWVTLGNKEGCKNPMIALQSIVGKPRPKKGGEVWRIEGVEPKVVCESIRTESPHRVLEVVLGEYANVFQTTCESVLSENQHRELEEVLGEYAHVFQTPSSLPPRRKKEHAINLIDGHGAVNVRPYRYPHHHKNEIKRQVQEMLATGIIRHSTSSFSSPVILVKKKDNTWRMCIDYRALNKVTIPDKFPIPVIEELLDELHGAKFFTKLDLKSGYHQVRVKDSDIEKTAFRTHEGHYEFLVMPFGLTNAPSTFQNLMNDVFRPLLRKSVLVFFDDILIYSQDWDSHLRHVREVLGLLSTHSLVVNKKKCSFAQQTVEYLGHVISENGVAVDPSKVISVLQWPQPRNVKGVRGFLGLTGYYRKFIKDYGKVAKPLTELTKKDGFKWHEKTQAAFDTLKQKLTTAPVLALPDFSTNFVIECDASGTGLGAILMQQNRPVAYFSKALGVRNLAKSAYEKELMAVVLAIQHWRPYLLGRKFVVSTDQRSLKQLMQQKIMTAEQQNWAAKLMGYDFDIVYKQGKLNKGADALSRVYEDSELSAMSSTATWIQEEQIKAEVQRDGKLQKIIAEIQLDPLSWPGYSYRQGTLLYEGRLVISNKSLLIPTLLQEFHSTPQGGHSGFYKTYRRMAANLYWIGMKGMIQEFVRQCDTCQRQKYMASSPGGLLHPLPIPEQIWEDISLDFITGLPKSKQFEAILVVVDRLSKYAHFIPLKHPYTARSIAEIFCKEIVRLHGIPLSIVSDRDPIFVSNFWREMFKLQGTKLKMSTSYHPETDGQTEVVNRCLETYLRCFISDQPRTWVTWIHWAEYWYNTTYHSSTDKTPFEVVYGRPPPLLTSWAQGETRVASVQKDLMDRDEALRQLKTQLLKAQERMKSQADKKRVDRSFMCGEWVFVKLRAHRQQSVVTRINAKLAAKYYGPYPIVERVGGVAYKLKLPEGSRVHPVFHVSLLKKAVGNYQEDKELPDLLEDPVEACEPEAALASRKIKQQGEEVRQFLIHWKGKTMEEATWEDELMMRSQFPNFDLEDKVNSEEGSIDRVQGNEGYPHQQLVHSTQNGVRPFLVYTRRKGRKVFGG

SEQ ID NO: 198688 - protein, 643 aa, Glycine max
  Coding DNA Sequence Number=SeqID_81910
  Gene Ontology: Mol. function=hydrolase activity, acting on glycosyl bonds; Cellular component=intracellular; Biological process =carbohydrate metabolic process
  Homolog annotation: Hit_ID=Q6ETD1; Match level="QueryCoverage=68%, HitCoverage=69%, E-value=4e-49, Identity=28%"; Hit description =Putative pentatricopeptide (PPR) repeat-containing protein-like protein
  Pfam annotation: Domain name=PPR; Domain location=383-417; Score =21.0; E_value=0.0042; Accession=PF01535.11; Description=PPR repeat
  Pfam annotation: Domain name=PPR; Domain location=463-497; Score =32.8; E_value=1.2e-06; Accession=PF01535.11; Description=PPR repeat
  Pfam annotation: Domain name=PPR; Domain location=498-531; Score =11.3; E_value=0.34; Accession=PF01535.11; Description=PPR repeat
  Pfam annotation: Domain name=PPR; Domain location=534-568; Score=6.3; E_value=1.3; Accession=PF01535.11; Description=PPR repeat
  Pfam module annotation: Pfam domain module=PPR::PPR::PPR::PPR; Domain location=383-417::463-497::498-531::534-568
MTRLKDTNVSVLEWTPLASERAMISVGNSSLEELDWAIWDDIMLPKSMSIFITIPYIKWAWSIFKSEVWDVRARLKIFQGAPSMFNIKWPPSKQSLASIAWWSEYVYMEESRKDYESKVERRGDSDDDNSPNAVFNAETWCCWMQKPQLHTFIKAITTLRPIPTTPPHTFLPLRNPSESVIYLKNHEIDAFIKRRNPNVALSVFHNTPLRDTVTYDLIISAFRQQIMLFVSTRKWGVQVHCGVIKFGFSCNVFMGDALVGFYTQVGQCGVALQLFDVPERNLAVWNVMLRGLCELGRVKVEDLLGFYLSRMRFEGGFGGIECFYYAENDLLCEALEVHCRVMKLGFNEGSVHVQSALIDMYGKCRDIESSVAVFECLPERTLDCFNSLMTSLSYCDAVDDVAELFGLMVDEGLVPDGVTLSTTLKALSVSALASFTSSQLMHCYALKSGLGEDAVVAYSSFSKRFTSMINAYARNGMGKEGIAMLQAMTERGLKPDDVTFLCALNGCNHTGLVEEGRIVFESMKSLHGVDPDRRHFSCTMDLFCRAGLLHEAEEFLLQSQGKGEYFMWSSLLRSCRVHKNEEVGTKAAQVLVELDPDDPAVWLQASNFYAEIGKFDASRQIREVSLARKMTREIGHSLIEIRQ

SEQ ID NO: 198689 - protein, 360 aa, Glycine max
  Coding DNA Sequence Number=SeqID_81911
  Homolog annotation: Hit_ID=Q2QQM3; Match level="QueryCoverage=34%, HitCoverage=11%, E-value=5e-24, Identity=43%"; Hit description =Ubiquitin-specific protease 12, putative, expressed
  Pfam annotation: Domain name=MATH; Domain location=18-136; Score =39.6; E_value=1.1e-08; Accession=PF00917.16; Description=MATH domain
MVNELTTGVDFEKFSWKIEDFSKKNLMKLRSKPFKIRGCTWRLLVYPLRRDVNHFSVYLMVADSLPPYGWSRNTFFKLALINQVDRNKSIAKETQQKFNGGYRCWGSFFLNLTDFNNPKQGYLVRNTCIIEAHICVSDLAPKIQVHPNSSPIHDSCDQATEESSSDDRDTISPRTSGSSTAAEGEIQGSNNLTLRELIDFESLGAEEQAFIPLLEEVCIWHPNLIKCQRERTRRFRQWAFTSLGHVLHFLKTKRVKDINEEDIKYLHGLWKELVKSSGFDLAWLEPYVQLALGSRAYMERANQLKKLKDKVVALEIKMKRLRGELAAAEGEFEVARRGLSEVRRGFNEMDLNAAIGYAMF

SEQ ID NO: 198690 - protein, 643 aa, Glycine max
  Coding DNA Sequence Number=SeqID_81912
  Gene Ontology: Mol. function=hydrolase activity, acting on glycosyl bonds; Cellular component=amyloplast; Biological process =carbohydrate metabolic process
  Homolog annotation: Hit_ID=Q27SZ4; Match level="QueryCoverage=52%, HitCoverage=100%, E-value=0.0, Identity=96%"; Hit description =Polygalacturonase
  Pfam annotation: Domain name=Glyco_hydro_28; Domain location=254-608; Score=292.0; E_value=1.1e-84; Accession=PF00295.8; Description =Glycosyl hydrolases family 28
MSGLSFRGFTYMLLIAFLIWSFNFEACIARRGKHWRQSRDVSASVYKKKGKNYGNAHNKYHGGGSKSKPPSSHKGTPTLPKPPPQHKNTPSPPYPTPPSDDTPTTPPPKAYNGGGHSSATTFNVLDFGAKGDGKSDDTKQMVLMYLLLTSLTCKTKNFQFIIEFIVPSANKFNIAKYSYENFWECTFRQLLNLLLCSQFGSCNYKGYKKAIRSIKNCFLLSSLFGMLLMPLKKVYRDHRVRAKQAFQEAWAEACKIESSTMLVPADYAFFVGPISFSGPYCKPSIVFQLDGTIVAPTSPKAWGKGLLQWLEFSKLVGITIQGNGIIDGRGSVWWQDNQYDDPIDDEEKLIVPLNHTVGSPSPPLPIQSEMGGKMPSVKPTALRFYGSFNPTVTGITIQNSPQCHLKFDNCNGVMVHDVTISSPGDSPNTDGIHLQNSKDVLIYSSSMACGDDCISIQTGCSNIYVHNVNCGPGHGISIGSLGKDNTRACVSNITVRDVNMHNTMNGVRIKTWQGGSGSVQGVLFSNIQVSEVELPIVIDQFYCDKRTCKNQTSAVSLAGINYERIRGTYTVKPVHFACSDNLPCVDVSLTSVELKPIQEQYHLYNPFCWQTYGELKTPTVPPIDCLQIGKPTNNRIQTDHDLC

SEQ ID NO: 198691 - protein, 68 aa, Glycine max
  Coding DNA Sequence Number=SeqID_81913
MWPTRTAQQQRTVRHSPQVASLKMLCYQTPAFTLAPQSYEEIHEDAKGNKNHNGMKKAIIEPQRKSIP

SEQ ID NO: 198692 - protein, 90 aa, Glycine max
  Coding DNA Sequence Number=SeqID_81914
MEFYWKFDLIEDHVTAKIDESDVWDGRFGHINLKSLKFKQDKNEIEMKNPGKRCLRTRGVKLNVFDVLLNSSLKFMKKLGIFMTNLKEEC

SEQ ID NO: 198693 - protein, 162 aa, Glycine max
  Coding DNA Sequence Number=SeqID_81915
MGRDEGVPADAAKATDDDDEGHFAVEGNVIEGVGGGKGEDDGVEGGINKVSVERVEELKGLMEVVAVCMEGDDGLEEELVGEGEAEERGGDEGVMKEGGLGGVGVEQGSKEECMEAFRAQRSKEREWNSQCQSKKDKKEIWKKQVKGSVQVKEGKIKDNGAK

SEQ ID NO: 198694 - protein, 248 aa, Glycine max
  Coding DNA Sequence Number=SeqID_81916
MTHTRPWFSPQDIKKYYIREEVSVQTLCVLGILPRHCAITVCVKNHVGSLCKHCAHQESYRITVRVRNPAETLCKHYGRQKFCRDTMCIRNPTRSLCEYYACYESYRITCASGILLNHCAHWESYRDIMQTLCTSGILPRHCATTMRVKNPVGSLCTSRILLEHCVNIVHIKSPAGSSCQHCAQLESCRDIVQTLYASGILPDYYVKHCANTICMGNPAKALSKHCSWYYASKIPMQTWYKHYSWYYS

SEQ ID NO: 198695 - protein, 86 aa, Glycine max
  Coding DNA Sequence Number=SeqID_81917
MDDLLGSFIESIKAIRQKVKVVKFDKSGEYYGRYDGIGQHLSPSAKLLQTQVPSKAVLKTPFELWTNRTPNKTHACLGLLGKNKDL

SEQ ID NO: 198696 - protein, 45 aa, Glycine max
  Coding DNA Sequence Number=SeqID_81918
MEKVAWSGRPNPTYNYATGLEIPSCLTQKTVRPKRKPPWRVAMTA

SEQ ID NO: 198697 - protein, 219 aa, Glycine max
  Coding DNA Sequence Number=SeqID_81919
MTCDVPVVSAWDFSGCFAGGVREWSSISAHVGSPTRVIAMKPHLEFSSFGEAFPLVVPIAAVLLPKRIISLEAGKKDCALRHFYQTRAKARIMSDIEQVQEQMKADMEAMKEQITTMMEAMMSMRKMMEVNAATVVSASIATERDPIHPPDFSQVNRPVSDVVGQGGETMKNGYGPHYVQVQSKSSFPPYSLPPNYTPPTIVYALGENIGNSAPVFIEN

SEQ ID NO: 198698 - protein, 75 aa, Glycine max
  Coding DNA Sequence Number=SeqID_81920
MAEATDTPSHRSHTRMCVWCESDPGHVDDEPQLLHGVEPVKDSGWVVSEGDGSNVVDEYEVGEVATSVVERGVEG

SEQ ID NO: 198699 - protein, 172 aa, Glycine max
  Coding DNA Sequence Number=SeqID_81921
MISNLTGEGEPLIRRFAQLLPSLKLRIGVRPRGSGMEFDVNNNHHGRVISSSHGGGGYSRGDIGGIDNDDMVAVMEVILVVVVIMTVVGGSDVSDGDCNHIGGSCGGSDDDKCGIIGSGDNDDIDDIDDSGGGSYDNIGDDCSNSDNDSSNNINDSGDNNVGGDGSMAMVVG

SEQ ID NO: 198700 - protein, 113 aa, Glycine max
  Coding DNA Sequence Number=SeqID_81922
MDLNMPMSSLRRCPEIQPYEDWAISSSTQVSPRLKPTMWITSITMWVLVRHLLVPPLLWQIDPILLMSISTSSTKGNLAKSLGVANIPCYMQSVNVELSLEIVFAFLAVITHN

SEQ ID NO: 198701 - protein, 98 aa, Glycine max
  Coding DNA Sequence Number=SeqID_81923
  Homolog annotation: Hit_ID=Q69NN2; Match level="QueryCoverage=41%, HitCoverage=4%, E-value=1e-09, Identity=65%"; Hit description =Hydroxyproline-rich glycoprotein-like
MGLDDKAAEDELVFDDDPLTWGAVADATRASESFTYTIWQIRPKKTASTASYNLGEKLLSGLVGIHGTFLEHCIDVFFTVIARDLLDVLDRPPDTARN

SEQ ID NO: 198702 - protein, 642 aa, Glycine max
  Coding DNA Sequence Number=SeqID_81924
  Homolog annotation: Hit_ID=Q6EP64; Match level="QueryCoverage=83%, HitCoverage=67%, E-value=2e-89, Identity=38%"; Hit description =Hydroxyproline-rich glycoprotein family protein-like
  Subcellular localization annotation: CTP_CleavageSite=48; ConfidenceScore=5.67e-01
MPASEIGSSPAQGKIQGKSQGAAKNHVTEMSSTSSAVTHSSPSTSRPSSNYTSRSQQLIGPQKGKVYIPAVQKLLCDCKDSVIIHYPVNIHILVSLTVESGSNKEWKPKPTNTINQGSGPASASEALVSVDPTGQLQSASSALNSEEATSKLQRKLEDLHLPQRQHVILPNHIIVPDSEKNKFSFGSLGVALGVNTSYVSGPESEKSSTPVSETSQTIEETVEEQDSSQNAAVTSEVGDYPDHPQSPTNGAENLSSSEVDGSSSAIQEYNESKQDTALPSGGHQYSGVHTSPNYSFGFMPPMLGTQLTQFDNSESQTRDASRLPSFIVHQQLDPASYYAQFYRTGGDSDGRLSPFSSAGTNTKYNGNVTVLPAPTSQSPQEGGVLSTAGPTPLVTQAAGLMQSSIAVTQQPVPVFRPSGVHISHYPPNYIPYSPYFSPFYVSPPAIHQFMGNGAFPQQPQASTVYPPPPAVAPTGMKYPLPQFKPGANAANPTHLVMPSAYGVYGSSAAGYNHNSAAAAGNSTSNEDLGSSQFKESNVYIGGQQSEGSAVWVAAPGRDITSLPTSTFYNLPPQGQHVTFAPTQAGHGNFAGMYHPAQAVTAATVHPLLQQSQTMAGAVDMVGPGGNVYQQPQHSQINWPSNY

SEQ ID NO: 198703 - protein, 121 aa, Glycine max
  Coding DNA Sequence Number=SeqID_81925
  Gene Ontology: Mol. function=binding
  Homolog annotation: Hit_ID=Q9ASI0; Match level="QueryCoverage=53%, HitCoverage=16%, E-value=2e-07, Identity=52%"; Hit description =Putative arm repeat-containing protein
  Pfam annotation: Domain name=Arm; Domain location=62-102; Score=25.6; E_value=0.00018; Accession=PF00514.13; Description=Armadillobeta -catenin-like repeat
MGEGENTEIETETESEATSTWSLGKHTQIIELSETLTNGNLSAKIEAAREIRKMVRKSSSSSSKTRAKLAAAGVIEPLVLMLSSSNVDARQSSLLALLNLAVRNERYPPSSLPRCMLFCEL

SEQ ID NO: 198704 - protein, 158 aa, Glycine max
  Coding DNA Sequence Number=SeqID_81926
  Gene Ontology: Mol. function=ribonuclease activity; Cellular component=cytoplasm; Biological process=carbohydrate metabolic process
  Homolog annotation: Hit_ID=Q8GZQ4; Match level="QueryCoverage=90%, HitCoverage=11%, E-value=3e-21, Identity=43%"; Hit description =Endoribonuclease
MDHKADPEKPKSWPKFILRVDHRMCEYLTSGKKTRLATLSSSLKVWILLKECFLDAVFRCILHFCRVNDMQVQSNSLEARLEFYLMVARGFIRGSFEVKPFTDDKVEKNQHKVAISMLRSSEARTKTPGQNVTLVQGEKLGSQGGRAKIIRVHFLRAS

SEQ ID NO: 198705 - protein, 307 aa, Glycine max
  Coding DNA Sequence Number=SeqID_81927
  Gene Ontology: Mol. function=nucleic acid binding; Cellular component= mitochondrion; Biological process=DNA integration
  Homolog annotation: Hit_ID=Q1SRN1; Match level="QueryCoverage=96%, HitCoverage=25%, E-value=8e-79, Identity=45%"; Hit description =Integrase, catalytic region
YMQQPPGFDSSNKSLVCKLYKAIYGLKQAPRAWFGRLKELILKLDFQSSKCDPSLFVYSKGSSTVCMLIYVDDIIITGNNPTLLQQLISKLNNVFSLKDLGSYLLTNLSGCKLIKEGSDPLTDPSMYRSVVGALQYATITRPEISFSVNKVCQFMSHHTLEAHWPFVMLTGPLTQMIEDPHESVVACSSTEAEYRSLALVTAEVSWLQSLLSELAVKHAVPVIHCDNMGTVPLVHNPVLHARIKHMELDLFFVREKVLSKLLKVVYVPALDQYADILTKALSPINFELYRTKLTVCDSSVFAKNPSP

SEQ ID NO: 198706 - protein, 86 aa, Glycine max
  Coding DNA Sequence Number=SeqID_81928
MSCEKIHTPLGWDNEGSIGAKKVMGVRKTKFGHEEEEEEEEEDAVGGVGGKCYAMVGLTWIAWTHGDVNGGKKSPMTGINNEDGTS

SEQ ID NO: 198707 - protein, 501 aa, Glycine max
  Coding DNA Sequence Number=SeqID_81929
  Gene Ontology: Mol. function=nucleic acid binding; Biological process= DNA integration
  Homolog annotation: Hit_ID=Q1S7C5; Match level="QueryCoverage=33%, HitCoverage=16%, E-value=5e-29, Identity=35%"; Hit description =Integrase, catalytic region
MATPVTADDCGGDPPPNGDPVLPIQPSPAHMNFHHSITEKLNSVNYLFWNSQVEPVIRGHCLHHFTENLQIPEWFATLVDPDAGRFIGCTSSWLVWDKNHNYFHAHTNVKARQLRIELRQLTLEGCTISDFLMEIQNLVDSAIGDPITIREHVDIIIEGLPENYESSVSHINNRSEPLTIDEIETILLGLEARIDKFMKKPVVSVNVASTSTAYSVSSSVSPQANFMQESNTQQQSEEAMVAEVVATFSATSAKSLVMMLQTAPMPQQMQPSATFVQQSMPQPMQYMQQQLPMQPMQQQPQIFWGTLPQNAMSQQMPSSTSIPPQMPTSNPMSSHNPQALTIGSTASSSSNWYPDSGASHHVTSNVENIQQCAPFEGPDQGSNEILLKGHLGSDGLYKFPHMLYSSSAPTSSSFRNVSFNSALHSSLVNTASLNFITTSTWHSRLGHPSAATQNLHIDACSLSSTTYSQPVELIFSDWWGPAPFVSSTGYSYYVTFVDAFT

SEQ ID NO: 198708 - protein, 455 aa, Glycine max
  Coding DNA Sequence Number=SeqID_81930
  Gene Ontology: Mol. function=metal ion binding; Cellular component =intracellular
  Homolog annotation: Hit_ID=Q9LUA9; Match level="QueryCoverage=99%, HitCoverage=99%, E-value=1e-90, Identity=43%"; Hit description=Zinc finger protein CONSTANS-LIKE 10
  Pfam annotation: Domain name=CCT; Domain location=404-442; Score =73.1; E_value=9e-19; Accession=PF06203.4; Description=CCT motif
  Pfam annotation: Domain name=zf-B_box; Domain location=1-47; Score =37.8; E_value=3.9e-08; Accession=PF00643.14; Description=B-box zinc finger
  Pfam annotation: Domain name=zf-B_box; Domain location=48-90; Score =7.6; E_value=0.019; Accession=PF00643.14; Description=B-box zinc finger
  Pfam module annotation: Pfam domain module=CCT::zf-B_box::zf-B_box; Domain location=404-442::1-47::48-90
MGYLCDFCGDQRSLVYCRSDAACLCLSCDRNVHSANALSRRHSRTLVCERCNSQPAFVRCVDEKISLCQNCDWLGHGTSPSSSTHKRQSINCYSGCPSAAEFSSIWSFFLDIPSMGEACEQELGLMSINENSNKNAWASPEGQNVSGSAEVTDLPSKGKSWAGTSSVPESSSEPRILDQPPGPANECMPKAKLLENHNRTRCDGDEHSNNETVYEILYCPGKKVSGIYEDDDLYDDFIMDEVDLQLENYEELFGMALSHSEELFENGGINSLFETKDMSASAGDSHCQGAVAAEGKEDGEVGYMNNMTSFDPGSSAELVNAIQPACSNAASADSMMSTKTEPIVCFTARQSLSNISFSGVTKDSVGDYQDCGASSMLLMGEPPWCPPCPESSLHSANRSNAVMRYKEKKKTRKFEKKVRYASRKARADVRKRVKGRFVKAGDVYDYDPLNQTRSC

SEQ ID NO: 198709 - protein, 117 aa, Glycine max
  Coding DNA Sequence Number=SeqID_81931
MAYLCPDSEWHLKKTTTPPFPTIVIIASPLSSLPPSSTITPLEKPHTRNTLEEKFLQADPSSPQQIWHHHISIHTTSIDPVPPTTDPSETVYGPESIYPPLYAARLALSHRVNSTSK

SEQ ID NO: 198710 - protein, 199 aa, Glycine max
  Coding DNA Sequence Number=SeqID_81932
MEGKQTLDGQGYLPLTETSQMNFSGVALQRLKRHRAQSKLEFEGHCKNKNYFDINTTKIKLYEKKIPKIQNERNTKLRNILIQVGGCALCGGAQESSTCMTQEETSKKVNYMANMNHHGYNQRSNASYHPRSNAGFHQGGNFSQNQGQDWRFHPSNNFKKDQVEKNPKEDYKVIFTRSKVRESLKRNECRGSRKGSGKR

SEQ ID NO: 198711 - protein, 305 aa, Glycine max
  Coding DNA Sequence Number=SeqID_81933
  Gene Ontology: Mol. function=oxidoreductase activity; Cellular component=membrane; Biological process=electron transport
  Homolog annotation: Hit_ID=Q1S4Y9; Match level="QueryCoverage=99%, HitCoverage=68%, E-value=1e-79, Identity=45%"; Hit description =Berberine and berberine like, putative
MVAMTMKGCLMWLHSQPLFILDMFNLRSIQIDMKTETAWVETGATLGEVYYIIDEKSKLFDRKSMGEDLFWAITGGGEASFVIVFRVLKTLEQNSTDIVYNWHHFAPTINNNLFITLVLNVTQNGIKTIRETFVALFLGDSKSLVSLLNDKFSQLGLKQSDCIETSWLGSVLFSKNTNITALVEVFLNRQPQSVNYLKRKYHYVKKSISKEGLEGIWRKMIELVDTSLNFNPYGGRMAKIPSTTSHFPHRAGNLWKIQYLANWNKPGKEVANHYINLTRKLHKYMTHFVSKNPRGAFFNYRDLHL

SEQ ID NO: 198712 - protein, 152 aa, Glycine max
  Coding DNA Sequence Number=SeqID_81934
  Gene Ontology: Mol. function=DNA binding; Cellular component=nucleus; Biological process=regulation of transcription
  Homolog annotation: Hit_ID=Q0PJL5; Match level="QueryCoverage=69%, HitCoverage=34%, E-value=1e-34, Identity=71%"; Hit description=MYB transcription factor MYB57
MGNMKWGHYKEWLPGCGGVETKVASHDQKYFIRQLSGGKDKTSASIHVITTMNLTETITTFSEDTDRFTSPHVLSRQQQPNSTPTTPRTRFQWSSQSNTGVAMTLNPGQERVFMSHYGANSFRVKIEEVEPESSIHFNKYNAWVELFPQLLM

SEQ ID NO: 198713 - protein, 50 aa, Glycine max
  Coding DNA Sequence Number=SeqID_81935
MALSHSEELFDNGGIDCLFETEDASAGDSQCQGVAAAENNLYIRPIPQSQ

SEQ ID NO: 198714 - protein, 305 aa, Glycine max
  Coding DNA Sequence Number=SeqID_81936
  Homolog annotation: Hit_ID=Q9LUA7; Match level="QueryCoverage=96%, HitCoverage=96%, E-value=3e-90, Identity=56%"; Hit description =Arabidopsis thaliana genomic DNA, chromosome 5, P1 clone:MIF21
  Pfam annotation: Domain name=DUF868; Domain location=27-304; Score =537.2; E_value=1.8e-158; Accession=PF05910.3; Description=Plant protein of unknown function (DUF868)
MQFHRSLRAQSVSTPIPEKITEEPLPSKVAQSTVTCFYQANVVGFWRNVSVLWCKNLMNHSLHITVDSVGGEVQYSCKIDVKPWHFWSKKGYKTFEVDGNQVELYWDLRSAKFTGSPEPSSDYYVALVSDEEVVLLLGDYKKKAYKRTKSRPALVDAMMLLKKENVLAKKSFSTKARFNEKRKDSEIVVDSSTGGPSDPEMWISIDGIVLIHVKNLQWKFRGNQTVMVNKQPVQVFWDVHDWLFSGSGSGHGLFIFKPGPPEAESEKEGSAVEGCESDDGSVGYFSTMNIATFEFCLVLYAYKIE

SEQ ID NO: 198715 - protein, 72 aa, Glycine max
  Coding DNA Sequence Number=SeqID_81937
MALLFHICHSFFSFALPKLSYKGVLHDSENDFSLQFGVGMRRNFGALMEASMVEKKEEKSNVERGEEVSEFC

SEQ ID NO: 198716 - protein, 70 aa, Glycine max
  Coding DNA Sequence Number=SeqID_81938
  Subcellular localization annotation: CTP_CleavageSite=19; ConfidenceScore=5.07e-01
MLAVTKYGSLGDRKSRSVVSFRQTNLNRRNISINAPQRPTLLTTDRAHKPSINKPPDGHDESNPLSNLDS

SEQ ID NO: 198717 - protein, 458 aa, Glycine max
  Coding DNA Sequence Number=SeqID_81939
  Gene Ontology: Mol. function=protein serine/threonine kinase activity; Cellular component=membrane; Biological process=protein amino acid phosphorylation
  Homolog annotation: Hit_ID=Q5YD56; Match level="QueryCoverage=99%, HitCoverage=99%, E-value=1e-179, Identity=70%"; Hit description =Calcium/calmodulin-regulated receptor-like kinase
  Pfam annotation: Domain name=Pkinase; Domain location=133-380; Score =139.4; E_value=1e-38; Accession=PF00069.15; Description=Protein kinase domain
  Pfam annotation: Domain name=Pkinase_Tyr; Domain location=133-405; Score=146.4; E_value=7.4e-41; Accession=PF07714.7; Description =Protein tyrosine kinase
  Pfam annotation: Domain name=RIO1; Domain location=146-307; Score= -91.6; E_value=0.032; Accession=PF01163.12; Description=RIO1 family
  Pfam module annotation: Pfam domain module=Pkinase::Pkinase _Tyr::RIO1; Domain location=133-380::133-405::146-307
  Subcellular localization annotation: CTP_CleavageSite=62; ConfidenceScore=5.48e-01
MKKTPPPNLHQSSQSRQNANLQFVGTNNDAKRHSSKTLRSLKYAAKKCAAVFSLFLYGKRKSASYVVGNDGRKNTSKVRGVVSSSTDLSSESTTKNSSKWKFSYSYASSITASGQLGIGNFSFEEIYKSTAKFSPANEIGQGGFGTVYKGKLNDGSIVAVKRAKKDVIHNHLHEFKNEIYTLSQIEHRNLVRLYGYLEHGDEKIIVVEYVGNGNLREHLNGIRGEGLEIGERLDIAIDVAHAVTYLHMYTDNPIIHRDIKASNILITENLKAKVADFGFARLSDDPNATHISTQVKGTAGYMDPEYLRTYQLTEKSDVYSFGVLLVEMVTGRHPIEPKRPVDERVTIRWAMKMLKQGDAVFAMDPRLRRNPASIKAVKQVLKLALQCVAPSKQSRPPMKNCAEVLWDIRKSFRDEANSDHPPLPSHHSANFPQREKNKFGIEDDDSYKFVSVPNHIRS

SEQ ID NO: 198718 - protein, 272 aa, Glycine max
  Coding DNA Sequence Number=SeqID_81940
  Gene Ontology: Mol. function=binding; Cellular component =intracellular; Biological process=regulation of transcription
  Homolog annotation: Hit_ID=Q1RWK6; Match level="QueryCoverage=93%, HitCoverage=63%, E-value=3e-35, Identity=32%"; Hit description =Pancreatic ribonuclease; Tetratricopeptide-like helical
  Pfam annotation: Domain name=PPR; Domain location=125-159; Score=3.7; E_value=2.7; Accession=PF01535.11; Description=PPR repeat
  Pfam annotation: Domain name=PPR; Domain location=222-256; Score=8.7; E_value=0.69; Accession=PF01535.11; Description=PPR repeat
  Pfam annotation: Domain name=PPR; Domain location=55-89; Score=37.7; E_value=3.9e-08; Accession=PF01535.11; Description=PPR repeat
  Pfam annotation: Domain name=PPR; Domain location=90-124; Score=7.5; E_value=0.96; Accession=PF01535.11; Description=PPR repeat
  Pfam module annotation: Pfam domain module=PPR::PPR::PPR::PPR; Domain location=125-159::222-256::55-89::90-124
MGIYAKYGCIELARKLFDEMPDRTTADWNVIISGCWKNSETARMYFDKMPERSVVSWNAMLSGYSLSGAAQETLRLFNDMLSSGNEPDQTTWVTVLSSCSSLGEPCLAKSIVRKLDKLNFRSNYFFKTALLNMHTKCGNLEVAQKIFEQLGVYKNSVTWNAMISAYARAIKLFKEMISSKGSKPDEVTMVSVFSACGHLGRLGLGNWAVSILNENHIKLSISGYSSLIFMYLRCGSMEDARIIFPEMATRDLVSYNTFDFRASSPWAWNQTA

SEQ ID NO: 198719 - protein, 96 aa, Glycine max
  Coding DNA Sequence Number=SeqID_81941
  Gene Ontology: Mol. function=zinc ion binding; Biological process =regulation of transcription
  Homolog annotation: Hit_ID=Q0GLE1; Match level="QueryCoverage=76%, HitCoverage=39%, E-value=5e-14, Identity=64%"; Hit description=Dof11
MVKSCNFQWLPCLLQGIWVFHWFLETQNHLKNLYCVYGNGDLGDLDDGNYGGVAVSGEMMLPYDQVVMSNATAQSENQLQVGTVSQILAMGFFKEL

SEQ ID NO: 198720 - protein, 72 aa, Glycine max
  Coding DNA Sequence Number=SeqID_81942
MDHTNCESLNVECERRSKMTQMFTHPLTFFLIHHSFNGNGSKKKEDKGERAMCLSARKKDEGESSVREGPKF

SEQ ID NO: 198721 - protein, 241 aa, Glycine max
  Coding DNA Sequence Number=SeqID_81943
  Subcellular localization annotation: CTP_CleavageSite=37; ConfidenceScore=5.48e-01
MPSLFAIPGTKGVVGNGHRPMGKASSASIAGGGVRPPASVKRLSPSCYACRDRTLLGQRRGDGNVLPNDHNSDLPLPKCQLVYAILTQMSVHVAQLISDIIYQFAKIAPTRHPVDPEKFNRALGFPTLIIGLCQFYGVPVTPNKIIRPPINRAYIEKYCMPKLECCIRHVANQQATNHRGQSQDPSPYAWPTPEELEVIVAWPRDWPNFQTGAGPKGTSRDGDEAQEDDDMANVMDFFLGG

SEQ ID NO: 198722 - protein, 286 aa, Glycine max
  Coding DNA Sequence Number=SeqID_81944
  Homolog annotation: Hit_ID=Q1SDS1; Match level="QueryCoverage=62%, HitCoverage=34%, E-value=3e-16, Identity=30%"; Hit description=IMP dehydrogenase/GMP reductase
IDAFLAYHHSKESPVTAILVDLYDTFDRRCEKSDTRIVYCTPTLYVWLVSHLFRHESRPVCPMQGHYICAEKGEVNWEQLLASVVGASINWFPWWKKGGVGVLSSCKGFPNIPLMGMRGCINYNPVLAIRQLGYPMRGAPSEESIMPLIARGFSDHNARILQGVHKAWGAVQRKDKELRGSANGIIDDYHKWLKTQTQELDWIQKLKVSSEERDEILEESEEVQALKAELERAQAVKEKFKTTAIELKLWNGKQRGPKRKNTAETSFEGLYGGSNNELKLPRAERD

SEQ ID NO: 198723 - protein, 87 aa, Glycine max
  Coding DNA Sequence Number=SeqID_81945
MASYGGELLQTYLLLEVASPIIFLLLHSAVVKLQQAKYSIDEEDLRPISSTWSYITMTRSISTSDDKKLKSQEHFMTTKMMISRIKE

SEQ ID NO: 198724 - protein, 82 aa, Glycine max
  Coding DNA Sequence Number=SeqID_81946
MDYAMKSREWWSVWKGSNGVVTSNKENRKSEYDETVHYGDNPPPKDNRGTLRNSFFLPSLWESVPFHFQLLRASLFLTEQKD

SEQ ID NO: 198725 - protein, 207 aa, Glycine max
  Coding DNA Sequence Number=SeqID_81947
  Gene Ontology: Mol. function=calcium ion binding; Biological process =guanosine tetraphosphate metabolic process
  Homolog annotation: Hit_ID=Q84LE6; Match level="QueryCoverage=68%, HitCoverage=25%, E-value=2e-40, Identity=62%"; Hit description=RelA -SpoT like protein RSH4
  Pfam annotation: Domain name=efhand; Domain location=116-143; Score =17.2; E_value=0.06; Accession=PF00036.22; Description=EF hand
  Pfam annotation: Domain name=efhand; Domain location=82-110; Score =27.0; E_value=6.6e-05; Accession=PF00036.22; Description=EF hand
  Pfam module annotation: Pfam domain module=efhand::efhand; Domain location=116-143::82-110
MAVEVIENGKTRPLMEIQIRTTEMDRLAVGGIAAHSLYKAGLTDPEEAKRLKTIMLAATELTTLCLKDFLTSTNHKGIEIDQRDRAFCLLDKNGDDKISIEELTQVMEELGAPGEDAREMMQLLDSNSDDSLSYDEFHMFQEQDMNALRYDLMELKPTLFARVPRVFEKNMCFRNQESSGRTQSNEENSFWHALQLQTWLDEKRIQT

SEQ ID NO: 198726 - protein, 246 aa, Glycine max
  Coding DNA Sequence Number=SeqID_81948
  Gene Ontology: Mol. function=RNA-directed DNA polymerase activity; Cellular component=exocyst; Biological process=RNA-dependent DNA replication
  Homolog annotation: Hit_ID=Q1SYP9; Match level="QueryCoverage=87%, HitCoverage=22%, E-value=5e-41, Identity=44%"; Hit description=Myb, DNA-binding
MNEFDVKEEQMWLSEREISKFKIFSFHCEVEKKKNILRGLSIDGRWEETPREVKREVNNFFEKKISEVNFPRPSLDGASFKQISKEENQMLIVQFGEQEIKKALWECDSQCPGPDGIHFNFLKTFWETMKEDTVRFISEFLAHGMLPRGTNTSFITPVRKVEDPQNLSEFKPISLVGCMYKVLAKPLANKMKRVMNGVIDQRQSAILGDRYILHSTLVANKAIEEAKREKKKSFFSKLIMKKLMIP

SEQ ID NO: 198727 - protein, 113 aa, Glycine max
  Coding DNA Sequence Number=SeqID_81949
MSFDQDYHSLLCLQDYQVCWLVETSEVICPLYISRLSSLLACRDNKGHLLLYISKTIRACCFKTITALGSPRRARKLRAEVTSSLGRARLLLEEATSSPGRAAKQPPPLISYK

SEQ ID NO: 198728 - protein, 97 aa, Glycine max
  Coding DNA Sequence Number=SeqID_81950
  Subcellular localization annotation: CTP_CleavageSite=14; ConfidenceScore=5.26e-01
MASRPRVTALQMSRDLMTQSRSFGRILTSSGFWRTLSSGFFSSGFDDVKKNILDNFVIIKKGENVNNASFDDTEKNSLDNDCHHQKGGECEYMNTGF

SEQ ID NO: 198729 - protein, 189 aa, Glycine max
  Coding DNA Sequence Number=SeqID_81951
MAPKKLPAKRARKDAAGEGSNAAPQVDVEFDGHRRQWTQLVAPMAKYNPEIVMELYANAWPTEEGVRDKRSWVRGQWIPFDEDVINQFLGHPLVLEEGQRYEFSQRRSQASRFNEEAISQQLCVLGQDFTRSVAGRRVRIMLTSMTTLTQIWMTLQLNNILPSDHNSDLPLSKCQLVYAILTQMSVYVA

SEQ ID NO: 198730 - protein, 194 aa, Glycine max
  Coding DNA Sequence Number=SeqID_81952
  Gene Ontology: Mol. function=ribonuclease H activity; Cellular component=mitochondrion; Biological process=DNA integration
MNGGVEAANKNIKKIVQKMIVSFKDWHEMLPFALHGYQTSVRTTTRETLFSLVYGMEVVLPFEVEVPSLRILAELGLEESEWAKTRFGQLNLIEENFWCEDPEGQQRLKIKLSCGVLDESLSDYEVSRVHPHKFSEGDLVLKKVSQVQKDYRGKWTPNYEGPFFVKKDFSGGALLLASMDDEELTLLVNSNIVK

SEQ ID NO: 198731 - protein, 70 aa, Glycine max
  Coding DNA Sequence Number=SeqID_81953
MRASTGTPCTSRARTPNPFPWPTPEQFGATIAWPRDRPDFQTGAGPVGTLGDEGGAQDDDDMADVMDYFL

SEQ ID NO: 198732 - protein, 51 aa, Glycine max
  Coding DNA Sequence Number=SeqID_81954
MGFPLLAVTYLVENLSGLKVLAFYLLSLEEIPLSFASGARMRILLIGQGPK

SEQ ID NO: 198733 - protein, 177 aa, Glycine max
  Coding DNA Sequence Number=SeqID_81955
  Gene Ontology: Mol. function=RNA-directed DNA polymerase activity; Cellular component=intracellular; Biological process=RNA-dependent DNA replication
MEIVNLGVGEERKEVKDGMGMSTLIRDELVALLRDYQDIFAWSYQYMPSLSPDIMQHRLPLNLECSPFDVGFLAVARYPEWVANIVSVPKKDGKMRMCVDYWDLNRASPKDNFPLSHINVLGTFYYKVMSIGFKNDVVTYQRAMVALFRDMMHKEIEVYVDDMIAKSKIEDEHLVKL

SEQ ID NO: 198734 - protein, 85 aa, Glycine max
  Coding DNA Sequence Number=SeqID_81956
MSFTNQPMNYMFSHPLLLSPCGEHTYSNHSLLPKDSARVKLDLVKETKDQAMIKAKECKQRMAERFNTKMKLREFSKGNLVWRAM

SEQ ID NO: 198735 - protein, 330 aa, Glycine max
  Coding DNA Sequence Number=SeqID_81957
  Gene Ontology: Mol. function=protein dimerization activity; Cellular component=nucleus; Biological process=regulation of transcription, DNA-dependent
  Homolog annotation: Hit_ID=Q9LS83; Match level="QueryCoverage=89%, HitCoverage=65%, E-value=6e-41, Identity=32%"; Hit description =Similarity to Ac-like transposase
MSASTPMAGGNEDNKGSKGGKGGSTSHLRRHSESCLIRRLQLSKEKKQPIIPFQPSNPTNPFLVPGIRYSNERMREIIAIVVMVHELPFSIVEDEVWMWALQYANSEFQKISRKIVRSDCLTLYEAEKKQLKTLLKIVSNISLTTDMWKSSHQVVEYMVITGHFMDAGACSTRGIDVVDVIFKCLMAWEIEDKVFYVSIDNASYNDSCLKNLKENLSLSRKLVLNGDLFHVRCCTHILNLLVQDGLSKIKDIIQNVRESVKYINHNDSRLKAFCDVVEQKHLKERKLIIDCPTRWNSTFQMLSTTLKFKTAISAYSERDPHYTYAPSHED

SEQ ID NO: 198736 - protein, 59 aa, Glycine max
  Coding DNA Sequence Number=SeqID_81958
MQVGCLRCHGGVGVGNRRRGQYRCSQGMISWRKRGGRNKGNCTGHPGVTALSGFIVSLD

SEQ ID NO: 198737 - protein, 75 aa, Glycine max
  Coding DNA Sequence Number=SeqID_81959
  Gene Ontology: Mol. function=receptor activity
  Homolog annotation: Hit_ID=Q1SAZ3; Match level="QueryCoverage=92%, HitCoverage=8%, E-value=5e-12, Identity=57%"; Hit description =Protein kinase
MSRSFLVGFVEGLVLAVLIQAQDQSGFISIDCRSPADLNYTESTTGINYTSDANFINTGVSGTIVSELRNEALNI

SEQ ID NO: 198738 - protein, 141 aa, Glycine max
  Coding DNA Sequence Number=SeqID_81960
  Homolog annotation: Hit_ID=Q9FGL6; Match level="QueryCoverage=38%, HitCoverage=12%, E-value=5e-10, Identity=51%"; Hit description =Arabidopsis thaliana genomic DNA, chromosome 5, P1 clone:MJM18
MGEFTIQISNDLVNQLVNDMPDSAVTPGWPVQFPLFLPTTLPVQPSHSELEGIQSMLQEKNITTSLSPTNHALTTSESKFESAMRRRIMKFLNISDNDYFMVFTANRTSAYDYENEAVEAMISCSEKRGAKAHSGTCKTKR

SEQ ID NO: 198739 - protein, 234 aa, Glycine max
  Coding DNA Sequence Number=SeqID_81961
MSIREECSGKSTQVLGKAKYFSALRVTFFGNKKGVLDYKNELASSLDSDYETFSSRFSTSSLDGGNVDLSEDKEMVDESVDGVFSQKVDVEASCSDNVVKFFGMDALDFANVFQEASVTVGNAIIIGPINQSHWPRPTPNDMVSSAEKKGKKGRKGKIDCNNINKIREERMQTQFYTGSATTRAYVQYSSNPLEISTIFVKSITKSEPHRDNPSLVFRNPLQQETHSLLTNLIE

SEQ ID NO: 198740 - protein, 87 aa, Glycine max
  Coding DNA Sequence Number=SeqID_81962
  Homolog annotation: Hit_ID=Q1SS67; Match level="QueryCoverage=75%, HitCoverage=22%, E-value=2e-07, Identity=43%"; Hit description=Zinc finger, CCHC-type
MSKDHEPWVRPSMRLRSSLGLEEVLKGDFKLKKSMSEKDKKEMLEKAHSAIILSLGDKVIRQVSKEKTTTRVWSKLEGLYMIKSLVN

SEQ ID NO: 198741 - protein, 518 aa, Glycine max
  Coding DNA Sequence Number=SeqID_81963
  Gene Ontology: Biological process=regulation of GTPase activity
  Homolog annotation: Hit_ID=Q1SD19; Match level="QueryCoverage=91%, HitCoverage=64%, E-value=4e-09, Identity=22%"; Hit description=Arf GTPase activating protein
MTEKEFILVFLVQSEKEESFASKKSSSFRFEIISPHSSSGPRSDDKNLRYIYDESRSPRYTQKYARHTGLSRNPIKIEVVDDRFQDDERRNRRLSNIASKLKQISIDGQKNVDKSQLPVERPLGEILRENASSLQATHSCGKGSVEENLSEQKNNNPERSIDLSSKSQATHSAAGGRPELPHTTQSNESNWAIFGASTENNDPTTPDTNTSKPSTKKTASEAAIPAKNPVDLLLFELSGPVTPVTGGMSQAASGTNNDPTTTTVDNGTTWDFPSTSVGQTTASPNNTSVWSFTSTPATESAQPSNEVPLHTEVSYAYKTSSMQYVPSVSTVCSSTTQPINSPVKDVASNNQPSLAPSTNDSSGDFTEQSSQTTSSMQYLPPALAGCSSTAQPKNSPVKDVSSNNHPSVTPSTNNSSWGFTEISSQTTSKPTHETRSSGRLELPEDLFTSSYLSGPAPLTGWQNVQPHGMQYYNNAAPPSALPNAPKYSNPFDVTDGRSLIHVSSLVSAIKLEASDAIH

SEQ ID NO: 198742 - protein, 162 aa, Glycine max
  Coding DNA Sequence Number=SeqID_81964
  Homolog annotation: Hit_ID=Q38958; Match level="QueryCoverage=40%, HitCoverage=14%, E-value=2e-12, Identity=51%"; Hit description =Polygalacturonase-like protein
MKRSRSFSLLFYLYLLVIVFSTFSIVSVEARKTNTKKKLHKPHKGGHTRGSHSPCPILAPQGSTFDVLAFGAKGNGVSDDSEALLAAWNRACKVAGATVKIPAQLKFLMKHATLQEALRLTLLEKYTFNIGYLRHSTSVLKSMLKVLMLNVLLLTLVLKNRC

SEQ ID NO: 198743 - protein, 526 aa, Glycine max
  Coding DNA Sequence Number=SeqID_81965
  Gene Ontology: Mol. function=transporter activity; Cellular component= integral to membrane; Biological process=transport
  Homolog annotation: Hit_ID=Q6Z1Z0; Match level="QueryCoverage=83%, HitCoverage=92%, E-value=1e-133, Identity=56%"; Hit description =Putative sulfate transporter-like
  Pfam annotation: Domain name=MFS_1; Domain location=54-464; Score= -43.4; E_value=0.031; Accession=PF07690.6; Description=Major Facilitator Superfamily
  Pfam annotation: Domain name=Sulfate_transp; Domain location=140-470; Score=-116.3; E_value=0.0012; Accession=PF00916.10; Description =Sulfate transporter family
  Pfam module annotation: Pfam domain module=MFS_1::Sulfate_transp; Domain location=54-464::140-470
MAYQNPPSIPISDPEAPEITPTPTPSTNPLANGFSAKGVANKVKNNLVFHSKWGELNGAMGDLGTYIPIVLALTLARDLNLGTTLIFTGVYNIITGAIYGVPMPVQPMKSIAAQALSDTDFGVPEIMTAGILTGGVLFVLGVTGLMQLVYMLIPLCVVRGIQLAQGLSFALTAVKYVRKIQDLPKSKSLGQRHWFGLDGLVLAIVCLCFIVIVNGAGEKSRGCCDVVESGGDDDLGGQKRRNEVVERNRTRWVRKVIFSLPSAFMVFVLGVVLAFIRRHEVVHEIKFGPSTIEVVKFSKHAWKKGFVKGAIPQLPLSILNSVVAVCKLSSDLFPGKDFSPTSLSVTVGLMNLIGSWFGAMPSCHGAGGLAGQYKFGGRSGGCVALLGAAKLVLGLVLGTSLAHILKQFPVGILGVLLLFAGIELAMCARDMNTKEDSFVTLVITAVSLVGSSAALGFLCGMVVYVLLRLRNWTKDKPLSTIWMQKRPEQNDFLHGGAKRVQWWHCGASNHSNARVNKDLRLSERMD

SEQ ID NO: 198744 - protein, 101 aa, Glycine max
  Coding DNA Sequence Number=SeqID_81966
  Subcellular localization annotation: CTP_CleavageSite=37; ConfidenceScore=5.53e-01
MASFHGVPPPAVSPRTGLMHASSLGSLGTMVSQSPCYASPVPKGEYQVNNKEQPTRPQRAGSFNSELSAFGSLDPIQQSNRGLMTSKTANYFSNTRGNPFD

SEQ ID NO: 198745 - protein, 208 aa, Glycine max
  Coding DNA Sequence Number=SeqID_81967
  Homolog annotation: Hit_ID=Q8LKU0; Match level="QueryCoverage=56%, HitCoverage=43%, E-value=1e-21, Identity=41%"; Hit description =Putative expressed protein
  Pfam annotation: Domain name=DUF1639; Domain location=12-61; Score =80.7; E_value=4.6e-21; Accession=PF07797.4; Description=Protein of unknown function (DUF1639)
VKKEKRKFWIALSCEEIKEDIFVMTSPKPARRPRKQPKNVQKQMHSVFLGLWLVGITADAYRVTDTPAKAIYVFGVGIPLFNHNVGSTHTIKWSLWIIHKLLLAAAYGFILSANFSKWREKLPPRPSFHNYVAVMFVFSVITLFAYGLAEIDAGLNNWLYDLTMLCYHCVINTNAISLVDNAYYFALGILRNSAFEIDHIFINQGHTY

SEQ ID NO: 198746 - protein, 64 aa, Glycine max
  Coding DNA Sequence Number=SeqID_81968
MYSAKTPKTLGIDIVVGWNGLSSCNASNKDHVYHREEGIVIKIVGEKDLTLRYVYEEVGIIIII

SEQ ID NO: 198747 - protein, 121 aa, Glycine max
  Coding DNA Sequence Number=SeqID_81969
  Gene Ontology: Mol. function=amidophosphoribosyltransferase activity; Biological process=purine base biosynthetic process
  Homolog annotation: Hit_ID=Q26TP3; Match level="QueryCoverage=68%, HitCoverage=16%, E-value=1e-27, Identity=70%"; Hit description =Amidophosphoribosyl transferase
MCCKAIKLGNARGELELHRGGGRSRTSGSPGLQEFDYGIDTPEREKLLAATHDLEAMRKYIGADSLAFLSIPGLYRAMGEEARNAACPQYTDHCFTGDYPTGLTDLSIAGPKRFAMLAEAD

SEQ ID NO: 198748 - protein, 149 aa, Glycine max
  Coding DNA Sequence Number=SeqID_81970
  Gene Ontology: Mol. function=oxidoreductase activity; Biological process=metabolic process
  Homolog annotation: Hit_ID=Q5CDC4; Match level="QueryCoverage=28%, HitCoverage=32%, E-value=6e-16, Identity=100%"; Hit description =LacOPZ-alpha peptide from pUC9
  Pfam annotation: Domain name=adh_short; Domain location=11-148; Score= -19.0; E_value=9.9e-05; Accession=PF00106.15; Description=short chain dehydrogenase
MAESQRTLEGRVAVVTGASRGIGRAAALALAGAGAHVIAVARTVGALEELDDAIRAAGSSATLVPFDLADYDAIDRLGAAINERWKRLDILVDQAYRYRRPRGGARYQLLFPLVRVNFELGVIMVIAVSCVKLLSAHNSTQHTSRKHKV

SEQ ID NO: 198749 - protein, 333 aa, Glycine max
  Coding DNA Sequence Number=SeqID_81971
  Homolog annotation: Hit_ID=Q2L230; Match level="QueryCoverage=41%, HitCoverage=46%, E-value=5e-61, Identity=87%"; Hit description =Putative methylglyoxal synthase
  Pfam annotation: Domain name=Fer2; Domain location=10-94; Score=57.7; E_value=3.7e-14; Accession=PF00111.17; Description=2Fe-2S iron-sulfur cluster binding domain
MPKLTVLPHPDYCPEGAVIEDAPKGVSICRVLLDNHIDIEHACELSCACTTCHVVVKQGYASLEDATDDEEDLLDKAWGLTPTSRLSCQARVEDADLTIEIPKLPRRWRTPTRTSIPRRCASLSCANGCWPCPASVTTRNAAAKRSWRPSRWPGSTRPTEPSAKRSFGSVFALGARAAGYHQDSFRCPCHPSLPMPAAQLRFGLAANRLHHETPDAALFTWLRACSSTIRELGVQLHTVGRTHDAIVREGMLQGYPGLIRYPYGREGGLMKLVARVTEGRDGQEPFDGAIYLIDPVDPSSIFPEALALKRQSSRMAVRSSRRWRAPSNGWRWS

SEQ ID NO: 198750 - protein, 328 aa, Glycine max
  Coding DNA Sequence Number=SeqID_81972
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=6e-37, Identity=28%"; Hit description= UPI00006A17C9 related cluster
GLHVLSFRALHALAFRGLHVLTFKGLHALAFRGLQALAFGRLHVRAFRGLHVLAFRRLYVLIFRGLHALSFRGLHAVSLRGLHVLGFRGLHVLTFRGLHALPFRGLHTLAFSGLHILAIRGLCSLTFRGLHALSLRGLHVLGFRGLHVLGLRGLYVLAFRELYVLAFRGLHDITFRGLHVLDFRKTTRSRFQRTTHPQLLRTTCTRLQRATRRRLQRITRPDLQRTTNLAIRGLHVLTFRGLHVLSFRGLHALAFRGLHILTFRGLHVPTFRGLHILNFRGLHIHNIRGLHVLTFRGLHALTLKQLHILTFRGLHVLTFRGLHVPTFR

SEQ ID NO: 198751 - protein, 139 aa, Glycine max
  Coding DNA Sequence Number=SeqID_81973
  Gene Ontology: Mol. function=transporter activity; Cellular component= membrane; Biological process=transport
  Homolog annotation: Hit_ID=Q1AVD6; Match level="QueryCoverage=83%, HitCoverage=33%, E-value=3e-18, Identity=35%"; Hit description =Putative secreted solute-binding lipoprotein precursor
MHRIATAVCSLSLLVSGYAFAAQKVAFVPQIIGIPYFQAMEAGGKRAAHDLGVEFVYSGPVDTNPMDQLQIVQNLIAQKVNAIGISVLDASSIAPVMAQAQASNVHLFTSDSDAPDSGRPVYVAQATDEGLGDTVIDEM

SEQ ID NO: 198752 - protein, 54 aa, Glycine max
  Coding DNA Sequence Number=SeqID_81974
  Subcellular localization annotation: CTP_CleavageSite=20; ConfidenceScore=5.04e-01
MDTQQGTFIHRQQIAHSSKRFSKGQCSKFSPMELPKMKYSPILVSFFYLTEVTA

SEQ ID NO: 198753 - protein, 105 aa, Glycine max
  Coding DNA Sequence Number=SeqID_81975
  Pfam annotation: Domain name=zf-CCHC; Domain location=66-83; Score =11.0; E_value=0.015; Accession=PF00098.13; Description=Zinc knuckle
MREGTPLKGHLDKLNSILMELRNINIKIEDADLAIILLDFLPPPYENWQKKKKGKCGKKSKDDSKDIYNYCKEPDHWKRDYPKKANKDVVVALFRMTPHGEAIWF

SEQ ID NO: 198754 - protein, 129 aa, Glycine max
  Coding DNA Sequence Number=SeqID_81976
MVLLVNVMIQQAILLKFQPAPYQLDFTLYASGSYNAQWNAPGLLHDKHTLRSSRILRKMEVEEPWLGLFAAKFLFVGVFLVCAKGGLRHWNNDIVGFGGKLGRIGMAVTAWVSPSFSPSSFAPVFSVVL

SEQ ID NO: 198755 - protein, 304 aa, Glycine max
  Coding DNA Sequence Number=SeqID_81977
  Gene Ontology: Mol. function=calcium ion binding; Cellular component =integral to membrane
  Homolog annotation: Hit_ID=UPI000034EDFE; Match level="QueryCoverage =76%, HitCoverage=42%, E-value=7e-13, Identity=27%"; Hit description =calcium ion binding
  Pfam annotation: Domain name=efhand; Domain location=134-162; Score =12.8; E_value=0.52; Accession=PF00036.22; Description=EF hand
  Pfam annotation: Domain name=efhand; Domain location=95-123; Score =25.9; E_value=0.00015; Accession=PF00036.22; Description=EF hand
  Pfam module annotation: Pfam domain module=efhand::efhand; Domain location=134-162::95-123
MLKVFDRNGDQIITKEEFVTGLTEYINQSKHALDRQYLPKESLNKMYQTFIKPWIEHVRKQRELKGHLISEVLKHAQNDMVGRLRQDDGTPDKIAIKRLFEEIDVNQDNHISRSELEKVVKDIQFGKAVETEEAVTKLVQDLDLNRDDEISETEFVEGFTKWMNSNSSQAANSKSSSHEIRRTWEDVEKVIEENQTKGTSAWLTAIGYVVLGVTILALLAEPLIASVQKFSEEAGISSFFISFILVPLATNFREATSAIKEASHKKTSNTSQTMYEVSHHLHMPVSLLHYAPMSMRHRYDTVYM

SEQ ID NO: 198756 - protein, 363 aa, Glycine max
  Coding DNA Sequence Number=SeqID_81978
  Homolog annotation: Hit_ID=Q7CR66; Match level="QueryCoverage=21%, HitCoverage=60%, E-value=3e-34, Identity=91%"; Hit description =Putative HesB-like domain
  Pfam annotation: Domain name=Fe-S_biosyn; Domain location=1-90; Score= 96.0; E_value=1.1e-25; Accession=PF01521.11; Description=Iron-sulphur cluster biosynthesis
FTDAAAKKVKNLIADEENPALKLRVYITGGGCSGFQYGFTFDDQMNDGDMTIEKQGVALVVDPMSLQYLVGGSVDYTEASDAGLAAVLAAMIYHSIVTKRAVSRRNASRFSTLCVTRGCALKCRPQSTDGSVCSLGREISQREKIVSETAIEPVVVAAPIGAATISPMASSSALVMARTRPAQPVIVKRNHRHVKLRLPEARDAGGAAGITGSDNRLRVPHQHLLPAHLRPAYAAVSKDIATAAQAAAGQTAETAAPAFAADSADAVSATAGVTPARPRWPAGAVGSSAAAPPARQSSGRVIADRSIPHGCPDAAAAPPGAADCRRARPAPHPGNDARCGQQTVAQQPQPEQQISSHAPAVPA

SEQ ID NO: 198757 - protein, 65 aa, Glycine max
  Coding DNA Sequence Number=SeqID_81979
  Homolog annotation: Hit_ID=Q9LFN8; Match level="QueryCoverage=84%, HitCoverage=5%, E-value=8e-10, Identity=55%"; Hit description =Glutamate receptor 2.6 precursor
MAMVVWLFVALIITQSYTANLASMLTAERLEPTIDDIDQLRNSNIKVGYGSVTVPSFKHEALWST

SEQ ID NO: 198758 - protein, 432 aa, Glycine max
  Coding DNA Sequence Number=SeqID_81980
  Homolog annotation: Hit_ID=Q6D1Z4; Match level="QueryCoverage=46%, HitCoverage=87%, E-value=1e-81, Identity=77%"; Hit description =Mta/Sah nucleosidase (P46) [includes: 5'-methylthioadenosine nucleosidase and ...
  Homolog annotation: Hit description=S-adenosylhomocysteine nucleosidase]
  Pfam annotation: Domain name=PNP_UDP_1; Domain location=1-215; Score =272.2; E_value=1e-78; Accession=PF01048.10; Description =Phosphorylase family
  Pfam annotation: Domain name=Peripla_BP_2; Domain location=223-431; Score=59.2; E_value=1.4e-14; Accession=PF01497.9; Description =Periplasmic binding protein
  Pfam module annotation: Pfam domain module=PNP_UDP_1::Peripla_BP_2; Domain location=1-215::223-431
MEQEVTLLRDKIENRQTLTLAGCEIYTGTLNGVEVALLKSGIGKTAAALGTTLLLELCKPDLVINTGSAGGLAPTLQVGDIVVSDEVRYHDADVTAFGYEPGQMAGCPAAFVADSALIAAAEQVIKQLDLNAVRGLVVSGDAFINGAAPLERIRSTFPQAIAVEMEATAIGHVCHQFKVPFVVVRAISDVADKASHLSFEDWRVAKYLLLGLWLLCHSLLAAPRVITLSPHLTELAFAAGITPVAVSAWSDYPAAARQLEQVANWQGIRVERIVQLRPDVVLAWRGGNPLRQVEQLQRLGIHVEWIDPQSLDQMIDALAALQRWSPQPQRATAAAQALHQQLQTLRQRYQQQTPVPLFLQFGQQPLFTAARSTLQNEVITLCGGRNIFADSSVSWPQVSREQVLMRHPQAIVTGGDASRAASVARFWQPQLN

SEQ ID NO: 198759 - protein, 421 aa, Glycine max
  Coding DNA Sequence Number=SeqID_81981
  Gene Ontology: Mol. function=magnesium ion binding; Biological process=GTP metabolic process
  Homolog annotation: Hit_ID=Q6D1Z5; Match level="QueryCoverage=98%, HitCoverage=84%, E-value=1e-134, Identity=59%"; Hit description =Deoxyguanosinetriphosphate triphosphohydrolase
  Pfam annotation: Domain name=HD; Domain location=66-179; Score=21.2; E_value=0.00014; Accession=PF01966.12; Description=HD domain
MATINFRKKISFTRPYTSRKDPEGEYFITRHFESDRGRIINSAAIRRLQQKTQVFPLERNAAVRSRLTHSLEVQQTGRYITKEILHTLKTQGGGLAAYGLDGFEGAVESLVEMACLLHDVGNPPFGHFGEAAINDWFDDNLPAELVDPLVAGVADDAQRADFDRLNAMIRQDLCHFEGNAQAIRLVHTLLQLNLSYAQVACILKYTAPAWWQGDKPAEFSVLMKKPGFYLSEREYVADLRAATDIPEHHRYPLTWIMEAADDISYCIADLDDAVEKDIFTVDTLYHSLLNAWGPVKPSDAFSRTINEAWKEANQKKRRSISDQFFMSLRVNVQSVLVSHAVRRFVDNLPAIFAGSFNHALLEDDGDEGRLLKLFKTVARQQVFNHPEVEQLELQGYRVIKGLLEIYQSLMQLDYDSFPRNE

SEQ ID NO: 198760 - protein, 117 aa, Glycine max
  Coding DNA Sequence Number=SeqID_81982
  Gene Ontology: Mol. function=protein dimerization activity; Cellular component=nucleus; Biological process=regulation of transcription, DNA-dependent
  Homolog annotation: Hit_ID=Q0GPE1; Match level="QueryCoverage=50%, HitCoverage=26%, E-value=3e-23, Identity=90%"; Hit description=BZIP transcription factor bZIP57
MKTEVSALSPRVAFLDHQRLILNVDNSALKQRIAALAQDKIFKDAHQEALKKEIERLRQIYHQQNLQKMNNNNNNLQQTPPTSQPQQQPMQLHHHRQQQITVSQTLGCKDNKEQLLS

SEQ ID NO: 198761 - protein, 154 aa, Glycine max
  Coding DNA Sequence Number=SeqID_81983
  Homolog annotation: Hit_ID=Q1SLA0; Match level="QueryCoverage=36%, HitCoverage=18%, E-value=2e-07, Identity=46%"; Hit description=HMG-I and HMG-Y, DNA-binding; cAMP response element binding (CREB) protein
  Subcellular localization annotation: CTP_CleavageSite=36; ConfidenceScore=5.47e-01
MANFNPTTSTTTIVTTTTPPPPSWVDEFLDFSSARRGAHRRSASDSITFLETPFLEECRTGFDRLDEDQLISMFSDDIAVAALPPPPLSSVSNPSSPTSDQNSSEEKPIAMALDVKPKTENVEEESSSKDEEAAAPSSVTATCTEIVVDPKRVK

SEQ ID NO: 198762 - protein, 299 aa, Glycine max
  Coding DNA Sequence Number=SeqID_81984
  Gene Ontology: Mol. function=DNA binding
  Homolog annotation: Hit_ID=Q1SFS3; Match level="QueryCoverage=66%, HitCoverage=39%, E-value=2e-09, Identity=27%"; Hit description =Lambda repressor-like, DNA-binding
MHEYHIPFCLCSVNIVILCTFPHCVFCTGIAYGFCLDPTEGPCRLLKNVRWGILLPLDVVSKKGTNSPDPRIPRLHLCHMHSIMHSSIPPMRYRSFDLHQLLSHFSKHENKSNRQEVLPSQGQKPRYHQHQGIRAVDGTPPNASFPQDLRKDLRVDHSRGVHRSHCSTYPILRPALEMLHIRGTSNLVPTIEEFEEILGCPLREKKTISFLRVSPLFEQNCNCGQGFSKRFGPHKTDSERHSGPTTEVPRRQGEGYGQSRRLGPVYGCVSFANFWGRPLSKRGWFGRPSSNRRFPCLPP

SEQ ID NO: 198763 - protein, 150 aa, Glycine max
  Coding DNA Sequence Number=SeqID_81985
MQVQPKEEAIAQLLCISGQDFTRATAKRRVRIMHTNMITLTQIWMTLLLSNISSSDRNTDLPLRKYQGRAHKTPSGPREVQQGPGVFSSGYGPLGRVHKTPSGPKEVQQGLGASGSDYGPLSVLRSARHPQQGHQAPINRGFIEKYCAPR

SEQ ID NO: 198764 - protein, 302 aa, Glycine max
  Coding DNA Sequence Number=SeqID_81986
  Gene Ontology: Mol. function=exonuclease activity; Cellular component= intracellular; Biological process=regulation of transcription, DNA -dependent
  Homolog annotation: Hit_ID=Q8LAA0; Match level="QueryCoverage=74%, HitCoverage=78%, E-value=2e-87, Identity=71%"; Hit description =Exonuclease, putative
  Pfam annotation: Domain name=Exonuc_X-T; Domain location=102-259; Score=80.0; E_value=7.7e-21; Accession=PF00929.14; Description =Exonuclease
  Subcellular localization annotation: CTP_CleavageSite=51; ConfidenceScore=5.59e-01
MKKPKQTLLSPNWVQLQQVPFLSSFFFLVFQNSCFYINLLVFVTVQKLKLNGSKASRTFKTSDEDTPESILGKRKERPDDESNDCQINPLVPVNDDSSLTDAVAMDCEMVGVGQGNKSALGRVTLVNKWGNVIYDEFVRPIERVVDFRTKISGIRPRDLRKAKDFWAAQKKVAELINGRILVGHALSNDLKALLLSHPRKDIRDTSEYQPFLKSSSRRALRHLAAKHLGVNIQTGEHCPKSKISILFQIEDARAAMLLYQRNKKEWEKSIKDQFRLKQKQRKSKQKKKLKNEHTSNGNHVEI

SEQ ID NO: 198765 - protein, 351 aa, Glycine max
  Coding DNA Sequence Number=SeqID_81987
  Gene Ontology: Mol. function=oxidoreductase activity; Cellular component=mitochondrion; Biological process=visual perception
  Homolog annotation: Hit_ID=Q84N44; Match level="QueryCoverage=78%, HitCoverage=75%, E-value=1e-105, Identity=67%"; Hit description =Oxidoreductase
  Pfam annotation: Domain name=ADH_N; Domain location=56-143; Score =47.0; E_value=6.4e-11; Accession=PF08240.2; Description=Alcohol dehydrogenase GroES-like domain
  Pfam annotation: Domain name=ADH_zinc_N; Domain location=174-318; Score=63.5; E_value=6.9e-16; Accession=PF00107.16; Description=Zinc -binding dehydrogenase
  Pfam module annotation: Pfam domain module=ADH_N::ADH_zinc_N; Domain location=56-143::174-318
MRIPSNCEFTRITPSAFSYHRLKSYVSDCRAVLLPSFGGPHVLQLRSHVPVPPLKPHDVLVRARAVSVNPLDTRMRAGYGRSIFEPLLPLILGRDVSGEVSAVGDKVRSVSVGEQVFGALHPTAVRGTYSDYAILSEEEVTPKPDSLTHVEASAIPFAALTAWRALKSTARISEGQRILVVGGGGAVGLSAVQLAVAAGCSVATTCGSQSVDRLLAAGADQAVDYVAEVDVELAIKGKFDAVLDTIGVPETERMGINFLKRGGHYMTLQGEAASLSDRYGLTIGLPAATAVLLKKQLLYRFSHGIGRNFQTITCYFSFDTFKYATYFLCKFYLLFDIDRTGIITVRNNGFC

SEQ ID NO: 198766 - protein, 715 aa, Glycine max
  Coding DNA Sequence Number=SeqID_81988
  Homolog annotation: Hit_ID=Q9LIM5; Match level="QueryCoverage=86%, HitCoverage=84%, E-value=5e-31, Identity=43%"; Hit description =Arabidopsis thaliana genomic DNA, chromosome 3, BAC clone:F4B12
  Subcellular localization annotation: CTP_CleavageSite=70; ConfidenceScore=5.75e-01
MESDRERPHRSTSSSSSTSELFVCFTSRLSSSSMKLSSKSILSPSRSRDPPQISLSSSLSRRLRSNGSIKGGGGGGQASPMFPTGGGGKRRGGCGFENPEPSSPKVTCIGQVRVKTKKQGKKMRARSKRRGEASFRKGEQHQQQQVGANANASATNLNLNLNPDLTRQSSQGFQHHQNCLKHRNNQRWVHLPLTICEALREFNCFFPCRSSCMSSEKEKEKGGGGGVEGGGHGMMREGSCGNTNNAVGRWLVALQDGDGKGRGIELVMEEEMEVSGRERSNSQRRHVFEDIDVDLVVGEEEQKKHEEVVGGEEEEKARVSICIPPKNALLLMRCRSDPVKMAALANRFWESPVHKDRCQEEQDEEEQNIKTKEDEQLEEVQEEQVEREAIEDSICERETETAVVATEDEEQEGKESYEIESREILESKEFGEVKEEEEKGDEEEAANGGNAVGKGETLTHPEAHSDLENLRTEEKEVDLQEGKEEERENNESSELSSTSETVAASDQENDGAEPETDTNSDPEEEEEKESEPKEQPQQPDTNSDPESKERENGSKCQEREREGLPECLLLMMCEPKLSMEVSKETWVCSTDFIRWLPERPAAGGGSKRVAGETFTKSKPKPKPPQPMMQLPRSSCSLPAAGGSAGVSMAAMIEQKLVGSKSGNGYEPFVLTRCKSEPMRSSAKLAPEACFWNNRKLEPHPPAAQLGVGAPAGVGF

SEQ ID NO: 198767 - protein, 1433 aa, Glycine max
  Coding DNA Sequence Number=SeqID_81989
  Gene Ontology: Mol. function=nucleoside-triphosphatase activity; Cellular component=protein complex
  Homolog annotation: Hit_ID=Q9LIM2; Match level="QueryCoverage=98%, HitCoverage=71%, E-value=0.0, Identity=47%"; Hit description =Similarity to 26S proteasome subunit 4
  Pfam annotation: Domain name=AAA; Domain location=218-408; Score =258.7; E_value=1.2e-74; Accession=PF00004.19; Description=ATPase family associated with various cellular activities (AAA)
  Pfam annotation: Domain name=AAA_3; Domain location=218-363; Score= -20.4; E_value=0.055; Accession=PF07726.2; Description=ATPase family associated with various
  Pfam annotation: Domain name=AAA_5; Domain location=218-354; Score= -5.9; E_value=0.005; Accession=PF07728.4; Description=ATPase family associated with various
  Pfam module annotation: Pfam domain module=AAA::AAA_3::AAA_5; Domain location=218-408::218-363::218-354
MDIRQPLAFTVLDLGCRLNTRYKVYFANFGCLKNVRAALFRGRALKCTRCGRRGATTGCRVDRCPRTYHLPCARASGCIFDHRKFLIACTDHRHLFQPCGNKYLSWIKKLKARKMMWEIRKRSNEACRKDIGDEERWLENCGEDEEFLKRENKRLHRDLLRIAPVYIGGSESASENSFQGWESVAGLKDVICCMKEVVILPLLYPELFDNLGLTPPRGVLLHGHPGTGKTLVVRALIGACSRGDKRVAYFARKGADCLGKYVGDAERQLRLLFQVAEKCQPSIIFFDEIDGLAPCRTRQQDQTHSSVVSTLLALMDGLKSRGSVVVIGATNCPESVDPALRRPGRFDREIYFPLPSIEDRASILSLHTQKWPKPITGSLLEWIARKTSGFAGADLQALCTQAAMNALKRNFPLQEVLSLAAEEKHSGSKHIPLPSFAVEERDWLEAYFSSPLPCSRRDAGNAANDVVCYPLPIQLIPCLLQPLCTLLVSLYLDERLWLPLPISKAATVIKDVMISALDKKQKPSDHWWLHMDDFLQETNIVYELKRNLTCSGILSANDGIAGSFDTVDDANNNSLKFESSTRNHLGMHSGLCALTNKSGFRILISGNSRSGQRHLASSLLHCFIGNIEVQKIDMATILQEGHGVVVQGIGQILMKCASRQSCIVFLPRIDLWAVEKHFQIAERIDSCLTMGKSCFTPNEVVQKENDISNEKNSTEMTKGQANTKASYAWMSFIEQVESIDVSTSLMILATSEVPYTELPCKVREFFKSYQSKDGRSTPLEQTIPRFSVQIDENFDHDMVINLSALELLRIVVEQLVQLIHQRSHVHMGSQKGRSYKSIEVSKDKEVCQRKEDGPANDKREIQLESFTKVPPTPNSKSMKGKSILLLAISTFGYQILLYPHFTELCWVTSKLDEGPCTDVSGPWRGWPFNSCIIRPNNSHDQVAVSCSSGGTKSREASGLVRGLIAVGLSAYRGVYKSVREVSLDVRKVLEILIEKINTRIQAGKDRYQYFRILSQVAYLEDMVNNWAYSLLSNSFHFSLEQDSPEHKIKAIPASGGPLNSHLTHENHQTEGEDCHLVVPVDGNDLETLEGSQKEIPAETTGCLASDDKNDNADIFDCDDGNASSEGHLQNHSFSDKNINNSIAASQPLYPSTSQENGILFGQSEFVTAGNNEEMDGELGISKGLNKSTCTQSVVPSENGLHTACEPKKHDVEIGNIRSDQPLSLPSVETGAKSSDVKSDKQENAPDSNVSSSNGCGPAESGVICLYQCCPACLHSLHHLTKKILVEKWGLNSDKWTAEDVHDAVASLSVDLISAVRKCFMPEDFIDSSNKTSRNEKRGTSLDCLKLSTCNNGNQRKDVVPAECVSHSASQHATAMEGMVLNEESSKHDLKFVFRDGVLVHLDPDKDVSVHCKFENLCLCSLRELIVMKKRPFD

SEQ ID NO: 198768 - protein, 512 aa, Glycine max
  Coding DNA Sequence Number=SeqID_81990
  Homolog annotation: Hit_ID=Q9LIM3; Match level="QueryCoverage=60%, HitCoverage=95%, E-value=6e-20, Identity=29%"; Hit description =Arabidopsis thaliana genomic DNA, chromosome 3, BAC clone:F4B12
MEPIGNSCESSFYKDEKVEAADLLLEECWFFDNLLKIAPRMTRCHSDPYPSSTGLISPPDFLVKDSNSSSPSKPPNNGAIVHSKKIQRAPSMPPLRLREEDHKGSCSVRSKLVHQPTDPVVSHAASEPHCAQMKGHHNSDCNRRKSKLLRTPSLPPSIGREEKFQVNDTRTGRSHKQPSTPTHIDILPPRQTSKSCSIPRCRPARKTEVESFNKEGIMEMRRRFLNQKTMRRSLSDLEFEEVQGFKDLGFSFEKEALSPSLASILPGLQEKKRDETEEDKAARRPYLSEAWLVQSCAPPIPNWASHKSSGDMKEQIKFWARAVASNCHHHLLFPLTLAHHKVKPPLSILPPLHHKPTILHSVSASAIPPWAAQLADAAADIDTEGPVELPFSSTPSIFATSDDPSPIQVASSVLLTGAVSVFLFRSLRRRAQRVKQSQFRSSGEKSIKEEALDSLKAMGSASVKAKEDSASPVQALLGGISAGVIALILYKFATTIEAALNRQTISDNFSVG

SEQ ID NO: 198769 - protein, 103 aa, Glycine max
  Coding DNA Sequence Number=SeqID_81991
  Subcellular localization annotation: CTP_CleavageSite=50; ConfidenceScore=5.10e-01
MKNAQKLKKKNEKLFWHSQKLANGHSPIGFSVLLGVRMCSESEEKRRRCSAAPVGPRRERNRNPRNRIGDASSSIGFLVRLKGVFHFFSEDWVSGFRGFGVLP

SEQ ID NO: 198770 - protein, 85 aa, Glycine max
  Coding DNA Sequence Number=SeqID_81992
MKNGEESPRNRLRKRLESVTKAPRDAILPRKGPVTRAMSKRLQEDWARATEESPRVLMNLRGSILYVGYPRNIGFFNPCILGHLD

SEQ ID NO: 198771 - protein, 576 aa, Glycine max
  Coding DNA Sequence Number=SeqID_81993
  Homolog annotation: Hit_ID=Q9FN33; Match level="QueryCoverage=64%, HitCoverage=65%, E-value=9e-20, Identity=28%"; Hit description =Arabidopsis thaliana genomic DNA, chromosome 5, TAC clone:K19P17
  Subcellular localization annotation: CTP_CleavageSite=57; ConfidenceScore=5.72e-01
MGKSSSSLKKKRSKKLSKAKASSKSKRSRKSKSKKVRRRKVSPSSSDYDDSKSLDTLASSSSEDSYRRKRDRSRTRKDVKGLRRKARGRSYSSDSSEDSHYARKRKKAKRKNERDEVMKKSSQKKKIKREASVDLMSSRSWSCSTCQDGSASSDDSQCKSRRGRSERKEKDRRRSRGRIGSKKSSRYRARSCSPCSIENSYEVTEEKSVGENNSRRLRSVITVTKEAEEYGELYRNETKEEIVYDHDYPCRSNDSNDGGTKTELDHHTLASEEKLGIEDEAGDMNADLNFTEPELRDRSYNDSSNLKVCSGRTIESMKETSETSGAIVNDDLESILRQRALENLRKFREIQSSAKAPDQKNKIDSLVKQPITNKHELVQGKPVVNDAAAGTKIDKRTLGEETNLPDGRRNLIACPRNNERISNMDKDVSAKCHPAGAPEKVIDSDNPSGTITESSNYNTTNLELTKQAQNSCCDSLQTHASNEAANANLPVTEVDVERNAAKTSHAAIQSVNSNDRNVNVSSEENKSGKLQDESNQGSQFEKKTMNVMRGGEMVQVSYKVYIPNKVPALARRQLKR

SEQ ID NO: 198772 - protein, 131 aa, Glycine max
  Coding DNA Sequence Number=SeqID_81994
  Homolog annotation: Hit_ID=Q8RW43; Match level="QueryCoverage=63%, HitCoverage=20%, E-value=1e-25, Identity=70%"; Hit description=TCP1 protein
  Pfam annotation: Domain name=TCP; Domain location=64-131; Score=17.9; E_value=1.3e-09; Accession=PF03634.4; Description=TCP family transcription factor
  Subcellular localization annotation: CTP_CleavageSite=76; ConfidenceScore=5.16e-01
MASIKSKQQVLRGKKTKQEQDKTVSEPGSSSAPAPHKNNNNNNNNNGRTATETGFRGASGGGGGEIVEVEGGHIVRSTGRKDRHSKVCTAKGPRDRRVRLSAHTAIQFYDVQDRLGYDRPSKAVDWLINKA

SEQ ID NO: 198773 - protein, 414 aa, Glycine max
  Coding DNA Sequence Number=SeqID_81995
  Gene Ontology: Biological process=regulation of transcription
  Homolog annotation: Hit_ID=Q8RW43; Match level="QueryCoverage=85%, HitCoverage=90%, E-value=9e-58, Identity=41%"; Hit description=TCP1 protein
  Pfam annotation: Domain name=TCP; Domain location=47-233; Score =141.7; E_value=2e-39; Accession=PF03634.4; Description=TCP family transcription factor
MAASLKRKNNNIKCLSLDPQRKRAFAATVEHAGTTSSSQGMVRGSGGEIVQVEGGHIVRSTGRKDRHSKVCTAKGPRDRRVRLSAHTAIQFYDVQDRLGYDRPSKAVDWLINKAKSAIDQLAHLPPWKPTLPAPQNDDESDKLNPNPNPIPIHHPDAEILHQFNENDTENLRCDGGGGSSYLPMDNDAIRSFFPTTTSSLVHFQSYPPDLLSRTSSQDLRLSLQSLQDPVLLHQNHHNNEHVLFAGTGFENMVAWNSSSNNNNNTASNDTCGGGGGGGGGGGGGGFVFNAPSTLTGPATVASPAVVFGHGLGQGQYFTQRGPLQSSNSPSVRAWIDAPSFVAAAADHRHHHHHYLSPAAAAAALVYQSAPSTAAFAAAPGGFSGFRVPAQIQGEEEHDGGVSDKPSSASSDSHR

SEQ ID NO: 198774 - protein, 251 aa, Glycine max
  Coding DNA Sequence Number=SeqID_81996
MLNVHPKFGVKRCREERYKGISKKKKEGESERCNWMVKEVRDRKKNEVEKVEEKVAICSVEQSHHSHVWSQQIQSDFELMIGMKRQTPYSFSPDFPHAPAFNCISSPFAEIRTNAKTLCGNGTGFKFDAGNSTSREVSSSLASYSEPNSKKRREENENFNGDFLTLAPPSPTSYPPSKSKLSSTYLAFHNQGNVEDQIPAPPPVFRLFNQQKQPFYGFFLPEPKEEQIGQTTARIQNGHEVGESVDLNLKL

SEQ ID NO: 198775 - protein, 183 aa, Glycine max
  Coding DNA Sequence Number=SeqID_81997
  Gene Ontology: Mol. function=calcium ion binding; Cellular component =integral to membrane
  Homolog annotation: Hit_ID=Q8W543; Match level="QueryCoverage=48%, HitCoverage=61%, E-value=5e-12, Identity=43%"; Hit description =Drought-induced protein RDI
MFKRTPCKGSSPRINGTPNVSAIRSSWHWCEAFIVTTLCRQLYREIDQDGSSGISASEVKVLLLKNKSSKEVAQSQVSVGMGLLAGSTTLLQTIIWGTCVIVGKCDIEGSIAIDSRDTRGFSLTGSGVSTDIWTSYAARIMVISVLPFVIVQLPQILNSTSGRHLAVLIALIVSLGLLIACCL

SEQ ID NO: 198776 - protein, 56 aa, Glycine max
  Coding DNA Sequence Number=SeqID_81998
MGSSLAMRCSSQFDVCICGSCEGGVKGDEGWFCWLKEAVVVVVDMRVVETMVVIEE

SEQ ID NO: 198777 - protein, 173 aa, Glycine max
  Coding DNA Sequence Number=SeqID_81999
MKVPPDNINSNWHIEHHQLKSGIRDPDIYIPTCAKCWQVTSDSHIIALRQCHMIPREIHDNRGIKKTRRFGDLHCDEVLWGERLNTRREIHGSNARKRERKNPFAKDSLGATKVEACQPWCPGVTIPYSTVSSPCYDVISYRKQGLGEFLFGEVVLGDIFFPPACPRDDHHFG

SEQ ID NO: 198778 - protein, 278 aa, Glycine max
  Coding DNA Sequence Number=SeqID_82000
  Gene Ontology: Mol. function=zinc ion binding; Cellular component =nuclear chromosome; Biological process=lipid transport
  Homolog annotation: Hit_ID=O65462; Match level="QueryCoverage=72%, HitCoverage=100%, E-value=1e-100, Identity=83%"; Hit description =Receptor like protein
  Pfam annotation: Domain name=BAH; Domain location=66-181; Score =150.2; E_value=5.6e-42; Accession=PF01426.8; Description=BAH domain
  Pfam annotation: Domain name=PHD; Domain location=185-234; Score =60.6; E_value=5e-15; Accession=PF00628.19; Description=PHD-finger
  Pfam module annotation: Pfam domain module=BAH::PHD; Domain location =66-181::185-234
  Subcellular localization annotation: CTP_CleavageSite=46; ConfidenceScore=5.13e-01
MAIGAILAQKNSTVLAIAQAPAPRISNSPPKPFCWKQSIRETLHNMAKTRPGRKDVDSYTIRGTNKIVRAGDCVLMRPSDTSKPPYVARVEKIEQDNRNNVKVRVRWYYRPEESIGGRRQFHGAKELFLSDHYDVQSAHTIEGKCVVHSFKNYTKLENVGAEDYYCRFEYKAATGAFTPDRVAVYCKCEMPYNPDDLMVQCEGCKDWYHPACVGMTIEEAKKLDHFVCSECSSDDDMKKPQATFPVSPGSDGKVRLPASSPEQFELRCTFTYVPFQFP

SEQ ID NO: 198779 - protein, 234 aa, Glycine max
  Coding DNA Sequence Number=SeqID_82001
  Gene Ontology: Mol. function=calcium ion binding; Cellular component =integral to membrane
  Homolog annotation: Hit_ID=Q8W543; Match level="QueryCoverage=37%, HitCoverage=64%, E-value=2e-37, Identity=86%"; Hit description =Drought-induced protein RDI
MSNASACFFFFAFVVLVALHNAECRSLRPSVSDGVDAVQLPQESSYLQLKDQSVVVESSSDEHFCKQMYGFLPCSNNILGHLFLILVYEYLLFHGESYLAAGGEQIFKILGPGVFGASAFDILGALPESLILVVTGLSSDKESAQEYASTGVGLLAGSSIMLLTVVWGTCVFIGRQKLKNDSNYGGTNSSSGGIKESLTATRVESNERVSFPHRGEPRLQSCVSNKITSDGGYL

SEQ ID NO: 198780 - protein, 96 aa, Glycine max
  Coding DNA Sequence Number=SeqID_82002
MTDPLLGFPNALSELSASLSECEELWSLVHNHLHKELTSWSKEDINVLGGIERFEELKHSLFVDGLSMVTIDKWMNITDTGYVIASRYNMIVVSLS

SEQ ID NO: 198781 - protein, 39 aa, Glycine max
  Coding DNA Sequence Number=SeqID_82003
MAILIANTSTTFHRDERLGNTFMIPTWLAHGENARIMHE

SEQ ID NO: 198782 - protein, 113 aa, Glycine max
  Coding DNA Sequence Number=SeqID_82004
MEAMKEKMARMMKAMISMKKIMEANAVAISATSVVAKVNPMPLCGLDQMNNPTSDMVGKDLGSTGGPHYAQIKNKHAFPPYGLPPNYTPPNVVYTPSENVNNSTPILIESRQP

SEQ ID NO: 198783 - protein, 220 aa, Glycine max
  Coding DNA Sequence Number=SeqID_82005
  Gene Ontology: Mol. function=transferase activity
  Homolog annotation: Hit_ID=Q1SPZ1; Match level="QueryCoverage=94%, HitCoverage=71%, E-value=8e-52, Identity=51%"; Hit description =Ankyrin
  Pfam annotation: Domain name=Ank; Domain location=154-187; Score=1.9; E_value=17; Accession=PF00023.20; Description=Ankyrin repeat
  Pfam annotation: Domain name=Ank; Domain location=37-69; Score=4.6; E_ value=6.7; Accession=PF00023.20; Description=Ankyrin repeat
  Pfam annotation: Domain name=Ank; Domain location=77-113; Score=21.5; E_value=0.003; Accession=PF00023.20; Description=Ankyrin repeat
  Pfam module annotation: Pfam domain module=Ank::Ank::Ank; Domain location=154-187::37-69::77-113
MSSEDKFRGLTVEGKWEEVIKMCEEDIKLCTIKINNKRGTALHVAVNEGNEDAVKCLVGTMIKHKRGEKALTLKNERGDTPLHLAATRGLKNICECIIGKNKERKGLITFLNDEGETPFFQVALSWQKEAFWYLCSLVPADENVNYSKFLIRNNGDSILHCAIRREFFDLALIIMYKYPKLYDIQNREGFSPLKLLATRPSAFKSGSNLLWWKRILYHCK

SEQ ID NO: 198784 - protein, 560 aa, Glycine max
  Coding DNA Sequence Number=SeqID_82006
  Gene Ontology: Mol. function=transferase activity
  Homolog annotation: Hit_ID=Q1SPY9; Match level="QueryCoverage=89%, HitCoverage=64%, E-value=1e-120, Identity=47%"; Hit description =Ankyrin
MTHHLYYFLPEGVSVETLDVQEAEKLYMKAEVQEYQNEQCMVIKEEKDELCPNTKEKMDELQLPENYNTCHHFYHLFKDLCRLTNTFFRSLQLLGKELGILFKDLCRLISTCASGHKREKQEDPEKHQQCQISMAEDLGHEHVPPNLVSCLQSVKLAYIYTLGLSGVGVENIRKMKQKHKWSGQLLSEFMKKPYESYTGSGGPPLLDSSVQTDFIYAYNTENIDKEEIMALNIDREETAILVAARNGIIEMVNELISKIPSAIHETNSKKKNVLLIAVENRQTLIVEELKNRFGEKKTKVVLHNLILGVDDQENTMLHLAAAPIDKGWMISGSALQMMWHIKWFQTLVHPFNSTMEQYIKELVPEHFTIRTNKKEKTAGEIFRESHKGLVKEASGWLKDTSESCSVVAALLAGVSFATSTTVPGGVNTDTGKPALEGQVPFESFAMCSLIGLCFSVTALIMFLSILTSRKEIRDFRTNLPLKLLMGLSSLFISIAALFATFCSAHFFVIDDKFKQVLILIYTVTCLPVTFYAVAQFPLYIDLMRAITTKVPLASDKGDDL

SEQ ID NO: 198785 - protein, 79 aa, Glycine max
  Coding DNA Sequence Number=SeqID_82007
  Subcellular localization annotation: CTP_CleavageSite=70; ConfidenceScore=5.50e-01
MASASCTPRPAISKLASQSYGFSSSGEVASASGEMPFHVKSPAPLAVWPSTCRMAAKLLLPMAGSKIPAQSQKVASPES

SEQ ID NO: 198786 - protein, 445 aa, Glycine max
  Coding DNA Sequence Number=SeqID_82008
  Gene Ontology: Mol. function=zinc ion binding; Cellular component =intracellular; Biological process=response to DNA damage stimulus
  Homolog annotation: Hit_ID=Q94EV8; Match level="QueryCoverage=91%, HitCoverage=99%, E-value=1e-83, Identity=43%"; Hit description =Hypothetical protein hypro4
  Pfam annotation: Domain name=WLM; Domain location=43-240; Score =310.7; E_value=2.6e-90; Accession=PF08325.1; Description=WLM domain
  Pfam annotation: Domain name=zf-RanBP; Domain location=368-397; Score= 24.2; E_value=0.00046; Accession=PF00641.9; Description=Zn-finger in Ran binding protein and others
  Pfam annotation: Domain name=zf-RanBP; Domain location=402-431; Score= 10.0; E_value=0.063; Accession=PF00641.9; Description=Zn-finger in Ran binding protein and others
  Pfam module annotation: Pfam domain module=WLM::zf-RanBP::zf-RanBP; Domain location=43-240::368-397::402-431
MKGLNFLQLKHDIISHTVPMIDYCKLRKFGISGFWTMNVGDLNKVWEIRALKRKPAAEEATKMLEKIAKQVQPIMRKHKWRIKLLSEMCPSNPRLLGLNVGAGIHVKLRLRRPNRDLDFYPFDQVLDTMLHELCHNAHGPHNANFYKLWDELRKECEELMAKGISGAGEGFDLPGRRLGGYSRQPPLSSLRKTALEAAEKRVQLGSLLPSGPKRLGGDSVIMRALSPVQAAAMAAERRLQDDVWCGSQSCENLDHEDVDYEVAENIVHKGENVGSSRQTDNSTLPSNLLSRKRSQDTNSSLPAKSSSSTSEFVDLTMDTPKSRPDKEHQTGPKRRCGGSESFSHSQSNYQAGSSSANLSSVSGRHSEESGMWECTMCTLLNKRLAPICELCGTQQPKDFSTKCNTWSCKFCTLENNVKLEKCSACDQWRYSHGPSVSIRAPNLGT

SEQ ID NO: 198787 - protein, 250 aa, Glycine max
  Coding DNA Sequence Number=SeqID_82009
  Homolog annotation: Hit_ID=Q9LYF5; Match level="QueryCoverage=36%, HitCoverage=40%, E-value=2e-36, Identity=84%"; Hit description =Ribosomal protein L19
  Pfam annotation: Domain name=Ribosomal_L19; Domain location=177-250; Score=-13.9; E_value=3.1e-06; Accession=PF01245.10; Description =Ribosomal protein L19
MESRAQAQAINPNTGLFPFSLALFRCVLGYGFSQALIISAPTIPPSISAGISSSDPFPAILCPKLFHSRFSDRRKHPLHSFPYTFFALDFDLITKLPGTEVFSQFESGNGLASVLRSSGMGLYQPAGGLVPPFASRFMSTEATSVDSSSQDSSMLEPEVPPRIKFKRLDKTARHIMQAYKEAVEEVRGQREIPDIKPGYIVQLKVEVPENKRRVSIIKGIVIARRNAGLNTTFRIRRQVAGVGIESLFPL

SEQ ID NO: 198788 - protein, 55 aa, Glycine max
  Coding DNA Sequence Number=SeqID_82010
MYKDHPIRFDTKITAEGDSNGDCNFGQVTVATNGTIDDSLKRTREPDTYRSERKL

SEQ ID NO: 198789 - protein, 85 aa, Glycine max
  Coding DNA Sequence Number=SeqID_82011
MEEGYATNKPPMFKGVKRNKLRLLTHEYVSQRALRGRARARLTGALSKGGKMRGVATNVYLWKTSEKSKETGQNENSKFGSYIYA

SEQ ID NO: 198790 - protein, 113 aa, Glycine max
  Coding DNA Sequence Number=SeqID_82012
MGNTCSIELYKWLSVEFPEEFALIYPKDKSKYSIFHLSINLERVLLRLANALCDDYLVQLLHMEVTGESDNNGSFNLGLVRVVADGITPEQTVRDTEHFDHLCGTKSCLYAVM

SEQ ID NO: 198791 - protein, 205 aa, Glycine max
  Coding DNA Sequence Number=SeqID_82013
AEFTKECAFIYTSITDTDKRSIFRLSLNPEKRMLLRFAHSFCDAHPVRSLHMEATAERDSNGCFNFGVVRVVADGFTSEQTLRDTEHFAHLCGTKSCCCGVVRKGGNVNVGSEEKMTTWEVLLSIKVSLTTHIRYYVNVECDKVRGLRAKFRGPFKCKGQVLREGLPKQSEGSSLIRREVDGKPPKACCAFVESEFTGQQQGEGK

SEQ ID NO: 198792 - protein, 261 aa, Glycine max
  Coding DNA Sequence Number=SeqID_82014
MGNIPSTKPMIEVYNWSSAEFTKECAFIYTSITDTDKRSIFRLSLNPEKRMLLRFAHSFCDAHPVRSLHMEATAERDSNGCFNFGVVRVVADGFTSEQTLRDTEHFAHLCGTKSCFYGVVRKGGNVNVGSEEKMTSTWEVLHSINVSVTTHIRFYVNVECDKVRGLRANFRGPFKCKGQVLREGLPKQSEGSSLIRREVEGKPRKACCAFVESKFTGQEYILFQQQGEGKGTRVNIVNTGGLFHGHGNGATYENCNILMKT

SEQ ID NO: 198793 - protein, 414 aa, Glycine max
  Coding DNA Sequence Number=SeqID_82015
  Gene Ontology: Cellular component=membrane
  Homolog annotation: Hit_ID=Q6ZGZ0; Match level="QueryCoverage=83%, HitCoverage=88%, E-value=2e-93, Identity=52%"; Hit description =Putative purine permease
  Pfam annotation: Domain name=TPT; Domain location=236-385; Score =172.9; E_value=8e-49; Accession=PF03151.7; Description=Triose -phosphate Transporter family
  Pfam annotation: Domain name=TatC; Domain location=138-334; Score= -81.9; E_value=0.052; Accession=PF00902.8; Description=Sec -independent protein translocase protein (TatC)
  Pfam annotation: Domain name=UAA; Domain location=67-391; Score= -152.8; E_value=0.0089; Accession=PF08449.2; Description=UAA transporter family
  Pfam module annotation: Pfam domain module=TPT::TatC::UAA; Domain location=236-385::138-334::67-391
MGETKEVQLSPETCFTIHMGEPQEVQLTKIEANGAKEENSLEDNSFGGPMNESTMSKKKRYYRWLRISIHSSLVLVCGSAAILLGRLYYEKGGKSKWMGTLVQLAGFPIQLPFHFISAPKNLTTNSSIHPKQSSASILAFIYVSIGLLLALDCYLYSVGLWYLPVSTYSLICSSQLAFNAFFSYFLNSLKFTPYIINSLVLLTISATLLVFQNESSSSDDDDSDSTQVSKKKYVIGFICTVGASAGYGLWLSLTQLVFKKVIKRETFKVVLDMILYTSLVATLATLVGLFASGEWSGLKNEMKEYELGKASYLLNLTFTAILWQVFTIGCLGLIREVSSLFSNAISALGVPIVPMLAVVFFHDKMDGIKGISMVLAIWGIISYVYQQYLDDTKSENRNTSHVPKASSPIEEVHR

SEQ ID NO: 198794 - protein, 211 aa, Glycine max
  Coding DNA Sequence Number=SeqID_82016
  Gene Ontology: Mol. function=histone-lysine N-methyltransferase activity; Cellular component=nucleus; Biological process=chromatin modification
  Homolog annotation: Hit_ID=Q4VPE7; Match level="QueryCoverage=75%, HitCoverage=96%, E-value=2e-53, Identity=69%"; Hit description =Lateral organ boundaries-like 4
  Pfam annotation: Domain name=DUF260; Domain location=18-119; Score =239.9; E_value=5.3e-69; Accession=PF03195.5; Description=Protein of unknown function DUF260
MDCGGNKNTGGSERGDGPCGACKFLRRKCVKGCIFAPYFDSDQGTAHFAAVHKVFGASNASKLLMRIPAHKRLDAVVTLCYEALSRARDPVYGCVGHLFALQQQVMNLQAELTYVQAHLATMQRLPVKVAPLPPHPQSSSPPPTLHSSDHMAPNADLQSAPMMHFGPLQPHSASLPLGSIVFDQSNRQLDDRELRVLAREFVSKYLPGVRF

SEQ ID NO: 198795 - protein, 116 aa, Glycine max
  Coding DNA Sequence Number=SeqID_82017
MPKQQSSKLGELDMPHKPTTPTLVEVGSLSFNEGISHGRRSFATKNVPWIRSLERMIQWRKRERERERGEHKIEEGKGGEKLNIELCLTRLSFIKVTTSVTHASIYRLGSLLEKLS

SEQ ID NO: 198796 - protein, 92 aa, Glycine max
  Coding DNA Sequence Number=SeqID_82018
MRDGFRFVAQFNLKCGTPFTQLKNNDVYTHPRKTWENSHTLRDVLWAYGIKNHHSSIQFKRDCQDMRGQDEINNWAVLLMIDWVVSPQWHKS

SEQ ID NO: 198797 - protein, 51 aa, Glycine max
  Coding DNA Sequence Number=SeqID_82019
MEACCCNLEVDVNGEETFMVDKDLITILKHTIDTMLNITVTKFWLNAASYS

SEQ ID NO: 198798 - protein, 534 aa, Glycine max
  Coding DNA Sequence Number=SeqID_82020
  Gene Ontology: Mol. function=RNA-directed DNA polymerase activity; Cellular component=intracellular; Biological process=RNA-dependent DNA replication
MAQATTSARIGTRPTNQSQSRKCHLHAIWDININFFNTPLQRSLPPITFTDRDFKGINPINQDGRMVVSIIIANFIVPKVLINQASSTNILYWRTFQRLEVSPGPLLGFAGEKVETRGYMDLMTTFGQGHIFRSFTIRYLLVDADTSYLALIGRKTLNELGAIVSMLHLKMKFPTLIGEIITVKADQKQARQCYAESLKVASYPLTKESAKPHPTVAEDSHDDTSDGGPKPIEELIKLQLRLKPGLVDGSFGFQVLSFLDAYSRYNQIRMHTPDEEKTTFNTKDANFFYMIGQNIEVYVDDMVVKSKSIAQHVADLEEFFGELCKYDMCLNHEKCTFGVGGGKFLGFMITHQGIKANPNKCTAILEMHSPTNVQEVQKMNGRLASLSRFLLKLVEKAKPFYKLLKKTEPFLWDETCERAFLAFKKTITTPSILSRPRLGAQGLDKPHRPVILSLVEVTTPDIGQTPIHAWGLNKLVTLLLVMATAPDIKQSSTLDNLFHPQAGSELEGLMYCPGSTKYTWHHMWYSEARVNPPC

SEQ ID NO: 198799 - protein, 59 aa, Glycine max
  Coding DNA Sequence Number=SeqID_82021
MCPKWALGLHTLALREVFVKRIGGGGGGRTCRTKDFDTQEWSGVELHILVCRGCYSLYK

SEQ ID NO: 198800 - protein, 142 aa, Glycine max
  Coding DNA Sequence Number=SeqID_82022
MWAFHTSRQIDWAHLVRYHMHKALRLNAPLPYPHLVTLFLQHFNIPLDSEPYIPIKRSFLIGAVVVASFGYRKERDGSWVKKGAQPNDDEGHLPVKGDSSLLQSILDRFDGLQTYVGERITKVEGDVIFIRTCFDLPPPPSS

SEQ ID NO: 198801 - protein, 241 aa, Glycine max
  Coding DNA Sequence Number=SeqID_82023
  Gene Ontology: Mol. function=DNA binding; Cellular component=nucleus
  Homolog annotation: Hit_ID=Q6ZJ55; Match level="QueryCoverage=47%, HitCoverage=28%, E-value=1e-20, Identity=47%"; Hit description =Putative AT-hook protein 1
  Pfam annotation: Domain name=AT_hook; Domain location=86-98; Score =16.7; E_value=0.03; Accession=PF02178.9; Description=AT hook motif
  Pfam annotation: Domain name=DUF296; Domain location=156-241; Score= -8.8; E_value=0.0028; Accession=PF03479.5; Description=Domain of unknown function (DUF296)
  Pfam module annotation: Pfam domain module=AT_hook::DUF296; Domain location=86-98::156-241
MGFHCDFVTCSRRPWSENSIFCMEAREGISSGVTVIGAEAPSAYHVAPRSEAPNQVHVPDGGGGAAATAAPVGVSPVSVGLDGTVKKKRGRPRKYGPDGSVTMALSPMPISSSAPPSNDFSSGKRGKMRGMDYKPSKKVGLDYIGDLNVCSDGTNFMPHIITVNAGEIVEVGEDDEIVRGKMITEHWNYKDDEYDITMKVISFSQQGPRAICILSANGVISNVTLRQPDSSGGTLTYEVWQ

SEQ ID NO: 198802 - protein, 93 aa, Glycine max
  Coding DNA Sequence Number=SeqID_82024
  Gene Ontology: Mol. function=RNA-directed DNA polymerase activity
MAQKRNLWEQIKQLRNSSFGRLWCILGDFSSVRNPVERAGICERGVNDSNMEEFNEWIVDLDVEDMPCVGRKFTWYKPNGTTKNRLDRVLISA

SEQ ID NO: 198803 - protein, 96 aa, Glycine max
  Coding DNA Sequence Number=SeqID_82025
MACLPNYTPPNVAYIPNEDVNNSTPILIKSQQPQSDHPHVSRPMEETHEIPHHDLADFKPCLGYAAEGQEVGGVPLQKTLEGPQYHPQPQPSRSTT

SEQ ID NO: 198804 - protein, 224 aa, Glycine max
  Coding DNA Sequence Number=SeqID_82026
  Gene Ontology: Mol. function=identical protein binding; Biological process=negative regulation of enzyme activity
  Homolog annotation: Hit_ID=O49607; Match level="QueryCoverage=50%, HitCoverage=16%, E-value=1e-24, Identity=46%"; Hit description =Subtilisin proteinase-like
MTRSRSSTTTTITSSRGNIELPKGHPSHNVVEIIFHTNWGRKPFPSRVKLIFKVQNVSRVVARFKDFLKVIKARIVARLTKGNEGKENVRCITDGNEVMWFHCFGSTEDTAMFQPDVGVEDSDNDIEVVVGFKLEAALVAEFAMATFEDSEDIRVLAYGRDLLACEHCVDAVENSVVYVEDVGFFDELRGVPMVVSGEHGGLGLGIHTKDEGLGSFITGNNGKK

SEQ ID NO: 198805 - protein, 78 aa, Glycine max
  Coding DNA Sequence Number=SeqID_82027
MGISSLDVSPKVAWSGVVVVLGDVVMTLFVMVKKKKGCGRKGLKEEEEDGLLYPCVILKHVNAIGEKGSTTDFVKFSI

SEQ ID NO: 198806 - protein, 986 aa, Glycine max
  Coding DNA Sequence Number=SeqID_82028
  Gene Ontology: Mol. function=protein-tyrosine kinase activity; Cellular component=integral to membrane; Biological process=protein amino acid phosphorylation
  Homolog annotation: Hit_ID=Q1SSH9; Match level="QueryCoverage=96%, HitCoverage=96%, E-value=1e-162, Identity=38%"; Hit description =Tyrosine protein kinase, active site
  Pfam annotation: Domain name=LRR_1; Domain location=100-122; Score =14.1; E_value=0.5; Accession=PF00560.23; Description=Leucine Rich Repeat
  Pfam annotation: Domain name=LRR_1; Domain location=124-146; Score =17.8; E_value=0.04; Accession=PF00560.23; Description=Leucine Rich Repeat
  Pfam annotation: Domain name=LRR_1; Domain location=148-170; Score =17.7; E_value=0.041; Accession=PF00560.23; Description=Leucine Rich Repeat
  Pfam annotation: Domain name=LRR_1; Domain location=172-195; Score =13.4; E_value=0.84; Accession=PF00560.23; Description=Leucine Rich Repeat
  Pfam annotation: Domain name=LRR_1; Domain location=197-219; Score =16.3; E_value=0.11; Accession=PF00560.23; Description=Leucine Rich Repeat
  Pfam annotation: Domain name=LRR_1; Domain location=221-243; Score =14.3; E_value=0.45; Accession=PF00560.23; Description=Leucine Rich Repeat
  Pfam annotation: Domain name=LRR_1; Domain location=245-267; Score =20.4; E_value=0.0066; Accession=PF00560.23; Description=Leucine Rich Repeat
  Pfam annotation: Domain name=LRR_1; Domain location=269-292; Score =14.6; E_value=0.37; Accession=PF00560.23; Description=Leucine Rich Repeat
  Pfam annotation: Domain name=LRR_1; Domain location=294-316; Score =11.8; E_value=1.7; Accession=PF00560.23; Description=Leucine Rich Repeat
  Pfam annotation: Domain name=LRR_1; Domain location=318-340; Score =14.2; E_value=0.48; Accession=PF00560.23; Description=Leucine Rich Repeat
  Pfam annotation: Domain name=LRR_1; Domain location=342-364; Score =17.9; E_value=0.036; Accession=PF00560.23; Description=Leucine Rich Repeat
  Pfam annotation: Domain name=LRR_1; Domain location=366-389; Score =12.5; E_value=1.3; Accession=PF00560.23; Description=Leucine Rich Repeat
  Pfam annotation: Domain name=LRR_1; Domain location=391-413; Score =14.9; E_value=0.29; Accession=PF00560.23; Description=Leucine Rich Repeat
  Pfam annotation: Domain name=LRR_1; Domain location=415-437; Score =10.7; E_value=2.8; Accession=PF00560.23; Description=Leucine Rich Repeat
  Pfam annotation: Domain name=LRR_1; Domain location=439-461; Score =17.1; E_value=0.062; Accession=PF00560.23; Description=Leucine Rich Repeat
  Pfam annotation: Domain name=LRR_1; Domain location=463-485; Score =21.0; E_value=0.0044; Accession=PF00560.23; Description=Leucine Rich Repeat
  Pfam annotation: Domain name=LRR_1; Domain location=487-509; Score =16.4; E_value=0.1; Accession=PF00560.23; Description=Leucine Rich Repeat
  Pfam annotation: Domain name=LRR_1; Domain location=511-533; Score =5.1; E_value=32; Accession=PF00560.23; Description=Leucine Rich Repeat
  Pfam annotation: Domain name=LRR_1; Domain location=535-557; Score =12.6; E_value=1.3; Accession=PF00560.23; Description=Leucine Rich Repeat
  Pfam annotation: Domain name=LRR_1; Domain location=559-579; Score =8.3; E_value=8.1; Accession=PF00560.23; Description=Leucine Rich Repeat
  Pfam annotation: Domain name=LRR_1; Domain location=581-600; Score =6.2; E_value=20; Accession=PF00560.23; Description=Leucine Rich Repeat
  Pfam annotation: Domain name=LRR_1; Domain location=602-625; Score =7.2; E_value=13; Accession=PF00560.23; Description=Leucine Rich Repeat
  Pfam annotation: Domain name=LRR_1; Domain location=627-651; Score =4.2; E_value=48; Accession=PF00560.23; Description=Leucine Rich Repeat
  Pfam annotation: Domain name=Pkinase; Domain location=689-956; Score =133.0; E_value=8.5e-37; Accession=PF00069.15; Description=Protein kinase domain
  Pfam annotation: Domain name=Pkinase_Tyr; Domain location=689-956; Score=88.9; E_value=1.6e-23; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::Pkinase::...
  Pfam module annotation: Pfam domain module=Pkinase_Tyr; Domain location=100-122::124-146::148-170::172-195::197-219::221-243::245 -267::269-292::294-316::318-340::342-364::366-389::391-413::415 -437::439-461::463-485::...
  Pfam module annotation: Domain location=487-509::511-533::535 -557::559-579::581-600::602-625::627-651::689-956::689-956
MANCVCSLLIMVLYVMLLPSIIVTSIAPSSNYTSTNEEHQALLQSGWWYAYQNISDHCYWDGVFCNEAGSVTQIYPDYLSIPPLEELRRIQKLNVSAFPNLVYLDLNGMALTGTIPKEISTLTKLTYLVLSNNCLQGSIPVEIWNLTQLVELYLDNNSLTGSIPSTLGRLKNLVFLILDSNHIQGELMPKAFSNLTQLKHLDVSRNSLSGVIPSTLGELKNLEHLSLYSNKFEGLLPMEVGNLTQLKELYLSNNSLTGSIPSTLSQLENLTYLFLDSNHIEGRLMPKTLSNLTELKHLDVSWNSLRGVIPSTLGELKNLVKLYLQSNQFEGPLPIEVGNLTQLQELILSNNSLTGSISSSLGQLQNLTMLLLDSNHIEGKLMPKMFSNLTQLEQLDVSGNSLSGVIPCTLGQLNNLGHLSLHSNKFEGTIPSTLGQLKNLEHLSLHSNKLEGTIPSTLGQLGNLTNLSLSSNQITGPIPVEFGNLTSLKILSLSNNLLTGSIPPTMGRLKVMINLFLDSNQITGPIPIELWNSTGLILLNLSHNFLSGSIPSEIAQAYYLYDVDLSHNNFTILSPFLKCPYIQKVDLSYNLLNGSIPSQISCIHNLNLSHNFLKGEIPHISSEANSILDSLDLSYNNLTVVLLSALYFRRCVFQTKFEGKSTKNGNLFSIWNYDGKIAFEDIIEATEDFHIKYCIGTGAYGSVYRAQLPSGKIVALKKLHQMESQNPSFNKSFHNEVKMLTQIRHRNIVKLHGFCLHNRCMFLVYQYMERGSLFYALNNDEEVQELNWSKRVNIIKGMAHALSYMHHYCTPPIVHRDVTSSNVLLNSQLEAFVSDFGTARLLDPDSSNQTLVAGTYGYIAPELAYTMNVTEKCDVYSFGVVTLETLMGRHPGELISSLSNSTAQNMLLKDILDARLPLPNLGKDTHDIMLAVTIALACLCLKPKFRPSMQQVVGQFSNFKLPLSLPFHEILIHQLMTPDMLSFIQV

SEQ ID NO: 198807 - protein, 387 aa, Glycine max
  Coding DNA Sequence Number=SeqID_82029
  Gene Ontology: Mol. function=RNA-directed DNA polymerase activity; Biological process=RNA-dependent DNA replication
MLRRMSFCYRWISWIEGCLNSASIFILVNGSLSAKFIPQRGLRQGDPLATFLFNVVAEGLNGLMRKAMEKKLFEGFLFGRNEVESILQYADDTIFFGKASRENVKAIKAILWSFELVSGLKINFSKSSFGVVGMLERWKEDAAMFLNCSLLVIPFLYLGTLIGTNPRVPNKILDKLVRIQQRFLWGGGLEQRKIAQLKWESMELWARVLVSKYGEWSNWDEVRRGNTKSSWWKGIRSIAHSTEEGSWFVKGIKRNLGCRARVQFWEDDGVTLMLKYPRLYSISPINNNNPFNRWEVSQATGLGREIQVVYTLWGMRMRCLWATIQTKIRMELSMCCGNSVLDKQIGSIFAMSETTFPSVCAWKDIWCLVLAMAVLVDILDMEYLASS

SEQ ID NO: 198808 - protein, 47 aa, Glycine max
  Coding DNA Sequence Number=SeqID_82030
MTETSITLKGLDDTSQSKFKAAARWIIVKYFNDARSLELERLKVFRI

SEQ ID NO: 198809 - protein, 95 aa, Glycine max
  Coding DNA Sequence Number=SeqID_82031
MTTLCKSRRKRFLTIQTISPNEKFIFMGNGVKAPVETVETYCLKLDTRHRLNLLETPYEKQAKHTKKGATRSTQLLEIVHTDICGPFDVSSFGKE

SEQ ID NO: 198810 - protein, 122 aa, Glycine max
  Coding DNA Sequence Number=SeqID_82032
  Homolog annotation: Hit_ID=Q00VP3; Match level="QueryCoverage=73%, HitCoverage=40%, E-value=5e-18, Identity=54%"; Hit description =Homology to unknown gene
  Pfam annotation: Domain name=DUF1499; Domain location=5-102; Score =11.2; E_value=7e-06; Accession=PF07386.2; Description=Protein of unknown function (DUF1499)
MYLKGWLFALFLPIIEVKLNQFRTILQIESTTPDKFSPRIVERKEDYIRVEYQSSILGFVDDVEFWFPPGKGSTVEYRSASRLGNFDFDVNRKRIKLDKEILGSMALRQELEKKGWASQDTI

SEQ ID NO: 198811 - protein, 78 aa, Glycine max
  Coding DNA Sequence Number=SeqID_82033
MRQDINVLIFLDVRKALEEFDAVTPLSETEAVDLVKTVFASATEIDIYTVMSEASNCHPKTLYTEIYCWRYQSWIGNV

SEQ ID NO: 198812 - protein, 1322 aa, Glycine max
  Coding DNA Sequence Number=SeqID_82034
  Gene Ontology: Mol. function=ATP-dependent helicase activity; Cellular component=proton-transporting two-sector ATPase complex; Biological process=ATP synthesis coupled proton transport
  Homolog annotation: Hit_ID=Q1RWC6; Match level="QueryCoverage=98%, HitCoverage=98%, E-value=0.0, Identity=70%"; Hit description=ATP -dependent helicase HrpA
  Pfam annotation: Domain name=DEAD; Domain location=269-450; Score= -18.4; E_value=0.0002; Accession=PF00270.19; Description=DEADDEAH box helicase
  Pfam annotation: Domain name=DUF1605; Domain location=996-1151; Score= 42.8; E_value=1.1e-09; Accession=PF07717.6; Description=Domain of unknown function (DUF1605)
  Pfam annotation: Domain name=HA2; Domain location=834-966; Score =61.0; E_value=3.8e-15; Accession=PF04408.13; Description=Helicase associated domain (HA2)
  Pfam annotation: Domain name=Helicase_C; Domain location=680-773; Score=60.5; E_value=5.5e-15; Accession=PF00271.21; Description =Helicase conserved C-terminal domain
  Pfam module annotation: Pfam domain module=DEAD::DUF1605::HA2::Helicas e_C; Domain location=269-450::996-1151::834-966::680-773
METWESSGDQIEFNSQSLGDGDSNALILPAKRMRKRKGKEQENGKVKSNKKQKLSKPQKRKMKKLEDDKEKQLLLEKAIKTLNENTLPEYAYPLLLSSCNINRDETMKEKRRRAVHLLKEGLEVSYDGLSMKPETDEIHLEQVDEVVENDIQIQPISPEEVLNTTSVSLESSQEPVHGNEVETYKYVSEHPTDISIDNHLDEIRSSPMSCSIDEIKGTKSKYRTNENHNSNELSNLPGYSAPRRSNVPTVVHVYRPTEVEDKRKDLPIVMMEQEIMEAINDRSSVIICGETGCGKTTQVPQFLYEAGYGSSKGIIGVTQPRRVAVLATAKRVAYELGLHLGKEVGFQVRYDKKIGESCSIKFMTDGILLREVQNDILLRRYSVLILDEAHERSLNTDILIGMLSRVIKTRQMIYNEQQKMILSGENISPEKMVFPLKLVLMSATLRVQDFTSGKLFHTPPPVIEVPTRQFPVTAYFSKKTEKTDYIGEAYKKVLAIHKRLPPGGILVFLTGQREVEDLCRKLRKASREFIKKKVEGSLETDSTVVHETNSVEGVNINEINEAFEVHGSSSIQQTDRFSCYDEDEDNVNWNESDFSYDSETDSELEFDEDDDNLELSENKSNIVDVLGQAGSLASLKAAFEKLSGQATLSSSNEEEASVNIEGNLDQSKVFREKRAKENCSTPGALCVLPLYAMLPAAAQLRVFEEVKDGERLVVVATNVAETSLTIPGIKYVVDTGREKVKNYDPSNGMETYEVQWISKASAAQRAGRSGRTGPGHCYRLYSSAAFSNEFPEHSPAEVEKVPVHGVVLLLKSMHIKKVANFPFPTSLKDSSLLEAETCLKALEALDNKDELTLLGKAMAHYPLSPRHSRMLLTVIKNTRHVHKFNPNMLLAYAVAAAAALSLSNPFVMQYEDDSSRDSEMSEKSSLGDGDKGIGKKEKSRKKKLKETAKVAREKFRVVTSDALTIAYALQCFEHSQKSAEFCDDYALHFKTMDEMSKLRQQLLKLVFYQSDKGGFEEECSWTCGSLEDVERVWQASSEKYPLSLVEERLICQAICAGWADRVAKRITASSRASDGENTSRALKYQSSMVDESVFLHRWSSASIVGPEFLVYNELLETKRPNKEGITSAKRAYMHGVTSVEPAWLVEHAKSSCIFSPPLMDPRPYYDAQTDQVKCWVIPTFGRFCWELPKHSLSISNDEHRVQVFAYALLEGQVCPCLKSVRKYMSAAPESIMKREALGQKRVGNLLSKLKSRLIDSSAMLRMVWKENPRELFSEILDWFQQSFHKHFEELWLQMVNELLMEKQERPLHKSSKKKKVKSKSLR

SEQ ID NO: 198813 - protein, 293 aa, Glycine max
  Coding DNA Sequence Number=SeqID_82035
  Gene Ontology: Mol. function=protein binding; Biological process =vesicle docking during exocytosis
  Homolog annotation: Hit_ID=Q1RWC8; Match level="QueryCoverage=99%, HitCoverage=46%, E-value=1e-104, Identity=63%"; Hit description=Sec1- like protein
MVQALPQYTEQVEKISLHVEIAGKINKIIRETDLRELGQLEQDLVFGDAGAKEVINFLRTKQNTTPEYKLRLLMIYASVYPEKFEGDKASKLMQTKQAARKDRTEEEETWQLFRFYPMLEELIENLSKGELAKNEYSCINEPNPSNARGSVRISKQTQTPPTTAPHSMRSRRTANWGRARTSDDGYSRNKLCFKMITVSVSSFNPDFILLPNFNSDSTLKNVTTDFKRMGKRIFVFIIGGATRSELRVCHKLTPKLKREVILGTTSMDDPPQYLTKLKLLFDNNVSQLNGLGI

SEQ ID NO: 198814 - protein, 50 aa, Glycine max
  Coding DNA Sequence Number=SeqID_82036
MGGLASNCHERFTNAKRKQEVLKKMKEMIPKCELSRQMHAKCSLQAGSSH

SEQ ID NO: 198815 - protein, 90 aa, Glycine max
  Coding DNA Sequence Number=SeqID_82037
MQLQQQVLLVIGVLNADFRMENRCERETLESLNEAEEVVIILCVYVRGNIGREFRAMSNTMRLRKSLYTESNVDTRSYFGNIVLLIQDFI

SEQ ID NO: 198816 - protein, 287 aa, Glycine max
  Coding DNA Sequence Number=SeqID_82038
  Gene Ontology: Mol. function=protein binding; Biological process =vesicle docking during exocytosis
  Homolog annotation: Hit_ID=Q1RWC8; Match level="QueryCoverage=97%, HitCoverage=26%, E-value=2e-53, Identity=72%"; Hit description=Sec1 -like protein
MDFSYEMYMVQGFITDQETAMEELYGNIENTRRFNTCLNNMAIRIATVFASLKMEDFNGLLLTHCNESVACMLWLFAWLSNLSSNKSRLLLTCNVRRVRKGFSSYMEHIVKVRQRGRVVPKGSFPQPQINIRESYSFSHKESLRELPCVWYRAAKDSDESTATAVRELVPTKLANAVWDMVSKYKSTIPGFPQNETCDMLIVDRSVDQLSPFDDCVESAPQIAPVIHEWTYDAMCHDLLTMDGDKYMHEVPSKVGGQPEIKEVILQDHDSVWLELRHTHIADVRLIY

SEQ ID NO: 198817 - protein, 114 aa, Glycine max
  Coding DNA Sequence Number=SeqID_82039
  Gene Ontology: Mol. function=zinc ion binding
  Homolog annotation: Hit_ID=Q1RX12; Match level="QueryCoverage=75%, HitCoverage=9%, E-value=3e-32, Identity=71%"; Hit description=Zinc finger, RING-type; Transcription factor jumonji, jmjC; Cupin region; Zinc finger, FYVE/PHD-type
MRKAASREDLTDNYLYCPKAVDLQYKDLRHFQWHWEKGEPVIVSNVLECTSGLSWEPLVMWRALRHVTNTKRGQHLAEKTIDCLDWTESYQNRMSLKYFVKYRKITIFWWMVPL

SEQ ID NO: 198818 - protein, 136 aa, Glycine max; identical to SEQ ID NO: 186964
  Coding DNA Sequence Number=SeqID_82040

SEQ ID NO: 198819 - protein, 91 aa, Glycine max
  Coding DNA Sequence Number=SeqID_82041
  Subcellular localization annotation: CTP_CleavageSite=40; ConfidenceScore=5.30e-01
MVSSSGGRTKVRPLPMEEGLRKSMQRRRPRKSTMTMFAISSVREVSMWTMSRGNAGEVGEGVEEHDNGRLDLAAEETTEGFEFKGTILNAI

SEQ ID NO: 198820 - protein, 70 aa, Glycine max
  Coding DNA Sequence Number=SeqID_82042
MHVEPWEERIIIIQMMFPSGKDLQHPEATSSLSGWETLEKDKSEIYTLSAQPARPARTLSLLALSAPKLA

SEQ ID NO: 198821 - protein, 1712 aa, Glycine max
  Coding DNA Sequence Number=SeqID_82043
  Gene Ontology: Mol. function=ARF guanyl-nucleotide exchange factor activity; Cellular component=intracellular; Biological process =regulation of ARF protein signal transduction
  Homolog annotation: Hit_ID=Q9LZX8; Match level="QueryCoverage=99%, HitCoverage=100%, E-value=0.0, Identity=69%"; Hit description =Guanine nucleotide exchange factor-like protein
  Pfam annotation: Domain name=Sec7; Domain location=655-840; Score =334.8; E_value=1.5e-97; Accession=PF01369.11; Description=Sec7 domain
MASSEADSRLSQVVVPALEKIVKNASWRKHAKLAHECKSVIESLSHQQAPPPPGSPSDTEPETAVPGPLQDGGPVEFSLAESESILAPLINAAVSGVLKIADPAVDAIQKLIAHGYLRGEADPASGAAAPEAKLLSSLIESVCKCHDFGDDAMELLVLKTLLSAVTSISLRIHGDSLLLIVRTCYDIYLVSKNIVNQTTAKASLIQILVIVFRRMEADSSTVPIQPIVVAELMEPVEKSDVDISMTQYVQGFITKIMQDIDGVLNPTTPSGKVSLLGGHDGAFETTTVETTNPTDLLDSTDKDMLDAKYWEISMYKTALEGRKGELVDGEVVERDDDFEVQIGNKLRRDAFLVFRALCKLSMKTPPKEALGDPQLMKGKIVALELLKILLENAGAVFRTSVSVLFDAVDILIFSASSPPYFRGYNLIPESQCNYNTQGPFSMFLGAIKQYLCLSLLKNSASTLLIVFQLSCSIFISLVSRFRAGLKAEIGVFFPMIVLRVLENVSQPNFQQKIIVLRFLDKLCVDSQILVDIFINYDCDVNSSNIFERMVNGLLKTAQGVPPGVTTTLLPPQEATLKLEAMKSLVSVLKSMGDWMNKQLRIAEPHSAKKVEATDNSPESGGFTMVNGNGEDPVDGSDSQLEVSNDASDVSTIEQRRAYKLELQEGISLFNRKPKKGIEFLINANKVGDSPEEIAAFLKDASGLNKTLIGDYLGEREELSLKVMHAYVDSFNFQGMEFDEAIRVFLQGFRLPGEAQKIDRIMEKFAERYCKCNPKAFSSADTAYVLAYSVIMLNTDAHNPMVKNKMSADDFIRNNRGIDDGKDLPEEYLRSLFERISRNEIKMKENDAAPQQKQTVNPNRLLGLDSILNIVIRKRGEENMETSDDLIRHMQEQFKEKARKTESIYYAATDVVILRFMIEVCWAPMLAAFSVPLDQSDDEVVISLCLEGFRYAIHVTSVMSMKTHRDAFVTSLAKFTSLHSPADIKQKNVDAIKAIVVIADEDGNYLQEAWERILTCVSRFEHLHLLGEGAPPDATFFSFPQNDLEKTKPAKSTILPVLKKGPGRMQYAAATLMRGSYDSAGIGSNGSGVTSEQKLNSEAIIDFVKALCKVSMEELRSPSDPRVFSLTKMVEIAFGSNGKTRDKVLNFIEEKNITSVPKDQAAAYDDHKNIVLLAFEIMEKIIRDYFPYITETETTTFTDCVNCLIAFTNSRFNKEISLNAIAFLRFCATKLAAGDLGSSSRNKDKEVTGKISSSSPQTRKEGKKDNGEVTDKDDHLYFWFPLLAGLSELSFDPRPEIRKSALEVLFETLRNHGHLFSLPLWERVFESILFPIFDYVRHSIDPSGSSSPVNEVEADGELDQDAWLYETCTLALQLVVDLFVNFYDTVNPLLRKVLMLLVSFIKRPHQSLAGIGIAAFIRLMSNAGELFSDEKWLEVVFSVKEAANATLPKFLFVESENFTRNYEHASTAEDDRDPAESGSPDNLETMRIRRLYAHLTDAKCRAAVQLLLIQAVMEIYNMYRTHLSAKATLVLFDALHDVAVHAHQINGNTILRSKLQEFGSVTQMQDPPLLRLENESYQTCLTFLQNLVIDKPPSYEADEVELHLIRLCQEVLEFYIEVAGFGQKSESSHGRQQHWSIPLGTGKRRELAARSPLIVATIQAICSLGDTSFEKNLSHFFPLISSLVRCEHGSKDLQVALSDMLSLSVGPVLLQSC

SEQ ID NO: 198822 - protein, 68 aa, Glycine max
  Coding DNA Sequence Number=SeqID_82044
MGLGCTAHEGLCAIGSKSEERSYVAGTVDGSSAIEITGGAMVVACGEEGGGGGGGGWGNSRVARWPCA

SEQ ID NO: 198823 - protein, 120 aa, Glycine max
  Coding DNA Sequence Number=SeqID_82045
  Gene Ontology: Mol. function=histone-lysine N-methyltransferase activity; Cellular component=nucleus; Biological process=chromatin modification
  Homolog annotation: Hit_ID=Q10P52; Match level="QueryCoverage=69%, HitCoverage=30%, E-value=7e-39, Identity=92%"; Hit description=LOB domain protein 18, putative
  Pfam annotation: Domain name=DUF260; Domain location=34-119; Score =186.5; E_value=6.5e-53; Accession=PF03195.5; Description=Protein of unknown function DUF260
  Subcellular localization annotation: CTP_CleavageSite=54; ConfidenceScore=5.52e-01
MSINSSCSISGGSSSGGNNNGAGGSGGNNGGGSPCGACKFLRRKCVPGCIFAPYFDSEQGATHFAAVHKVFGASNVSKLLLNIPVYKRLDAVVTICYEAQARLRDPVYGCVAHIFALQQQ

SEQ ID NO: 198824 - protein, 96 aa, Glycine max
  Coding DNA Sequence Number=SeqID_82046
MVGYAPSSFADLVFAGERIEASLKKGKFDHPALMNEKTGANEEDENEEGTHVVAAIPTWQNFPPVQQCHRSACNDPPRRYEVILSQHKFIQQHAIT

SEQ ID NO: 198825 - protein, 113 aa, Glycine max
  Coding DNA Sequence Number=SeqID_82047
  Homolog annotation: Hit_ID=Q1SP02; Match level="QueryCoverage=83%, HitCoverage=25%, E-value=1e-08, Identity=41%"; Hit description=IMP dehydrogenase/GMP reductase
MSRRRPLHGSWAVILHFSNAGYTSTFLQCIHPSFMMLMMRGAHGPAGGLQMPYGEHRGVRAFDLISSYTGQLRWGQIMVYVRPEWVLRQFGYLQTVPPPSVCDSLTGDDIDDR

SEQ ID NO: 198826 - protein, 126 aa, Glycine max
  Coding DNA Sequence Number=SeqID_82048
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=99%, HitCoverage=26%, E-value=6e-59, Identity=83%"; Hit description=NADH -plastoquinone oxidoreductase subunit 2
  Pfam annotation: Domain name=Oxidored_q1; Domain location=23-125; Score=-119.6; E_value=0.084; Accession=PF00361.10; Description=NADH -Ubiquinoneplastoquinone (comple
MAITEFLLFILTATLGGMFLCGANDLITIFVALEYVRSNEATTKYLLMGGASSSILVHGFSWLYGSSGGEIELQEIVNGLINTQMYNSPGILIALLFITVGIGYKLSPAPSHQWTPDVYEGVRFVR

SEQ ID NO: 198827 - protein, 56 aa, Glycine max
  Coding DNA Sequence Number=SeqID_82049
MASDLKWDWKIVEASGNRLPAYVIDYTEEQATGNRLQGMCNRLHSAFFRFSCPEAV

SEQ ID NO: 198828 - protein, 256 aa, Glycine max
  Coding DNA Sequence Number=SeqID_82050
  Gene Ontology: Mol. function=calpain activity; Cellular component =intracellular; Biological process=proteolysis
  Homolog annotation: Hit_ID=Q1RTJ9; Match level="QueryCoverage=89%, HitCoverage=68%, E-value=9e-27, Identity=35%"; Hit description =Cyclin-like F-box; F-box protein interaction domain
METFLFNFANMSGYHLVGSCNGLHCGVSEIPEGYCVCFWNKATRVISRESPTLSFSPGIGRRIMFGFGYDPSIGKYKVVAIALTMLSLDVSEKTEMKVYGAGDSSWRNLNGFPVLWTLPKVGGVYLSGTLNWVVIMGKETIYSEIVIISVDLEKETCISLFLPDDFCIFDTNIGVFRGSLCVWQDSNTNLGLWKMRKFGDDKSWIQLINFSYLHLNICPYEEKSMILPLCMSNNGDFFMLKFTRNADDEYQTILHN

SEQ ID NO: 198829 - protein, 99 aa, Glycine max
  Coding DNA Sequence Number=SeqID_82051
MPISPCKRIVPTRHPVDPKKFNRVLGFSALITSLCQFYGVPITPNKVIRPRINQGFIKKYCAPRQAQGETPQQHWDGRQRATDAPPPPLEFTSSHPQKG

SEQ ID NO: 198830 - protein, 107 aa, Glycine max
  Coding DNA Sequence Number=SeqID_82052
MASEEALRQAFWILFGYVSGNMYLEVSKEYRYLTQAPVVLLRILSTGCMLVEIFLYKPEIFQKVRPRCEAPRRDMIYPTNYTPCRYVRISCLRGNPIAIFFVQSYIL

SEQ ID NO: 198831 - protein, 91 aa, Glycine max
  Coding DNA Sequence Number=SeqID_82053
HNCSRVRLKNLDGVAKIAIVDWSLACCRIYEFITSRCLSGKLRLAYVTRLCVSTVKFFGVLLLACQWFIEDSLIVGEQMPIYNPMTKQSRQ

SEQ ID NO: 198832 - protein, 219 aa, Glycine max
  Coding DNA Sequence Number=SeqID_82054
  Subcellular localization annotation: CTP_CleavageSite=31; ConfidenceScore=5.12e-01
MAKPSKKLKGSLSRSQRHSETQETQIPSSISSSSLFSSEEQRIRYTNVFSSRSIIDPKFIDMDFFSNEGFECIQAFENSNLIPFMSLKLSVYSDLVKAFYSNLEIQEGTLIYEVYGIQMVIDQSLFYELTQLSSEGVPFEGTLIDDWKYDFSVHDVCRLVCTNQADMTGRLLASSLAFESRILHYLIVCILLPRSSNLAQVSEEDLIVMWAFHKSRQID

SEQ ID NO: 198833 - protein, 90 aa, Glycine max
  Coding DNA Sequence Number=SeqID_82055
MSLHVLYLYAFSRFPPQGFPGQDHLGLPSGVETKHERQKPIKVLKDERKRGWGHDRPIVALLCAKQAGNVAARQPRILCILQLSFTICLF

SEQ ID NO: 198834 - protein, 73 aa, Glycine max
  Coding DNA Sequence Number=SeqID_82056
MRMRRHSMFPFAWHAFSIGGVCLRGLGADDWFLCCYLPNGIRVASQTHSIQASLLGTLEDFKVPHVNHVSRPS

SEQ ID NO: 198835 - protein, 159 aa, Glycine max
  Coding DNA Sequence Number=SeqID_82057
  Gene Ontology: Mol. function=nucleic acid binding; Biological process= RNA-dependent DNA replication
MKVEQLFACHHTSEERKKSTLMKRHIPSYYERELMDKLQRLSQGSMSIEEYRQQMELLLLSVGLKEEEITSIARFLSGLNIEVREKVELLPYRDLDDLVQLCIRVEHQLKRKPTSKSYGFHSYPKKDQGQGILGAAHSKPKDDKGKMMCLYFLLFLKPF

SEQ ID NO: 198836 - protein, 48 aa, Glycine max
  Coding DNA Sequence Number=SeqID_82058
MDTVELYTRAMKGTMREPQANLGAGSDKPWDFSGLIKRLHRHHSKIVK

SEQ ID NO: 198837 - protein, 41 aa, Glycine max
  Coding DNA Sequence Number=SeqID_82059
MIAGASIVGSKDLALRRTIEIAKEQDGLYYLQDEDNKECTR

SEQ ID NO: 198838 - protein, 106 aa, Glycine max
  Coding DNA Sequence Number=SeqID_82060
MSWNFTDCLTMGVKWSPDEIRSHPTNCRNLPFGGAHGCVFQERKMRRVANNVYSRKTSEKPEKTWSMKFKCERFGSCIYARGRVFPFSYEFLNCDKEIKPTSFFEN

SEQ ID NO: 198839 - protein, 93 aa, Glycine max
  Coding DNA Sequence Number=SeqID_82061
MSLPSAVHVSSTFEFGAMLHDCLSVDPQKEKEGVETRVVITERAGRTKSVSYLCFPLISDERYLAPFVAQYVKSRDVPKIKRKQAYAIRENSV

SEQ ID NO: 198840 - protein, 62 aa, Glycine max
  Coding DNA Sequence Number=SeqID_82062
SRRVQGETPQQPGDGRQRATDALPSPLEFTSAHPQKGLSIAYTTWPTNRRPSPKPKDAPSCS

SEQ ID NO: 198841 - protein, 289 aa, Glycine max
  Coding DNA Sequence Number=SeqID_82063
  Homolog annotation: Hit_ID=Q47522; Match level="QueryCoverage=21%, HitCoverage=83%, E-value=1e-21, Identity=75%"; Hit description=LacZ protein
  Subcellular localization annotation: CTP_CleavageSite=42; ConfidenceScore=5.15e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSITLFSNAQLGHDISMELVTAHHQESRIKTAATDGPRYHWSQPFQIHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 198842 - protein, 180 aa, Glycine max
  Coding DNA Sequence Number=SeqID_82064
  Subcellular localization annotation: CTP_CleavageSite=36; ConfidenceScore=5.07e-01
MAMMNSSSRPKPAPSRDPTRRLRKASISIPLIVAVRSMAAQRRETLQDFIYGPIQIYGTVQAHHNHASSIRSGPGLSAPDTTAAREGYSLQMTRILHIEGASINDIASLYVEINRVFMADEDWQLGASLDALDDLLHGGYGALAGHAIATVVWRDIAHSRDALGRETTRAWLQSKLAQAA

SEQ ID NO: 198843 - protein, 180 aa, Glycine max
  Coding DNA Sequence Number=SeqID_82065
  Gene Ontology: Mol. function=DNA binding; Cellular component =mitochondrion; Biological process=DNA integration
  Homolog annotation: Hit_ID=Q1S3H4; Match level="QueryCoverage=98%, HitCoverage=41%, E-value=7e-59, Identity=50%"; Hit description =Integrase, catalytic region
  Pfam annotation: Domain name=rve; Domain location=45-165; Score=3.9; E_value=0.0028; Accession=PF00665.16; Description=Integrase core domain
MEEAKCKIWHCHSSTYAGHYSGDRTTAKRMGGISKRNEMPLHNIIEVEVFDCRGIDLVGPLPSFYKNAYILVAIDYVSKWVEAIATPRNDARIVIKFLKKNIFSRFGVPRTNGQAKVSNKELKRILEKTVTSLRKDCAAKLDDSLWAYRTAFKTSIGLSPFQMVYGKTCHLPVEVEHGAY

SEQ ID NO: 198844 - protein, 302 aa, Glycine max
  Coding DNA Sequence Number=SeqID_82066
MAVFWSLQLNLPTSKGIEELLGMGSQAINEYVELNRLTKPMHMSLSEQPMEVDEISTFPSTVLDFGKYFFRNFSTTSSHNSRDLHRVANLDVCDKSSSVTLRGRSSAMMRSSRLVCGLIIGMGDDDSNDEVWYLLQVASISGFKVTRSSSVDAPNNGSLASHCHERLYTLGDDVDGRRRGMDNGRKGRMVRDGGFSLFEKLRLWRVWRCDHALSAVASGFSEYGNDHALSAGFTLSAPLGFFIGLFRIKLELATKQGDALGLSCVLSELSHSSTFSSRLLLQVFASIFLQSTCNLPSFDSCW

SEQ ID NO: 198845 - protein, 573 aa, Glycine max
  Coding DNA Sequence Number=SeqID_82067
  Gene Ontology: Mol. function=DNA binding; Cellular component =intracellular; Biological process=DNA integration
  Homolog annotation: Hit_ID=Q0ZCB7; Match level="QueryCoverage=93%, HitCoverage=45%, E-value=1e-96, Identity=34%"; Hit description =Integrase
MCQTIGNLKIDPIRMTLQLADYSIKRPFEVVEDVLVKVCHFTFPVDFVFMDIEEVDEISWILGRPFMLTAKCVVDMGNGNLEMSMDDQKVTFNPFETTKHPSDNKACFKALINAIDCLTNEEEKDLEACLEDLERLKEIPTGEDAMEELNKDNPAEKPKVELKALSMHLKYVFLEENKVKPIVISNDLSPEEEEWLIDLLRKHKEVIGWHISYLKGISPTYCIHMIMMEEEYRPVRHPQRRINPSIKEEVWKEVLKLLEANPISNSARVSSVQVVPKKRGMTVVRNKKNDLIPTQSFTGWRMCIDYRKLNEATRKDHFPLSFMDQMLVDKTEIDVIEKLPPLVNAKGIRSFLGHTGFYRRFIKDFFKIARPLSNLLNKEAVFKLDEECQETFQTLKYKLVSAPIMVAPDWSKEFELMYNASDYVMGVVVVIFIDHAAIKYLLTKADSKLRLIRWVLLIQEFNIVIRDKKGSENESLLLVAARPWFADIANYKATRIIPPDLNWNQRQRFLYDVRFYVWDNLHLFKIEADNLLRRCVIVATYPTMGVWAKSQRSVFLKRKTRGSRHQRLFKGKR

SEQ ID NO: 198846 - protein, 139 aa, Glycine max
  Coding DNA Sequence Number=SeqID_82068
MASVLCGPWVPISMRDREICNIISVCPASPVLEVLYGICTSSSDWEKEEGDWLVVGGGTVGGRTGDGGAGVLLDVGQVDHEVQQLKGQGVKSDPLCITKSHDQCGKIKLGSDGLGDLCERWGSKVEVAQDAPCLGQCGE

SEQ ID NO: 198847 - protein, 89 aa, Glycine max
  Coding DNA Sequence Number=SeqID_82069
MAGDGRFPLFEKLTLWCEQALSAAASGLSEYGSDHALSAGFALSAPLGFFVGLLHAKLELAAKRGDALHLSCALSELSQSSTFSSRRFL

SEQ ID NO: 198848 - protein, 83 aa, Glycine max
  Coding DNA Sequence Number=SeqID_82070
MIGNVEDVESNADKHKGEKNQREQCSLLKPQGPKKGTKLKGSQKTKRRRVIINPTETCQFSPNEYSILLKPANLIRHSNPTGR

SEQ ID NO: 198849 - protein, 118 aa, Glycine max
  Coding DNA Sequence Number=SeqID_82071
  Gene Ontology: Mol. function=binding
  Homolog annotation: Hit_ID=Q1SA53; Match level="QueryCoverage=84%, HitCoverage=29%, E-value=7e-30, Identity=66%"; Hit description=HEAT
  Pfam annotation: Domain name=HEAT; Domain location=36-72; Score=11.9; E_value=1.5; Accession=PF02985.12; Description=HEAT repeat
  Pfam annotation: Domain name=HEAT; Domain location=77-113; Score=7.1; E_value=5.8; Accession=PF02985.12; Description=HEAT repeat
  Pfam module annotation: Pfam domain module=HEAT::HEAT; Domain location=36-72::77-113
MEEALQLSRAKDIKERMAGMERLHQLLEVSRKSLSSFEVTSLINTFIELLKDNNFRVSQTTLQALSSAAIHISEHYKLHINTFFYVVFNHLGDTKQPIRAACCLLLTLMEVVHLLLTR

SEQ ID NO: 198850 - protein, 82 aa, Glycine max
  Coding DNA Sequence Number=SeqID_82072
  Gene Ontology: Mol. function=unfolded protein binding; Cellular component=endoplasmic reticulum; Biological process=protein folding
  Homolog annotation: Hit_ID=Q1S678; Match level="QueryCoverage=67%, HitCoverage=14%, E-value=2e-17, Identity=68%"; Hit description =Concanavalin A-like lectin/glucanase
MEILCNFHNREEPKDWKEKEYIEDPNDVKHEGYDSIPREIPYPNAKEDEEEDGKWKPPKMPNPAYKDHGKENNHLCCIAVKI

SEQ ID NO: 198851 - protein, 225 aa, Glycine max
  Coding DNA Sequence Number=SeqID_82073
MDNSSFFQIHPRAQPRSVTLNGWLAKPANWLSEKVFYVQDPCDERWLVVLQGKTIGVNLEDDDSTLDTCHSPFSTHMPTMNGEDEVDDKYGISKDKWNQFCQSRRDPSWEDSLEEQSAQHSFTAHGRKDVLTTTIGQLEHPGRVCVARVGEAVLIARDRTLTLTHPVELNVAPSVADNPPHSIALERVYEGSSIVHHMPLANDMVNVGVEEVRDADARIPIPTEK

SEQ ID NO: 198852 - protein, 47 aa, Glycine max
  Coding DNA Sequence Number=SeqID_82074
MTVALPSMQILKRVHMYGHAYVIPMNFPKWQQMVIALIALMLATALG

SEQ ID NO: 198853 - protein, 60 aa, Glycine max
  Coding DNA Sequence Number=SeqID_82075
MDADGRITLLFIAGLKGVIRVLEGTLFVYAELEIETSSQVTLVRLSTIASESGEDENRCE

SEQ ID NO: 198854 - protein, 35 aa, Glycine max
  Coding DNA Sequence Number=SeqID_82076
METLNSSKRTHFWEELLRDKYQEHKVEEFNALGKM

SEQ ID NO: 198855 - protein, 80 aa, Glycine max
  Coding DNA Sequence Number=SeqID_82077
MDSTQAECSHVVTQISSQHVISISDALLQSKMMTLADLMEATEVVYEVCNGIVLAKVIAVESENGWSYQSCSKCIKKALL

SEQ ID NO: 198856 - protein, 769 aa, Glycine max
  Coding DNA Sequence Number=SeqID_82078
  Gene Ontology: Cellular component=mitochondrion
  Homolog annotation: Hit_ID=Q10G00; Match level="QueryCoverage=95%, HitCoverage=94%, E-value=0.0, Identity=51%"; Hit description =Expressed protein
MVVKMMRWRPWPPLVSKKYEVKLVVKTLTLQGCDLVRTSAEKGFVLQIKWKGPKLTLSSLRRNAVARNFTKEVHPEQNDDVVLWDEEFHALCTLNAYKDNAFHPWEIAFSLFNGLNQRSKTKVPVVGTAALNLADFASVVDQKDFDLNIPLTVSGGSVESSPSLSISISLVELRAVQESTELVHNKAIVPVPVASANSPLVQSGETTLAEKDELSTIKAGLRKVKILTEFVSVRKAKKACHEEEGSEGNFSARSEDGEYNYPFDSDSLDEFEEGDSDEMKEDSSVRKSFSYGKLAYANAGGASYSSVTVNDEGEDWVYYSNHRSDVGILHKENSTVSATEPSVLQSSRRSILPWRKRKLSFRSPKSKGEPLLKKAYGEEGGDDIDYDRRQLSSDESLSLGKTEDDSAANRSSVSEFGDDNFAVGSWEQKEVMSRDGHMKLQTQVFFASIDQRSERAAGESACTALVAVIADWFQNNRDLMPIKSQFDSLIREGSLEWRNLCENQTYRERFPDKHFDLETVVQAKIRPLSVVPGKSFIGFFHPEGMDEGRFDFLHGAMSFDNIWDEISHAGRECTNNDEPQLYIISWNDHFFILKVEADAYCIIDTLGERLYEGCNQAYILKFDSDTVIYKMQDVARGSGKKTASDLQTVAEVLEQNERQIQPINGKEMDSSVETEEQLKSDQEEEVVCRGKEACKEYIKSFLAAIPIRELQADVKKGLISSTQTPFHHRLQIEFHYTQLLQSCVAPPVVAEPSMTVPETLALAVTEVSA

SEQ ID NO: 198857 - protein, 71 aa, Glycine max
  Coding DNA Sequence Number=SeqID_82079
MAREFSMDSLKELSPKEWTMNLTKKLVPKESTMASTKKLGPKIVDHELDQRVWPIGVNCELDPQLSKNLGK

SEQ ID NO: 198858 - protein, 1034 aa, Glycine max
  Coding DNA Sequence Number=SeqID_82080
  Gene Ontology: Mol. function=binding; Cellular component =intracellular; Biological process=translation
  Homolog annotation: Hit_ID=Q338A4; Match level="QueryCoverage=82%, HitCoverage=93%, E-value=2e-54, Identity=22%"; Hit description =Pentatricopeptide, putative, expressed
  Pfam annotation: Domain name=PPR; Domain location=191-225; Score =21.3; E_value=0.0034; Accession=PF01535.11; Description=PPR repeat
  Pfam annotation: Domain name=PPR; Domain location=226-260; Score =38.4; E_value=2.4e-08; Accession=PF01535.11; Description=PPR repeat
  Pfam annotation: Domain name=PPR; Domain location=261-295; Score =34.1; E_value=4.8e-07; Accession=PF01535.11; Description=PPR repeat
  Pfam annotation: Domain name=PPR; Domain location=296-330; Score=7.3; E_value=1; Accession=PF01535.11; Description=PPR repeat
  Pfam annotation: Domain name=PPR; Domain location=331-365; Score =20.8; E_value=0.0049; Accession=PF01535.11; Description=PPR repeat
  Pfam annotation: Domain name=PPR; Domain location=366-399; Score =21.1; E_value=0.0039; Accession=PF01535.11; Description=PPR repeat
  Pfam annotation: Domain name=PPR; Domain location=400-434; Score =32.5; E_value=1.4e-06; Accession=PF01535.11; Description=PPR repeat
  Pfam annotation: Domain name=PPR; Domain location=435-469; Score =33.4; E_value=8.2e-07; Accession=PF01535.11; Description=PPR repeat
  Pfam annotation: Domain name=PPR; Domain location=470-504; Score =24.5; E_value=0.00039; Accession=PF01535.11; Description=PPR repeat
  Pfam annotation: Domain name=PPR; Domain location=505-539; Score=8.0; E_value=0.83; Accession=PF01535.11; Description=PPR repeat
  Pfam annotation: Domain name=PPR; Domain location=682-716; Score =13.5; E_value=0.19; Accession=PF01535.11; Description=PPR repeat
  Pfam annotation: Domain name=PPR; Domain location=717-751; Score =40.3; E_value=6.6e-09; Accession=PF01535.11; Description=PPR repeat
  Pfam annotation: Domain name=PPR; Domain location=754-788; Score=6.7; E_value=1.2; Accession=PF01535.11; Description=PPR repeat
  Pfam annotation: Domain name=PPR; Domain location=823-857; Score =27.5; E_value=4.9e-05; Accession=PF01535.11; Description=PPR repeat
  Pfam annotation: Domain name=PPR; Domain location=858-892; Score =28.5; E_value=2.4e-05; Accession=PF01535.11; Description=PPR repeat
  Pfam annotation: Domain name=PPR; Domain location=893-927; Score =31.1; E_value=3.9e-06; Accession=PF01535.11; Description=PPR repeat
  Pfam annotation: Domain name=PPR; Domain location=928-962; Score =36.9; E_value=7.2e-08; Accession=PF01535.11; Description=PPR repeat
  Pfam annotation: Domain name=PPR; Domain location=963-997; Score =34.7; E_value=3.2e-07; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR; Domain location=191-225::226-260::261-295::296-330::331-365::366-399::400 -434::435-469:...
  Pfam module annotation: Domain location=:470-504::505-539::682 -716::717-751::754-788::823-857::858-892::893-927::928-962::963-997
  Subcellular localization annotation: CTP_CleavageSite=25; ConfidenceScore=5.46e-01
MRSLSKIRSWDSILLSQSHVLNFSNASKFSRTHRTTQQQLSNNKPSDTDASRALFNEITEILGADTVIPDQSPSGFLFPLETPHSEVGLKDQLDCTKGVCENAAQNVDILEDAQMGNMGEKDVSRVVSEITEIVRVENDSSSVEERLENLSYGLNSEVFHMVLKRCFKVPQLALRVFNWLKLKDGFSHTTRTYNTMLHIAREAKEFGLVKKLVEEMDECGIQKDVNTWTIIINHYGKARKISEALLAFENMKRCGCEPDAVSYGAIICSLCSAGKRDIAMEFYNEMVRKDMVLDVRLYKMVMNCMARSGDIAAVSLLGNDMIRLSVMPEKCVHGCMLKSFCISGSIEEALELIRELKSKDLDLEPENYETLVRGLCKAGRITDALEIVDIMKRRDMVDGRVHGIIINGYLGRNDVDRALEVFQCMKESGCVPTISTYTELMLHLFRLDRYEEACMLYDEMLGKGIKPDVVAITAMVAGHVSQNHISDAWKMFKSMECQGIKPTWKSFAVFIKELCKASQTDDIVKVLHEMQASKSRIQDKVLDLVITWMKNKGELTVIEKIQQVHKASILDPEKFKESDKQVPLRIKVEEDAKVDQSKTEIDCSLIHPKLKNYSKQDVHEIRRILSSSTDWSLIQEKLEKSTIQFSPELVMEILQSCNMHGSSVLKFFSWIGKQTGYRHTAESYNIAIKIAGCGKDFKHMRSLFFEMRRNSYPITSETWTIMIMVYGRTGLTEMAMNCFKEMKADDYVPSRSTYKYLIIALCGRKGRKVDDALKIYGEMISAGYVPDKELIETYLGCLCEVGRVLDARRCTDSLQNFGYTVPLSYSLFIRALCRAGKVEEALALHEEVGEEKFIIDQLTFGSIVHGLLRKGRLEEALAKVDVMKQNGITPTIHVFTSLIVHFFKEKQVEKAIETFEEMLHSGYEPTIVTYSALIRGYMNVGRPIDAWDIFYRMKLKGPFPDFKTYSMFLTCLCKVGKSEEGMRLISEMLDSGIVPSTINFRTVVYGLNREGKHDLARVVLQQKSELRRKRKLIT

SEQ ID NO: 198859 - protein, 266 aa, Glycine max
  Coding DNA Sequence Number=SeqID_82081
  Gene Ontology: Mol. function=heat shock protein binding; Cellular component=mitochondrion; Biological process=protein folding
  Homolog annotation: Hit_ID=Q2QRM4; Match level="QueryCoverage=76%, HitCoverage=78%, E-value=9e-54, Identity=52%"; Hit description=Co -chaperone Hsc20 family protein, expressed
  Pfam annotation: Domain name=DnaJ; Domain location=107-176; Score =36.1; E_value=1.2e-07; Accession=PF00226.21; Description=DnaJ domain
  Pfam annotation: Domain name=HSCB_C; Domain location=190-264; Score =48.9; E_value=1.7e-11; Accession=PF07743.4; Description=HSCB C -terminal oligomerisation domai
  Pfam module annotation: Pfam domain module=DnaJ::HSCB_C; Domain location=107-176::190-264
  Subcellular localization annotation: CTP_CleavageSite=70; ConfidenceScore=5.21e-01
MSKKKLCMPLSTLLRRSLTSFPQHFTSNFSPQIKLCLHHSSPTFAPPSHNPACDYYYSLRFFGKSLCSKSAEEIQRGCWNCHTVPHSEPFLVCELCQCIQPVDSSIDYFDIFGVERKYDIEGENLEGKYKDWQKKLHPDLVHSKSQKERDFAAEQSARVIDAYRTLSKPLSRGIYLLKLYGEEVDEEQTISDPELLAEILEIREAVEEATNSETLNHILSEMQEKLQNWSNAFGLSFQSQNFEEAKMAIRRMTYYSRVIDEAVKKL

SEQ ID NO: 198860 - protein, 136 aa, Glycine max
  Coding DNA Sequence Number=SeqID_82082
  Subcellular localization annotation: CTP_CleavageSite=52; ConfidenceScore=5.11e-01
MSILTLGSKKGEGKFPSKEKAKKEGKGNSQSKSGRKRKGKKGNSQSKSGRKRKEKKENSQSKNGRNGENTETFSSLTSYPELRRSEFLIGGYVGARASLLSTTPPFVAMTQEPVARGDTLRLSAPRHSVTPSVIDE

SEQ ID NO: 198861 - protein, 846 aa, Glycine max
  Coding DNA Sequence Number=SeqID_82083
  Homolog annotation: Hit_ID=Q2R2E6; Match level="QueryCoverage=41%, HitCoverage=72%, E-value=2e-59, Identity=34%"; Hit description =Expressed protein
MEKKRKIVQYRERLDRTLASPDLANDEMLKKLVGSQLPPSSEPEVEGFRDKLVETKTAEVSHFLDMLRSASSDDSGRSYTSHTDWKLKQDGDEFRVMYREGPEGTPFHTMLVEGFVDGPVDSTIPTFKILSAECLQKTRIGEQLSLVRVKVSWPLSLREAIVHYYLFEYFQDDLIVVLTNSVPDSKNATGTLCGFNNEAIPEAREVVRVDLVGGFALQKTVSSMTSHDKGEFNKALGDPLYVRIREALYNTSGSKAMNGKELQQVASVLPAEDLVESKQGGEKDASKEDMSNQYANNVMPMAVNNKVLDSSKTFNEIVEVDCEEIVQGKEKNASKEDISNQYANNVMPMAMNTKELGGRKKFAEIVEIDIEEIVLIEEDTEEVKDIQNKEVEMSVLRGKRSIYIRSEVEHALETLEKAISMVREQRLHSRVVSSSVADEESPFMKNDDKVDTYSSKLTQPSSKNEVSVEVPNGDISEGASQEALGNNPGIQNSRCTGTDPNSKDVNSNKVVPTSSEQNVSTSILLSQAVSHPLGNGAILDQTTISNKQLNTDSVQDTSLDHADKSSRQKKLNTIVTQSHEGTGSEPPADGGREVQPNVSFCDKFFMNKEKPSTQPTIDLIQQQLAKMKFEDGKPLKLKVLIAESMFEGQCAPWQYALLVKLLEEDSSCFIDEGPWMILDHYLTVQCWYPEFVSTTTTIEMTMVDSNMLDVKRGRFMIVCIEVYLNKPMVGKVWLRGHKYNIEYEGLHHIYASCGCYGHLTRDFKNGNDHLVDATVQEGVQNQPLLLVPGVTMENNSLTEKANNQSHSIGINDMTHRKIGDQHLIHAWDECYAIKGANLGGVTWRNL

SEQ ID NO: 198862 - protein, 143 aa, Glycine max
  Coding DNA Sequence Number=SeqID_82084
  Subcellular localization annotation: CTP_CleavageSite=49; ConfidenceScore=5.00e-01
MAPPSLTRHTTAIQWHFFRKPQRNSAMVPPWPPFNNTETSLPPIISPLPAYYYKKPYLKLNNSHTSNRQYITSPFRKGRRWMLFQQPQRRRRRRQGCEIKTGTVRIQVMVTSERRWLGSSATVRGRRGAANLQEQQCSGVVWV

SEQ ID NO: 198863 - protein, 102 aa, Glycine max
  Coding DNA Sequence Number=SeqID_82085
MAEYNTRSQDFRKFEDSIKEKLKEMSENIRKIAYCVGGQETHISALNHQNTVLMERTNQKVHHGGSSHGSGSFHRDRSYMATRQEKIDFPWFDGSDLNGWLF

SEQ ID NO: 198864 - protein, 232 aa, Glycine max
  Coding DNA Sequence Number=SeqID_82086
MEKNEETTMEEKVKQKINGASMRSFNGDFPPWRSSGRQKRRGEGRHHPLGNKPWKKELHHKECVLDKKLEYDALTEEKKERRGEHKIEGIKEGEKWNFEVCLIRLSFIKVHENPKVHENPRAFFSSSSLILLKPLAHGSDLNNVAYKDEPFIMAEQTKHVFYAQDPSSSRCSMVLHGRISGVCHENDDSTLDVYETLSFSTRMPTIIEEHEVYQAHANCNDHDEGLQENIPT

SEQ ID NO: 198865 - protein, 311 aa, Glycine max
  Coding DNA Sequence Number=SeqID_82087
MACTKLSREMAFEVAQQISDNILKKSLEEQCTQVVVTINQYFGRSHGSQTSSLLNLQQLAQLTENIKKKLKDDLELEEKHKEERLIEKLKRRLNTEGSCAANPSREEPGSDMLDQHELYIDKHAPCLVAIGRDYEGVSTIHHMHLTEDMVRVEVEEVRDTDAPVPIPTEKDTYGTKKSVQHVDRVDPDDDFFYKLLMASMEMCKNDFESNKRGRDVEAKLHGESKVIQRSFDDNNDDDKGDEKKLKDQSKNNSSESRTIQEIKIRIKKNSRTQEESLETRIKIQGSRSQESRSRFKTQDSRMKKRLNQDKY

SEQ ID NO: 198866 - protein, 176 aa, Glycine max
  Coding DNA Sequence Number=SeqID_82088
  Pfam annotation: Domain name=GRP; Domain location=56-159; Score= -29.1; E_value=0.073; Accession=PF07172.2; Description=Glycine rich protein family
MMLHLFYDMNSIDSLSSHCLPLLDEGTANFQGHGSEEDLSDHEGELQKDEVEAENAGEVVSAQHEQANQQADVEYNERDVEAKDQQSYPRRGYQNHRGGRGGGGRRGYSNGRGGRSGGRGGYQNGRNQYYDQPGNYYPRNNYYNNRGRGGRGGGYYNNHGAGGQVNHVAGDVGVQS

SEQ ID NO: 198867 - protein, 127 aa, Glycine max
  Coding DNA Sequence Number=SeqID_82089
MQHDDELWEQLIKQCIQKPDMVGQCFIILAFYARFTYISTSYQDPVVEIHNYFTQGSCCRDSGYASTIFESSSYYIGGYATNDLESTSYYVGAKPDTIVENPSFKYGHDVSNDFENTCSKSMLTSPP

SEQ ID NO: 198868 - protein, 615 aa, Glycine max
  Coding DNA Sequence Number=SeqID_82090
  Gene Ontology: Mol. function=RNA binding; Biological process =regulation of translation
  Homolog annotation: Hit_ID=Q9FNK3; Match level="QueryCoverage=99%, HitCoverage=100%, E-value=1e-145, Identity=48%"; Hit description =Arabidopsis thaliana genomic DNA, chromosome 5, P1 clone:MCL19
  Pfam annotation: Domain name=KH_1; Domain location=141-211; Score =58.7; E_value=2e-14; Accession=PF00013.19; Description=KH domain
  Pfam annotation: Domain name=KH_1; Domain location=311-372; Score =60.3; E_value=6.4e-15; Accession=PF00013.19; Description=KH domain
  Pfam annotation: Domain name=KH_1; Domain location=38-101; Score =53.0; E_value=9.7e-13; Accession=PF00013.19; Description=KH domain
  Pfam annotation: Domain name=KH_1; Domain location=392-458; Score =68.8; E_value=1.7e-17; Accession=PF00013.19; Description=KH domain
  Pfam annotation: Domain name=KH_1; Domain location=546-608; Score =72.7; E_value=1.1e-18; Accession=PF00013.19; Description=KH domain
  Pfam annotation: Domain name=KH_2; Domain location=141-181; Score =0.3; E_value=0.11; Accession=PF07650.7; Description=KH domain
  Pfam annotation: Domain name=KH_2; Domain location=311-358; Score =5.1; E_value=0.03; Accession=PF07650.7; Description=KH domain
  Pfam module annotation: Pfam domain module=KH_1::KH_1::KH_1::KH_1::KH_ 1::KH_2::KH_2; Domain location=141-211::311-372::38-101::392-458::546- 608::141-181::311-358
MGETGKRYRSQRDHDGDRKNQKRQMTDRDDRGNDELIVYRILCPDEVIGSVIGKNGKVINSIRQETRAKVKIVDPFPGAKDRVITIYSYVKEKEGVEIDDEFAGKEPLCAAQDALLKVHVAIVNSIAALGDSGKKRKDRDECQILVPSSQSANIIGKAGATIKKLRSKTRANIKVTAKDAADPTHTCAMEFDNFVLITGESEAVKRALFAVSSIMYKFGPREDISLDTAVPEAPPRIIIPSIPSDVPVYPPGGLYPASDPIVTPRAVPQIIGTTNVPDLQGYADAENSWPLYTSALPVVSGVGASRSEELIVRMLCPSDKIGRVIGKGGSTIKSMRQASGARIEVDDSKANYDECLIIITTTESPSDLKSMAVEAVLLMQGKINDEDDTTVSIRLLVPSKVIGCIIGKSGSIINEIRKRTKADVRISKGDKPKCANANDELVEVGGSVDCVSDALIQIILRLRDDVLRERDTSHNPSIGDLVLNPFPPVAAPMPYDHRAESGAGLGMLSSSSLYGGYGSLSMEENGYGSLSLYATQLYGGLPPPSTLDMLIPANAVGKVLGKGGANIANIRKISGASIEISDNKSARGDRIALISGTPEQKRAAENLIQAFIMAT

SEQ ID NO: 198869 - protein, 365 aa, Glycine max
  Coding DNA Sequence Number=SeqID_82091
  Gene Ontology: Mol. function=pyridoxal phosphate binding; Cellular component=cytosol; Biological process=arginine catabolic process
  Homolog annotation: Hit_ID=Q38IW9; Match level="QueryCoverage=78%, HitCoverage=60%, E-value=1e-161, Identity=97%"; Hit description =Ornithine aminotransferase
  Pfam annotation: Domain name=Aminotran_3; Domain location=56-358; Score=279.4; E_value=6.9e-81; Accession=PF00202.11; Description =Aminotransferase class-III
MAATRPVQCLLRRVCRGSRSFGVATEVNASSSSSSQKIIDKEYEHSAHNYHPLPIVFSQAKGTSVWDPEGNKYLDFLSGYSAVNQGHCHPKILKALQEQAQRLTVSSRAFYNDRFPVFAEYVTNMFGYDMVLPMNTGAEGVETALKLARKWGYEKKRIPKDEAIIVSCCGCFHGRTLGVISLSCDNEATRGFGPLLPGNLKVDFGDAEALERIFKEKGEHIAAFILEPIQGEAGVIFPPDGYLKAVRDICSKYNVLMIADEIQTGLARTGKMLACEWEEVRPDIVIHINITCRHRVNKILDPGTPPMVSYLVPSPSKGGGRVRPSAVNAKLVDIPNNILDLKLKLFGKKKACVVDSIDTILLLSI

SEQ ID NO: 198870 - protein, 108 aa, Glycine max
  Coding DNA Sequence Number=SeqID_82092
MAACKSVNEYEGDKWGPDPRRKRTALGSAASVIARQASTLTANHSALNVAALKTFVVVVVLLVASDDFHLEPAIVGMHKEGTKVQREEGLRKLVLSINGCDNGMHPFY

SEQ ID NO: 198871 - protein, 83 aa, Glycine max
  Coding DNA Sequence Number=SeqID_82093
MVRTSFLRLGDLEYIKIGGTKNKKWRNNEEKKKSTTRSSLDALLSAQLALSMTKDAGAKQRRYARDSAPALSGQQVLSGQNRN

SEQ ID NO: 198872 - protein, 128 aa, Glycine max
  Coding DNA Sequence Number=SeqID_82094
MVQEDPSREVNYMGIQNRHGFQGYNQGRLSGFNQGPIGFNQGPPGFNQGRTFTQGSSWRNHPRNQYNKEHKGQPAQNLNQGVDLHEKTSKLEETLNQFMQVSMSNYRSTEASIKNLEIQVGQLAKQMA

SEQ ID NO: 198873 - protein, 149 aa, Glycine max
  Coding DNA Sequence Number=SeqID_82095
  Gene Ontology: Mol. function=nucleic acid binding; Biological process= DNA integration
MSLYTKFMKDILTKKGKYIDNESIVVGGNYSAMIQRKLPKKFKDPRSVTIPCTIKKESVEKTLIDLGASINLMPLSMCKRIGNLKIDPTRMTLQLADHSITRPYGVVEDVLVKVHHFTFLVDFFIMDIEEDTEIPLILGRPFMLTAKCV

SEQ ID NO: 198874 - protein, 481 aa, Glycine max
  Coding DNA Sequence Number=SeqID_82096
  Gene Ontology: Mol. function=transporter activity; Cellular component= membrane; Biological process=oligopeptide transport
  Homolog annotation: Hit_ID=Q9CAS0; Match level="QueryCoverage=99%, HitCoverage=74%, E-value=1e-148, Identity=55%"; Hit description =Putative peptide transporter; 37139-33250
  Pfam annotation: Domain name=MFS_1; Domain location=39-413; Score= -37.7; E_value=0.017; Accession=PF07690.6; Description=Major Facilitator Superfamily
  Pfam annotation: Domain name=PTR2; Domain location=1-397; Score =273.3; E_value=4.9e-79; Accession=PF00854.12; Description=POT family
  Pfam module annotation: Pfam domain module=MFS_1::PTR2; Domain location=39-413::1-397
MVVVTLTAWLPELHPPPCTPQQQALNQCVKASTPHLGALLTGLCLLSVGSAGIRPCSIPFGVDQFDPSTDEGKKGINSFFNWYYTTFTVVLLITQTVVVYIQDSVSWKIGFAIPTVCMFCSIIMFFVGTRIYVHVKPEGSIFTSIAQVLVAAYRKRKVELPREKHVDGVFYDPPLIGTNVLSKLPLTNQFRGLNKAAVIMEGELNPDRSRANKWKLVSIQQVEEVKCLARIFPIWAAGILGFTSMAQQGTFTVSQALKMDRHLGPKFQIPAGSLGVISFITIGVWVPFYDRIMVPTLRRVTKHEGGITLLQRIGIGMVFSILSMVVAALVEKVRRDLANANPSPLGIAPMSVLWLVPQLVLMGLCEAFNVIGQIEFFNRQFPDHMRSIANALFSCSFAGASYVSSALVTTVHHVTRTHSHPDWLTNDINAGRLDYFYYLVAGTGVLNLVYFLIVAQRYHYKGSGDLQDNAQDVELASKGKS

SEQ ID NO: 198875 - protein, 318 aa, Glycine max
  Coding DNA Sequence Number=SeqID_82097
  Gene Ontology: Mol. function=catalytic activity; Cellular component =intracellular; Biological process=metabolic process
  Homolog annotation: Hit_ID=Q681Q1; Match level="QueryCoverage=28%, HitCoverage=96%, E-value=5e-25, Identity=63%"; Hit description=Auxin- induced protein-like protein
  Pfam annotation: Domain name=Auxin_inducible; Domain location=1-93; Score=147.6; E_value=3.3e-41; Accession=PF02519.5; Description=Auxin responsive protein
  Pfam annotation: Domain name=PPR; Domain location=165-199; Score =14.2; E_value=0.16; Accession=PF01535.11; Description=PPR repeat
  Pfam annotation: Domain name=PPR; Domain location=266-300; Score =15.4; E_value=0.11; Accession=PF01535.11; Description=PPR repeat
  Pfam module annotation: Pfam domain module=Auxin_inducible::PPR::PPR; Domain location=1-93::165-199::266-300
MAIRLPSALSARHILRRSNAAATSLDVPKGYFAVYVGEGEKKRFVIPVSLLNQPSFQELLSIAEEEFGFTHPMGGLTIPCTEDIFDDSVSYMSKSNVFEFLHQFRVSGNVSAIKKLHAQLLRRGMLFLSHHLHTQLIATYAACLPNNTRQSLNNFFKCMNSTNPLHFNATISDFCRKGFPFLALSSFSFMHTNGVPLDTYALCSTLTASSKVKDLNLGKQIHAQVEKSGWSSSVFVGSALIDLYSKLSNVKDAAHVFDEISDKNTVCANALLSGYGEAGLWVQELELVRKMPVLKLKHDHFTLSAALRACTGLSAVEM

SEQ ID NO: 198876 - protein, 403 aa, Glycine max
  Coding DNA Sequence Number=SeqID_82098
  Gene Ontology: Mol. function=RNA-directed DNA polymerase activity; Cellular component=endoplasmic reticulum membrane; Biological process=DNA integration
MDEEIKAIKKNNTCELVSLPKGHKAIGVKWVYKAKKNAKGEVERYKAQLMTKGYSQKVGTDYDEVFALLARLETVRLIISLVAQNNWRIHQVDVKSSFLNGVLEEEGNENKVLKFKKALYRLKQATRAWNAQIDKYLHERNFIKCPYEHPLHIKAQNNDVLIVCLYVDDLIFTGCNSSMFDDFKKEMMKEFEMTDIGCMPYYLNIEVKQKDKGIFITQEGYAKGVIKKFKMNDSNPINTPMEFGIKLSKHEEGERMDPTLFKSLVGSLRYLTCTRPDILYAIGVVSPYMENPTTTHLKAAKRILQYIKELGLLQEEPTKIFVDNKSAIALAKNPDYHDQNKHIDMCYHYIRECIARKDVHLEYAKTHDQVVDIFTKPLKKEDFARLRSLIGVTKSSLRGDVEI

SEQ ID NO: 198877 - protein, 104 aa, Glycine max
  Coding DNA Sequence Number=SeqID_82099
MTTCTTPVRPGISVIKLEDDRLGLERNNRLFFLDEVISGRTADNTLICTHEIAHKLFSASTEELHIVPIIFLMMMMRLWPSSCMLATTDGLCCGAERDVAATFG

SEQ ID NO: 198878 - protein, 119 aa, Glycine max
  Coding DNA Sequence Number=SeqID_82100
MTSSSINAIVYYDGAIITTKHGSTFVSSLPKIIQVDNKMSFDALKQVIGNNISLPNGKVVNTGHACCKMMRTYDYVFYLRQNLQAHMLGVIYCHQRHTHTNMCTSTTNLCQLFEFGGFG

SEQ ID NO: 198879 - protein, 134 aa, Glycine max
  Coding DNA Sequence Number=SeqID_82101
  Homolog annotation: Hit_ID=Q1S1N3; Match level="QueryCoverage=97%, HitCoverage=52%, E-value=8e-10, Identity=23%"; Hit description =Calcineurin-like phosphoesterase family protein, related
MCEEYIGVVPPENALVGLTLKLKWLKEHMLTLPTEPTPQQLVAHCRAYIVGHIGGVLMLDKSENKVHLKYLPLLANLNRSWAWYNMSFIQPRVECQLSYSLAIRWSDRGLWFSRIPRGDVIGYRLRFDNMSNEE

SEQ ID NO: 198880 - protein, 324 aa, Glycine max
  Coding DNA Sequence Number=SeqID_82102
MWKPEWLVSKANQIKGSPIATDELDVTSSDKQDIEAGESGIEGILSRLEKQRNRSFGLDLDNISFENNEDKDEWDHRTTTDAVATGLENGSIASSSSSTSSHLSGSQIKHDPYGSQLGTENLRNSLKPETWRSWIVQRTGFRDTDFEDAEIVPSETEKGGMSDASGQPDILNRREFSSEHINRETGLYSLDGNTNHNDIKSRIQNLESELSSILHLLRSSSDKITMQMICCVWLCALTGASKEFHRLCASKELLCDLIGVGVATSYHTLSFLHCEETRRMVQKSSSDGLAKLSDAWEFQENEIMNAQGRLRSIRAKLSVLEGKM

SEQ ID NO: 198881 - protein, 42 aa, Glycine max
  Coding DNA Sequence Number=SeqID_82103
MGFIASHFHERLYTLGDDVTTCWGEILLSPGQGRYKKKIRLK

SEQ ID NO: 198882 - protein, 103 aa, Glycine max
  Coding DNA Sequence Number=SeqID_82104
  Subcellular localization annotation: CTP_CleavageSite=35; ConfidenceScore=5.66e-01
YKDCTSSSLSSLHSVSSSSSRSSRTSSSSLLFCSRGKKAKALFPESQKNMPHKGVYYDSYSNERVIYIGPIGNSLLTNNLMGFAFLTSTKRNQCQLLLSTIGD

SEQ ID NO: 198883 - protein, 217 aa, Glycine max
  Coding DNA Sequence Number=SeqID_82105
  Gene Ontology: Mol. function=transporter activity; Cellular component= membrane; Biological process=transport
  Homolog annotation: Hit_ID=Q4AHD3; Match level="QueryCoverage=97%, HitCoverage=36%, E-value=1e-64, Identity=57%"; Hit description =Putative outer membrane protein, probably involved in nutrient binding
  Pfam annotation: Domain name=Plug; Domain location=54-157; Score =41.9; E_value=2.2e-09; Accession=PF07715.5; Description=TonB -dependent Receptor Plug Domain
MIISYPGYRDFEQSITVDKNIKLDLPLNQEEEERTAKIDEVIISGVKKDKNLSTAQMGTETLSIKNIEKLPVLFGEKDVMKTIQLLPGIKSNGEGSSGFSVRGGATDQNLILLDEAPVYNASHLLGFFSTFNSDALKDASIIKGNSPAQYGGRLSSVMDVKMKDGNNKDYNINGGIGLISSRLSVEGPIQKEKSSFIVSGRRTYADLFLKGSEDFKD

SEQ ID NO: 198884 - protein, 171 aa, Glycine max
  Coding DNA Sequence Number=SeqID_82106
MSLPSAVHVSSIIKHGASGDWEICSSVVFRIAKKEGVETRIVITERAGWTKSVSYLCFPLISDERCLAPFVAQYVKSRDVPKIKRKQAYAIRENSVIFFLQKAVASGGSNLARLGELGGKLLPYFAINRGRSEGRRGSAFLALLILSKLLRKIISVKKTKPMRFRNVSVTF

SEQ ID NO: 198885 - protein, 143 aa, Glycine max
  Coding DNA Sequence Number=SeqID_82107
  Gene Ontology: Mol. function=RNA-directed DNA polymerase activity; Cellular component=chromatin; Biological process=chromatin assembly or disassembly
MAEGDEAGRQKFIHLTFNLCFLKIRVAVQAYVHEAAELQGGGVRGGGWCINVEGDWTAVEVELHGQRGVISDNRSELYEPLNAQDDVSTVDGKDVKVHGERRALKEDGSLVAYMGARNDGVVTDSNLEGKGGGGGKTEMLGHP

SEQ ID NO: 198886 - protein, 76 aa, Glycine max
  Coding DNA Sequence Number=SeqID_82108
MTHHNFQVQAIGLFAQATCALEFGLPRPFNQRLLVLHVGGGAVKQRVKFKTKRSKLSRIGCWTNGLTYLKKKRGLN

SEQ ID NO: 198887 - protein, 220 aa, Glycine max
  Coding DNA Sequence Number=SeqID_82109
  Subcellular localization annotation: CTP_CleavageSite=37; ConfidenceScore=5.20e-01
MFAHSIKGCRPLGRTCGVLIPSPSCLFRFFRRFPQINVGGDSARIPFVEHASRESRVALPPKGLCQSFVVPVTPSKVIRPPITRAFIEKYCTQRQAQGDAPQAADALPPHQAGPAGSFDTEQYLRHLVRQQAANHRAHVQTHDCLYQMSLSLQSQGFTSFPCPTPDQFRAEVAWPGDWPEAQAGEAPVEAPAEAPDEADEAREDEEMTDLLDFLGGSRAT

SEQ ID NO: 198888 - protein, 66 aa, Glycine max
  Coding DNA Sequence Number=SeqID_82110
MHAQRACLTERELVTGHLVDVHTLSVRSNKGFAGRASCVLSTMLSDFTFSRVLLALGELAFLAKWV

SEQ ID NO: 198889 - protein, 289 aa, Glycine max
  Coding DNA Sequence Number=SeqID_82111
  Homolog annotation: Hit_ID=Q47522; Match level="QueryCoverage=16%, HitCoverage=59%, E-value=2e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMVIDMTNAENVKESILKEIPIAKIDVMKLDLSSMASVRKFASEFISSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 198890 - protein, 77 aa, Glycine max
  Coding DNA Sequence Number=SeqID_82112
  Subcellular localization annotation: CTP_CleavageSite=32; ConfidenceScore=5.41e-01
CPCSPYFCSLYFYSPFTTSSSSSSRSLRSKLRAFHVYAPEPTPGPAPDYAELAGCGLAAGSYEPGGVCSEGGVASPK

SEQ ID NO: 198891 - protein, 140 aa, Glycine max
  Coding DNA Sequence Number=SeqID_82113
MKSDSSDGGRDSRGDSDDGSEGGIVVTTEVEVVVESGSNIDNNNGGDDNGGGGCANGGDGGGNNVVVGDNSCDGMMVVEVVAGCGGDSSGVGSGGDDNSGGMVEVEAAMSQLTLWREGDAGLMDASSKGRKYAESPPMFI

SEQ ID NO: 198892 - protein, 942 aa, Glycine max
  Coding DNA Sequence Number=SeqID_82114
  Homolog annotation: Hit_ID=P0ADR8; Match level="QueryCoverage=45%, HitCoverage=95%, E-value=0.0, Identity=84%"; Hit description =Hypothetical protein ygdH
  Pfam annotation: Domain name=5_3_exonuc; Domain location=604-703; Score=111.2; E_value=3e-30; Accession=PF01367.11; Description=5'-3' exonuclease, C-terminal SAM fold
  Pfam annotation: Domain name=Lysine_decarbox; Domain location=180 -322; Score=192.7; E_value=8.5e-55; Accession=PF03641.4; Description =Lysine decarboxylase family
  Pfam module annotation: Pfam domain module=5_3_exonuc::Lysine _decarbox; Domain location=604-703::180-322
MDLLSQLEVDMLKRTASSDLYQLFRNCSLAVLNSGSQTDSSHELLSRFENFDINVLRRERGVKLELINPPEEAFVDGRIIRSLQANLFAVLRDILFVNGQLSAADRLQNQDVTDSAHITNQVFSILRNARALHVGEYPNTVVCWGGHSINAVEYQYCRNVGTQMGLRELNICTGCGPGVMEAPMKGAAVGHAQQRYHDSRFIGLTEPSIIAAEPPNPLVNELIIMPDIEKRLEAFVRIAHGIVIFPGGVGTAEELLYLLGILMNPQNSDQVLPLILTGPKESADYFRVLDDFIVNTLGEAARRHYKIIIDDAAEVARLMKKAMPQVKEYRRETGDAYSFNWSIRIAPDLQVPFLPTHENMANLKLFPNQPAEKLAADLRRAFSGIVAGNVKEMGIREIREKGPYQLQGDADLMHRMDELLQGFVAQQRMKLPGRRQPAGCRYHYVASSAYNRRAQSDPPPCTPCRVRPVARPAWRRCIRYWATRDQRKWWRCLTAMTDSLAGVISYCRTIKRVARRCRTIYSRRWPRCSGPLRPAGVSCWVAEHDEADDLAATLAVKMADAGHQATIVSTDKGYCQLLAPSIRIRDYFQKRWLDVPFIEQEFGVAPAQLADYWGLCGISSSKIPGVPGIGPKSARELLLQFGSLEALYQQLDQVPEKWQKKLRDHRATAEVCRQVSTLKRDLVLQGNLNTLRYQGAANAAIVQRMKQKFCEIICATAGRQARAGQAGFSPIPHRRSQRRDSAKYEAGLAFVAPSADCRPDPAHMHGHFFAVVIQLARLDLRVYALLLQRRVHHCQVLRNFFIALFHWQLEVEDRLTAPAVDQPFGHQAGDAHRFFHHVAHQPADVAARRAEFETVFAAVRNLSGIHQAWRHRAVIHRVDPHAALHQLIGPAAGAGTEIDRIHAAAQPFVPLIGRHEHMECFFQLQRRAAWRIGRELQARNAH

SEQ ID NO: 198893 - protein, 62 aa, Glycine max
  Coding DNA Sequence Number=SeqID_82115
  Gene Ontology: Mol. function=hydrolase activity, hydrolyzing O -glycosyl compounds; Cellular component=outer membrane; Biological process=peptidoglycan turnover
  Homolog annotation: Hit_ID=Q6D8H3; Match level="QueryCoverage=95%, HitCoverage=15%, E-value=1e-13, Identity=61%"; Hit description =Membrane-bound lytic murein transglycosylase A
MKGHWAKYALTGAFLALLAGCSSKPTDRGQQYIDGKLEQPLGLVNEPNAKGRKVNGRDFGLQ

SEQ ID NO: 198894 - protein, 114 aa, Glycine max
  Coding DNA Sequence Number=SeqID_82116
  Gene Ontology: Mol. function=GPI anchor binding; Cellular component =anchored to membrane
  Homolog annotation: Hit_ID=Q9SUC9; Match level="QueryCoverage=51%, HitCoverage=17%, E-value=6e-16, Identity=72%"; Hit description =Uncharacterized GPI-anchored protein At4g28100 precursor
GAGVGGEEPGGEDGAAAAAVKGGAATAGGVDTAEELVGEVEAADLGLVCDMDARKTRYAIKEVNDCIFAFKLNCGHWLVIGSRVWWFVLVSEKVATLFWEVERKGLREEKEGTG

SEQ ID NO: 198895 - protein, 81 aa, Glycine max
  Coding DNA Sequence Number=SeqID_82117
RSCPQDTEWTRRSPMGSWSCQALITGLCQFYRVPVTSSKGIRPPTNRAFIKKYCVSRQAQWKHHSSMGMASSGQQTHRHHL

SEQ ID NO: 198896 - protein, 213 aa, Glycine max
  Coding DNA Sequence Number=SeqID_82118
VAVSPPKPPPKPHPEVDDPLYLMTLTIQELFLRPYQVRWDATVFGVVNPDFPLYIKHEDLFEIAHGGQCLSISVLQLWIQHLTETCMRAGNSDIYEFLEQQSIQRSGQSQFESESYIKSWMHSSQRDVYLGAYLNGGHWQMVVILPKEHLVVWFCSLHNRPDNYLKGIINSLNQRLRLGGLSSRQKGSTECGYYVMHWMSTIILGTFRNNGEA

SEQ ID NO: 198897 - protein, 81 aa, Glycine max
  Coding DNA Sequence Number=SeqID_82119
  Gene Ontology: Mol. function=oxidoreductase activity; Cellular component=mitochondrion; Biological process=metabolic process
  Homolog annotation: Hit_ID=Q1T4K0; Match level="QueryCoverage=91%, HitCoverage=14%, E-value=4e-29, Identity=76%"; Hit description =Aldehyde dehydrogenase; Carbamoyl-phosphate synthase L chain, ATP- binding
PFVESLSSCPKHGVHKAWKAPQRYLMFGAHMLSLPKVSDFFTMLIQRVSPKSYQQAFGEVYVTQKFLENFCGEQIYQNKTH

SEQ ID NO: 198898 - protein, 99 aa, Glycine max
  Coding DNA Sequence Number=SeqID_82120
MVSGNRLQRECNRLPGLKGQEARRAASNRLPRGCNRLPGLEMKAAGCGGLCFHVLKLYNSSLASGNRLPRLCNRLPEMKSLKIPLLLAFSGYETHCVAA

SEQ ID NO: 198899 - protein, 50 aa, Glycine max
  Coding DNA Sequence Number=SeqID_82121
MSGFSRVYDLIDYQVFPKVIKNTLFDYIKNLIDDIVLESFLDFGKNTLID

SEQ ID NO: 198900 - protein, 235 aa, Glycine max
  Coding DNA Sequence Number=SeqID_82122
MEFFSAESFDCIQAFQNLGLIPFMSLQLPVYPELVKAFYCNLEIQDNTLISEVFGIKMVIDQSLFHHLTQLSSDGVPFEGRQLDWAHLVRYRMHKALRLNAPLPYPHLVTLFFRHFQIPLDSEPYVPIKRSFLIGAVVIASFGYRKEHDGSWVKKGAQPTDEEGNLPVEDNSTLLRRLMDKFDGLQTFVGDKFDAMELQVDMRFDAMESRITKVEEDVSFIRTCFDPPPPPLSSS

SEQ ID NO: 198901 - protein, 54 aa, Glycine max
  Coding DNA Sequence Number=SeqID_82123
MRLKVLMNYMTIEGGLTITVRKSEGDKGNHEVLEKVGLQAENQTRTKPCAGGAG

SEQ ID NO: 198902 - protein, 42 aa, Glycine max
  Coding DNA Sequence Number=SeqID_82124
ALSVALSTKEQKPLRALSPARRPARDPTEAQAKPVGRAERAI

SEQ ID NO: 198903 - protein, 92 aa, Glycine max
  Coding DNA Sequence Number=SeqID_82125
MSQNFTDCLTMGVKFLEAVKQRLYAIKQWSPDEIRTSLWLAWAPKLLQGEGTSLPGRASYFRSKHQLAWVSSSSTGRAAIAPSAHFPIHRHA

SEQ ID NO: 198904 - protein, 308 aa, Glycine max
  Coding DNA Sequence Number=SeqID_82126
  Gene Ontology: Mol. function=ATP-dependent DNA helicase activity; Cellular component=cytoplasm; Biological process=DNA unwinding during replication
  Homolog annotation: Hit_ID=Q8P3D2; Match level="QueryCoverage=99%, HitCoverage=46%, E-value=1e-151, Identity=84%"; Hit description=ATP -dependent DNA helicase
  Pfam annotation: Domain name=UvrD-helicase; Domain location=1-308; Score=136.3; E_value=8.2e-38; Accession=PF00580.11; Description =UvrDREP helicase
MKNLVSRAKNAGLSPEQAMAAARSNREKEAASVYERYQLRLTAFNAVDFDDLIRLPVQILEENPEIALAWRERIGYLLVDECQDTNDAQYRLLKQLAGEKGNFTCVGDDDQSIYAWRGANPENLQQMGRDYPTLEIIKLEQNYRCSNRVLRAANALIANNPHEHLKKLWSDQADGERIRVWECRNSEHEAEKVAAEIAFVAQSRNVPWSDFCILFRGNFQSRPLEKAMQLLRIPYHLTGGTMFLERQEVKDTLAWLRLLVNPDDDTAFMRAVQSPKRDVGAGTLARLAELAQEKDMLMAHVDETIGAL

SEQ ID NO: 198905 - protein, 88 aa, Glycine max
  Coding DNA Sequence Number=SeqID_82127
MVPNAWLTRKWCFFGHLNFIITFSVHKLKGCPSHSSVWEVVEVLAIRIAIPWITGLNRAHAFTKRKGHTLRRPYRTRARARVMGEAEE

SEQ ID NO: 198906 - protein, 81 aa, Glycine max
  Coding DNA Sequence Number=SeqID_82128
  Subcellular localization annotation: CTP_CleavageSite=59; ConfidenceScore=5.47e-01
MDKAISRICPLDLMMKYVQFQAKCTSTTKRSFSALSVIEESGRPSTSRSRTKREISALSAAGVFSQAQRTTGTKLESTYPH

SEQ ID NO: 198907 - protein, 84 aa, Glycine max
  Coding DNA Sequence Number=SeqID_82129
AQYANRLSPRVGRFINAAGTTGFPTGKRAVSATQLMYAYAVTSALHGVEHNLRKDFMLQPPWDENVENKFIIHYTYGCDYKGIL

SEQ ID NO: 198908 - protein, 223 aa, Glycine max
  Coding DNA Sequence Number=SeqID_82130
NTSSEKIPGASSSSDAEINSSVRQDSLLLKLSTEYARKDVLKSIEENPSAAFGHLNFLKKLHNPLTSDETLGKVIQIEAIIDQFASTVQKKRENGTKLDAQKQAHILLLEKARAAQHEVERLTKEAKEGSSEIKDCDDNISSWEATITDLLFQVDDLRQKIVTEQAKRKELQEKAANSIQKLVDEKGREGLKAFSASQAVADEAKVMESADQVLTKEMATLKK

SEQ ID NO: 198909 - protein, 68 aa, Glycine max
  Coding DNA Sequence Number=SeqID_82131
  Subcellular localization annotation: CTP_CleavageSite=59; ConfidenceScore=5.43e-01
MAMDLNFSSTTRALSSFAFRASADDPITASPKLSVLSSRRIPCLANSLEYPRVVVTETPCDERRDAFV

SEQ ID NO: 198910 - protein, 241 aa, Glycine max
  Coding DNA Sequence Number=SeqID_82132
ELDRQRQVENGVVGIPRKYLEGVLFPNVEGLVDLAAIDVFLAYHNHKESPVVAMIADLYDTFDRRCEESNARIVCCTPALYVGLVSHLFLQEGRPVYPLQGYRSCVEKGKANWDQLLASMGGRLLIGSLARRKEESRFYLHANDDRELRGSSNGIIGGYHKWLGVRTQGLDWLPNLKTVRDNEVKASEESDDVQALKAKLERARVVEEKFKAAIVSSSSEEVKGIITGQRHDLEGRAKGLP

SEQ ID NO: 198911 - protein, 146 aa, Glycine max
  Coding DNA Sequence Number=SeqID_82133
MADFSRGRLYCFARILDRVILLASAGWFYYNAFVHDEPLTITVSTISQLQSLRQQAKFTDLPGEDTQAERMRNESDLNELIDRLTAGISANPRKRWVILQMNSTVEKMYLEDTEARERFIDYLVQINNILGISSTNGAFALKLIFF

SEQ ID NO: 198912 - protein, 161 aa, Glycine max
  Coding DNA Sequence Number=SeqID_82134
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=99%, HitCoverage=18%, E-value=2e-30, Identity=45%"; Hit description =Putative Na/H antiporter
MAYRSINQNVLANAPCLVRILVDKGLSGSNHLAGNQVSHHVAVLFFRGPNDREALCYGWRMVEHHGISLTVMRFVQSDQVQVQPLRQQHGGIDLDEPRVLTVQTDRDIQKQHDENLIHEFWMRCGDDDVVDYVEKVVSNSEDAVAAIRTMDDIHDLFIVGR

SEQ ID NO: 198913 - protein, 124 aa, Glycine max
  Coding DNA Sequence Number=SeqID_82135
MTTHKRRELSSHAPTHQEKHTHPMHIYDSKGFHNNNPHIKRGISLLTTYTQEDKGSLRVAGGGALESTRNAIIANEERLSDYIENPNRVARGGALESTRNATIANEERLSDYIEVRDELLTLGD

SEQ ID NO: 198914 - protein, 51 aa, Glycine max
  Coding DNA Sequence Number=SeqID_82136
MSQVYQSGEDRVESKDLDPKIGSTGHSCPLSPNVQSSSSYFCDLFRSYHTW

SEQ ID NO: 198915 - protein, 91 aa, Glycine max
  Coding DNA Sequence Number=SeqID_82137
MARRNPQNLSQKNDDLGLIHRWIVVKFEYHVYNPILSILTVGNCKVMSELRKKESHEASTSGGFNLFFVSLTFENSIGAVGGKTGGISGNL

SEQ ID NO: 198916 - protein, 501 aa, Glycine max
  Coding DNA Sequence Number=SeqID_82138
  Gene Ontology: Mol. function=RNA binding; Cellular component =intracellular; Biological process=mRNA processing
  Homolog annotation: Hit_ID=UPI000016338B; Match level="QueryCoverage =97%, HitCoverage=28%, E-value=1e-123, Identity=46%"; Hit description= RNA binding / structural constituent of ribosome
  Pfam annotation: Domain name=S1; Domain location=411-489; Score=17.6; E_value=0.0045; Accession=PF00575.13; Description=S1 RNA binding domain
VSSETGRVTLSLKQTACSSTDASFIQDYFLMDDKIARLEYCGSGASDTKWDEGFNIGMVAKGKVKAVEDVGLVISFEHYNDVFGFIANYQCNFSPSHMSGSIVEALVLDVGKADKLVELTLKPEFINRSKESSISRTNKKVLSIPENDYTIGYASVSDYNAQRFPHKQYQNGQSVVATVMALPSPETSGRLLLLVDVVNETSSSSKRTKKKSSYKVGTLVEAEITDIKTLELKLKFGFGLYGRIHITEVYYGNVLENPFSSYKVGQTVTARIVAKPNESDGNRKGSQWELSVRPEMVTGSSDIDDVSENLEFKIGQCVAGYVYKVESEWVWLTISRNVRAQLYILDSATEPSELEDFQNRYHVGQPVSGHILSVNMEKKLLRLVVRPFSTLSCGTSEEPLTNVVDKDLTAYVHEGDILGGRVSKILPGVGGLLVQVGPRTYGKVHFTELADTWVPDPLSGYHEEQFVKCIVLEVSHTVKGTIHVDLSLGSSNVKLSQDSAV

SEQ ID NO: 198917 - protein, 128 aa, Glycine max
  Coding DNA Sequence Number=SeqID_82139
  Homolog annotation: Hit_ID=Q5W7C9; Match level="QueryCoverage=98%, HitCoverage=55%, E-value=2e-26, Identity=70%"; Hit description =Unknow protein
MGESLTEQCRVKVEGLRVMNFFSRRRSNDAAAVRQRMQALSGMIGRKASVGGFLSSPSNPRAQPWTGGGNYQAGIGKNTNGESTLLGPTLDTERRKLGGANGIRYPSSPSRKRWILGAVRIDPGNAVA

SEQ ID NO: 198918 - protein, 84 aa, Glycine max
  Coding DNA Sequence Number=SeqID_82140
MAKLCLVPYIVIPPKFKVPDFDKYRGTTCPMNHLKIYCRKMGAYSKDEKLLMYFFQESLTGAAFTYISIILIWLRIGCSYKACV

SEQ ID NO: 198919 - protein, 100 aa, Glycine max
  Coding DNA Sequence Number=SeqID_82141
  Homolog annotation: Hit_ID=Q8RLZ8; Match level="QueryCoverage=57%, HitCoverage=10%, E-value=1e-15, Identity=67%"; Hit description =Chlorogenate esterase
  Subcellular localization annotation: CTP_CleavageSite=70; ConfidenceScore=5.09e-01
MNYTNNKRILTRSALMLAMLGSLAGCGSDSDDTSTPSTTKPPQLSPAVGVKMTGSCSDLLGFQYNNTVISSATLQEAGTLTVANKPIGAHCLVKGYMDQR

SEQ ID NO: 198920 - protein, 101 aa, Glycine max
  Coding DNA Sequence Number=SeqID_82142
  Homolog annotation: Hit_ID=Q9LHM6; Match level="QueryCoverage=87%, HitCoverage=5%, E-value=6e-35, Identity=79%"; Hit description=Pre -rRNA processing protein RRP5
  Pfam annotation: Domain name=S1; Domain location=22-93; Score=47.1; E_ value=5.8e-11; Accession=PF00575.13; Description=S1 RNA binding domain
MTCLSEIKKASALEEEVFTHSDVKPGMVVKAKILSVDSFGAIVQIPGGVKALCPLRHMSELEISKPGKKFKVGAELVFRVLGCKSKRVTVTHKKTLVCFYM

SEQ ID NO: 198921 - protein, 391 aa, Glycine max
  Coding DNA Sequence Number=SeqID_82143
  Gene Ontology: Mol. function=RNA binding; Cellular component =intracellular; Biological process=mRNA processing
  Homolog annotation: Hit_ID=Q9LHM6; Match level="QueryCoverage=90%, HitCoverage=19%, E-value=1e-100, Identity=54%"; Hit description=Pre -rRNA processing protein RRP5
MKLWGVVAEVNEKDLVVSLPGGLRGLVHASDAVDPIFDDKIELVSCVVLRLDDDKKEKGSRKIWLSLRLSLLHKNYNLDVVQEGMVLAAYVKSIEDHGYILHFGLPFFMGFLPKNSSAGKSQAPAVNLLLILSGMIEPSSICEGWGGEVKIGKLLQGLVRSIDKVRKVVYLSSDPDTITKSVTKDLRGLSIDLLVPGMLVNACVKSILENGVMLSFLTYFTGTVDLFHLQNIYPGKNWKDKCSESQKVVSRILFIDPSSRAVGLTLNPHLVQNRAPPSHVKIGDIYDNSKVVRVDRGLGLLLEVPSIPEPTPAFVSISDIAEEIPKLEKKYKEGNHVRVRILGLRYLEGIATGVLKVVIVFLFGEWVMWRMRMGYLERWRESVSEGENIEN

SEQ ID NO: 198922 - protein, 132 aa, Glycine max
  Coding DNA Sequence Number=SeqID_82144
  Homolog annotation: Hit_ID=Q9LHM5; Match level="QueryCoverage=88%, HitCoverage=49%, E-value=1e-08, Identity=41%"; Hit description =Arabidopsis thaliana genomic DNA, chromosome 3, P1 clone: MEC18
MAPHSKKPQKKNDSVDKPKIDKASKKIFKPKKREQNIAVAAAKSEALSLPLEDEVPDFPRGGEFSAKGRNDYDEFGAEDPSKKTRKKKKGKNASGKSNEAADDWGSLSGNGITGKLPRRVNKITLRVGCSSL

SEQ ID NO: 198923 - protein, 219 aa, Glycine max
  Coding DNA Sequence Number=SeqID_82145
  Gene Ontology: Mol. function=nucleic acid binding; Biological process= DNA integration
  Homolog annotation: Hit_ID=Q1S4N1; Match level="QueryCoverage=75%, HitCoverage=13%, E-value=1e-40, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MGHEAIIFKFMNQPHGEVAKVVDPDEEVHEEEYLFVDTCFSSIESSQNWLIDSGCTNHMTNNKDLFKELSNASTLKVQVENGAISTNKDTKLISNMLYVPEIDQNLLSVGQLVEKGFKLLFKNKSCLIKDANDKDILKVKMRGNFFALNPLEEEKIAFPIKENVSVSTSFEIEAPKSRSGAIEEKSKVIVQELTNKLIQLSEDALREFFSGLWLERKMK

SEQ ID NO: 198924 - protein, 135 aa, Glycine max
  Coding DNA Sequence Number=SeqID_82146
  Gene Ontology: Mol. function=protein serine/threonine kinase activity; Biological process=protein amino acid phosphorylation
  Homolog annotation: Hit_ID=Q2QDF4; Match level="QueryCoverage=52%, HitCoverage=16%, E-value=7e-22, Identity=56%"; Hit description=CDPK -related protein kinase
  Subcellular localization annotation: CTP_CleavageSite=25; ConfidenceScore=5.68e-01
MTPRSFPAPTSSSDPTSAIPKSRTSSSSRAVPTPRIAPKTRRKHLILKEGWRFKKGELKGQQVAVKVIPKAKFYDAFEDQDNVYIVMELCEGGELLDMILSRGRKYSEDDAKVVMVWYTEILSQSSPVTWAQPKH

SEQ ID NO: 198925 - protein, 82 aa, Glycine max
  Coding DNA Sequence Number=SeqID_82147
MSGVGREKPTPLGAGMGDKFTPLSGFEGRGGLNQLDGIIDAKEEEESNGGKEKGKKLEMLLPIIASSNGKQWSESCLLLLNV

SEQ ID NO: 198926 - protein, 526 aa, Glycine max
  Coding DNA Sequence Number=SeqID_82148
  Gene Ontology: Mol. function=DNA binding; Cellular component=beta -galactosidase complex; Biological process=DNA integration
  Homolog annotation: Hit_ID=Q1SS72; Match level="QueryCoverage=98%, HitCoverage=36%, E-value=1e-162, Identity=54%"; Hit description =Integrase, catalytic region
VKYPLHSVLSYSRLSPSHKNFIMSITAPTELNSYAEASRFDCWIKAMQTKLKALQQNQTWILTTLPPHKTAIGCRWVYKIKHNVDGTIERYKACLVAKGYTQMEGLDFLDTFSPVAKLTTIRLLLALAALHNWHLRQLDVNNAFLHGDLNEEVYMKLPLGLIVDNPNLVCRLQRSLYGLKQANRQWFTRLSSFLLSQGFHQSLTDHSLFLYSDNDNDITDILVYVDDIILTGNNLETIAYVTKLLDQTFSINDLGIMKFFLGLEVARSSHGIHLCQRKYVLDILSDFGMLGSHPTSTHMDYSTRLSASMGTPLSETSASSYRRLIAQLIYLTNTRPDIAHAVLRYLKGTPGSGIFFVAQGTLTLKAFSDSDWAGCCDTRRSITGFSVYLGESLISWWSKKQSTVSRSSSEAEYRALASTTCELQWLTYLLHDFPVPFLQPATLYCDNQSAIQIASNPIFHERTKHIEIDCHIVRDKVNKGLLKLLPVSSSMQLADIFTNPLSRALFQGLYFKLEMMNIHSQLAGGS

SEQ ID NO: 198927 - protein, 69 aa, Glycine max
  Coding DNA Sequence Number=SeqID_82149
  Gene Ontology: Mol. function=serine-type endopeptidase inhibitor activity; Biological process=response to wounding
  Homolog annotation: Hit_ID=Q1S278; Match level="QueryCoverage=91%, HitCoverage=91%, E-value=1e-19, Identity=73%"; Hit description =Proteinase inhibitor I13, potato inhibitor I
  Pfam annotation: Domain name=potato_inhibit; Domain location=7-69; Score=106.1; E_value=1e-28; Accession=PF00280.8; Description=Potato inhibitor I family
MSVINGKFSWPELVGVQGTVAEATIERENPSVNAIIVPLGSVVTTDLRSDRVWVWVNKDGIVNRVPKIG

SEQ ID NO: 198928 - protein, 519 aa, Glycine max
  Coding DNA Sequence Number=SeqID_82150
MVSVATLQHQVKLANPEGSGMLAVQACGSDDFLFLRAVSGSLPLSAFQCALLEHLNVATSQLHPNSWFLVKHDEPSSGIVPLSTVIPPTGEGVVEVSPSMPSSILAKRKCDNDTRVSGRKKSRAPSSLRAVRQAGLPMAPSTVQAPASAAPAVATHAPPPSPVAFVQEISTSLIAEVSASAALVGPVMAPPSTIVVPLLSASVATTSAPEMPPLPFSTPLVSPSAVLASTSPSFSSHPNLPLEKYGDLRGEWITTPGGSEQSGILGGWVKRLKVANTTVAFDEPMRSNHRLSSKVGSVLAKFLCSRLDGDELFERYKGLWREKNELVGEVESATAEKDKLTKVVADLEAQLKESESELEEELLIYKKEAVEENEKDFHKAIRQVGFFDKDLDLGLFDPFKDMRDVVLLDKKDIVAKKEDAVEEQDVRARTIHRLHLEFGGVLWPMHKTDRVDLVFDKPIEMRQGLPRADLGFDEPLEKRDSPRPLEKRDSPRAGLGFDEPLEKLNSPRANLEFDEPLEK

SEQ ID NO: 198929 - protein, 194 aa, Glycine max
  Coding DNA Sequence Number=SeqID_82151
MRSLITLEENGQWHQVALSKVASLEAEVFKWRASVRTIWRVKHPKVAKATFAFVEAVWSNHQLSFQVGSVLAQLLCTRLDGDKLFEHCKGLQREKNELVDKVESTAAEKDELAKVVVDLEAWLKESESKLRASKEKEVIKELEEELLVYKKEVVEQHEKGFHKAVRQARFFVKDLDLGHFYPFKDLNDDVLLDE

SEQ ID NO: 198930 - protein, 384 aa, Glycine max
  Coding DNA Sequence Number=SeqID_82152
  Gene Ontology: Mol. function=DNA binding; Cellular component =membrane; Biological process=DNA integration
  Homolog annotation: Hit_ID=Q1SS72; Match level="QueryCoverage=91%, HitCoverage=24%, E-value=7e-65, Identity=35%"; Hit description =Integrase, catalytic region
  Pfam annotation: Domain name=zf-CCHC; Domain location=247-264; Score =9.5; E_value=0.027; Accession=PF00098.13; Description=Zinc knuckle
  Pfam annotation: Domain name=zf-CCHC; Domain location=285-302; Score =13.8; E_value=0.0052; Accession=PF00098.13; Description=Zinc knuckle
  Pfam module annotation: Pfam domain module=zf-CCHC::zf-CCHC; Domain location=247-264::285-302
MNELLLNSESYLYLHPSEHPVVALVSPALDSSNYHSWSRSMITALSAKNKVEFVNGKALEPLKTDRTYGAWSRCNNMVVSWLVHSVFISIRQSVLWMDKAEEIWNDLKSRYAQGDLLRVFDLQQEASSIKQGTLSVTEYFTKLPVIWDEIENFRPDPVCSCTVKCTCSVLTTIAQRKLEDRAMQFLRGLNEQYNNIRSHVLLMNPIPTIPKIFSYVAQQERQLTGNNSLPSFNLETKEGPSINVVKSVCEFCGRIGHNESVCYKKHGVPPNYDGKAKGYNTRNGKTCTYCGKLGHTIDVCYKKHEYPPGFKFNNGKVIANNVVAVEGKATDDQIQRQESQELVRFSPEQYKALLALIQQPYAGNSASTKPQVASISSCSSNDAT

SEQ ID NO: 198931 - protein, 256 aa, Glycine max
  Coding DNA Sequence Number=SeqID_82153
MSTLDNLKEATRTTLVQALGLDKPNRLATLVLVEVTTLGTRQLSSMLKGLDELVTLLLVKITTLNTRQSPSTLDNLFHPQVDSELGKFRFSKGSSNPRSTLGESRFSNGSSNPRSALHESHFSKGLSNPRPALGESRIFKGQSNPRSILGESRISKGSSNQGPPLVSLDASLQACQTQDPPRVNFAKTQDAHILGPKLIKPKVLLGEPLHFQISHSQKSKEYKSVGTPNTQGPPLVQKLKVHPWYALLQKPKACPW

SEQ ID NO: 198932 - protein, 382 aa, Glycine max
  Coding DNA Sequence Number=SeqID_82154
MIDLGFDEPLEKRDSPRADLGFDEPLEKRDSPRADLRFDQPLEMRDSPMIDLGFDEPLEKRDSPRADLGFDEPLEMRDSLRADCSLMASSLIMAISWTSSFVSSSTCIYSSLCCSWNNNLIVDGSPTSMGIMAFVPYLSWKGVSLGLEDDSVGCICLIVVLGMFNRGYKRSKYVHSPYGEGPRGAQAMKIVRRNAWNVYEFLAVYASLCEIEGVCPECQPIVAGTHHFGCKGVSLRYEGRRSLHEVLHNLLGVYGGSLECPMDDGLKMLGLFGAGQLREQVCSGVTFLRIFDDDACPAFLHVGCVIHVKVPPVWGVLRTMLPSSLQFKILQNLFDGVVRLNHHLVTLNVWSETSNPALLSIMKYVVGEVDGKLVLPFLWCEG

SEQ ID NO: 198933 - protein, 407 aa, Glycine max
  Coding DNA Sequence Number=SeqID_82155
  Subcellular localization annotation: CTP_CleavageSite=67; ConfidenceScore=5.34e-01
MTMLASQVEYLTSQIKLALMSLSTSSLAVLRCSFPIFFFFCNTGLAWGKMASNNNVVMWIYTEYIIQAFLVDGQENMVPLSGFQRSIVVLAFDSPYSHYLSYQGGELHLKIQCGDEGFSLVDIASCLYSFSYKAKEWTEDLGHHKVGDYDGDNHGVDTVDVEVPDGVEVAFTGLTGLPSIGKSTHNVDARIFVGGAFVSLDLLLYPFLYRHCDSYVDPLGVLRVSLLLELKCSTWVSKLSMELRGSPLYQVRNASRCSSRLVVPSNRFRLSGFQTYGCRRVVCPSGHFVGRVLIFLNVKHKPPDGRVFVMVAWGGLEPSKGVSRLRPDNLLTMDEKRGYGWPLLGGQEEGPVKQRSLMLKGCYGGIIEYLTQDKEATSYSNDEVVRDNLSIESPTAKGMTLMPFCQG

SEQ ID NO: 198934 - protein, 207 aa, Glycine max
  Coding DNA Sequence Number=SeqID_82156
  Gene Ontology: Mol. function=RNA-directed DNA polymerase activity; Cellular component=intracellular; Biological process=RNA-dependent DNA replication
MCINYTDLNKACPKDAYPWLSIGRLVNGAYGFHVLRFLDVYLGYNQIRMYALDEEKMTFITEDVNFCYKVMSFGLKNASATYQRLMDQIFKHQIRRNVEVYMDDMVIESHTIAQHVADLEEVFGEIHKYDMRLNPERCTFGVGRGKFLGYTITHQGIEANLDKCTTILKMHSPTNIQEVQKLNSRLASLSRFLSKHAEKVKSFYKLL

SEQ ID NO: 198935 - protein, 119 aa, Glycine max
  Coding DNA Sequence Number=SeqID_82157
MLISWKFYLFTKARSHFSEENTKTISSLTSYQELRRSEFLIGGYVGAKASLLSTTPLFVTMTQELVARGDTLRLSAPRHSVTPSVIDEQRPMWSSAPFPEMSASSGGDFFKSHKLSRTT

SEQ ID NO: 198936 - protein, 94 aa, Glycine max
  Coding DNA Sequence Number=SeqID_82158
MVTSLLQLDSMNLFVKAQAWFNPITQGMTILIANTSTTFHGDERLGNTHAMHAKCNYEIEMPCRNLPFGGRATRDSRDACSTKGIRAESPPTFI

SEQ ID NO: 198937 - protein, 60 aa, Glycine max
  Coding DNA Sequence Number=SeqID_82159
MDGIEELDHSRYQATQRPTQDQMNKIASSTWRAGSGHGLIPGSGCCSISLGQRVKPVNDS

SEQ ID NO: 198938 - protein, 197 aa, Glycine max
  Coding DNA Sequence Number=SeqID_82160
RDSKVSMTDLVSAEDDGAEDDVSLCVLSSFSSYRKQKVYTDNHSGISARQRDSKVSMTDLVSAEDDGAEDDVSLCVLSGFSSYRQQKVYTDNHSGISARQRDSKVSMTDLVSAEDDQKVYTDNHSGISASQRDSKVNMTDLVSAEDDFAEDNVSLCVLSGFSSYRMQKVYTDNHSGISARQRDSKVNMTDLVSAEDD

SEQ ID NO: 198939 - protein, 256 aa, Glycine max
  Coding DNA Sequence Number=SeqID_82161
  Gene Ontology: Mol. function=monooxygenase activity; Cellular component=endoplasmic reticulum; Biological process=electron transport
  Homolog annotation: Hit_ID=Q1S9Q8; Match level="QueryCoverage=52%, HitCoverage=81%, E-value=2e-64, Identity=85%"; Hit description=E -class P450, group I
EENMELKRRKNNSDDYAWNDYLSLPFTQNVISESLRMANIVNAIWRKAVKDVDIKGYLIPKDWCVVASLTSVHMDGMNYENPFEFNPGRWENIGTGTNNNCFTPFGGGQRLCPGIELSRLELSIFLHHLVTTYRVGGRQEVNLVVNWARWGKGGRGLEEGDKYGEEGLDDGKKVFGMVDRVKGQVWVVRSSGKGPRGHGFSKAHGKSGIVHGNWPKGFQSLHAQNNEGATNGAVAYHDPQGRGHKEERPKNLATWV

SEQ ID NO: 198940 - protein, 257 aa, Glycine max
  Coding DNA Sequence Number=SeqID_82162
  Gene Ontology: Mol. function=hydrolase activity, acting on glycosyl bonds; Cellular component=beta-galactosidase complex; Biological process=carbohydrate metabolic process
  Homolog annotation: Hit_ID=Q5CCP8; Match level="QueryCoverage=91%, HitCoverage=27%, E-value=1e-127, Identity=87%"; Hit description=Beta- D-galactosidase
  Pfam annotation: Domain name=Glyco_hydro_35; Domain location=33-257; Score=324.7; E_value=1.6e-94; Accession=PF01301.10; Description =Glycosyl hydrolases family 35
METTSFSKLFFFFSFLVLCSHVARASVTYDRKALLINGQRRILFSGSIHYPRSTPDMWEDLILKAKEGGIDVVETYVFWNVHEPSPGNYNFEGRYDLVRFVKTIQKAGLYAHLRIGPYVCAEWNFGGFPVWLKYVPGISFRTDNEPFKRAMQGFTEKIVGMMKSERLFESQGGPIILSQIENEYGAQSKLQGAAGQNYVNWAAKMAVEMGTGVPWVMCKEDDAPDPVINTCNGFYCDKFTPNRPYKPMIWTEAWSGW

SEQ ID NO: 198941 - protein, 400 aa, Glycine max
  Coding DNA Sequence Number=SeqID_82163
  Gene Ontology: Mol. function=hydrolase activity, acting on glycosyl bonds; Cellular component=beta-galactosidase complex; Biological process=carbohydrate metabolic process
  Homolog annotation: Hit_ID=Q5CCP8; Match level="QueryCoverage=99%, HitCoverage=46%, E-value=0.0, Identity=82%"; Hit description=Beta-D -galactosidase
  Pfam annotation: Domain name=Glyco_hydro_2_N; Domain location=137 -281; Score=-58.2; E_value=0.057; Accession=PF02837.8; Description =Glycosyl hydrolases family 2, sugar binding domain
MYHGGTNFGRTAGGPFIATSYDYDAPLDEYGLIRQPKYGHLKELHRAIKMCERALVSTDPIVTSLGEFQQAHVYTTESGDCAAFLSNYDSKSSARVMFNNMHYSLPPWSVSILPDCRNVVFNTAKVGVQTSQMQMLPTNTQLFSWESFDEDIYSVDESSAITAPGLLEQINVTKDASDYLWYITSVDIGSSESFLRGGELPTLIVQSTGHAVHVFINGQLSGSAFGTREYRRFTYTGKVNLLAGINRIALLSVAIGLPNVGEHFESWSTGILGPVALHGLDKGKWDLSGQKWTYQVGLKGEAMDLASPNGISSVAWMQSAIVVQRNQPLTWHKTYFDAPEGDEPLALDMEGMGKGQIWINGQSIGRYWTAFATGNCNDCNYAGSFRPPKCQLGCGQPNQR

SEQ ID NO: 198942 - protein, 110 aa, Glycine max
  Coding DNA Sequence Number=SeqID_82164
MEKNPKEKCKAVMTRSRMAIQAEEGRANQKVEGFKQQLANRLALEPVDDLVELEEIVEEAEGDEEEETPIKECQERIKKKEEEEKEKEIKEEKEKEKEKEIKEEEEKEKN

SEQ ID NO: 198943 - protein, 35 aa, Glycine max
  Coding DNA Sequence Number=SeqID_82165
MVTWNMLGCTPSFCILMQLPINGLLEVWFLWLSCI

SEQ ID NO: 198944 - protein, 75 aa, Glycine max
  Coding DNA Sequence Number=SeqID_82166
VAWPGDQPSSSGRGGASTAQEPVTEEPTTPAAAEEESISAQTPQPSPPSAPTPEETQPSSALDLNEDQPQEEQDV

SEQ ID NO: 198945 - protein, 72 aa, Glycine max
  Coding DNA Sequence Number=SeqID_82167
MGAKYLEVVKRGSHPNNGWSPDEIWTRSPLDGEKVGGMTIICLRPPLGFLSPNDKGRKICLCAFITRLEKSK

SEQ ID NO: 198946 - protein, 91 aa, Glycine max
  Coding DNA Sequence Number=SeqID_82168
MKRQILRPLSFRSSEAGDKCAETDFAPFVIQILRPSGGSNLPRPGELGGKLLPYFPINRGRSEGKKGSALLIFNRSSTFFVRSSSFFSLQP

SEQ ID NO: 198947 - protein, 130 aa, Glycine max
  Coding DNA Sequence Number=SeqID_82169
ERPSQRVDLFLSCKVLWYLYLLVHLQRTTCPRLERATRPKLGGLHVLALRGLHVLTIRGLHALTCRGLHVLALRGLHALTLGTSYPHRQRTTRPRLERTTRPHHQRAARPHLQRTTCPRLERATRPHLGY

SEQ ID NO: 198948 - protein, 206 aa, Glycine max
  Coding DNA Sequence Number=SeqID_82170
MVHLALTELVSFEQAIIEPESKAAMEEELRAMEEPHMGAGHIDITLQQRVYWSEMGLQSEVTLTGQENKVSIKEGFTYWVSTSVEQNMEYQSYCRCTTDILKRFHMLDCNSTQTPLWYKVGEGRKGQIAKRILRYVKGFLDYGFSNHGKNVSDEIFGYYDSVVIKLTACTARYVFKMCRAFISWCSKESVVALFSCETSMRACQAL

SEQ ID NO: 198949 - protein, 346 aa, Glycine max
  Coding DNA Sequence Number=SeqID_82171
  Gene Ontology: Mol. function=nucleotide binding
  Homolog annotation: Hit_ID=Q33AG5; Match level="QueryCoverage=79%, HitCoverage=44%, E-value=3e-69, Identity=50%"; Hit description =ATPase, histidine kinase, DNA gyrase B-, and HSP90-like domain containing protein, expressed
MRFIYIPNLFYYADINSHYNTVICLKQLSKTLACKPPPNDFDDIGSHGTKVVIYNLWLNDEGIYELSFDDDAELVTQVSGFNGESVRILATHGYYAERWATHGAEKNLCKKTVQLQSHISYRLRFSLRAYVSMLYLRKFSNFSIILRGKLVDQFNIVDDLIYSKVIPYKPQLAMASNEAIVETKTTIGFIKEAAEIKVTGFNVYHKNRLIKPFWKVVADGSSKGRCVVGVLEANFIEPAHDKQDFERSVLFIRLENKLKQMTMDYWREHCHLVGYQPPNLKSQKNVVKEAHIRKSAEHSTNPQNQLLADQQDTSLVAEHQSGLSQSVVGLAVTGMQGLRHEHLVSS

SEQ ID NO: 198950 - protein, 328 aa, Glycine max
  Coding DNA Sequence Number=SeqID_82172
  Homolog annotation: Hit_ID=Q9XGX0; Match level="QueryCoverage=64%, HitCoverage=65%, E-value=2e-44, Identity=48%"; Hit description =Putative zinc finger protein SHI
  Pfam annotation: Domain name=DUF702; Domain location=111-260; Score =300.2; E_value=3.9e-87; Accession=PF05142.3; Description=Domain of unknown function (DUF702)
MAGLFSLGGGGGGGRGNNNNNQSSEIPPAETLFWYSSKNDDVSSFHRGFELWNQQDQHHHHHHHVMHPHARPLLQRDLYSSGVGPSRGGGGVSDDDHSSSRSAALVAMRAAAAAEGGISCQDCGNQAKKDCPHMRCRTCCKSRGYDCQTHVKSTWVPASKRRERQQALAALQQQQQEQQQQQQRDISKRPRDPTSCTRLPSSGLEEEGNFPSVVSSPAEFRCVRVSCVEDADDRYAYQTAVSIGGHVFKGILYDYGPENNNHNNSNNNSNNNYTAGETSASVVAAAQPLNLAAISSAALVDTSSLYSAPVNAFMAGGSGTQFFPHTRS

SEQ ID NO: 198951 - protein, 58 aa, Glycine max
  Coding DNA Sequence Number=SeqID_82173
MVVLSAELNSTRRELGWVDEFQQLSGDLDWVPGKKGLGLKKDQDQDQWHSLLFVAVKD

SEQ ID NO: 198952 - protein, 180 aa, Glycine max
  Coding DNA Sequence Number=SeqID_82174
  Homolog annotation: Hit_ID=O21999; Match level="QueryCoverage=28%, HitCoverage=33%, E-value=4e-22, Identity=100%"; Hit description=LacZ- alpha
MGLYQSYRVPVPPPPAWSCHRDIGKDRARRTPSGTKEVQQGPGVSSSDYGPLSVLRSACHPSKVIRPPTNRAFIKKYCAPMQAEGETPQQPGDGQQQATNAPPPPPEPLSSSIKRYKDTLDMHSRPAGMQAWHWPSFYNVVTGKTLALPNLIALQHIPLSPAGVIAKRPAPIALPNSCAA

SEQ ID NO: 198953 - protein, 80 aa, Glycine max
  Coding DNA Sequence Number=SeqID_82175
MESYCQQMKPNIDHDTEPTKYFLCEKVGVVEGEETASFIICDDLSVLPNVLVTSVNLLQKLGIKDMNALEEQTVDIRKRE

SEQ ID NO: 198954 - protein, 70 aa, Glycine max
  Coding DNA Sequence Number=SeqID_82176
GLVGACALSATLARLACITHPSSKFFLALSRKSGALSGWLAKPADWLSEKLKISTSQTCLINLKYKGNDY

SEQ ID NO: 198955 - protein, 95 aa, Glycine max
  Coding DNA Sequence Number=SeqID_82177
  Gene Ontology: Mol. function=DNA-dependent ATPase activity; Cellular component=nucleus; Biological process=DNA replication initiation
  Homolog annotation: Hit_ID=Q8H0G9; Match level="QueryCoverage=89%, HitCoverage=13%, E-value=1e-17, Identity=41%"; Hit description=MCM protein-like protein
YGQGVHIAIRHLESMIRMSEAHARMHLKQHSFRKYVTFKKNYNDFLLYILCELVQNAFLSEEIVTGFASGLTYLDVEVDNLCNKLISDNFKTVRK

SEQ ID NO: 198956 - protein, 177 aa, Glycine max
  Coding DNA Sequence Number=SeqID_82178
  Gene Ontology: Mol. function=sequence-specific DNA binding; Cellular component=nucleus; Biological process=regulation of transcription
  Homolog annotation: Hit_ID=Q6IEP9; Match level="QueryCoverage=36%, HitCoverage=10%, E-value=9e-27, Identity=81%"; Hit description=WRKY transcription factor 32
  Pfam annotation: Domain name=WRKY; Domain location=140-177; Score =45.1; E_value=2.4e-10; Accession=PF03106.6; Description=WRKY DNA -binding domain
MKFSAIQENNKRKDHEISLSLQDIATTSGEGPSRINEIFNKQIRQSAPSPPHTTDHDDSLSESELGLSLRLQPSTSHHKESDVGNNNKEDKNDQQLASFASVQNKLQRTHELPGITTHAAFPPNRKARVSVRARCEAATMNDGCQWRKYGQKIAKGNPCPRAYYRCTVAPGCPVRKQ

SEQ ID NO: 198957 - protein, 279 aa, Glycine max
  Coding DNA Sequence Number=SeqID_82179
  Gene Ontology: Mol. function=glutamyl-tRNA(Gln) amidotransferase activity; Cellular component=cytoplasm; Biological process =translation
  Homolog annotation: Hit_ID=Q1GYD3; Match level="QueryCoverage=76%, HitCoverage=43%, E-value=7e-71, Identity=65%"; Hit description =Glutamyl-tRNA(Gln) amidotransferase, A subunit
  Pfam annotation: Domain name=Amidase; Domain location=87-270; Score= -47.7; E_value=1.3e-09; Accession=PF01425.11; Description=Amidase
MALNLDDIMRIAHLARIEAVDTTGIEPMSHSQDVTQRLREDVVTATNQRELFQSIAPATQDDTLAMINSSLKQLGQQLASKQVSSVELTQAYLQRMAQLNPSINAYVTIDEAKTLAQAKAADARIAAGDFGPLTGIPLAQKDIFCAKGWRTTCSSKMLETFISPYDAHVISQFDAAGAVNLGKTNMDEFAMGSSNETSYFGGVKNPWDVDRVPGGSSGGSAAAVAARLCAAATGTDTGGSIRQARFLVWLYRFEADVWPGVVLRHDCLCLQPGPGRPNG

SEQ ID NO: 198958 - protein, 83 aa, Glycine max
  Coding DNA Sequence Number=SeqID_82180
MGPDGCRETRRTGTGEAAHKPSQDFSIQKAPNSSSFPYQVARKSYFWSLGAYLYLVGPSISERKLVERMGRVSLELNVRMVVL

SEQ ID NO: 198959 - protein, 160 aa, Glycine max
  Coding DNA Sequence Number=SeqID_82181
MYKTLPQNRFLQDENFRCLLRCLVPPAEEEDPVQKTVADYAWSIQTLLALEDIGLTKIPKLAKKTWAEMASESDDDSETDLQKQIQKAKQTKTVCNQKPSQSLTQQESTPQPGNSYISKNKFFNVLQDGTRILGQESFQSNRQSIFPGIPLQANSHKQNP

SEQ ID NO: 198960 - protein, 102 aa, Glycine max
  Coding DNA Sequence Number=SeqID_82182
  Gene Ontology: Mol. function=hydrolase activity, hydrolyzing O -glycosyl compounds; Biological process=carbohydrate metabolic process
  Homolog annotation: Hit_ID=Q10F03; Match level="QueryCoverage=96%, HitCoverage=19%, E-value=8e-31, Identity=60%"; Hit description =Isoamylase N-terminal domain containing protein, expressed
DAHKVVEENQKKINNAQKALQILKTTCVVWPNKASEVLLTGSFDGWSTKRKMERLSLGVFLLNLQLYPGRYEFIVDGEWKIDPLRPVVTSNGYENNLLIVHD

SEQ ID NO: 198961 - protein, 93 aa, Glycine max
  Coding DNA Sequence Number=SeqID_82183
  Gene Ontology: Mol. function=catalytic activity; Biological process =auxin mediated signaling pathway
  Homolog annotation: Hit_ID=Q1S9X9; Match level="QueryCoverage=98%, HitCoverage=100%, E-value=2e-24, Identity=66%"; Hit description =Auxin responsive SAUR protein
  Pfam annotation: Domain name=Auxin_inducible; Domain location=1-91; Score=146.9; E_value=5.5e-41; Accession=PF02519.5; Description=Auxin responsive protein
MAFRLPGFRRSSFSASQASSFKDEEVPKGYLAVYVGEKMKRFLIPVSFLNELLFQELLRKAEEEFGYYHPMGGLTIPFMEDVFLDTASHLKRL

SEQ ID NO: 198962 - protein, 107 aa, Glycine max
  Coding DNA Sequence Number=SeqID_82184
  Homolog annotation: Hit_ID=UPI0000162ED7; Match level="QueryCoverage =95%, HitCoverage=25%, E-value=3e-16, Identity=45%"; Hit description =Ran GTPase binding
  Pfam annotation: Domain name=RCC1; Domain location=1-42; Score=14.8; E_value=0.018; Accession=PF00415.9; Description=Regulator of chromosome condensation (RCC1)
DGHVYTWGRGFKGFEDARVPQCLNSSLNFTKVALGWNHALAMSGEGEVCMLGGNHLGVLSDLQNISPAKHLPHLREVNLEKVPGLDGTKITDIATGAEHSVIVTGKM

SEQ ID NO: 198963 - protein, 229 aa, Glycine max
  Coding DNA Sequence Number=SeqID_82185
  Gene Ontology: Mol. function=ubiquitin-protein ligase activity; Cellular component=intracellular; Biological process=protein modification process
  Homolog annotation: Hit_ID=UPI0000162ED7; Match level="QueryCoverage =96%, HitCoverage=81%, E-value=4e-77, Identity=48%"; Hit description =Ran GTPase binding
  Pfam annotation: Domain name=RCC1; Domain location=122-171; Score =17.0; E_value=0.01; Accession=PF00415.9; Description=Regulator of chromosome condensation (RCC1)
  Pfam annotation: Domain name=RCC1; Domain location=17-66; Score=22.9; E_value=0.0012; Accession=PF00415.9; Description=Regulator of chromosome condensation (RCC1)
  Pfam annotation: Domain name=RCC1; Domain location=179-228; Score =5.0; E_value=0.2; Accession=PF00415.9; Description=Regulator of chromosome condensation (RCC1)
  Pfam annotation: Domain name=RCC1; Domain location=69-119; Score =14.6; E_value=0.019; Accession=PF00415.9; Description=Regulator of chromosome condensation (RCC1)
  Pfam module annotation: Pfam domain module=RCC1::RCC1::RCC1::RCC1; Domain location=122-171::17-66::179-228::69-119
MEEPKKTENEDDKDESEQRVWSWGAGTEGQLGTKILQDEHFPQLLHQPSLSSISSLACGGAHVIALTSAGKVLSWGRGNSGQLGHGLVVSNSLYPKAVTSLDGYFITHVSAGWGHSGFVSDNGCVFTCGDGSFGQLGHGDHASHCSPVKVSCFVDQHVEQVACGMRHSLVLLKDCTGNQVYGFGSGKRGQLGVSNDRVKSVNVPKVVSGFEGVEIAGIAANGDHSAAVS

SEQ ID NO: 198964 - protein, 60 aa, Glycine max
  Coding DNA Sequence Number=SeqID_82186
MLMDLSGIGAVSLNVPTKYLHLMASLPPLMSIWIRKAFRWFHYGLLKMNGNHMIDPHNVN

SEQ ID NO: 198965 - protein, 44 aa, Glycine max
  Coding DNA Sequence Number=SeqID_82187
  Pfam annotation: Domain name=Auxin_inducible; Domain location=1-44; Score=-2.5; E_value=7.3e-05; Accession=PF02519.5; Description=Auxin responsive protein
MGFSLRGVQRRVDVPKGCVAVYQEFGFDHPMGGLTIPCREDVFL

SEQ ID NO: 198966 - protein, 212 aa, Glycine max
  Coding DNA Sequence Number=SeqID_82188
  Gene Ontology: Mol. function=RNA-directed DNA polymerase activity; Cellular component=membrane; Biological process=RNA-dependent DNA replication
MVSKATEKEEDLIKDILDNYGRAFGKQGSRLLTNQDIIVFKVFKVKYFTHGSFLDAELGGNLSFVCHNIYASQVILRQGIKRKLGDNREINIWKNPWLNSSSNPYIQFIPQEGNEHLVVANIIDHDMQCWNINVLPYFFSNEDIQAIESVPLLNLHDSDQLSWKFTPRGSYSVVTTYHYVVKDILNTTHLKVDGNWKAIWNLKVPPKLKHML

SEQ ID NO: 198967 - protein, 99 aa, Glycine max
  Coding DNA Sequence Number=SeqID_82189
  Gene Ontology: Mol. function=catalytic activity; Biological process =response to chitin
  Homolog annotation: Hit_ID=Q8S351; Match level="QueryCoverage=89%, HitCoverage=98%, E-value=4e-22, Identity=57%"; Hit description=Auxin- induced SAUR-like protein
  Pfam annotation: Domain name=Auxin_inducible; Domain location=1-97; Score=140.0; E_value=6.6e-39; Accession=PF02519.5; Description=Auxin responsive protein
MGIRLPIFMALHANKIFKWQQHLHSRNHSNVPKGHIVVYVGEAQKKRFVVPISYLNHPSFVDLLNRVVEEFGYNHPMGGLTIPCKEEAFITLTSQLRAS

SEQ ID NO: 198968 - protein, 292 aa, Glycine max
  Coding DNA Sequence Number=SeqID_82190
  Gene Ontology: Mol. function=nucleic acid binding; Cellular component= chloroplast envelope
  Homolog annotation: Hit_ID=Q9SJX7; Match level="QueryCoverage=69%, HitCoverage=48%, E-value=4e-20, Identity=31%"; Hit description =Expressed protein
  Pfam annotation: Domain name=DUF647; Domain location=1-291; Score =165.7; E_value=1.2e-46; Accession=PF04884.5; Description=Protein of unknown function, DUF647
MELGAGVELATAAVPHLFLPLACAANVLKNVAAVTSTSTRTPIYKAFAKGENIGDVTAKGECVGNIADLLGTGLSILIAKRNPSLVTTFSLLSCGYILSSYREVKSVVLHTLNCGRFSVAVEHFLMTGQVPTLQEGNMNENIFSFPWKDRPVVLGSRIKEAFQDPSAYVAIEPLFDRERYIVTYNPSKHKVYAVLKDQAKSDDILKAAFHAHVLFFSLMKSLNENKASSLKQREDLSNMTHTVADIEARIAGTCKTVADSYGCFKNKAKEQLCSGSRALGLLHDALLWVTIP

SEQ ID NO: 198969 - protein, 169 aa, Glycine max
  Coding DNA Sequence Number=SeqID_82191
MREVPRKAEVYYYNKKMGIRKAEGERRGTSFPWKMTDTYRDWHERVHSNFWGIEIRTYTGNTPWVMGFHCLEWENRRRRRRRKLGWKPKGRMFVHFPISSTWLLAVYNHYSRIRLNQHLPLPMQQHSHRQDMSTQYYITFFCLNKPSTLTTGEMKDENSILFLEDYDMH

SEQ ID NO: 198970 - protein, 72 aa, Glycine max
  Coding DNA Sequence Number=SeqID_82192
  Subcellular localization annotation: CTP_CleavageSite=32; ConfidenceScore=5.31e-01
MDKHPSLRFPPQFPPPPPPPVLPFLFLTPHPQAMESHNPGSIAGVSPNFDTPKVRVNPFVPISICVCHLPGE

SEQ ID NO: 198971 - protein, 230 aa, Glycine max
  Coding DNA Sequence Number=SeqID_82193
  Gene Ontology: Mol. function=protein binding; Cellular component =ubiquitin ligase complex; Biological process=regulation of transcription, DNA-dependent
  Homolog annotation: Hit_ID=Q17BE8; Match level="QueryCoverage=83%, HitCoverage=15%, E-value=2e-32, Identity=38%"; Hit description =Cullin-associated NEDD8-dissociated protein 1
MANLALTSILEKMTGKDKDYRYMATSDLLNELSKATFKADADLEVKLTNIIIQQLDDAAGDVSGLAVKCLAPLVRKVSEVRVVEMTSKLCDKLLNGKDQHRDIASIALKTVVAEVSTQSLAQSILQTLTPQLIRGITGPGMGSEIKCESLDILCDVLHKFGNLMAADHELLLSSLLSQLSSNQASVRKKTVACIVLSVVIFSFFTLVESYCSKFVQNKILLDFYCGFSIF

SEQ ID NO: 198972 - protein, 88 aa, Glycine max
  Coding DNA Sequence Number=SeqID_82194
  Subcellular localization annotation: CTP_CleavageSite=23; ConfidenceScore=5.12e-01
MSIIPNAYAFYVTRRVRTSHPTLASLIVGAVGTVVVNLNPNTPVLPVELKSRCRVWNDEHGMRRSSEAERAVIQVKRRREGKEGKLGI

SEQ ID NO: 198973 - protein, 230 aa, Glycine max
  Coding DNA Sequence Number=SeqID_82195
  Gene Ontology: Mol. function=protein binding; Cellular component =ubiquitin ligase complex; Biological process=regulation of transcription, DNA-dependent
  Homolog annotation: Hit_ID=UPI0000E47D1A; Match level="QueryCoverage =81%, HitCoverage=19%, E-value=1e-41, Identity=46%"; Hit description =PREDICTED: hypothetical protein, partial
SLSSSLSDDLLAKATVEVVTNLKNKVAKSEMIRTNIQMIGALSRAVGYRFGPHLGDTVPVLINYCTNASENDEELREYSLQALESFLLRCPRDISVYCDEILHLTLEYLSYDPNFTDNMEEDTDDEGLEEEEDDESANEYTDDEDVSWKVRRAAAKCLAALIVSRPEILSKLYDEACPKLIDRFKEREENVKMDVFNTFIELLRQTGNVTKGQTDADMRQHISNLRCTIK

SEQ ID NO: 198974 - protein, 304 aa, Glycine max
  Coding DNA Sequence Number=SeqID_82196
  Gene Ontology: Mol. function=nucleic acid binding; Cellular component= cytoplasm; Biological process=spliceosome assembly
  Homolog annotation: Hit_ID=Q6ZC63; Match level="QueryCoverage=96%, HitCoverage=97%, E-value=1e-105, Identity=66%"; Hit description =Putative survival motor neuron domain containing 1; splicing factor 30, survival of motor neuron-related
MQGQGVDEVNIEELASNLSLYKDQLNQVRQLLNDDPSNSEYADMERELSEVIALTEELLATAKQNEIPAPPNAAAASPTLSIHNDNQVLDSSSDHQEKLPVGTKVQAVWSEDGEWYDATVEAYTPNGYYVSYDNWGNKEEVDPANIRSIQEGSVDALLEAERVAEATKQAIKRKIVQAASIDLQSRSLPAKLRIEADDPEDVDYRCHWKASKRKKIHAFKSKMRMEQLEVTQNKRQNAWQQFQSTKGKAKKIGFFSGRKRESIFKSPDDPQGKVGVTGSGKGLTEFQKREKHFHLKDGTVENDE

SEQ ID NO: 198975 - protein, 685 aa, Glycine max
  Coding DNA Sequence Number=SeqID_82197
  Gene Ontology: Mol. function=protein binding; Cellular component =ubiquitin ligase complex; Biological process=regulation of transcription, DNA-dependent
  Homolog annotation: Hit_ID=UPI000051A8F0; Match level="QueryCoverage =98%, HitCoverage=54%, E-value=1e-152, Identity=45%"; Hit description= PREDICTED: similar to Cullin-associated NEDD8-dissociated protein 1 ...
  Homolog annotation: Hit description=(Cullin-associated and neddylation-dissociated protein 1) (p120 CAND1) isoform 1
  Pfam annotation: Domain name=HEAT; Domain location=133-169; Score =2.0; E_value=25; Accession=PF02985.12; Description=HEAT repeat
  Pfam annotation: Domain name=HEAT; Domain location=344-379; Score =11.1; E_value=1.9; Accession=PF02985.12; Description=HEAT repeat
  Pfam annotation: Domain name=HEAT; Domain location=421-457; Score =22.3; E_value=0.0017; Accession=PF02985.12; Description=HEAT repeat
  Pfam annotation: Domain name=HEAT; Domain location=493-532; Score =10.5; E_value=2.2; Accession=PF02985.12; Description=HEAT repeat
  Pfam annotation: Domain name=HEAT; Domain location=50-88; Score=11.7; E_value=1.6; Accession=PF02985.12; Description=HEAT repeat
  Pfam annotation: Domain name=TIP120; Domain location=534-685; Score =257.1; E_value=3.7e-74; Accession=PF08623.1; Description=TBP (TATA -binding protein) -interacting protein 120 (TIP120)
  Pfam module annotation: Pfam domain module=HEAT::HEAT::HEAT::HEAT::HEA T::TIP120; Domain location=133-169::344-379::421-457::493-532::50 -88::534-685
MDELYHALSAPVLSAVGERYYKVTAEALRVCGELVRVVRPNIEGSGFDFRPYVHPIYNGIMSRLINQDQDQEVKECAISCMGLIVSTFGDHLNAELPACLPVLVDRMGNEITRLTAVKAFAVIAASPLRVDLSCVLEHVVAELTAFLRKANRALRQATLGTLNSLIVAYGDKIVLSAYEVIIVELSGLISDSDLHMTALALELCCTLMGDKRSNQSIGLAVRNKVLPQALTLIKSSLLQGQALSALQNFFAALVYSANTSFDSLLESLLACAKPSPQSGGIAKQALHSIAQCVAVLCLAAGDQKCSSTVKMLTDILKDDSSSNSAKQHLALLCLGEIGRRKDLSTHAHIENIVIESFQSPFEEIKSAASYALGNIAVGNLPKYLPFILDQIDNQQKKQYLLLHSLKEVIVRQSVDKAEFQESSVEKILNLLFNHCESEEEGVRNVVAECLGKIALIEPVKLIPALKVRRTSPAAFTRATVVIAVKYSIVERPEKIDEIIYPEISSFLMLIKDNDRHVRRAAVLAISTFAHNKPNLIKGLLPDLLPLLYDQTIVKQELIRTVDLGPFKHIVDDGLELRKAAFECVDTLLDSCLDQVNPSSFIVPYLKSGLDDHYDVKMPCHLILSKLADKCPSAVLAVLDSLVDPLQKTINFKPKQDAVKQEVDRNEDMIRSALRAIASLNRIRQR

SEQ ID NO: 198976 - protein, 60 aa, Glycine max
  Coding DNA Sequence Number=SeqID_82198
MFVFNSALKGLDDTQQSKSKSPARWIVVKYFTDPRPLELERLKALRNQWAKYYLKVKNET

SEQ ID NO: 198977 - protein, 741 aa, Glycine max
  Coding DNA Sequence Number=SeqID_82199
  Gene Ontology: Mol. function=molecular_function; Cellular component =centrosome; Biological process=mitotic checkpoint
  Homolog annotation: Hit_ID=Q9LTY1; Match level="QueryCoverage=99%, HitCoverage=99%, E-value=0.0, Identity=53%"; Hit description=Mitotic checkpoint protein-like
  Pfam annotation: Domain name=MAD; Domain location=4-739; Score=658.1; E_value=7e-195; Accession=PF05557.4; Description=Mitotic checkpoint protein
MIVRTPPPPKRPRADGDGQLVIYEDPPESSPSEHMLCTYQCRQMVKSDFIDALSKAENQARHYQSKFETLEPNFHKLESERKKFQDQFLYAQQELAAAKGREQALQDQLLMEVTQSQERLRKQIQLNTQLQVKLQNETDLRKKAESHAASAEEKATSFEGKLGHLSESIEREKKRLRDDHSQLKSDSKLSISRISAKLEQMECRANNAEREAELLKEQLKLLKDQLDECLHQKIEVEKKLSTLMFQEVASTESNVLVKHLQQELRNYESVVREARKLRSSHENVELLKEKLLEEKSHRERAESELSKLHDIQLNMKKLEDQISSWRVMITDIPGVSCFEDLPVKFAALQKYQKEILLAALHLSRHLLSFDLDIYYQCREVIYSTQKEGEITARLKQMEVALDAAEIGKQNAEAEAALAKDKAEVLKSEIKRIELMLAVVTEERNKLRNVANLKNDEALDASKNANPVQEPESSLMKKDDCIKDLESTLHEQRMVNNRQLDEMKLLNEKLHGEARRVKSLERESDRLRSEISLLEAKLGHGDFSAANTKVLRMVNTLTVDNEAKQTIEALQTELQKTKEKLKAVEELKSQSDVWVFLITSNSLGEAGKLVDSYISDKMLQLKEQIATLEKREERYKTVFADRISVFRRACCELFGYKIVMDEHQRSNGIPVTRFTLQSIYAQSDDEKLEFEYESGNTNILANHYTSQPEVSRQVEIFIRKMNSIPAFTANMTVESFNRRTLS

SEQ ID NO: 198978 - protein, 366 aa, Glycine max
  Coding DNA Sequence Number=SeqID_82200
  Gene Ontology: Mol. function=nucleotide binding; Cellular component =microtubule
  Homolog annotation: Hit_ID=Q5DMX3; Match level="QueryCoverage=90%, HitCoverage=31%, E-value=1e-106, Identity=62%"; Hit description=DRP
  Pfam annotation: Domain name=PH; Domain location=169-309; Score=46.7; E_value=7.9e-11; Accession=PF00169.19; Description=PH domain
VHRVLVDLVSSSANATPGLGRYPPFKREIVAIASSALEAFKNESKKMVVALVDMERAFVPPQHFIRLVQRRMERQRREEELKNRPSKKALDAEQSILNRATSPQTSQQSGGNLKSMKEKSSQQDKDTQEGSGLKTAGPEGEITAEYSFIYFEDRNSFYTFLSGPAAFCFYLSRYLLKKSGKGSGWSRRWFVLNEKTGKLGYTKKQEERHFRGVITLENLKLTGIMTIVKPFSTECNIDEISDDDEASTKSSKDKKSNGPDSGKASNLIFKITSKVPYKTVMKAQSAVLLKAESMADKVEWINKLRSVAQAKGGQAIGEPSFPMRQSLSDGSLHLGFGPNLIPQNQLVRGEMPKLYKDFICFHLSYL

SEQ ID NO: 198979 - protein, 873 aa, Glycine max
  Coding DNA Sequence Number=SeqID_82201
  Gene Ontology: Mol. function=protein dimerization activity; Cellular component=nucleus; Biological process=regulation of transcription, DNA-dependent
  Homolog annotation: Hit_ID=Q3Y6G6; Match level="QueryCoverage=74%, HitCoverage=94%, E-value=0.0, Identity=66%"; Hit description=Auxin response factor 1
  Pfam annotation: Domain name=AUX_IAA; Domain location=466-651; Score=- 80.2; E_value=0.001; Accession=PF02309.7; Description=AUXIAA family
  Pfam annotation: Domain name=Auxin_resp; Domain location=229-312; Score=172.3; E_value=1.2e-48; Accession=PF06507.4; Description=Auxin response factor
  Pfam annotation: Domain name=B3; Domain location=120-207; Score=36.7; E_value=7.9e-08; Accession=PF02362.12; Description=B3 DNA binding domain
  Pfam module annotation: Pfam domain module=AUX_IAA::Auxin_resp::B3; Domain location=466-651::229-312::120-207
MASTLKSGGIHTGAINDDLYKELWHACAGPLVTLPREGERVYYFPQGHMEQLEASMYEGLEQQMPSFNLPSKILCKVVNVHLRAEPETDEVYAQITLLPEADVTSPDDPLPESPRVKIHSFCKTLTASDTSTHGGFSVLRRHADDCLPPLDMSQQPPWQELVATDLHGNEWHFRHIFRVIVAGLWCMLYSRGENGELRVGVRRVMRQQSNVPSSVISSHSMHLGVLATASHAIATGTLFSVFYKPRTSRSEFIVSVNKYLEVQSHKLSVGMRFKMRFEGDEIPERRFSGTIVGVGDNKSSSVWPDSEWRSLKVQWDEPSSILRPDRVSSWELEPLVSTTLANSQPTQRNKRARPLILPSTMPDSSLQGGFAGLVVQNFFVILLPILFFYIIIFLCAPGIWKSSVESTSFSYCDPQQGRGLYPSPKFNSSATNFIGFSGNSSVGSPSNKSIYWSNRMENNLESISAIALKEAGEKRQGTGNGCRLFGIQLLENSNAEGNLQTVTLSGRVGDDRSVPSLDAESDQHSEPSNANRSDIPSVSCDAEKSCLQSPQESQSKQIRSCTKVHMQGMAVGRAVDLTRFDGYEDLLRKLEDMFNIKTELCGSLKKWQVVYTDNEDDMMMVGDDPWDEFCSVVRKIFIYTAEEVKKLSPKIRLPMNEKVNPSKQDSEAISYEFQFQYILVVMNAINVGVERGDNELKLGWLAGMTSASKNRRRGECSGPCSFGFELAASTNILRFGIPVEHCFHGVAAGRASEWGEVLELQGNTCFRHNLIPLPESSPPSPRATPSRRGSGFGVSTFNEPRDHDIPSQKPLTIVTNKMEAIIVNMACGWGSKSVAKDILSSCFGASASLYQAPLAAFMILNLTPADNSASLTV

SEQ ID NO: 198980 - protein, 592 aa, Glycine max
  Coding DNA Sequence Number=SeqID_82202
  Gene Ontology: Mol. function=protein dimerization activity; Cellular component=nucleus; Biological process=regulation of transcription, DNA-dependent
  Homolog annotation: Hit_ID=UPI0000383125; Match level="QueryCoverage =70%, HitCoverage=92%, E-value=9e-84, Identity=41%"; Hit description =COG3146: Uncharacterized protein conserved in bacteria
  Pfam annotation: Domain name=DUF482; Domain location=60-487; Score =498.1; E_value=1e-146; Accession=PF04339.3; Description=Protein of unknown function, DUF482
  Subcellular localization annotation: CTP_CleavageSite=28; ConfidenceScore=5.56e-01
MAAVSVSVTVRVRWCTRKPPTPTPTRFSVNALFGDWGFGNRTRNSLQQQFTFTLADSKVISVSVVSSISDVASSEWDACALDATGPDNFNPFLSHAFLSTLEHSASAVRETGWIPHHIVAKANNNSNNNVVAVVPLYLKTHSYGEFVFDHSWANAYHSYGYNYYPKLQSCVPFTPVTGPRILLRNTSFKHQVFDIIVSAMKELALTVIHSQLSSLHVTFPSENEWHKLTEKGFLPRIGMQYHWKNRNYKNFDDFLMDMKQSKRKNIRQERKKVDICRFYQLVLEFYPIALSSISAQNLIMKRLRGYEIKIVLRVRIDANDPLKFTARHWDSFYSFYRNTTDNKWGTPHLTREFFHELGAKMGDNVLLVVAEEGDELVAGALNLIGGDTLFGRLWGCQPRSYYPSLHFEACYYQAIEAAIELNLKTVEAGAQGEHKIQRGYLPVTTYSCHYLIDEEFREAIQDFLIREAAQVKLVIKLLHDSGPFKEDSERSTIVSWSEIENHECSQRCLIERSRSTKARGEYVFCHRLAQPFYRPLWCTIELPASHPPSPSTSHVHYYRFHLICHYRQRLLRRNIMLKLQSNIVTNPVKILN

SEQ ID NO: 198981 - protein, 52 aa, Glycine max
  Coding DNA Sequence Number=SeqID_82203
MAEGDPIVGAKDGSYTNKVLTSGNAVPFLMFDGRFLGKLEIGIPLPLIPKED

SEQ ID NO: 198982 - protein, 198 aa, Glycine max
  Coding DNA Sequence Number=SeqID_82204
MVSTQSSLRRETPLENFHPHPATMTNTNTLQQLQNRIADDEHFAHILPKGTQGESHPRRTVNTLDDLSLTHMHRLAGQTTYPNEHLDAFMTQANLYTNDDVILCRVFPTFLKGYATSRSHYVTLSALASLRQADDESLRKFMDRFGRIAVQIQNLNPKEAFNLDLPIRLPPMKPPRLGSNATKYCKYHHDIGHNIEDY

SEQ ID NO: 198983 - protein, 101 aa, Glycine max
  Coding DNA Sequence Number=SeqID_82205
  Homolog annotation: Hit_ID=Q9LTY0; Match level="QueryCoverage=81%, HitCoverage=8%, E-value=3e-21, Identity=59%"; Hit description =Arabidopsis thaliana genomic DNA, chromosome 5, TAC clone:K9P8
MVENGFVQDDITPPPKSCSNKKMVEPGKPAGLTWQRKLNNNGNASSQISLSLKEIIHLAPIGYRLWRHCREEAAKGRGGMIDPFAKRHVTFCHGVPLGGIG

SEQ ID NO: 198984 - protein, 728 aa, Glycine max
  Coding DNA Sequence Number=SeqID_82206
  Gene Ontology: Mol. function=translation elongation factor activity; Cellular component=eukaryotic translation elongation factor 1 complex; Biological process=translational elongation
  Homolog annotation: Hit_ID=Q8S3W1; Match level="QueryCoverage=52%, HitCoverage=91%, E-value=1e-172, Identity=78%"; Hit description =Elongation factor 1-gamma
  Pfam annotation: Domain name=EF1G; Domain location=223-331; Score =158.5; E_value=1.8e-44; Accession=PF00647.9; Description=Elongation factor 1 gamma, conserved
  Pfam annotation: Domain name=GST_C; Domain location=70-162; Score =43.7; E_value=6.2e-10; Accession=PF00043.15; Description=Glutathione S-transferase, C-terminal domain
  Pfam module annotation: Pfam domain module=EF1G::GST_C; Domain location=223-331::70-162
MGVSNKTPEFLKINPIGKVPVLETPDGPVFESNAIARYVTQLKGDNTLYGSSLIEHAHIEQWIDFSSLEIDANIIKWYAPRVGRGPYLPPAEEAAISALKRALAALNTHLASNTYLVGHSVTLADIIMTCNLYLGFANILVKCFTSEFPHVERYFWTLVNQPNFRKIIGQVKQAETIPPVQSAKKPSQPKESKPKVKNEPKKEANKEPEKPKEEAEEEAPKPKAKNPLDLLPPSPMILDEWKRLYSNTKTNFREVAIKGFWDMYDPEGYSLWFCDYKYNQENTVSFVTLNKVGGFLQRMDLARKYAFGKMLVIGSDPPFKVKGLWLFRGQEIPQFVIDECYDMELYEWTKVDISDEPQKERVNQMIEDCEPFEGEALLDAKCFKQLETGWRQHNLCLWILISHFSASFPPRSILSSVVRHPIKSSNLLGCHVVESVIRVMPLSRFAADYSVKSAKARPSLAVAMAGGKYMQMTGGIINTKWNVKTAGYILLYCFPLFVLQLFVIFVGGEFKSSSSSSCTYPLLSTLLLGLFALILTSYLFWLGSRILKLVINKGLQKRVYTLVLSVSGFLPLRVVFLGLSVLSGPEDFMFEAFAFLAFLALASCAGVCMCMLVYRPLADCLALDINDTTSLIKGDRDATFLQLSLFSPTPNRFLSFLSSVKFMSPVKPTPWKPCNWRRTSSVLANQCADFLARLGSSSSETLRTVALPLPEMKPLLLADASSVVFVHL

SEQ ID NO: 198985 - protein, 700 aa, Glycine max
  Coding DNA Sequence Number=SeqID_82207
  Gene Ontology: Mol. function=hydrolase activity, acting on glycosyl bonds; Cellular component=integral to membrane; Biological process =sphingolipid metabolic process
  Homolog annotation: Hit_ID=Q2R859; Match level="QueryCoverage=99%, HitCoverage=72%, E-value=0.0, Identity=61%"; Hit description =Expressed protein
  Pfam annotation: Domain name=DUF608; Domain location=387-700; Score =588.6; E_value=5.7e-174; Accession=PF04685.4; Description=Protein of unknown function, DUF608
METVPHIMHYTQGLGQYMRIDHLFCSNAEPDPALRIVCRQISPVIPHNYKESSFPVTVFTFTLKNLGNTTADVTLLFTWTNSVGGISEFTGDHFNSKTTRNDGVHAVLLHHKTANERSPVTFAIAAEETEDVHISECPVFVISGAYSSISAKNMWNEVKQGVKHREIPIDELQVNYTSELDTAFNPKLKHGSFDHLNFAETSAPSEPGSSIGAAIAATVTIPSNAQRIVTFSLAWDCPEVKFPEGKTYYRRYTKFYGTNGDAAADIAHDAIMEHCQWEAQIDDWQRPILEDKRFPEWYPTTLLNELYYLNSGGTIWTDGSLPVHGLVNTGERKFSLDGFNNNLSHKNDIAINILEMFNSVVEQTHSPPASKSAYGVNLLQEGEENIGQFLYLEGIEYQMWNTYDVHFYSSFSLVMLFPKLELSIQRDFAAAVLMHDPSKMKLLYDGQWAPRKVLGAVPHDIGLNDPWFEVNGYNLYNTDRWKDLNPKFVLQIYRDVVATGDKKFAQAVWPAVYIAIAYMDQFDKDGDGMIENEGFPDQTYDTWSVSGVSAYSGGLWVAALQAASALAREVGDKGSEDYFWLKFQKAKSVYENLWNGSYFNYDSSGGSSSLSIQADQLAGQWYARACGLLPIVEEKKRRRGAVNGMLPDGKVDMSTMQSREIWSGVTYALAATMIQENMIDMAFQTAGGVYETAWSNNGLG

SEQ ID NO: 198986 - protein, 95 aa, Glycine max
  Coding DNA Sequence Number=SeqID_82208
MLDHPEPLKLPHCTEVPLRACGNHMTVLRRHGPPLQWKVETLNPAISGKGVVQPWYDFLEEMNFDDGDEISIYYRYYEKIWDVIIRRQEAGRLGR

SEQ ID NO: 198987 - protein, 149 aa, Glycine max
  Coding DNA Sequence Number=SeqID_82209
MTKSFLLKTLLLFLITKSFYNPPVVPNLEARQAHNDLRIRGVKTFLFVLLFFPQHTRFPMLEVPTKVFFQLRQRFQHSPPPTLHTRKVVLESFFLLERLVHNTFMEAKNSFQKAYSRMQKGLSKTPFPANGNTIPEAFFGYGMVLSETV

SEQ ID NO: 198988 - protein, 193 aa, Glycine max
  Coding DNA Sequence Number=SeqID_82210
  Pfam annotation: Domain name=WD40; Domain location=159-193; Score =7.9; E_value=4.4; Accession=PF00400.22; Description=WD domain, G -beta repeat
  Pfam annotation: Domain name=WD40; Domain location=47-83; Score=23.1; E_value=0.00097; Accession=PF00400.22; Description=WD domain, G-beta repeat
  Pfam annotation: Domain name=WD40; Domain location=87-123; Score =11.3; E_value=1.7; Accession=PF00400.22; Description=WD domain, G -beta repeat
  Pfam module annotation: Pfam domain module=WD40::WD40::WD40; Domain location=159-193::47-83::87-123
  Subcellular localization annotation: CTP_CleavageSite=72; ConfidenceScore=5.37e-01
MDSKPNLWNTPPSTCSSYSSNSSESDASPFCSHRIPIAIVSGFFHSHRSLAVLSGHVGSVSCLALCGEFILSASQGKDIIVWQQPDLRVFAKFGQGDGSVKALASVGNKVFTAHQDSRIRVWKVSRSSENVFKLVDTLPTTKDYLGKFMKQSNYVQTRRHHKRLWIEHADSISCLTVYSGLIYSGSWDKTLKV

SEQ ID NO: 198989 - protein, 479 aa, Glycine max
  Coding DNA Sequence Number=SeqID_82211
  Gene Ontology: Mol. function=hydrolase activity; Cellular component =chloroplast; Biological process=biological_process
  Homolog annotation: Hit_ID=Q1SAN8; Match level="QueryCoverage=98%, HitCoverage=77%, E-value=0.0, Identity=82%"; Hit description =Metallophosphoesterase; Fibronectin, type III-like fold
  Pfam annotation: Domain name=Metallophos; Domain location=183-395; Score=77.6; E_value=4e-20; Accession=PF00149.18; Description =Calcineurin-like phosphoesterase
MKNDPNYLSCKKKECKTFQNGKCAVSTCSGSLQFHVVNIRSDIEFVFFSGGFVEPCLVGRSTPVSFANPKRPLYGHLSSIDSTGTSMRLTWVSGDKEPQQIQYGNGKTVASAVTTFSQDDMCSSALPSPAKDFGWHDPGYIHSALMTGLKPSSTFSYRYGSGWVGWSEQIKFSTPPAGGSDELRFIAFGDMGKTPLDASEEHYIQPGALSVIKAIANDVNSNNVNSVFHIGDISYATGFLAEWDYFLHLINPVASRISYMTAIGNHERDYIDSGSVYVTPDSGGECGVPYETYFPMPTSAKDKPWYSIEQGSVHFTVISTEHDWSENSEQYEWVQKDMASVNRQKTPWLIFMGHRPMYTTNHGFLPSENKFMEAVEPLLLENKVDLVLFGHVHNYERTCSLFQNECKAMPAKDKNGVDTYDGRNYSAPVHAVIGMAGFTLDKFSSNVKSWSLKRISEFGYLRAHATRNDLNLEVNSKAP

SEQ ID NO: 198990 - protein, 105 aa, Glycine max
  Coding DNA Sequence Number=SeqID_82212
MTKRDWRMEDCEVVADNSENYVLAGNIRKCWQRQNLRHDGCEKVIKEIREEEAVNKESDESNRFELDFLILQSCNPKPKLNEIGLRNKNGIKPIILNKSWKLIRL

SEQ ID NO: 198991 - protein, 198 aa, Glycine max
  Coding DNA Sequence Number=SeqID_82213
  Homolog annotation: Hit_ID=Q2QXZ5; Match level="QueryCoverage=45%, HitCoverage=20%, E-value=6e-10, Identity=42%"; Hit description=GRAS family transcription factor containing protein
  Pfam annotation: Domain name=GRAS; Domain location=6-197; Score= -60.4; E_value=1.6e-05; Accession=PF03514.5; Description=GRAS family transcription factor
MQGVSRQPKLWTQVDSTSRGVRVQGMNWDDDERIRLINLLNECVKLTELGNFNAADVAFYHLSHLASPDGDSMQRVATCFIEALAYCQVAKNLRGVPKVLHLWTNLIKCLKPSTPTCPKITITAIHEKKEVLEKMGLHLGVEAQRLLFPFQFNPVVSSLENLDPETLPIKKGEPLAISSVLQLHSLLASDDDDEMAKM

SEQ ID NO: 198992 - protein, 102 aa, Glycine max
  Coding DNA Sequence Number=SeqID_82214
MALSEWVNSPNEVIQNMAEKIDGSLLEEGASPPRIALDKKLEEDALMEEKKERRGEHEIEGIKEGKKWNFEVYLIRLSFIKVTTSVTHASIYRLGSFLEKLS

SEQ ID NO: 198993 - protein, 203 aa, Glycine max
  Coding DNA Sequence Number=SeqID_82215
  Gene Ontology: Mol. function=transporter activity; Cellular component= integral to membrane; Biological process=transport
  Homolog annotation: Hit_ID=Q9STX9; Match level="QueryCoverage=91%, HitCoverage=91%, E-value=3e-48, Identity=44%"; Hit description =Putative aquaporin TIP5.1
  Pfam annotation: Domain name=MIP; Domain location=16-186; Score=65.9; E_value=1.3e-16; Accession=PF00230.10; Description=Major intrinsic protein
  Subcellular localization annotation: CTP_CleavageSite=68; ConfidenceScore=5.47e-01
MAPSSVTVTVTSRFHESVTRNALRSFLSDFISTFFYVFLVVGAGMPSRKLMADASLNPTSLVVVGIASAFALSSVLYIAWDISGGNVNPAVTFAMAAVGGHGILTFVLVYRVYAARDPRHGPMSSTGILVVGLMAGASVLATAPFSGGSMNPACAFGSAAIAGSFRNQAVYWVGPLIGATIAGLLYDNVLFRSQPTDSIQGIG

SEQ ID NO: 198994 - protein, 264 aa, Glycine max
  Coding DNA Sequence Number=SeqID_82216
  Gene Ontology: Mol. function=nitric-oxide synthase activity; Cellular component=intracellular
  Homolog annotation: Hit_ID=Q66GP9; Match level="QueryCoverage=99%, HitCoverage=46%, E-value=6e-90, Identity=61%"; Hit description =Nitric-oxide synthase 1
MAINDPVAASAQRYKPIQSAVPGTTLGPIQINAFLGGGKLYDTPGVHLYHRQTAVVHSEDLPILAPQSRLRGLSFPSSILSSVEEGASTIVNGLNAFSIFWGGLVRIDVLKVLPETCLTFYGPKRIPIHMVPTEQAVEFYQTELGVLLTPPSGGENAENWKGLESERKLQIKFEDVDSYDPKPACDIAISGLGWFTVEPVSRSLKISQPKPVETAGELILAVHVPKAVEIFVRSPIPVGKAGAEWYQYVELTEKQEEMRPKWYF

SEQ ID NO: 198995 - protein, 186 aa, Glycine max
  Coding DNA Sequence Number=SeqID_82217
  Gene Ontology: Mol. function=nitric-oxide synthase activity
  Homolog annotation: Hit_ID=Q66GP9; Match level="QueryCoverage=83%, HitCoverage=28%, E-value=1e-36, Identity=50%"; Hit description =Nitric-oxide synthase 1
  Subcellular localization annotation: CTP_CleavageSite=45; ConfidenceScore=5.47e-01
MALKTLSTFLSPLSLPNTKFPQFLTTKPSLILCEFPRSQKSRLLAADSEGTGAAAPSPGEKFLERQQSFEDAKIILKENKKKRKKKDNAIKASRAVASCYGCGAPLHTSDADAPGYVDPETYELKKKHHQLRTVLCRRCRLLSHGKMITAVGGHGGYPGGKLFVTAEELREKLSHLRHEKALIVKL

SEQ ID NO: 198996 - protein, 370 aa, Glycine max
  Coding DNA Sequence Number=SeqID_82218
  Gene Ontology: Mol. function=nucleic acid binding; Cellular component= nuclear pore; Biological process=DNA integration
MWKHAMNEDMQSMIVNGIWELVDLLENCNAIDCKWVFKTKKDSNGNIKKFKARLVEKGFMQNEGVDFKETFSPISTKDSFRIIMTLKAHFDLELHQMNNYEPGDVSIVKGDKFNKNQCHKNEIERAKMNDRLFGSGLSSLMYAQVCTGPNIAFIVGVLSRYQLNPRNDHWIVAKKVIRRVDNLEVVGYTNSYLGGYFDDKRSTSGYIFMMAGDAISWKSKKQTLVASCTMQAEFIVCFTVVTHVVWLRNLMTRLSIMDSIARPLRILCDNNIVVFYTKNNKTSKGSKHLKLKCPTIRDLVKDGSIVVKHVDIDSMLVDPMTKGLKPVVFIQHVENMGIVSSFDMLDVKLLKLGVVETTVPMVDTKIGAKP

SEQ ID NO: 198997 - protein, 143 aa, Glycine max
  Coding DNA Sequence Number=SeqID_82219
  Gene Ontology: Mol. function=transporter activity; Cellular component= membrane; Biological process=oligopeptide transport
  Homolog annotation: Hit_ID=Q9CAR8; Match level="QueryCoverage=72%, HitCoverage=17%, E-value=3e-44, Identity=81%"; Hit description =Nitrate transporter (NTL1); 53025-56402
MELEAPQVSTWEGYVDWRNKPALRGRHGGMLAASFVLVAEILENLAFLANASNLVLYLRHYMHMSPSKSANNVTNFMGTAFILALLGGFLSDAFFTSYRVYLISAVIEFLENNYIKKEEIFNFFLWVTLGTRVRQKDVTCLPE

SEQ ID NO: 198998 - protein, 269 aa, Glycine max
  Coding DNA Sequence Number=SeqID_82220
  Gene Ontology: Mol. function=nucleic acid binding; Biological process= DNA integration
MTLLPSVLSKKRNSRKKKIDIALLSVHGKPTSGKGHWKKTKSASNTSYRYQGLGKPGKGQHHNQGGSRLAIFKKVDGLYKLSLDYDNTSSSLVVENSVAKRSTFEEKSLMLWYNRLGHISREMVKRLTKTNILPSLNLDDLGTCVGCIKGKFTRTKKKGATRSSDLLEKKTNPKMSRCFFVGYPDRTKGYRFFCPDKRNKIVESMNAKFLELDVVDLVIPSNEIDVESPKTISLPLPIPVVSVSSFVSIKTGVQIIPIETRVLIFQLRP

SEQ ID NO: 198999 - protein, 337 aa, Glycine max
  Coding DNA Sequence Number=SeqID_82221
  Gene Ontology: Mol. function=protein binding; Cellular component =nucleus; Biological process=response to stress
  Homolog annotation: Hit_ID=P94088; Match level="QueryCoverage=66%, HitCoverage=67%, E-value=1e-102, Identity=81%"; Hit description =Putative arginine-aspartate-rich RNA binding protein
  Pfam annotation: Domain name=LUC7; Domain location=1-268; Score =362.1; E_value=8.9e-106; Accession=PF03194.6; Description=LUC7 N _terminus
MDAQRALLDELMGAARNLTEEERKGYKEVSWDDKEVCGFYMVRFCPHDLFVNTRSDLGPCPRIHDPKLKESFEKSPRHDAYVPKFEAELSQFCEKLVMDLDRRVRRGRERLAQEVEPTPPPPLTAEKSEQLSVLEEKIKNLLEQVESLGEAGKVDEAEALMRKVETLNAEKTALTQPQNDKVLMLGQEKKMALCEICGSFLVANDAAERTQSHVTGKQHVGYGMTAKEKANEEERLAREREAEERRKQREKESERRRRSDSSDRDRHRDKDHNRERDRYRDRDSDRERSREHDVRGYRDGGRGVDYRARNGRNGGRDRYRDRSRSRSPGKHSHRRSS

SEQ ID NO: 199000 - protein, 478 aa, Glycine max
  Coding DNA Sequence Number=SeqID_82222
  Gene Ontology: Mol. function=transporter activity; Cellular component= membrane; Biological process=oligopeptide transport
  Homolog annotation: Hit_ID=Q9CAR8; Match level="QueryCoverage=97%, HitCoverage=79%, E-value=1e-164, Identity=62%"; Hit description =Nitrate transporter (NTL1); 53025-56402
  Pfam annotation: Domain name=MFS_1; Domain location=6-419; Score= -53.5; E_value=0.088; Accession=PF07690.6; Description=Major Facilitator Superfamily
  Pfam annotation: Domain name=PTR2; Domain location=6-407; Score =363.3; E_value=3.9e-106; Accession=PF00854.12; Description=POT family
  Pfam module annotation: Pfam domain module=MFS_1::PTR2; Domain location=6-419::6-407
MAKEHGFFVQGLIVLTIQARDPSLKPPKCDLDTPCQEVNDSKAAMLFIGLYLVALGVGGIKGSLPAHGGEQFDETTPSGRKQRSTFFNYFVFCLSCGALIAVTFVVWIEDNKGWQWGFAISTISIFVSIPVFLAGSATYKNKIPSGSPLTTILKVLVAALLNICTYKNTSSAVVNMASSPSNPHSGRMESKLETAKASTIAEPQRLPQVFNKAVTYKPRYSSLECTVQQVEDVKVVLKVLPIFGCTIILNCCLAQLSTFSVEQAATMDTKLGSLKVPPSSLPVFPVVFIMILAPIYDHIIIPYTRKATKSEMGITHLQRIGFGLVLSIVAMAVAALVEIKRKRVATHSGLLDYPTKPLPITFLWIAFQYLFLGSADLFTLAGLLEFFFSEAPIRMRSLATSLSWASLAMGYYLSSVIVSIVNSVTGNGTHKPWLSGANFNHYHLEKFYWLMCVLSGLNFLHYLYWATRYKYRGTGTTS

SEQ ID NO: 199001 - protein, 32 aa, Glycine max
  Coding DNA Sequence Number=SeqID_82223
MSSPFMNQRPTFIVWVVRGKQSSPLVIRSEAK

SEQ ID NO: 199002 - protein, 56 aa, Glycine max
  Coding DNA Sequence Number=SeqID_82224
  Gene Ontology: Cellular component=mitochondrion
  Homolog annotation: Hit_ID=Q39818; Match level="QueryCoverage=98%, HitCoverage=32%, E-value=1e-23, Identity=78%"; Hit description=Heat shock 22 kDa protein, mitochondrial precursor
  Subcellular localization annotation: CTP_CleavageSite=24; ConfidenceScore=5.26e-01
MTTAPTTTAPTSIVTPNALSLALRAATISSQVLNMMDQVMDNPFLSASRGIGAGAG

SEQ ID NO: 199003 - protein, 86 aa, Glycine max
  Coding DNA Sequence Number=SeqID_82225
MAGKTCEEGIPPLLLARQRSIGSRLFKNLFRKGFATGSGKISFSPIKRSCTNEWEHLCEFLGACYACAGGEKHELCILLFLKLDRK

SEQ ID NO: 199004 - protein, 97 aa, Glycine max
  Coding DNA Sequence Number=SeqID_82226
MALVLKERWEAEAAGRRRDLERREEERKRFAMREDAIELRLQKVGWFLDLMSKLGKNLCAGKWGVRVGDIRGMRFSKVLPWRASISVLLAIDHRGHT

SEQ ID NO: 199005 - protein, 60 aa, Glycine max
  Coding DNA Sequence Number=SeqID_82227
MVNSLPYLSLPLDYDYLVIEYDGCEQGWGVILKKEKNKYEKIHDEEICKYASGKYHTKPQ

SEQ ID NO: 199006 - protein, 90 aa, Glycine max
  Coding DNA Sequence Number=SeqID_82228
MQAKGTPRVGRKEDKSVTLIKAQWDLLALIYHLALSAECLAAVEIQHFSVETNWENTQSIIKSPRIWVVLLLYAARSLTGPGWISFQCSS

SEQ ID NO: 199007 - protein, 360 aa, Glycine max
  Coding DNA Sequence Number=SeqID_82229
  Gene Ontology: Mol. function=hydrolase activity
  Homolog annotation: Hit_ID=Q1S1X8; Match level="QueryCoverage=91%, HitCoverage=90%, E-value=3e-42, Identity=65%"; Hit description=NUDIX hydrolase
PICIDKAEKSLRVGVSIVDVAMEKEASSTDDPSSFTLLVSCPSGLSPSQVSVAFSDAYDRIPHSDVILENTISEIWKQRSQKNNSLFNGKKFRHTSNPLGNGAVVETNDNKILVLQRSDNVGEFPGHFVFPGGHPEICNLRSTDAALQRCVRCWTNARHGCGPDSYAMRYQGDDDKMRKGRMLSVALWPSIMATLSVNVLLWCLFNCDIVSGMTLNGVLKLGKAEAHPDLLVPVSVSMSCPTPCPNPCFLPQEIGITSHQYNKELTESINTKVSQEMFDSIVREVVEEIGVPASSLSIPAFIGISRRNLNVRPAAFFFIKCGLDSKEVRQFYSSAQDGYESTQLYAVPMVNLKLVLIVLA

SEQ ID NO: 199008 - protein, 234 aa, Glycine max
  Coding DNA Sequence Number=SeqID_82230
  Gene Ontology: Mol. function=transcription factor activity; Biological process=regulation of transcription, DNA-dependent
  Homolog annotation: Hit_ID=Q4K9F0; Match level="QueryCoverage=77%, HitCoverage=61%, E-value=3e-51, Identity=53%"; Hit description =Transcriptional regulator, LysR family
  Pfam annotation: Domain name=HTH_1; Domain location=27-76; Score =45.0; E_value=2.5e-10; Accession=PF00126.17; Description=Bacterial regulatory helix-turn-helix protein, lysR family
  Pfam annotation: Domain name=LysR_substrate; Domain location=100-234; Score=6.9; E_value=0.00029; Accession=PF03466.10; Description=LysR substrate binding domain
  Pfam module annotation: Pfam domain module=HTH_1::LysR_substrate; Domain location=27-76::100-234
MARSRRVVGPPGRPRPAPIALAPLVPSRAICLAKAAEDLDMSSAGLSKQLRALEAHLGAVLIQRTTRKMSLTDTGAAYYAECCRLLDALDALEKSVKRQSGRVSGRLRVNAPVSFALSVLSPLLARFLRQYPELRLDLAMEDRLVDAVGQGFDVSIRLRAQLDDSSLIARRLASLTQVLCAAPSYLERRGLPDSVEALRGHDILSYSLADSPGPVPEEDAGQPADPLAGPALIQ

SEQ ID NO: 199009 - protein, 63 aa, Glycine max
  Coding DNA Sequence Number=SeqID_82231
MPYADLLPSLISNQMVVVNPVKVYQSPFPRWYNSNATFAYHGDDDKKPKRMISRLSHQVQNQD

SEQ ID NO: 199010 - protein, 217 aa, Glycine max
  Coding DNA Sequence Number=SeqID_82232
  Gene Ontology: Mol. function=RNA-directed DNA polymerase activity; Biological process=RNA-dependent DNA replication
  Homolog annotation: Hit_ID=Q0ZCD0; Match level="QueryCoverage=86%, HitCoverage=16%, E-value=9e-13, Identity=27%"; Hit description =Integrase
MERSMIDAASGGALGDMTPVEARNLIEKMASNYQQFSARNDVIVLRGVHDVATDSSSSAENKKLEGKLDALVNLVTQLAINPKSAFAPVTVARVCGLCSSADHHTNLCPSLQQFGINEKPEAYAANIYNRPPQQQNQQQQNNYDLSSNRYNPGWRNHPNLRWSNPPQQQQQQQQPAPPFRNAAGPSRPYVPPPMQQQQQRQQATEAPSQPSLEELVR

SEQ ID NO: 199011 - protein, 491 aa, Glycine max
  Coding DNA Sequence Number=SeqID_82233
  Gene Ontology: Mol. function=protein serine/threonine kinase activity; Cellular component=chloroplast; Biological process=protein amino acid phosphorylation
  Homolog annotation: Hit_ID=Q5XWQ1; Match level="QueryCoverage=99%, HitCoverage=81%, E-value=0.0, Identity=78%"; Hit description =Serine/threonine protein kinase-like
  Pfam annotation: Domain name=Pkinase; Domain location=135-415; Score =167.8; E_value=2.8e-47; Accession=PF00069.15; Description=Protein kinase domain
  Pfam annotation: Domain name=Pkinase_Tyr; Domain location=135-415; Score=138.4; E_value=1.9e-38; Accession=PF07714.7; Description =Protein tyrosine kinase
  Pfam module annotation: Pfam domain module=Pkinase::Pkinase_Tyr; Domain location=135-415::135-415
MGLGGENGKVVESWDVCKSKGGRKKKKKGDAEEVEEGAEAEAGCWVRLRFIGSCISSRSKVDTSVSASGISTHYAESKSTNDTSRDQPTAPAVSSTTTSNAESNSSTSKLEEELKIASRLRKFSFNDLKSATRNFRPESFLGEGGFGCVFKGWIEENGTAPVKPGTGLTVAVKTLNHDGLQGHKEWLAEVNFLGDLVHPNLVKLVGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKHRPNGEHNLVEWARPHLGERRRFYRLIDPRLEGHFSVKGAQKAAQLAAHCLSRDPKSRPLMSEVVEALKPLPSLKDMASSSYYFQAMQADRFGASPNTRNGRMQGALLTRNGQQQRSLSIPNGTYASPYHHQFPQPSPKPNGKA

SEQ ID NO: 199012 - protein, 232 aa, Glycine max
  Coding DNA Sequence Number=SeqID_82234
  Gene Ontology: Mol. function=peptidase activity; Cellular component =membrane
  Homolog annotation: Hit_ID=Q5KSB6; Match level="QueryCoverage=71%, HitCoverage=58%, E-value=6e-74, Identity=83%"; Hit description =Hypersensitive-induced response protein
  Pfam annotation: Domain name=Band_7; Domain location=52-223; Score =112.0; E_value=1.7e-30; Accession=PF01145.15; Description=SPFH domain  Band 7 family
MEPELMISGKHVVMWSHKTREGFFVDCLSLRPSAPEKKIGLAKMGQMFSMFGFVQVEQSSVAIKEVFGKYNDVLDPGCHCVPWYFGNRVAGALSLRIQQLDVRCETKTKDNVFVTVVASIQYRALAEKASDAYYKLSNTRAQIQSYVFDVIRASVPKMELDATFEQKTDIAKTVEEELEKAMSAYGYEIVQTLIVDIEPDERVKRAMNEINAESFIFPFQAIKINVSLMERF

SEQ ID NO: 199013 - protein, 386 aa, Glycine max
  Coding DNA Sequence Number=SeqID_82235
  Gene Ontology: Cellular component=integral to membrane
  Homolog annotation: Hit_ID=Q1S1X5; Match level="QueryCoverage=99%, HitCoverage=61%, E-value=1e-115, Identity=60%"; Hit description =Ankyrin
MAVKGQSLEVVEELIKADPSTINMVDNKGNTALHIATRKGRARMRGILTSKRYAYVASMSVELIQPCNVLICNIYNNVQVQVLVSSDLGLMIVKLLLGQTETDALVVNRSGETALDTAEKTGNSEVKDILLEHGVRRAKAIKAQPGTATARELKQTVSDIKHEVHYQLEHTRQTRRGVQGIAKRINKMHTEGLNNAINSTTVVAVLIATVAFAAIFTVPGQFADEPKDIPAGSGMTIGEANIAPQAAFLIFFVFDSIALFISLAVVVVQTSVVIIESKAKKQMMAIINKLMWLACVLISVAFLALSFVVVGKDQKWLAIGVTIIGTTIMATTLGTMSYWVIRHRIEASNLRSIRKSSMGSRSRSFSVSVMSDSELLNNDRKILYAI

SEQ ID NO: 199014 - protein, 600 aa, Glycine max
  Coding DNA Sequence Number=SeqID_82236
  Gene Ontology: Mol. function=transcription regulator activity; Cellular component=nucleus; Biological process=regulation of transcription
  Homolog annotation: Hit_ID=Q52JK6; Match level="QueryCoverage=90%, HitCoverage=93%, E-value=0.0, Identity=65%"; Hit description=VIP2
  Subcellular localization annotation: CTP_CleavageSite=25; ConfidenceScore=5.41e-01
EFSLQSSLNGSASNLPDGAGRSFASSFSGQSGAASPNFHHTGAIQGLHNIHGSFNVPNMPGTLTSRNSTINNVPSGGVQQPTGSLSSGRFTSNNLPVALSQLSHGSSHSGITNRGGISVVGNPGFSSSTNGVGGSIPGILPTSAAVGNRNAVPGLGVNPILGNAGPRITSSVGNMVGGGNIGRTGGGLSVPALASRLNLGANSGSGGLGMQGPNRLMSGVLPQVDCGNQHFLDAGSPQVISMLGNSYPSGGPLSQSHVQAVSNLNSMGMLNDVNTNDSSPFDINDFPQLTSRPSSAGGPQGQLGSLRKQGLGVSPIVQQNQEFSIQNEDFPALPGFKGGNADYAMDMHQKEQLHDNAVPMMQSQHFSMGRSAGFSLGGTYSSHRAQQQQHAPSVSSGNVSFSSVNNQDLLHLHGSDIFPSSHSTYHSQLVFQDETSGPPGIGLRPLNSPNTVSGMGSYDQLIQQYQQHQNQSQFRLQMSAVNQSFRDQGMKSIQTAQPAPDPFGLLGLLSVIRMSDPDLTSLALGIDLTTLGLNLNSSENLHKTFGSPWSDESAKGDPEFTVPQCYYAKQPPALHLQQRLVLSQRTSFVVYKSSQHGAAG

SEQ ID NO: 199015 - protein, 448 aa, Glycine max
  Coding DNA Sequence Number=SeqID_82237
  Gene Ontology: Mol. function=pectate lyase activity; Cellular component=anchored to membrane; Biological process=pathogenesis
  Homolog annotation: Hit_ID=Q1T4K8; Match level="QueryCoverage=92%, HitCoverage=94%, E-value=1e-144, Identity=58%"; Hit description =Pectate lyase, N-terminal; Pectolytic enzyme, Pectin lyase fold
  Pfam annotation: Domain name=Pec_lyase_C; Domain location=179-364; Score=307.8; E_value=2e-89; Accession=PF00544.9; Description=Pectate lyase
  Pfam annotation: Domain name=Pec_lyase_N; Domain location=36-88; Score=14.6; E_value=0.00019; Accession=PF04431.4; Description =Pectate lyase, N terminus
  Pfam module annotation: Pfam domain module=Pec_lyase_C::Pec_lyase_N; Domain location=179-364::36-88
MAKIHNFYLLTCLVVMIPTLYANVKEDEAYWKRQSEVLLVDSYWQERASIAEKENQQAYTSDPYSLTKNLTFSVSEIIIGEKSGRRNLRGRGGKCMATNPIDRCWRCDPNWANNRKKLADCVQGFGRNTIGGKNGPFYVVNSSLDNDMVNPAPGTLRHAVTRSGPLWIIFARSMNIRLSQELIMTSDKTIDGRGVDVYIANGAGITIQFIKNVIIHGIKIFNIQVGNGGLIRDSETHYGFRTYSDGDGISIFGSSNVWIDHVSMRNCKDGLIDAIQGSTAITISNGHFTDHNEVMLFGASDSYDGDKIMQITLAFNHFGKRLVQRMPRCRYGFVHVVNNDYTHWEMYAIGGSKHPTIISEGNRFIAPNNVYAKEITKREYSPEQEWKNWQWRSINDEYMNGAFFREGGSQITDRPFSRQDMITAKPGSYVGRLTRYAGSLRCIVGKPC

SEQ ID NO: 199016 - protein, 333 aa, Glycine max
  Coding DNA Sequence Number=SeqID_82238
  Homolog annotation: Hit_ID=Q0GPG4; Match level="QueryCoverage=99%, HitCoverage=99%, E-value=1e-144, Identity=79%"; Hit description=BZIP transcription factor bZIP109
  Pfam annotation: Domain name=DUF1664; Domain location=85-242; Score =121.7; E_value=2.1e-33; Accession=PF07889.3; Description=Protein of unknown function (DUF1664)
MAMAMQSGIGVSKILIIAGAGYTGTVLIKNGKLSDLIGELQGLEKSGEHAEGEGEYADAIAAQVRRLANEVRQLASNRPITVLNGGNLSSLVVPAAALGALGYGYMWWKGISFSDLMYVTRRNMEKAVADLTKKLQHASDVIADTKKHLTQRIQNLNDKMLKLNELQRSTKDEVRLLPHTNLMLAHNWIKIPLDDIDFDTLLMDIYVAGVRSTITNIHEDLGYLQQTVETLDYRLAELSSKQDYANYGLSYLIDYVHGKSQKKPELLQGLKDIAETLSGLDMSASDSVMPDGGDKREQQRRPLLRKGIAKTLSSLDKFASDGIMLDGVDKLEQ

SEQ ID NO: 199017 - protein, 858 aa, Glycine max
  Coding DNA Sequence Number=SeqID_82239
  Gene Ontology: Mol. function=protein serine/threonine kinase activity; Cellular component=membrane; Biological process=protein amino acid phosphorylation
  Homolog annotation: Hit_ID=Q1SHR4; Match level="QueryCoverage=97%, HitCoverage=99%, E-value=0.0, Identity=72%"; Hit description=Protein kinase
  Pfam annotation: Domain name=Pkinase; Domain location=497-767; Score =129.0; E_value=1.3e-35; Accession=PF00069.15; Description=Protein kinase domain
  Pfam annotation: Domain name=Pkinase_Tyr; Domain location=497-767; Score=126.9; E_value=5.8e-35; Accession=PF07714.7; Description =Protein tyrosine kinase
  Pfam module annotation: Pfam domain module=Pkinase::Pkinase_Tyr; Domain location=497-767::497-767
MRDCREICLFICVLSILPLVCFSANFVPTDNYLIDCGSPTNTPIDSRNFTADSFYKNFLSTQQDIVASTSLKSITSTSDSPLYSTARIFTAPSKYTFPINKKGRHWIRLYFFPFAYEKYNLSAAKFAVSTQNYNLLSDFSVQKNPVMKEYSLNVTSDTLVITFSPSDNSIAFVNAIEVVSVPDDLIIDDANTLNPAGSYSGLFAQALETVFRVNMGGPTISSGSDTLQRTWVPDEKFLIQPNLARNFTNIGAVKYVDGGPTENTAPPSVYGTLTQMNSADDPRSNFNVTWQFDVEPQFQYLVRLHFCDIISKSLNELYFNVYINSWFVAKDLDLSTINNNILAAPFFKDMITAPSASTKIFISIGPSTVNSNYPNAILNGLEIMKMNNSVSSLSSSTAVPLSSTSGSGSKKVGLIVGVSVGAFLAVVIVGVFFFLLCRKRKRLEKEGHSKTWVPLSINDGTSHTMGSKYSNATTGSAASNFGYRFPFVTVQEATNNFDESWVIGIGGFGKVYKGELNDGTKVAVKRGNPRSQQGLAEFRTEIEMLSQFRHRHLVSLIGYCDERNEMILIYEYMEKGTLKSHLYGSGFPSLSWKERLEICIGAARGLHYLHTGYAKAVIHRDVKSANILLDENLMAKVADFGLSKTGPEIDQTHVSTAVKGSFGYLDPEYFRRQQLTEKSDVYSFGVVLFEVLCARPVIDPTLPREMVNLAEWSMKLQKRGQLEQIIDPTLAGKIRPDSLRKFGETAEKCLADFGVDRPSMGDVLWNLEYALQLQEAVVQGDPEENSTNMIGELSPQVNNFNHEVSVSAAQFEATSLDDLSGVSMSRVFSQLVKSEGSGLSSERVVLSLLACLRHFIDL

SEQ ID NO: 199018 - protein, 125 aa, Glycine max
  Coding DNA Sequence Number=SeqID_82240
  Gene Ontology: Mol. function=protein serine/threonine kinase activity; Biological process=protein amino acid phosphorylation
  Homolog annotation: Hit_ID=Q1SH92; Match level="QueryCoverage=82%, HitCoverage=33%, E-value=9e-33, Identity=65%"; Hit description =Protein kinase
LRKPPAVSFDLIGERTTGGVFEENVLILFSVFNSVIMAETFDDIRGSSKAIEYLLLVFQHRRGVNIGGFDGGGRRKMNGSICGYGYVDGGEAASAERVSANPNHGYEQCMCVFSVLEEKENKRRK

SEQ ID NO: 199019 - protein, 377 aa, Glycine max
  Coding DNA Sequence Number=SeqID_82241
MERGILKSKFGVLKLHKDQLGQQKFKKKEYQQLDKPKSLVERIYTQNGNRFKNNAYPGLIKERERWSKLTNFLIKINEEVVHKFYANAYLRIDSDPTLRSLVHGVLIKYDVVTINKYLENTFKEAVSQDCAFFLVCAWRSSFNNTDFSNKLCILGRSYVENDEGKPLRFKRSSLRPLLKFGPAFSSPTLLSPYTPQSLACLAYIVYCVMSNIGVNIGSVISREMHKFVMAKSSTNPPKPLGFPALITTIFAHQGSLSTWTTLIKIPTILLSLMKRNLSSLSLLSLSIVLKWLLPLYFYFNKVPPSTGPYQASMLPSITSSTMQPQVQPQLGDQPTFMRGVDGPDISSNVKGVGLVAGKGQQAEEGPIKEEIKEEDDD

SEQ ID NO: 199020 - protein, 139 aa, Glycine max
  Coding DNA Sequence Number=SeqID_82242
MHRPFLGGCAEKGPSHPEAKHCPHVLSRRGCEYLEQKLMAEKKNKKLEKAAQSRITDGVIDPPSPIRRHVKWKMTRTKKTGQMTSEAAKEITEKIDSLEEQASQGSFVLTAAIGRPEHPGHVCAARASVIIKKYFGLAP

SEQ ID NO: 199021 - protein, 279 aa, Glycine max
  Coding DNA Sequence Number=SeqID_82243
  Homolog annotation: Hit_ID=Q9FLV7; Match level="QueryCoverage=39%, HitCoverage=32%, E-value=2e-11, Identity=35%"; Hit description =Arabidopsis thaliana genomic DNA, chromosome 5, P1 clone:MZF18
  Pfam annotation: Domain name=DUF313; Domain location=141-252; Score =30.7; E_value=2.2e-07; Accession=PF03754.4; Description=Domain of unknown function (DUF313)
MRDLKTLKELVASVTDWKSLEKMSCKPFKPSILHLAISQDAPHLYSEEQLIQLKNFSKLLSRAESKPNTNKTDKRVAKKRQIEERPKEERIMPAMIKKPRKIILVQNGPSPDLSRRIVLGHSGTSSDLPRRIILEHSGPSPDLPVQFKNRVTELSGHDLKYLMHKRLFCSDVRPNNNRLMPMNEIMCEFLTQDEIEKLDERNGSNGKGRLVGLEVTVLDPCLREFSLALKKWSMQRTDTYNLVTNWNRIVFINEFEEGHELQIWSFRVDNKLYLLLNKL

SEQ ID NO: 199022 - protein, 99 aa, Glycine max
  Coding DNA Sequence Number=SeqID_82244
  Gene Ontology: Mol. function=protein serine/threonine kinase activity; Biological process=protein amino acid phosphorylation
  Homolog annotation: Hit_ID=Q1SH95; Match level="QueryCoverage=98%, HitCoverage=28%, E-value=3e-18, Identity=53%"; Hit description =Protein kinase
MKRWSAEMLLHHPFVNNETVSFHKVNEPLPLPSPSPRTHFDLTHWASTVTTWLPSSPDSDEWRMAEFGSSCSPENRFRRLLTDQTPANWSESDGWTSVR

SEQ ID NO: 199023 - protein, 104 aa, Glycine max
  Coding DNA Sequence Number=SeqID_82245
  Homolog annotation: Hit_ID=Q9ZTT3; Match level="QueryCoverage=55%, HitCoverage=7%, E-value=6e-07, Identity=46%"; Hit description =Subtilisin-like protease C1
NSTATIFRSDEDNNSLALYIASFSSRGPNLITPNSLKGLTSIGQKKSFSVIIEGSINTEILSASLVWDDGTFQVRSPIVVYGKVDVITWSKNTMVPTNLRVIHN

SEQ ID NO: 199024 - protein, 151 aa, Glycine max
  Coding DNA Sequence Number=SeqID_82246
  Gene Ontology: Mol. function=serine-type endopeptidase activity; Biological process=negative regulation of enzyme activity
  Homolog annotation: Hit_ID=Q39547; Match level="QueryCoverage=51%, HitCoverage=12%, E-value=3e-14, Identity=61%"; Hit description =Cucumisin precursor
  Pfam annotation: Domain name=Subtilisin_N; Domain location=75-145; Score=33.5; E_value=7.3e-07; Accession=PF05922.7; Description =Subtilisin N-terminal Region
MGEQMCNKQPISVTQKGGGGTANAIAIKIVTKNRVERSFSLISTGKYDFFKAKPSFHALNCGLIIHQTYSKNDRKTYIVYMGDHPKGMDPASLPSLHMTMAQKVLGSDFEPEAILHSYKKSFNGFVIKLTEQEAEKMAGRLICTQLDPGTS

SEQ ID NO: 199025 - protein, 158 aa, Glycine max
  Coding DNA Sequence Number=SeqID_82247
  Gene Ontology: Mol. function=serine-type endopeptidase activity; Cellular component=cytoplasm; Biological process=negative regulation of enzyme activity
  Homolog annotation: Hit_ID=Q39547; Match level="QueryCoverage=79%, HitCoverage=16%, E-value=2e-29, Identity=53%"; Hit description =Cucumisin precursor
  Pfam annotation: Domain name=PA; Domain location=60-146; Score=8.9; E_ value=0.04; Accession=PF02225.12; Description=PA domain
MKRGILTSNSAMNLGPGFYTTTIYPPWILSVAASTIDRKFITKVQVDNGMVFEGVSINTFDLKRKMFPMVYAGDVPNTADGYNSSISRLCYDNSVDKHLVKGKIVLCGGFQSIGHVEVLSGEAGMLVGGPAAKDVQATFALVKARAWNKQKLAAKLRN

SEQ ID NO: 199026 - protein, 493 aa, Glycine max
  Coding DNA Sequence Number=SeqID_82248
  Gene Ontology: Mol. function=sequence-specific DNA binding; Cellular component=nucleus; Biological process=regulation of transcription
  Homolog annotation: Hit_ID=Q1T4J9; Match level="QueryCoverage=90%, HitCoverage=76%, E-value=9e-69, Identity=38%"; Hit description=DNA -binding WRKY
  Pfam annotation: Domain name=WRKY; Domain location=180-240; Score =143.6; E_value=5.3e-40; Accession=PF03106.6; Description=WRKY DNA -binding domain
MEFTKGHGICTDQNLESAKGEKGETREENKMLEFYGILHHDKPDDATNAKGVFSHIEENEESELVSLSLGISISKGKPSKNEKMINNGIEKREDEDVHKRLVLGLDINLDPVDQDELAANNSTPESSFGEGGKEDEPTEMWPPSKVSKTMKSEDKSEASPHYQPKKTRVSIRARCDTQTMNDGCQWRKYGQKMAKGNPCPRAYYRCTASPSCPVRKQVQRCAEDMSILITTYEGTHNHPLPMSATAMACTTSAAASMLQSPSLSSQHGLVDSAISSIINSSAANYYNPNNALNFSTHQVSRPNQFYFSNSSISTLNSHPTITLDLTAPPTSSNSSFTHMPKYSSTNLNFSSGFSPLHSSMPQSPWSSYNYFNSGTLSQNRKHGGNYLLNTGNQNQPHSLGNLHQPIYMRSNTISQHSLPDPIVAATKAITSNPKFQSALATALTTYVGNEAGGGRLRENHVLESAELMNLKLCSENSIGNSSIVQLPLLEQWK

SEQ ID NO: 199027 - protein, 217 aa, Glycine max
  Coding DNA Sequence Number=SeqID_82249
  Gene Ontology: Mol. function=nucleotide binding; Cellular component =membrane; Biological process=small GTPase mediated signal transduction
  Homolog annotation: Hit_ID=Q40193; Match level="QueryCoverage=99%, HitCoverage=99%, E-value=1e-100, Identity=85%"; Hit description=Ras -related protein Rab11C
  Pfam annotation: Domain name=Arf; Domain location=1-173; Score=-71.9; E_value=0.00032; Accession=PF00025.11; Description=ADP-ribosylation factor family
  Pfam annotation: Domain name=MMR_HSR1; Domain location=13-128; Score =12.1; E_value=7.7e-05; Accession=PF01926.13; Description=GTPase of unknown function
  Pfam annotation: Domain name=Miro; Domain location=14-128; Score =83.0; E_value=9e-22; Accession=PF08477.3; Description=Miro-like protein
  Pfam annotation: Domain name=Ras; Domain location=14-175; Score =327.9; E_value=1.7e-95; Accession=PF00071.12; Description=Ras family
  Pfam module annotation: Pfam domain module=Arf::MMR_HSR1::Miro::Ras; Domain location=1-173::13-128::14-128::14-175
MAFKVDHEYDYLFKVVLIGDSGVGKSNILSRFTRNEFCLESKSTIGVEFATRTLQVEGKTVKAQIWDTAGQERYRAITSAYYRGAVGALLVYDITKRQTFDNVQRWLRELRDHADSNIVIMMAGNKSDLNHLRAVSTEDAQSLAEREGLSFLETSALEAYNVDKAFQTILFDIYHIISKKALAAQEATSSTGLPQGTTINVSNMAGNAGGNRSCCSN

SEQ ID NO: 199028 - protein, 647 aa, Glycine max
  Coding DNA Sequence Number=SeqID_82250
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=99%, HitCoverage=87%, E-value=0.0, Identity=55%"; Hit description =Subtilisin-like protease C1
  Pfam annotation: Domain name=PA; Domain location=261-359; Score=37.7; E_value=4.1e-08; Accession=PF02225.12; Description=PA domain
  Pfam annotation: Domain name=Peptidase_S8; Domain location=22-488; Score=24.0; E_value=4.6e-08; Accession=PF00082.12; Description =Subtilase family
  Pfam module annotation: Pfam domain module=PA::Peptidase_S8; Domain location=261-359::22-488
MAEMDNVISVFPNKKNRLHTTRSWDFVGLPQNVKRATTESDIIVGVLDTGVWPESESFSDKGFGPPPTKWKGSCHNFTCNNKIIGAKYFNLENHFTKDDIISPRDSQGHGSHCASTVAGNSVNSASLFGFGSGTARGGVPSARIAVYKVCWLTGCGDADNLAAFDEAISDGVDIISISTGASGIVHDPYFHDSNNIGSFHAMKRGILTSNSGNNLGPSLYSMTNYAPWLVSVAASTFDRKIVTKVQLGNGAIYEGVSINTYDLKKKFYPLVYGGDIPNIAGRHNSSTSRYCVEDSLDKHSVKGKIVLCDLIQAPEDVGILSGATGVIFGINYPQDLPGTYALPALQIAQWDQRLIHSYITSTRNATATIFRSEEINDGLMPFIASFSSRGPNPITPNTLKPDIAAPGVEVIAAWSPVASLSQFEGDKRAVQYNVISGTSMACPHATAAAAYVKSFHPSWSPAMIKSALITTATPMSPILNPEAEFAYGAGLINPVKAANPGLVYDINEADYIKFLCGEGYTDKELRILTEDHSSCSGRANKKAVYELNLPTFALSVNGLDYSRAYRRTVTNVGSATSTYKAKVIAPSLFNIQVKPSTLSFTSIGQKKSFYVIIEGTINVPIISATLILDDGKHQVRSPIVAYKAPNN

SEQ ID NO: 199029 - protein, 257 aa, Glycine max
  Coding DNA Sequence Number=SeqID_82251
  Gene Ontology: Mol. function=hydrolase activity; Cellular component =intracellular; Biological process=protein kinase C activation
  Homolog annotation: Hit_ID=Q1S7R2; Match level="QueryCoverage=99%, HitCoverage=49%, E-value=2e-97, Identity=61%"; Hit description =Tetratricopeptide-like helical
  Pfam annotation: Domain name=PPR; Domain location=27-61; Score=37.7; E_value=4.1e-08; Accession=PF01535.11; Description=PPR repeat
MMLNKESERAVDMFQRLESEGLKPDSATWNSMISGFAQLGVCGEAFKYFREMQYVGVAPCLKIVTSLLSASANSSMLRRGKEIHGFALRTDINRDDLLATALVDIYMKSGHPSWARGVFDQFDAKPDDPAFWNAMIGGHMGQVDRGLHFFRMMGKEYGLQPKPEHFGCIVDLLGRSEPPVSVFASLLGACRCYLDSNLGEEMAKKLLDIEPENPAPLVVLSNIYVGLGRWKEVERIRGMITDKGLDKLSGFSMIELA

SEQ ID NO: 199030 - protein, 413 aa, Glycine max
  Coding DNA Sequence Number=SeqID_82252
  Gene Ontology: Mol. function=zinc ion binding
  Homolog annotation: Hit_ID=UPI000034EE49; Match level="QueryCoverage =97%, HitCoverage=78%, E-value=1e-160, Identity=67%"; Hit description= zinc ion binding
  Pfam annotation: Domain name=LIM; Domain location=57-116; Score=15.6; E_value=8.4e-05; Accession=PF00412.12; Description=LIM domain
MALSSAEDLKRPNGYNWGEDTGDDYSKAPHDTLNSSAHPPFAPTPFYPHPHKYRRVCGGCNQEIMYGNCLGCMDTYFHPNCFRCHSCGYPITEREIPINAAGLIEYRCHPFWSQKYCPSHEYDNTARCCSCERLEPLNIKYYRLEDGRSLCLECMESAIMDTGDCQPLYHSIRDYYEGMQMRIDQQVPMLLVEREALNEAIVGEKNGFHHLPETRGLCLSEEQTVTSIHRRPRIGGHRLIGMRTQPQKLTRKCEVTAILVLYGLPRLLTGAILAHELMHAWLRLHGYRNLTPEVEEGICQVLSYMWLESEVMPSFQNMPSTSTSAGSSYSSSSSSSSSSSSSSSKKGAKSHVENKLGEFFKNQIANDSSPAYGGGFRAANEAVNKYGLRRTLDHIHWTGFFPVEKERKFSKYG

SEQ ID NO: 199031 - protein, 265 aa, Glycine max
  Coding DNA Sequence Number=SeqID_82253
  Gene Ontology: Mol. function=transporter activity; Cellular component= mitochondrial inner membrane; Biological process=transport
  Homolog annotation: Hit_ID=Q10NJ7; Match level="QueryCoverage=92%, HitCoverage=89%, E-value=6e-71, Identity=49%"; Hit description =Mitochondrial carrier protein, expressed
  Pfam annotation: Domain name=Mito_carr; Domain location=134-263; Score=104.1; E_value=4.1e-28; Accession=PF00153.17; Description =Mitochondrial carrier protein
  Pfam annotation: Domain name=Mito_carr; Domain location=27-122; Score= 84.8; E_value=2.7e-22; Accession=PF00153.17; Description =Mitochondrial carrier protein
  Pfam module annotation: Pfam domain module=Mito_carr::Mito_carr; Domain location=134-263::27-122
  Subcellular localization annotation: CTP_CleavageSite=69; ConfidenceScore=5.06e-01
MEARVGVAVDGGGVRKLVQPPPPKHIGTVSQLLAGGVAGAFSKSCTAPLARLTILFQIQGMHSNVATLRKASIWNEASRIIHEEGFGAFWKGNLVTIAHRLPYSSVNFYSYEHYKKLLKMVPGLQSHRDNVSADLCVHFVGGGLAGVTAATTTYPLDLVRTRLAAQRASPGAAVKLCLGDLLVMGSNPETASLHMQGKQLEGAGGRARVYTTGLYGVFRHIIQTEGVRGLYRGILPEYYKVVPGVGICFMTYETLKMLLADIGTA

SEQ ID NO: 199032 - protein, 105 aa, Glycine max
  Coding DNA Sequence Number=SeqID_82254
MKEVLFETPKWKPKFKAEKPIESNVENQKEKLFVKPNLIFEVFKVCSVSESVCTLVEEETHQMVNRSLTKGQSSTSLFQAGKSLLDLLLNHQNGKVKVARVKPRP

SEQ ID NO: 199033 - protein, 93 aa, Glycine max
  Coding DNA Sequence Number=SeqID_82255
VSLMQNFETIAFKAEDAELDEGGEGENGAGEVEVFEDEAGDAVVVVVAEVGDAVSGFEANEVVGTKILVWLWFYGIESMAVLGLANGTVLFVI

SEQ ID NO: 199034 - protein, 76 aa, Glycine max
  Coding DNA Sequence Number=SeqID_82256
  Homolog annotation: Hit_ID=Q1S7R2; Match level="QueryCoverage=53%, HitCoverage=6%, E-value=8e-10, Identity=70%"; Hit description =Tetratricopeptide-like helical
MARVRSVGGCEGGRSIRVGMETDFEEMGMEGLGVGRGTEVGACFEESGECEGVKGGGRLHVLLCPCNSDLTLVATK

SEQ ID NO: 199035 - protein, 452 aa, Glycine max
  Coding DNA Sequence Number=SeqID_82257
  Gene Ontology: Mol. function=snoRNA binding; Cellular component =nucleus; Biological process=35S primary transcript processing
  Homolog annotation: Hit_ID=Q8W4D9; Match level="QueryCoverage=99%, HitCoverage=100%, E-value=0.0, Identity=75%"; Hit description=SOF1 protein-like protein
  Pfam annotation: Domain name=Sof1; Domain location=361-448; Score =146.1; E_value=9.1e-41; Accession=PF04158.5; Description=Sof1-like domain
  Pfam annotation: Domain name=WD40; Domain location=193-232; Score =29.4; E_value=1.3e-05; Accession=PF00400.22; Description=WD domain, G-beta repeat
  Pfam annotation: Domain name=WD40; Domain location=279-317; Score =33.7; E_value=6.6e-07; Accession=PF00400.22; Description=WD domain, G-beta repeat
  Pfam annotation: Domain name=WD40; Domain location=321-360; Score =24.6; E_value=0.00036; Accession=PF00400.22; Description=WD domain, G-beta repeat
  Pfam annotation: Domain name=WD40; Domain location=56-95; Score=30.3; E_value=6.6e-06; Accession=PF00400.22; Description=WD domain, G-beta repeat
  Pfam annotation: Domain name=WD40; Domain location=99-137; Score =40.1; E_value=7.7e-09; Accession=PF00400.22; Description=WD domain, G-beta repeat
  Pfam module annotation: Pfam domain module=Sof1::WD40::WD40::WD40::WD4 0::WD40; Domain location=361-448::193-232::279-317::321-360::56 -95::99-137
MKVKVISRSVDEFTRERSQDLQRVFRNYDPSLRPQEKAVEYVRAVNAVKLDKIFARPFIGALDGHVDAVSCMTRNPSQLKGIFSSSMDGDIRLWDLAARRTVCQFPGHRGAVRGLTASTDGRILVSCGTDCTIRLWSVPITTLMESDDSTKSTVEPASVYVWKNAFWGADHQWDGEHFATAGAQVDIWNHNRSQPINSFEWGSDTVISVRFNPGEPNLLATSASDRSIILYDLRMSSPVRKMIMMTKTNSICWNPMEPINFTAANEDGNCYSYDARKLDEAKCVHRDHVSAVMDVDYSPTGREFVTGSYDRTVRIFQYNGGHSKEIYHTKRMQRVFAVKFSGDGSYVISGSDDTNLRLWKAKASEQLGVILPRERKKHEYHEAIKKRYKHLPEVNRIARHRHLPRPIFKASALMRVMADAKRRKEEKRKAHSAPGSITTQPLRRRRIIKEVE

SEQ ID NO: 199036 - protein, 132 aa, Glycine max
  Coding DNA Sequence Number=SeqID_82258
  Homolog annotation: Hit_ID=Q9FI89; Match level="QueryCoverage=79%, HitCoverage=12%, E-value=2e-31, Identity=63%"; Hit description =Similarity to regulatory protein Nedd1
  Pfam annotation: Domain name=WD40; Domain location=31-69; Score=24.2; E_value=0.00046; Accession=PF00400.22; Description=WD domain, G-beta repeat
  Subcellular localization annotation: CTP_CleavageSite=56; ConfidenceScore=5.19e-01
MALLAASGGDTVKLFDASAVKPGVYTPAGDPCALSFTPSPGSQVNSVKWNHTNLVVASAGDDKKISLWRKNGNSMGTIPVAGTDSGDSIEQYTCSLSMRQSSEVFLHSTNLKRQRLLLHYTPVFKGVSDSIA

SEQ ID NO: 199037 - protein, 740 aa, Glycine max
  Coding DNA Sequence Number=SeqID_82259
  Homolog annotation: Hit_ID=Q9FI89; Match level="QueryCoverage=99%, HitCoverage=88%, E-value=0.0, Identity=54%"; Hit description =Similarity to regulatory protein Nedd1
  Pfam annotation: Domain name=WD40; Domain location=120-159; Score =19.0; E_value=0.017; Accession=PF00400.22; Description=WD domain, G -beta repeat
  Pfam annotation: Domain name=WD40; Domain location=162-200; Score =7.1; E_value=5.5; Accession=PF00400.22; Description=WD domain, G -beta repeat
  Pfam annotation: Domain name=WD40; Domain location=33-71; Score=16.8; E_value=0.077; Accession=PF00400.22; Description=WD domain, G-beta repeat
  Pfam annotation: Domain name=WD40; Domain location=75-115; Score =14.1; E_value=0.52; Accession=PF00400.22; Description=WD domain, G -beta repeat
  Pfam module annotation: Pfam domain module=WD40::WD40::WD40::WD40; Domain location=120-159::162-200::33-71::75-115
ESILAISFSNKASRYVCSGGTGQVVRIWDLQRKRCIKWLKGHTNTVTGVMYNCKDEHLASISLSGDLMLHNLASGQKAAELKDPNQQMLRVLDYSRVSRHLLLTAGDDGTVHLWDTTGRSPKVSWIKQHSAPTAGISFSPSNDKIIASVGLDKKMYIYDSGSRRPSSYISYEAPFSSLAFRDDGWMLAAGTSNGRVAFYDVRGKPQPVAVLHAYGSSEPAQFNPLKEMVLDDMRVYILSTVISDNFGTVSMQQAVTSLCWQRSKPVVVDERNCSAETALVGDTVEDSILMPDPLPSATSSNNSLSTSVSSTRNSGRLGASFDGSSLTASGSGFTSNILNVSTAEETPQRNHLWPGGTLSRLHAPRASYNFKDDMEVFSPLVDVQPLAPSLWDENGIKKDNLFADRKPLLFPSSSRRFSNSEDVTSDHPVSDWKSGSTAKQDIAQSSFPLVGSTPPPSSKNEDSSITPPEAWGGERLSDKYAYTRQPVNAPSRFGMLASAGQTAGSMLSGLQDTSSSVGVSSYTSSSLSFANLRAKDASSSQETSLGFTDHMFSTSLPMSINTKTSLGQAIDSPKILDSPRMSSFNRRFSTYAERISTTSTLSDGVSLSVGSPKIKKSGAETREELLNSLLLKSDISAPIESGSLPLTSGVISQPKASQPDAQGSSFTLQLFQRTLEETLDSFQKSIHEDMRNLHIEILRQFHMQETEMSAVMNSILENQAELMKEVKSLRQENQQLRQML

SEQ ID NO: 199038 - protein, 585 aa, Glycine max
  Coding DNA Sequence Number=SeqID_82260
  Homolog annotation: Hit_ID=Q1S7R7; Match level="QueryCoverage=94%, HitCoverage=98%, E-value=1e-130, Identity=53%"; Hit description=IQ calmodulin-binding region
  Pfam annotation: Domain name=IQ; Domain location=116-136; Score=30.3; E_value=6.9e-06; Accession=PF00612.17; Description=IQ calmodulin -binding motif
  Pfam annotation: Domain name=IQ; Domain location=138-158; Score=21.0; E_value=0.0044; Accession=PF00612.17; Description=IQ calmodulin -binding motif
  Pfam annotation: Domain name=IQ; Domain location=164-184; Score=12.5; E_value=1.6; Accession=PF00612.17; Description=IQ calmodulin-binding motif
  Pfam module annotation: Pfam domain module=IQ::IQ::IQ; Domain location=116-136::138-158::164-184
  Subcellular localization annotation: CTP_CleavageSite=64; ConfidenceScore=5.31e-01
MGKGRSPGKWFKNLLLGKKSSSKSTSSKKNDIFKPSSDKDALVSSEVPVSDPTVDSLQISAPISGANDSKGVLSEKEVVSRSSHDRDVLSTGVEEAKVQDVANFGSQEDLEKLQLTEAAIKVQAACRSYLARQTFKKLEGVIQLQAFIRGHLVRRQAVSALYCVKGIVKFQALARGYNVRRSDIGLAIQKIRKDTHCSNSVRVASSTQAEKLSENVFVCKLLASSPYAVPLSLNSDPGEPNMVRKWLDYWTRSHFWAPLPELEKKLGSASDEKNGSSQTVQKGQIKKITRKYPAVKAKNGSNLGSNKSKQCPKKDSSHPLPSAQEHPQKETEKSSFEKTHAHNVSNGSEVVSEKRKSGNKKILDHAVTDVSEQGPNASSEKKKDLTVPKSKESDPEKGDGQEAKDKNDNELHRYPVAVLKTTVMKGENEGYQGVSENLNGGDNCMSNNSQRRASLPANFNDQENELYNTPVTPRLPSYMAPTESAKARLRGQGSPRFANDLVDKNSTTRRHSLSSSLNGRSGSFSPRAEKLIGVSGRGGIKSDRSLSSSRDGTGFSNPSCIFSSPLQSRNSTSCNTHRNEYTKAI

SEQ ID NO: 199039 - protein, 732 aa, Glycine max
  Coding DNA Sequence Number=SeqID_82261
  Gene Ontology: Mol. function=protein kinase activity; Cellular component=integral to membrane; Biological process=protein amino acid phosphorylation
  Homolog annotation: Hit_ID=Q1S7R4; Match level="QueryCoverage=98%, HitCoverage=99%, E-value=1e-176, Identity=50%"; Hit description =Protein kinase
  Pfam annotation: Domain name=LRR_1; Domain location=110-132; Score =5.4; E_value=28; Accession=PF00560.23; Description=Leucine Rich Repeat
  Pfam annotation: Domain name=LRR_1; Domain location=134-156; Score =6.7; E_value=16; Accession=PF00560.23; Description=Leucine Rich Repeat
  Pfam annotation: Domain name=LRR_1; Domain location=158-179; Score =12.9; E_value=1.1; Accession=PF00560.23; Description=Leucine Rich Repeat
  Pfam annotation: Domain name=LRR_1; Domain location=181-200; Score =10.3; E_value=3.4; Accession=PF00560.23; Description=Leucine Rich Repeat
  Pfam annotation: Domain name=LRR_1; Domain location=202-224; Score =7.1; E_value=13; Accession=PF00560.23; Description=Leucine Rich Repeat
  Pfam annotation: Domain name=LRR_1; Domain location=226-248; Score =7.9; E_value=9.6; Accession=PF00560.23; Description=Leucine Rich Repeat
  Pfam annotation: Domain name=LRR_1; Domain location=250-272; Score =9.5; E_value=4.7; Accession=PF00560.23; Description=Leucine Rich Repeat
  Pfam annotation: Domain name=LRR_1; Domain location=274-295; Score =10.4; E_value=3.3; Accession=PF00560.23; Description=Leucine Rich Repeat
  Pfam annotation: Domain name=Pkinase; Domain location=438-712; Score=- 32.4; E_value=1.2e-06; Accession=PF00069.15; Description=Protein kinase domain
  Pfam annotation: Domain name=Pkinase_Tyr; Domain location=438-712; Score=-145.4; E_value=0.0015; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::Pkinase::Pkinase_Tyr; Domain location= 110-132::134-156::158-179::181-200::202-224::226-248::250-272::274 -295::438-712::438-712
MKNFLVSLYYLFPAIIAIILVLLTPIPSAQLTTSENRILLQVQKLLEYPQALHGWTNLTNFCSLPSSPSLNIVCSNGHVTELTVVGNSSETLSERFSIESFFTVLTKLSNLKVLSLVSLGLWGPLPSKIDRFWSLEVMNFSSNFIYGEITPSVSSLKNLKSLVLADNLFNGSVPDLGKLASLEELNLSGNKLGPEFPSLSKNLVRVILRNNSLRCRIPPQLMHVYKLELFDISSNVIFGNIPSFIFSLPSLKYLKLASNQLSGSLSLNVSCSSSLTFVDISHNLLVGTLPSCVGSKASNRTTLYYGNCLINRSLSDQYPSSYCQKVEALAVIKPSIKSQKKEPEMQLGQILGIVGGVVGISGLLALLIWCIFRKSKPEKADSDYSIDISAPDNFSVRAYPRPNINARRPPLPMRQPFLGFPPYCIFSLEEIEDATNNFDPSNLIAEGSQGQLYKGWHIDGSMVMVNCVKLKQKSLYKNSIQSLKVLPYLRHRNLDRPQMISTVFIVFEHVSNVSLRDYLADRRKREMLKWPQRMEISIGIGRGIQFLHTRVHPGIFGNNIKIENILLDDCLNGKVSGYSIPWPSKKGHNSKLCEQRSTNQIGSIDDAEKEDIYQFGVILLQVITGKLITSSSEVEEVKDELERGLAEAASPSLRGASPSLKGTSPILKGVFDSSLRETCVYESLKTAVQITISCLSKVSSNRPSIEDVLWNLQYSMQVQEPRTSGVHLFSKM

SEQ ID NO: 199040 - protein, 189 aa, Glycine max
  Coding DNA Sequence Number=SeqID_82262
  Gene Ontology: Mol. function=small conjugating protein ligase activity; Cellular component=nucleus; Biological process=protein modification process
  Homolog annotation: Hit_ID=P25865; Match level="QueryCoverage=89%, HitCoverage=100%, E-value=8e-77, Identity=94%"; Hit description =Ubiquitin-conjugating enzyme E2-17 kDa 1
  Pfam annotation: Domain name=UQ_con; Domain location=8-132; Score =168.7; E_value=1.5e-47; Accession=PF00179.16; Description=Ubiquitin -conjugating enzyme
MSTPARKRLMRDFKRLQLDPPAGISGAPQDNNIMLWNAVIFGPDDTPWDGGTFKLTLQFIEDYPNKPPAVRFVSQMFHPNIYADGSICLDILQNQWSPIYDVAAILTSIQRWKRAKYKIRGLDILQKPRACFVIQTQTLQQIQKLLGYLVKTNVNTTEEYETLLSRVGLLINYLGASIAVKRLSKDLIE

SEQ ID NO: 199041 - protein, 122 aa, Glycine max
  Coding DNA Sequence Number=SeqID_82263
MMLVNHSGQILPLPNELIVRAYVLWSGVSTLVMSWYPATNKGFVNALMEGIQMVSGSMQSLLDLKVVLEGTSYHQTIQQALQLLQGGFEVGCSLERQSKRVVERCVSFTYFLCSSTVEPIRT

SEQ ID NO: 199042 - protein, 53 aa, Glycine max
  Coding DNA Sequence Number=SeqID_82264
  Gene Ontology: Mol. function=serine carboxypeptidase activity; Biological process=proteolysis
  Homolog annotation: Hit_ID=Q93Y09; Match level="QueryCoverage=77%, HitCoverage=9%, E-value=6e-10, Identity=73%"; Hit description=Serine carboxypeptidase II, putative
MAQWPPWQNDGYGNVLSFVTVRGASHEASFSTLERSLVLFKSFLESKPLPDAF

SEQ ID NO: 199043 - protein, 68 aa, Glycine max
  Coding DNA Sequence Number=SeqID_82265
MDNTILWRNYVCPSHLAEKNQTLLKVEWKFVKGVDTNGSNSHGETLSGCKIDDGDCVIAPTMFSAMQG

SEQ ID NO: 199044 - protein, 38 aa, Glycine max
  Coding DNA Sequence Number=SeqID_82266
  Homolog annotation: Hit_ID=Q6K9N6; Match level="QueryCoverage=94%, HitCoverage=8%, E-value=1e-07, Identity=72%"; Hit description =Succinyl-CoA ligase [GDP-forming] beta-chain, mitochondrial precursor
VSHINEMYFAITLDHTSVGLIIIACSKGGTSIEDLPEN

SEQ ID NO: 199045 - protein, 136 aa, Glycine max
  Coding DNA Sequence Number=SeqID_82267
MARRDQVWSFCTHDTRRYLTVIRTPLPFRHSRVRWHAETKFGHSAHMIRGRYQNGYPHPFAIQTQSCPLARRDQVWSFCTHDTRRYLTVIRTPLPFRHSRVRWQAETKFGHSAPMIRGDTLWLFAPILLLSVRQNA

SEQ ID NO: 199046 - protein, 49 aa, Glycine max
  Coding DNA Sequence Number=SeqID_82268
MDGYAKLRKNVVHASAMMVATSLQSPKNLTFWPNQPVIVFLIPVMAGCV

SEQ ID NO: 199047 - protein, 119 aa, Glycine max
  Coding DNA Sequence Number=SeqID_82269
  Gene Ontology: Mol. function=nucleoside-triphosphatase activity; Cellular component=integral to membrane; Biological process =translation
  Homolog annotation: Hit_ID=Q1S1V3; Match level="QueryCoverage=57%, HitCoverage=11%, E-value=4e-20, Identity=72%"; Hit description=AAA ATPase
EAVVMLGDVGGEFAEGGGDKRSGVEEESIVGGEGAGGEDVEEGGFSGAAGAHRGQDFGGEGGEGDVFKDAADWWGGGAWGEEERSKLGGVCGGGGGGGGGEFEGSSLEGWSEREELWTK

SEQ ID NO: 199048 - protein, 93 aa, Glycine max
  Coding DNA Sequence Number=SeqID_82270
  Gene Ontology: Mol. function=cysteine-type endopeptidase activity; Cellular component=vacuole; Biological process=proteolysis
  Homolog annotation: Hit_ID=Q5QL07; Match level="QueryCoverage=74%, HitCoverage=14%, E-value=2e-32, Identity=91%"; Hit description =Vacuolar processing enzyme 2
MSSLRLCLQVKERTISGDSYYGSHVMQYGDVGLSSDVLFHYLGIDPVNDNFTFVNKNSLWSPSKPVNQCDADLIHFWDKCLIMSSPVTTNEHM

SEQ ID NO: 199049 - protein, 80 aa, Glycine max
  Coding DNA Sequence Number=SeqID_82271
MKLPKDTTQYLHNGVEWIFNIPIQQLEKARGGVTGKGSGFDENIDDGIFEDVPTIGRGGGRRRGSGSNIGAEEWRRGHTH

SEQ ID NO: 199050 - protein, 267 aa, Glycine max
  Coding DNA Sequence Number=SeqID_82272
  Homolog annotation: Hit_ID=O48626; Match level="QueryCoverage=22%, HitCoverage=8%, E-value=7e-12, Identity=56%"; Hit description =Centromere/kinetochore protein zw10 homolog
  Subcellular localization annotation: CTP_CleavageSite=29; ConfidenceScore=5.14e-01
MRNPFNFSFRAEPSCLLLTLSVGFRNTPRTSESRTVSKKHNSYNCGRCGLPKKGHDCTGKTAPTPTSASSATPSHSSFSAVSAPSSGSASRCPLSHFRRALSFDEDEAGRLDLSEPVDVRSEEDDLDSFGLLGNLLWSLWRTAEELRIRVPAWAQVGFVSILKKCPGIVKLSLKRERSVVELGFGNGVVDNIFFVPGYSINGFVVAQVLVNFMEKAVRFDVDLNQVEVKYHLEVENVNGIQLQTVLEAMDVVGILEYGLAKVADLMI

SEQ ID NO: 199051 - protein, 82 aa, Glycine max
  Coding DNA Sequence Number=SeqID_82273
MSYIPILRSVFVPFSAYVHICKAFGYLFNIHMYMVNNIFTPSMYKEIIMVQPKPSAGTKGKPYQHALTFMPSCISKIKGLGP

SEQ ID NO: 199052 - protein, 99 aa, Glycine max
  Coding DNA Sequence Number=SeqID_82274
MYIQKREGIEREQNILSSWLHYYINFRRNNKRIAPQTSTIGVTPPTSHTSLSFVRMPPKSIANDLFFGNNFASVLVCYASWCWLSPRVPPNTSLKKAKL

SEQ ID NO: 199053 - protein, 75 aa, Glycine max
  Coding DNA Sequence Number=SeqID_82275
MNGHRRGPPLIKGKHAVVVVDVGDEQGELLHAKDDEETSGNFFGLLGFRFGQWIWRRKRQTVIGCWLVVVMVFGD

SEQ ID NO: 199054 - protein, 347 aa, Glycine max
  Coding DNA Sequence Number=SeqID_82276
  Gene Ontology: Mol. function=aminocarboxymuconate-semialdehyde decarboxylase activity; Cellular component=cytosol; Biological process=metabolic process
  Homolog annotation: Hit_ID=Q2T398; Match level="QueryCoverage=82%, HitCoverage=93%, E-value=1e-92, Identity=62%"; Hit description =Amidohydrolase family superfamily
  Pfam annotation: Domain name=Amidohydro_2; Domain location=3-279; Score=107.3; E_value=4.5e-29; Accession=PF04909.4; Description =Amidohydrolase
MDACGIRHAILSLTSPGAQSILDVAAATHFVTCTNDYIAEYFVQPHPDRFSAFATVALQNPQAAADELERAVKKLGMKGALINGYTNMSGTEEGRYLDDPAVEVFWQKVSELNVPVYLHPREPLPAACGIYRGYESLVGSAWGFATETAVHAIRLMMSGLFDRYPNITIILGHLGEGLTFMLPRTAHRLEKQFEGIGLGGNQQPLTDYLTNNFYVTTSGHFTTSALHNAIEVMGKDRVMFSVDYPYEDMCQAADWFDPLVLDADVKQSIAYGNTWKCGRTPGGNLSGNRGQQLSTGYNVPYAQEAREQHFGSQLNTAACQAGNQSNLAYISHCDSKASLTGAGIERQ

SEQ ID NO: 199055 - protein, 134 aa, Glycine max
  Coding DNA Sequence Number=SeqID_82277
  Homolog annotation: Hit_ID=Q9FG25; Match level="QueryCoverage=58%, HitCoverage=55%, E-value=2e-14, Identity=44%"; Hit description =Arabidopsis thaliana genomic DNA, chromosome 5, P1 clone:MPH15
  Subcellular localization annotation: CTP_CleavageSite=31; ConfidenceScore=5.76e-01
MLPKPLSQKTPSSISLKVRCFRASEPIPLPSSSPLSSVLSSRSPKRVSRLLRSEAQHALMDYMHSTRGYTFSDAEYISENSPRFIESLVSMIDDKDDVLRSLERFLRYNPINEFEPFFESLGIDPSELYLFLPH

SEQ ID NO: 199056 - protein, 303 aa, Glycine max
  Coding DNA Sequence Number=SeqID_82278
  Gene Ontology: Cellular component=chromosome, pericentric region; Biological process=cell division
  Homolog annotation: Hit_ID=O48626; Match level="QueryCoverage=92%, HitCoverage=35%, E-value=5e-76, Identity=52%"; Hit description =Centromere/kinetochore protein zw10 homolog
  Pfam annotation: Domain name=Zw10; Domain location=2-303; Score= -170.4; E_value=0.033; Accession=PF06248.3; Description =Centromerekinetochore Zw10
MESLFDSINVHDLLSAQDLSDPNSPLSAPDLRLLIQRLESHSLQIRSQVQSYLVSHREDFARLFSLCNDAVSQTREVSDDVTAILRLLSDRPIDAEVRDIVSEMKAKKEELKVKKELLGLVGTVVALNQRLESVREALKSGRFEFAAQGLKELKVALRIGEENDREPLVYGLLRKEWSQCFEEVYSYVLMRGGFGAVNIQEVLMKFMEKAVRFDGDLNQVEVKYHLEVENVNGIQLHTVVEAMDVVGILEYGLAKVADLMIKYVITPFVNHGQPLSFLEELHQESALLKIVPSLDSKSSQFSS

SEQ ID NO: 199057 - protein, 37 aa, Glycine max
  Coding DNA Sequence Number=SeqID_82279
MDEEPPSKMAREGDISGAKIAEIMEAMDYYGVRKRSR

SEQ ID NO: 199058 - protein, 326 aa, Glycine max
  Coding DNA Sequence Number=SeqID_82280
  Gene Ontology: Mol. function=RNA-directed DNA polymerase activity; Biological process=RNA-dependent DNA replication
MTRGRDGTQFKVGGVFYQHPPLERHRVLKVENLAQVIPFFPRSILRNQSTPLHQDQKCGTGNVCGPFAVENTKWFDKWMIVYGTGQKRIGNLQRQHWKTPTSSGELKVEGVVLKPLGRRIMYKAAKVLLQGATKNLGLTINFWMVQVQSSKVVVMALVDIVAISYGCGDDMKFPNIRGCTLKARAKSLVEEGQWVSMMHKDYTHSVAGHIRLGDKSVKKGFKELIHGGLEVLYSAIRIWWNPWSKSSFKNQEVVPSLSNSSSIIDIGKQSLIDEKGLWLRRMRLTESISVTFFFNLSFLKMRVAIWLDIDGFSVWKEMDLVGDGSG

SEQ ID NO: 199059 - protein, 365 aa, Glycine max
  Coding DNA Sequence Number=SeqID_82281
  Gene Ontology: Mol. function=DNA binding; Cellular component =chromatin; Biological process=DNA integration
  Homolog annotation: Hit_ID=Q1RSZ9; Match level="QueryCoverage=95%, HitCoverage=28%, E-value=1e-73, Identity=44%"; Hit description =Polynucleotidyl transferase, Ribonuclease H fold
MAGNDSTSKSTFHPAFSVSNIKNHIQITLEMENVHYDSWAELFLNAANAFDVADHIIPPKDVTIKKDAQWSRLDAIVKQWIYSTISIDLLLHTILKPGATAQEAWNRLKDIFHDNKNSRAVYLEQQFSQIHMDNYPNALSYCQALKLIAEQLGNVGASVSEDRLVLRLVTGLSSGYDSLANIIQQLDPLPSFYKTRSMLTLEETRRNKNTGAESALLHTQSDVSSAAPNQSLDAAPSRSNNRNTGGHGKQGNQPASWTWIPFTPPSWPQQPSWNPPPCPYPTTGWVPSATGHGAGVLGPKPHAFLAQNQTLGAPQGSLVPTDIAATMQTMSLQQPDDNWYMDTGASSHMTSNAGYADEEATYEAH

SEQ ID NO: 199060 - protein, 186 aa, Glycine max
  Coding DNA Sequence Number=SeqID_82282
MVLTSAGSRISVRFDDPNGALFKLTQKGFVNEYLYEFERLVNRIVRLPPSFLLSCFVSGLMRRRRLCNPSPYLRRYHWQSSKRINWRIVTRAIVFAQEFQTQHHCHNHHPNFLLFHPFHHLQLPHSKPKMKMLLLTPLPNHSILPLPHLYQTSPTRKLVLSPLSKLQHRRPCVSTVTYAIHVSQCS

SEQ ID NO: 199061 - protein, 186 aa, Glycine max
  Coding DNA Sequence Number=SeqID_82283
  Gene Ontology: Mol. function=RNA-directed DNA polymerase activity; Cellular component=chromatin; Biological process=RNA-dependent DNA replication
EDMPIVRDFPEVFPVDVTSLPPKHEIEFSISIFVTPYRMSPLHQCESSFQDLKNRLTSASVLVLPNPSETHERNYPTHDLELAVVVFALKLWRHYLYGSRFEVCSDHKSLRYLLDHKELNMRQRKWLEFLKDYDFELSYHLGKANVVVNALSRKYLSISAFMVRELDLLEQFRDMSLVCEVTPKSV

SEQ ID NO: 199062 - protein, 79 aa, Glycine max
  Coding DNA Sequence Number=SeqID_82284
MWNFKFYVGGVAWWRGKVMAEACVVFGVAGPEVVLEWHPARGPASIWAYVASSWVEVGGAFYKVGQCRACGILKVQDLT

SEQ ID NO: 199063 - protein, 100 aa, Glycine max
  Coding DNA Sequence Number=SeqID_82285
MAKQPCQLKEKSDRNVSMPVRPGSQFLPFGNEMEFMLLKAVFSSEMRGKKRTLLDVLMILRMYRYILEEDELEIQIRRALLQSGGCEGLALGLSDGDSIP

SEQ ID NO: 199064 - protein, 226 aa, Glycine max
  Coding DNA Sequence Number=SeqID_82286
  Homolog annotation: Hit_ID=Q9LK76; Match level="QueryCoverage=81%, HitCoverage=44%, E-value=8e-23, Identity=37%"; Hit description =Arabidopsis thaliana genomic DNA, chromosome 3, P1 clone: MDC8
  Pfam annotation: Domain name=IQ; Domain location=121-141; Score=31.4; E_value=3.2e-06; Accession=PF00612.17; Description=IQ calmodulin -binding motif
  Pfam annotation: Domain name=IQ; Domain location=143-163; Score=18.5; E_value=0.025; Accession=PF00612.17; Description=IQ calmodulin -binding motif
  Pfam annotation: Domain name=IQ; Domain location=169-189; Score=6.8; E_value=7.8; Accession=PF00612.17; Description=IQ calmodulin-binding motif
  Pfam module annotation: Pfam domain module=IQ::IQ::IQ; Domain location=121-141::143-163::169-189
MGRATRWVKSLFGIRKEKEKKQNFKCGEAKSMEFCCSESTSNSRVLCHNPGTITPNLSQAEAAWLQSFYTEKDQNKHAIAVAAATAAAADAAMAAAQAAVAVVRLTSQGRGGTMFGVGPEMWAAIKIQTVFRGYLARKALRALKGLVKLQALVRGYLVRKQATATLHSMQALVRAQATIRSHKSRRLMTTKNEAYRSQIRARRSMVLAQILNCSYISHYMNYGYIF

SEQ ID NO: 199065 - protein, 121 aa, Glycine max
  Coding DNA Sequence Number=SeqID_82287
  Homolog annotation: Hit_ID=Q9LK76; Match level="QueryCoverage=84%, HitCoverage=26%, E-value=6e-18, Identity=52%"; Hit description =Arabidopsis thaliana genomic DNA, chromosome 3, P1 clone: MDC8
  Subcellular localization annotation: CTP_CleavageSite=99; ConfidenceScore=5.45e-01
EECRFSSTAQSTPRFTNSCSCGSVAVPMTPKSVCTDNLFFLRQYGNFPNYMASTQSFKAKLRSHSAPKQRPEPGPRKRISLNEMMESRSSLSGVRMQRSCSQVQEVISFKNAVMGKLQKST

SEQ ID NO: 199066 - protein, 251 aa, Glycine max
  Coding DNA Sequence Number=SeqID_82288
MGSEVGMDVASSCSNFEGGENDKVEQVPNDPGGHKRKVLKEKSEFRVKSSKYYPPDNNHMLESCHRRVKIVKDHVGCKTFKEEHPIGEVVAENEPIGERKCKVLEDNYNKRRRDNQNMTGVQKEEEAIEPSIGYERVQSLNNVKITLKQGSVKMITPIMITESISKDVEVGIKGKSERVVNGGDMKNMLDLSPQKDEYKGSQDLSTDERVENTYPDSAYVYDIEGSEKVWEEQNLMGVSYGIEEKNMAEKT

SEQ ID NO: 199067 - protein, 198 aa, Glycine max
  Coding DNA Sequence Number=SeqID_82289
  Gene Ontology: Mol. function=RNA-directed DNA polymerase activity; Cellular component=nucleus; Biological process=RNA-dependent DNA replication
  Homolog annotation: Hit_ID=Q1RTD3; Match level="QueryCoverage=71%, HitCoverage=22%, E-value=2e-35, Identity=51%"; Hit description=IMP dehydrogenase/GMP reductase
MDKCLCSSLWGDGELEWVALPSLGASRGLLCIWDPKFFVAHRHFLGVDSLDWKKFGELKVEKASWECGWDKSPGSKGFNLKFIKAFWDMLKVDFMRYLEEFHQNGVIPRGCNSSFISLIPKVEVPNQLDDFIQFSLVVCMYKMLAKILSNRLKKVLNKVVDQRQSSFFKDRSLLHNAMVANEVVEEARMKKEVVWSLK

SEQ ID NO: 199068 - protein, 127 aa, Glycine max
  Coding DNA Sequence Number=SeqID_82290
  Gene Ontology: Cellular component=microtubule organizing center; Biological process=microtubule cytoskeleton organization and biogenesis
  Homolog annotation: Hit_ID=Q9FG37; Match level="QueryCoverage=65%, HitCoverage=10%, E-value=2e-09, Identity=45%"; Hit description=Gamma- tubulin interacting protein-like
MEEEDQQKLPDLVKALVHLLLSQNLPLNPNSPKFCNSLHILSIRFTPFVAPDAATIADSIKCRLTSHGHSSQALSFADLFSKFAYLSSFSFISCMRKRREDEVSQQREREKESENKREKGSVCCPIR

SEQ ID NO: 199069 - protein, 33 aa, Glycine max
  Coding DNA Sequence Number=SeqID_82291
MVDLVGFSGLAFPLPNICAALTHTLSTPVIYQQ

SEQ ID NO: 199070 - protein, 219 aa, Glycine max
  Coding DNA Sequence Number=SeqID_82292
  Gene Ontology: Mol. function=protein kinase activity; Biological process=protein amino acid phosphorylation
  Homolog annotation: Hit_ID=Q6KAK1; Match level="QueryCoverage=68%, HitCoverage=10%, E-value=5e-27, Identity=44%"; Hit description =Protein kinase-like
MTNYDSDAEMSDLPWALARPSSKPTSQSDLRRNGNRKYGVDELNEPPPRLPGIRSLLPLPGGDLLTGGTDLKIRRWDHYSPDRSYCICGPNLKGIGNDDFYETKSSFGVQVVQETKRRPLTIKLTAKAILAAAATDSAGCHRDSIVSLASIKLNQRLLLSSGRDGAIKVLTHQVVIRAPSLFLSDTFPFLCTPDLYQQEKVAILIFLDRPQFYLKVSIV

SEQ ID NO: 199071 - protein, 1299 aa, Glycine max
  Coding DNA Sequence Number=SeqID_82293
  Gene Ontology: Mol. function=protein kinase activity; Cellular component=cellular_component; Biological process=protein amino acid phosphorylation
  Homolog annotation: Hit_ID=Q6KAK1; Match level="QueryCoverage=99%, HitCoverage=84%, E-value=0.0, Identity=49%"; Hit description=Protein kinase-like
  Pfam annotation: Domain name=HEAT; Domain location=520-556; Score =29.6; E_value=1.1e-05; Accession=PF02985.12; Description=HEAT repeat
  Pfam annotation: Domain name=HEAT; Domain location=565-601; Score =11.2; E_value=1.8; Accession=PF02985.12; Description=HEAT repeat
  Pfam annotation: Domain name=HEAT; Domain location=688-724; Score =6.0; E_value=7.9; Accession=PF02985.12; Description=HEAT repeat
  Pfam annotation: Domain name=HEAT; Domain location=727-763; Score =17.3; E_value=0.056; Accession=PF02985.12; Description=HEAT repeat
  Pfam annotation: Domain name=HEAT; Domain location=768-803; Score =6.9; E_value=6.2; Accession=PF02985.12; Description=HEAT repeat
  Pfam annotation: Domain name=Pkinase; Domain location=27-293; Score =13.9; E_value=2.2e-09; Accession=PF00069.15; Description=Protein kinase domain
  Pfam annotation: Domain name=Pkinase_Tyr; Domain location=27-291; Score=-111.4; E_value=1.2e-05; Accession=PF07714.7; Description =Protein tyrosine kinase
  Pfam annotation: Domain name=WD40; Domain location=1111-1149; Score =45.0; E_value=2.5e-10; Accession=PF00400.22; Description=WD domain, G-beta repeat
  Pfam annotation: Domain name=WD40; Domain location=1159-1197; Score =7.4; E_value=5; Accession=PF00400.22; Description=WD domain, G-beta repeat
  Pfam annotation: Domain name=WD40; Domain location=1262-1298; Score =6.4; E_value=6.5; Accession=PF00400.22; Description=WD domain, G -beta repeat
  Pfam module annotation: Pfam domain module=HEAT::HEAT::HEAT::HEAT::HEA T::Pkinase::Pkinase_Tyr::WD40::WD40::WD40; Domain location=520 -556::565-601::688-724::727-763::768-803::27-293::27-291::1111 -1149::1159-1197::1262-1298
MGNKIARTTQVSASEYYLHELPSTYNLVLKEVLGRGRFFKSIQCKHDEGLVLVKVYFKRGDFLDLSDYERRLSQIKHIFTSIDHPHVWPFQFWQETDKAAYLLRQYFFHNLHDRLSTRPFLSLIEKKWLAFQLLVAVKQCHENGVCHGDIKCENVLITSTNWVYLADFASFKPTYIPYDDPSDFSFFFDTGGRRLCYLAPERFYEHGGEMQVAQDTPLKPYMDIFAVGCVIAELFLEGQPLFELSQLLAYRRGQYDPSQHLEKIPDLGIRKMILHMIQLEPEFRLSAERYLKEYAAVVFPIYFSPFLHDFYRCWSPLHSDMRVLLCQSAFPEILKQMMNNKSSDDAGVNSAELLEEMVAKESASFMKDSLMKREDIGKGLVHDHYELLGDINSLLRDAKKNNNPSHVAENAHNSTFPENLKNLQTGKLLQTISNAFRGNDHPFLKSITMNDLNSLMSEYDSQSDTFGMPFLPLPKDSMRCEGMVLITSLLCSCIRNVKLPHLRRAAVLLLKASALYIDDEDRLQRVIPYVIVMLSDSAAIVRCAALETLCDILPLVRDFPPSDAKIFPEYILPMLSMLPDDPEESVRICYASNIAKLALTAYGFLIRSISLSEAGVLDELSLPQKPLTSSTQTSGRMKRINGDAQLLQLRKSIAEVVQELVMGPKQTPNIRRALLQDIGKLCCFFGVRQSNDSLLPILPAFLNDRDEQLRTVFYEKIVYVCFFVGQRSVEEYLLPYIEQALSDVTEAVIVKAVECMTILCKSGFFRKRILLQMIERAFPLLCYPSEWVRRSVVSFIAASSENLGAVDSYVFLAPVIRPFLRTQPVSLASEKALLSCLKPPVSRQVFYEVLENSRSSDMLERQRKIWYSSSQSKLWEMDLLKKGIDELDSLKNWTDKQQGPGVQQTVGTAFQQPGITDCDKAEAKLRDMGAFMHNDSNTVGHRDTQCSEKLQFSGFMSPHFSGMNSLTYEKPSEGIPLYSFSVDRRGMGIPSAASDPPLPMNSLGVSSSAMPWVNPLSKSFNLANSVPAPKLFSGSYSISNGSKQFHRVVHEPDARENETAYVNNTFQDVGLSANIKGTSIALEDATAQTDLSGFPSFARASIPDSGWRPRGVLVAHLQEHRSAVNDIAISADHSFFVSASDDSTVKIWDSRKLEKDISFRSKLTYHMEGSRVLCATMLPGSAQVIIGASDGFIHMFSVDHISRGLGNVVEKYSGIADITKKDIKEGAILNLLNCPVDNYTIMYSTQNCGIHLWDTRSNSNTWTLQATPKEGYASSLASGPCGNWFVSGSSRGVITLWDL

SEQ ID NO: 199072 - protein, 177 aa, Glycine max
  Coding DNA Sequence Number=SeqID_82294
  Gene Ontology: Mol. function=DNA-directed RNA polymerase activity; Cellular component=nucleus; Biological process=transcription
  Homolog annotation: Hit_ID=Q1SUB2; Match level="QueryCoverage=99%, HitCoverage=27%, E-value=5e-27, Identity=43%"; Hit description=RNA polymerase, beta subunit
  Pfam annotation: Domain name=RNA_pol_Rpb2_7; Domain location=24-175; Score=58.0; E_value=3.2e-14; Accession=PF04560.10; Description=RNA polymerase Rpb2, domain 7
MHARGSGPRVMLTRQPTEGRARNGGLRVGEMERDCLIAYGANYHLVEVETMFFGVGSGRKESGDVKEEERTGGKIDCLRGDIGVAPIEEKMIENWLSPVKRERGRPRNTLEEVVKEFMVCTACGLLGYYNHKLKTGICSSCKNGDNISTMKLPYACKLMIQELQSMNIVPRLKLADA

SEQ ID NO: 199073 - protein, 385 aa, Glycine max
  Coding DNA Sequence Number=SeqID_82295
  Gene Ontology: Mol. function=DNA-directed RNA polymerase activity; Cellular component=membrane; Biological process=transcription
  Homolog annotation: Hit_ID=Q9FKF1; Match level="QueryCoverage=99%, HitCoverage=35%, E-value=1e-167, Identity=71%"; Hit description=DNA -directed RNA polymerase subunit
  Pfam annotation: Domain name=RNA_pol_Rpb2_4; Domain location=25-87; Score=85.0; E_value=2.3e-22; Accession=PF04566.3; Description=RNA polymerase Rpb2, domain 4
  Pfam annotation: Domain name=RNA_pol_Rpb2_5; Domain location=107-147; Score=62.2; E_value=1.7e-15; Accession=PF04567.7; Description=RNA polymerase Rpb2, domain 5
  Pfam annotation: Domain name=RNA_pol_Rpb2_6; Domain location=152-385; Score=147.0; E_value=4.9e-41; Accession=PF00562.18; Description=RNA polymerase Rpb2, domain 6
  Pfam module annotation: Pfam domain module=RNA_pol_Rpb2_4::RNA_pol _Rpb2_5::RNA_pol_Rpb2_6; Domain location=25-87::107-147::152-385
CESLGVEDMKDLSAEELHTPDSFLVIFNGLILGKHRRPLHFATAIRKLRRAGKIGEFVSVYVNEKQHCVYLASDGGRVCRPLVIADKGISRIKQHHMKELMDGVRTFDDFLRDGLLEYLDVNEENNALIALYEGDATSETTHIEIEPFTILGVIAGLIPYPHHNQSPRNTYQCAMGKQAMGNIAFNQVGYDKLGAGQNATVAVMSYSGYDIEDAIVMNKASLDRGYNAIIQKHSNDTSDRILRPNRTADTAGRMQILDDDGIAAPGEILRPYDIYINKQSPIDTRTPKTGSAANLPDSAYRSNAQSFKGNGGEVVDRVVLCSDKDNNMCIKFLIRHTRRPELGDKFSSRHGQKGVCGTIVPQEDFPFSEKGICPDLIMNPHGFPR

SEQ ID NO: 199074 - protein, 59 aa, Glycine max
  Coding DNA Sequence Number=SeqID_82296
  Gene Ontology: Mol. function=catalytic activity; Biological process =metabolic process
  Homolog annotation: Hit_ID=Q1SI48; Match level="QueryCoverage=92%, HitCoverage=14%, E-value=6e-17, Identity=78%"; Hit description=AMP -dependent synthetase and ligase
MWYLWCQFCIMDYEHAGVGAIEFIICHSEVSIALAEEKKIPELFKTFPNATKYLKSKFC

SEQ ID NO: 199075 - protein, 282 aa, Glycine max
  Coding DNA Sequence Number=SeqID_82297
  Gene Ontology: Mol. function=oxidoreductase activity, acting on single donors with incorporation of molecular oxygen, incorporation of two atoms of oxygen
  Homolog annotation: Hit_ID=Q0K796; Match level="QueryCoverage=95%, HitCoverage=96%, E-value=2e-28, Identity=36%"; Hit description =Putative glyoxalase (Bleomycin resistance protein), dioxygenase superfamily
MAIPVPVPQLDHAVINVADRLDDASALYRRLGFQLTPRGHHSLGSSNHLAVFGDNYLELLGYEAGRAHRRQDIWQAPAGLSGLVWKTGDADAVWRYLESQDIDGDPAASFYRPVQLPDGSAQQARFRTVRLRPALVPNGRSFFCQHETPQAVWQPVWQQHPNAVTDIIEFVVVAQDPAAAALPYSRLFGADKLTACQQGAFVLKAGVATVRFAAAHYVTQRFTGLPPDYDGSARMAALTLRSSDLRRVKASLLLGDMPFREEPDAIVVSAEQASGVALRFQL

SEQ ID NO: 199076 - protein, 81 aa, Glycine max
  Coding DNA Sequence Number=SeqID_82298
  Pfam annotation: Domain name=DUF1471; Domain location=1-79; Score =20.1; E_value=1.6e-05; Accession=PF07338.3; Description=Protein of unknown function (DUF1471)
MSLLVASTFSISALAAQEITKEEAKQYQEVGKVSTNNEYSSPAEAMAEISKEADEMGGVIVIATGRFNNGLLSCFYFYSKR

SEQ ID NO: 199077 - protein, 120 aa, Glycine max
  Coding DNA Sequence Number=SeqID_82299
LRIANETFSQSRPENADIFGKGAANVTFSQFRLEDANIYEEEDVDILGKGEVLRIANETFSQSRPEHPDISEEGASDDSRSENIDISDKGVGDGENASIFEKGAGDDDSHWMLLGFESYG

SEQ ID NO: 199078 - protein, 301 aa, Glycine max
  Coding DNA Sequence Number=SeqID_82300
  Gene Ontology: Mol. function=helicase activity; Cellular component =membrane; Biological process=viral genome replication
  Homolog annotation: Hit_ID=Q1SN45; Match level="QueryCoverage=56%, HitCoverage=9%, E-value=3e-50, Identity=59%"; Hit description=AAA ATPase
  Pfam annotation: Domain name=DUF889; Domain location=1-105; Score= -19.6; E_value=3.6e-10; Accession=PF05970.5; Description=Eukaryotic protein of unknown function (DUF889)
MESLSSDSVDKSETIESCHFRSLTIEFLNSLTTSGLPNHCLKLKIGTPIMLLRNLDQTQGLCNGTRLIITRLAKHVIAADIISGTNIGDHVYIPRMSMSSSQSPWPFKLLRRQFSIMLSYAMTINKSQGQSLSSVGLYLPKPVFSHGQLYVALSRVKSKKGLRILIHDQDKKNDFNHECGFQRDNQLALQNIIYAKSLSTSALDSNKNTSSPASTTTIFHTYHSANSRPIFEQNIQCSTVPKLLNLPSLTPPRKAMTLPSPTTLHHQTTVHFSTTFISILTKLFSQSDYHHVSRFIDCLKQ

SEQ ID NO: 199079 - protein, 223 aa, Glycine max
  Coding DNA Sequence Number=SeqID_82301
  Gene Ontology: Mol. function=oxidoreductase activity; Biological process=tRNA processing
  Homolog annotation: Hit_ID=UPI00006725B9; Match level="QueryCoverage =29%, HitCoverage=49%, E-value=1e-10, Identity=43%"; Hit description =Uncharacterized membrane protein
MCRVTTRATHTLCHVTPLSPLVTLTSNTHGLHSPPLTTHHRHKFHRQPPTLLHLHLLLPQIPHPPPPPHAAPCVLPHQQPPHHLHHSPHHHHHHLRRDHILRRRCPLRRPRREPPPRIHPPLAPPHPRRGVTRHVPALQVPNLRVTVISGLSGQDRSDFAYSVIKDVQVVPRFIGEWGDVVITLKDGTKVDLRSVPKFREISKYCLAMAQKPIVLNESGPKGF

SEQ ID NO: 199080 - protein, 49 aa, Glycine max
  Coding DNA Sequence Number=SeqID_82302
MTLLDCGGAIRGREGLHTDLVVVGMRNNTGFGRRWRCTVVLEDEGGVAQ

SEQ ID NO: 199081 - protein, 579 aa, Glycine max
  Coding DNA Sequence Number=SeqID_82303
  Gene Ontology: Mol. function=protein serine/threonine kinase activity; Cellular component=flagellin-based flagellum; Biological process=protein amino acid phosphorylation
  Homolog annotation: Hit_ID=Q93YF4; Match level="QueryCoverage=90%, HitCoverage=90%, E-value=0.0, Identity=76%"; Hit description=Calcium- dependent protein kinase 2
  Pfam annotation: Domain name=Pkinase; Domain location=122-372; Score =318.6; E_value=1.1e-92; Accession=PF00069.15; Description=Protein kinase domain
  Pfam annotation: Domain name=Pkinase_Tyr; Domain location=122-370; Score=-44.6; E_value=9.8e-10; Accession=PF07714.7; Description =Protein tyrosine kinase
  Pfam annotation: Domain name=efhand; Domain location=419-447; Score =40.9; E_value=4.4e-09; Accession=PF00036.22; Description=EF hand
  Pfam annotation: Domain name=efhand; Domain location=455-483; Score =25.3; E_value=0.00022; Accession=PF00036.22; Description=EF hand
  Pfam annotation: Domain name=efhand; Domain location=491-519; Score =33.2; E_value=8.9e-07; Accession=PF00036.22; Description=EF hand
  Pfam annotation: Domain name=efhand; Domain location=525-553; Score =42.0; E_value=2e-09; Accession=PF00036.22; Description=EF hand
  Pfam module annotation: Pfam domain module=Pkinase::Pkinase _Tyr::efhand::efhand::efhand::efhand; Domain location=122-372::122 -370::419-447::455-483::491-519::525-553
  Subcellular localization annotation: CTP_CleavageSite=48; ConfidenceScore=5.22e-01
MGNNCVGSRTSSSKDGTNGSSNSSSFWWSRGHKKDASHAHKSGKKSAKAAETVQNKPPEMVKIEREDVKPPHQSKETKPPSEETKEQPTKPKRPHNVKRLASAGLKTDSVLQRKTGNLKEFYNLGPKLGQGQFGTTFLCVEKITGKEYACKSILKRKLLTDEDVEDVRREIQIMHHLAGSPNVISIKEAFEDAVAVHVVMELCAGGELFDRIVERGHYTERKAAKLARTIVGVIESCHSLGVMHRDLKPENFLFVNQQEESPLKAIDFGLSAFFKPGSPYYVAPEVLRKRYGPEADVWSAGVIIYILLSGVPPFWGESEQDIFEAILHSDLDFSSDPWPAISESAKDLVRKVLVRDPTKRITAYEVLRHPWIQVDGAAPDKPLDSAVLSRLKQFYAMNKLKKMALRVIAQNLSEEEIAGLKEMFKMIDTDNSGQITFEELKVGLKMFGANLNESEIYDLMQAADVDNSGTIEYGEFIAATLHLNKVDREDHLVAAFAYFDKDGSGYITQDELQQACEEFGVGDVRLEEMIREADQDNDGRIDYNEFVAMMQKGHADLGKRGRKGNTSFRVGFREAPPVR

SEQ ID NO: 199082 - protein, 580 aa, Glycine max
  Coding DNA Sequence Number=SeqID_82304
  Gene Ontology: Mol. function=DNA binding; Cellular component=beta -galactosidase complex; Biological process=DNA integration
  Homolog annotation: Hit_ID=Q1S3I6; Match level="QueryCoverage=61%, HitCoverage=26%, E-value=1e-110, Identity=54%"; Hit description =Integrase, catalytic region
MVLVSPPLNANNYHTWSRGQLQGNGTSDSKVFLPPQISRIIKGIEGHKGEGVAALVEEEVMESWAEEMEMLEEEEGTTIQANSSQGGTVTSPGVQFKPEQLHQLLTMLQQSYTKSTHLVSQITSGNVDESSSQQQNCLSGRFLSKFATWILDSGATDHVTHDSSFLVTFHAIKPIHVNLPNGITVTAKYFDFFNFLLDPLPSHSQPAPESLNPLNNSNNPTHIPILSASQPVLPEAAPATRRSSRIRKAPEYLKDFHCQFTQSTVLSFHSISPSHLKYTLVISTTNEPKTYNQAIKSKEWIQAMESELHALEANNTWYLTKLPRGKVPIGCRWVYKIKHHVDGSIERHKARLVAKGYTQQEGVDFLNTFSPVAKLTTVRLLLAFVAVKNWDLQQLDVDNAFLHGDLHEEVYMELPLGLVPATPNQVCRLTKSLYGLKQASRQWFAKLSSFLVSIGFSPSPFDHSLFTKQHGSSFTTLLVYVDDVILTGNSPSEITSVKQLLHHKLCIKDLGKLKYFLGLEVSRTSKGIHICQWKYALDILSESGMLASKPCSTPMIKGNKLLYDDTAPPYDQIAYRRLIG

SEQ ID NO: 199083 - protein, 108 aa, Glycine max
  Coding DNA Sequence Number=SeqID_82305
MLFMIPYQLDGTTQLKPEYTLNDEDFVSATWNTLRGKNDEKEKNARKWKRVLILKEMGGTWSIAGVRRPAAGPCRKMDLAYGHAIWCLPRAPHVNECQINRDYKLTGV

SEQ ID NO: 199084 - protein, 155 aa, Glycine max
  Coding DNA Sequence Number=SeqID_82306
MFHFMKEGLEYESDSKEAKKLLQCGSKANDDEKYDNNGLGCSFLTKDKDLVFTLIPSPGFEFSLGFDGHHLCLLGLKVDFSTDFSTVVFGYIAFDDYVWPMVELVGVSLVVVRPKLCKIESLNLLRKQNGRRSIFGSRSKCWTSSLRNFKKGGLN

SEQ ID NO: 199085 - protein, 122 aa, Glycine max
  Coding DNA Sequence Number=SeqID_82307
MWKNKQAKKKKKLSVQCDGWLREREIEILVSSSIEESRSERRSKYRSANSKSQINEFERERGRRVRTDINNPILVPALALGYWAKPESDPELGQHDFYLSKSRRVRFGSHGIGFRCHTYVLW

SEQ ID NO: 199086 - protein, 290 aa, Glycine max
  Coding DNA Sequence Number=SeqID_82308
  Homolog annotation: Hit_ID=Q1RXR7; Match level="QueryCoverage=18%, HitCoverage=4%, E-value=1e-17, Identity=83%"; Hit description =Tyrosine protein kinase, active site
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGIRYDKHLIGVGGQGCVYKAVLPTGQVVAVKKLHSVPNGEMLNLKAFTCEIQALTEIRHHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 199087 - protein, 137 aa, Glycine max
  Coding DNA Sequence Number=SeqID_82309
  Gene Ontology: Mol. function=DNA binding; Biological process=DNA integration
MKSEFYMIGLGELAYFLGIEFVQTGRGIILHQKRYIHEVFKRFNKVDYNIALTPLDANIKLVKDEAKKLVDNTLFKQLIGSFRFCGAPISWCSKKQDVVALSSCEVEYIVDCHFACQALALISLLEEMHLGLKSVMQ

SEQ ID NO: 199088 - protein, 135 aa, Glycine max
  Coding DNA Sequence Number=SeqID_82310
MSSWGKKTDLFSGFLPSLSKIAAVVRDSARELDRVKQTQNGIVGLPRKYLEGKARDMANQEEWVPFADVLALLIFGVVLFPNVDGLVDLAVIDAFLAYHHNKESPVEAEQSTGFLNGRKDKREFSSHVGTTQTFR

SEQ ID NO: 199089 - protein, 238 aa, Glycine max
  Coding DNA Sequence Number=SeqID_82311
  Gene Ontology: Mol. function=structural molecule activity; Cellular component=flagellin-based flagellum; Biological process=ciliary or flagellar motility
  Homolog annotation: Hit_ID=Q9S0T3; Match level="QueryCoverage=81%, HitCoverage=35%, E-value=2e-37, Identity=44%"; Hit description =Flagellin
DLGARHVRHFRGVFGVLDARTGAGQVVDHVVQVGDGRFQAVLHRAQLAGQLVQHGEGGVQRLEWIGRFRALAGSVRRQLTRGVDVGLGADLGGVVAPTRAARDRGLAACRIDTVIGLIVRGGREVPLVVDVSVGRCAAGELHRGAGDALAQFDLDVIGRGVGLDLRHHRIGTDGVGKHQSIAAGDVDVGVGLATDHDARRTGCGCISRRDRHDEGERGRGGAIGVGRKVAAVIQERRL

SEQ ID NO: 199090 - protein, 95 aa, Glycine max
  Coding DNA Sequence Number=SeqID_82312
MSYPNFVQGQLFVNIWILASRIELLNTNCGAIPRGTRSQGKVQDDDHQCPKRVPQTERHQYGHRRSIGTGNKEGPKGRMGPKQVPRSFVGKQQRA

SEQ ID NO: 199091 - protein, 43 aa, Glycine max
  Coding DNA Sequence Number=SeqID_82313
MMWMDRFTFTLNGSQELPRLLAKAKAMVDVYSGPEEVHGLLDY

SEQ ID NO: 199092 - protein, 69 aa, Glycine max
  Coding DNA Sequence Number=SeqID_82314
MLKQADGSYACIAENANRFSLGELHTNPLTDIGQRGIVEGLGTSRRRGKLSRISSKRLQGVLLLINQFL

SEQ ID NO: 199093 - protein, 163 aa, Glycine max
  Coding DNA Sequence Number=SeqID_82315
  Homolog annotation: Hit_ID=P98205; Match level="QueryCoverage=51%, HitCoverage=8%, E-value=2e-27, Identity=69%"; Hit description =Putative phospholipid-transporting ATPase 2
MEILESLYSYNSLRPKVIEPKGQLLSIDGKTEAEVCRSLERVLRTMRITTLEPKDVAFVVDGWALEIALTHYRKAFTELAVLSRTAICCRVIESLNTADHATFDNHTSYMGSINGPKLPLVFEVQQMPHDLTTEGCPKNNFQNSCIFNKVCRCINNRMNACCI

SEQ ID NO: 199094 - protein, 111 aa, Glycine max
  Coding DNA Sequence Number=SeqID_82316
  Homolog annotation: Hit_ID=Q1SWX1; Match level="QueryCoverage=52%, HitCoverage=11%, E-value=4e-07, Identity=40%"; Hit description=IMP dehydrogenase/GMP reductase
MGSSQAPSLKKRFYQVKVKSLGITSLKKLGQLMGQLQRQAFRKAYGKIWDLAMAEVSTEAIASLAQYYDRPLRCFTFGDFQLSPMVEEFEEILGCPLGEGNHTSSQDSIPL

SEQ ID NO: 199095 - protein, 163 aa, Glycine max
  Coding DNA Sequence Number=SeqID_82317
  Homolog annotation: Hit_ID=Q1S0F5; Match level="QueryCoverage=47%, HitCoverage=19%, E-value=2e-09, Identity=57%"; Hit description=IMP dehydrogenase/GMP reductase
MGWLEYRENVWRQKQESWQVEVNGPPTIDAFLAFHDRKESSVVAILADLYDTFDRRCEKSSTRICLLYSDPLRMVGFTPSPPRASKEGVSINWFPRWKEGRTGVLISCRGFPNVPLMGTRGCISYNPVLAIRQLGYPMRGAPLEEELAPIIARGFNNTNAEAL

SEQ ID NO: 199096 - protein, 54 aa, Glycine max
  Coding DNA Sequence Number=SeqID_82318
  Homolog annotation: Hit_ID=Q1SGW6; Match level="QueryCoverage=60%, HitCoverage=6%, E-value=6e-11, Identity=90%"; Hit description =Glycoside hydrolase, family 28
MPPLPSYGYGREHPGPRYGSLIHGQHLTDVVITEEVSFATNGIVAAGLRAFSLA

SEQ ID NO: 199097 - protein, 67 aa, Glycine max
  Coding DNA Sequence Number=SeqID_82319
MLGTYAKRAFGLPRGPSRAKPGLHAERDCALSLNLPAKRECALSLDYTLSELSNSSNSSSILASIFL

SEQ ID NO: 199098 - protein, 213 aa, Glycine max
  Coding DNA Sequence Number=SeqID_82320
MRHWPRWILRTICASGSDWEEDEEGWLVTGGTDGGGTSDASGAALTRTLLGRGKMTEGSVGEVEVAHNTLSLSQYGEVLPKQLPRSSIGVQNELTPRCAPLGRDGLVVWISVQVLGVCGVLLPLWDNDGDLQKVIQCLGVEANDFPPNPTELGGEPYPGFCEAICKITETKTKVSKNEVAKIKEQREWLAKSRSTEVEAQHEVALNLCNNTSW

SEQ ID NO: 199099 - protein, 190 aa, Glycine max
  Coding DNA Sequence Number=SeqID_82321
MAMIVVSMMTIPMLMVVVLIMVVGGTSVGGGDSDDNDDGGDVNVHDNDGSVNGGNDDNSSIVDGGSGCGNDIDNGCGVVDNTKGGSCGNDDDGVGDDDDSGRAEIMETTMMVVRCNGGGGSDDSSARMMMLVMTMVVGCNSGSSSDNNNGGGGTVTATMVVAKVRCGSNDNNGGMVKVIVVGSGGMVVTT

SEQ ID NO: 199100 - protein, 484 aa, Glycine max
  Coding DNA Sequence Number=SeqID_82322
  Pfam annotation: Domain name=IBR; Domain location=67-161; Score=-7.4; E_value=0.1; Accession=PF01485.11; Description=IBR domain
  Pfam module annotation: Pfam domain module=IBR::Retrotrans_gag; Domain location=67-161::284-377
MGNHLCVTVKAKRKATTKSTPSSTLNLETILENYVPPNHKFCCESRPIFDSFSPEGCCHFYCTKCTLRYIVSKLQNNVLNLNCPESGCRDNLSPHFCKPCNSTELRVHVVGEGAVRVRDSREGQVLFEPHKGMIVRASNCPHCKRIVCVQCRAPWHAEISCDKFQMLKNTCDDLIIDHAKRRKWRRCPNCKHYVEKKQGCDAMTCWMRLEDYSSSTTSQYFTSIARPDVQAANITYPNSLIQLIQGNLFHGLPSEYPYAHLATYIEIYNMVKIAGVPEDAILLNLFSFSLAGEAKRWLHLFKGNSLRTWEEVVEKFLNKYFPESKTAEGKVEISSFHQYPDESLSEALDHFHGLLRKNATHGFSELVQLNIFIDGSHSKQLLDASAGGKIKLKTPEEAMELIENMAANDHAILHAMLAQNKLLTKTLETLTATLSNLPQQLHVVQSPLTSSVMHSGGCNIYGGAHESGSCMVHDDATNEANYMG

SEQ ID NO: 199101 - protein, 506 aa, Glycine max
  Coding DNA Sequence Number=SeqID_82323
  Gene Ontology: Mol. function=nucleotide binding; Cellular component =extracellular space; Biological process=cell-cell signaling
  Homolog annotation: Hit_ID=Q2RAL9; Match level="QueryCoverage=94%, HitCoverage=95%, E-value=1e-169, Identity=59%"; Hit description =Expressed protein
  Pfam annotation: Domain name=RED_C; Domain location=383-506; Score =239.4; E_value=7.9e-69; Accession=PF07807.2; Description=RED-like protein C-terminal region
  Pfam annotation: Domain name=RED_N; Domain location=6-192; Score =240.8; E_value=3e-69; Accession=PF07808.3; Description=RED-like protein N-terminal region
  Pfam module annotation: Pfam domain module=RED_C::RED_N; Domain location=383-506::6-192
MTASNKKNHKEKPIRRKEEKPEEPEVPKYRDRAKERREDQNPDYEQTELGFHAVAPPGTVDIRSSDAHKLSIEKSKYLGGDVEHTHLVKGLDYALLNKVRSEIDKKPETGDDVEGKSRSAKEDQQVSIRTATAKGGYHHDIPTTLHRSKADCPVPEEMVTVNVDGSVLDRIAKIMSYLRLGSSGKILKKKKKEKDAKGKILAVGNGFDKEDKPSKVEGPAVARAEDDDIFVGEGVHYDVPGKDLSQSPVSEDMEESPRNKEKPSYVTEPTYGPVPPSMVPQGWQETNGYDVMQTQAFDAGYQGEWQEYQYAEQLAYPDQYLQQNMQPYDVQAGLNLPQDPRFMSQEEKDRGLGSVFKRDDQRLQQLRERDAREKDPNFISESYSECYPGYQEYNREIVDSDDEDDLSKMDMGGRAKGRLHRWDFETEEEWATYNEQKEAMPKAAFQFGVKMQDGRKTRKQNKDQKLNNDLHKINKILARKKMEKDTNGEGGHHYDDEPTPGKKLRI

SEQ ID NO: 199102 - protein, 190 aa, Glycine max
  Coding DNA Sequence Number=SeqID_82324
  Gene Ontology: Mol. function=hydrolase activity, acting on ester bonds; Biological process=lipid metabolic process
  Homolog annotation: Hit_ID=Q9FLN0; Match level="QueryCoverage=91%, HitCoverage=44%, E-value=2e-32, Identity=44%"; Hit description=GDSL -motif lipase/hydrolase-like protein
  Pfam annotation: Domain name=Lipase_GDSL; Domain location=48-190; Score=8.6; E_value=0.00035; Accession=PF00657.12; Description=GDSL -like LipaseAcylhydrolase
  Subcellular localization annotation: CTP_CleavageSite=51; ConfidenceScore=5.32e-01
MAKQNFPMDCSFVCITLIQFIASMSFSKSQSLINETNTSTTTTTTKAFFILGDSTVDSGNNNYINTIPENKADYKPYGQNGFFQEPTGRFSDGRVIVDFIAEYANLPLIPPFLQPNADYSNGANFASGGAGVLVETNQGLVIDLQTQLSHFEEVRILLSEKLGEKKAKELISEAIYFFSIGSNDYMGGYL

SEQ ID NO: 199103 - protein, 97 aa, Glycine max
  Coding DNA Sequence Number=SeqID_82325
MEDANIRGERNEIQMKGTKFEMEKQMRARRKKGISQYPGRRSTNGDCWVHGEEETSAEARGRRNRRGRRRYFWYFLELLGAPAILLGAPNNAHFTVV

SEQ ID NO: 199104 - protein, 75 aa, Glycine max
  Coding DNA Sequence Number=SeqID_82326
  Gene Ontology: Mol. function=hydrolase activity, acting on ester bonds; Biological process=lipid metabolic process
  Homolog annotation: Hit_ID=Q7Y055; Match level="QueryCoverage=67%, HitCoverage=13%, E-value=9e-09, Identity=43%"; Hit description=GDSL -lipase
KIKEFSLCDNVGDFVWWDSFHPTEKIHEQFAKALWNGPASSVGPYNLENFFNKEIKLTIADVVDAPEIHHGEFHY

SEQ ID NO: 199105 - protein, 116 aa, Glycine max
  Coding DNA Sequence Number=SeqID_82327
  Gene Ontology: Mol. function=hydrolase activity, acting on ester bonds; Biological process=lipid metabolic process
  Homolog annotation: Hit_ID=Q8L8G1; Match level="QueryCoverage=71%, HitCoverage=23%, E-value=4e-09, Identity=43%"; Hit description =Lipase SIL1
MNQNIINPFFLRSQYYYTSSLAGAKPFLHADTAKYAKLPQIPPVLQPTVDYSNGINFASGGAGVLAETNQGLVIDLPTQLRHFEEVRKSLAEKLGEKKAKELILEAIYFISVGNND

SEQ ID NO: 199106 - protein, 201 aa, Glycine max
  Coding DNA Sequence Number=SeqID_82328
MAKISTIQSTLVMMVARPEDAQPWRTSMGYEEEDERRNFTFEHAWLDQLKENSSKRTKIYVNGYYLLSPNPETLIEVSESDTPSRIPCPMGQKAAKWKIKGKGGATSTPIVDLSGIEVTYQGNPCGVYPDLSSFTGSGVYPDLSSFIGSGIYPDLSSFTGSGVYPDLSSFTGSGVIQIFVACIKRSVPRKILIIWYQSFGS

SEQ ID NO: 199107 - protein, 91 aa, Glycine max
  Coding DNA Sequence Number=SeqID_82329
  Subcellular localization annotation: CTP_CleavageSite=22; ConfidenceScore=5.18e-01
MKDGAIVCPNGSSSPPSSHQIVSQHRRRIIVLSDLCIVVLVVSRALQSRTKWSNDGDINPLHCPSYTFMTSTSQPARRRGGEHVEMEGGDD

SEQ ID NO: 199108 - protein, 303 aa, Glycine max
  Coding DNA Sequence Number=SeqID_82330
  Gene Ontology: Mol. function=hydrolase activity, acting on ester bonds; Biological process=lipid metabolic process
  Homolog annotation: Hit_ID=Q8L8G1; Match level="QueryCoverage=91%, HitCoverage=76%, E-value=4e-51, Identity=39%"; Hit description =Lipase SIL1
  Pfam annotation: Domain name=Lipase_GDSL; Domain location=2-260; Score=67.3; E_value=4.8e-17; Accession=PF00657.12; Description=GDSL -like LipaseAcylhydrolase
EYAKLPQIPPFLQPNADYSNGVNFASGGAGVLAETNQGLAIDLQTQLSHFEEVRKSLSEKLGEKKTKELISEAIYFISIGSNDYMGYLGNPKMQESYNTEQYVWMVIGNLIRAIQTLHEKGARKFGFLGLCPLGCLPALRALNPVANKSGCFEAASALALAHNNALKLFLPNLKPYLEGFMYSYSSFYNWLRDRIDNPTKYGFKDGVNACCGSGPYGGVFTCGGTKKVEEFSLCDNVEYHVWWDSFHPTEKIHEQFAKEMWNGSPCSVRPYTLEDFFSKNEMIKPTISNVVDSPKTEHGQFHY

SEQ ID NO: 199109 - protein, 66 aa, Glycine max
  Coding DNA Sequence Number=SeqID_82331
MRLIKLNPNNSIHGTEKEQFSKVLWNGPPSSVGSYNLKTSFNNEVMKLTIADVVDAPETQQGQLPY

SEQ ID NO: 199110 - protein, 431 aa, Glycine max
  Coding DNA Sequence Number=SeqID_82332
  Gene Ontology: Mol. function=zinc ion binding; Cellular component =intracellular
MLHSQGVSRHCSLLAVLSGKSRDIKQKQKQGTASEDQFPYPFPELSSSGRLEVKVLTKPTADELGRSLEQLQPDFVYLQGQQLEDSEEIGPLVWEDFDLSVPEALCGLFSSKIPNTVYLETPKGEKLAEALLNKFSPRLQSGNCIPIQGTVHTPHLPILCKATYCVPVPPESIVNLGVPYTIYWKNDFSKYAASHFRHSFFSVAQSTSSHTWDAFQLALASFRLYCVQNNVLPSNSHKGAGKLGPQILGVPPNIDVSPCVADMKEEEGSPETISSLKIYDDDVNMRFLICGVPCTLDACLLGSLEDGLNALLFAEIRGCKLHNRTSATPPPLQAGTFSRGVVTMRCDISTCSSAHISLLVSGSADTCFNDQAWLLENHIKKELIEKSQLVQAFPNHQQSKAPSSEPRRSASVACGSSVFEVCMRVPAWASQ

SEQ ID NO: 199111 - protein, 178 aa, Glycine max
  Coding DNA Sequence Number=SeqID_82333
  Homolog annotation: Hit_ID=Q10QV1; Match level="QueryCoverage=44%, HitCoverage=10%, E-value=6e-29, Identity=73%"; Hit description=SacIy domain containing protein, expressed
GDPRGSSSGGGRGWRRRRRLAVAEGEEEEEVELRVPVDEFAGRRMLYLKQPRVFGSMELLRVLVHWCWDLNKFGEGEAMASSENEPSSHSSPPAHACLHKFRLYETLSNFYMIGRDKSRTYWRVLKIDRLDPSELNVLEDSTTYTESECSDLLRRIHEGNRSTGGLKFVTTCFGIVGM

SEQ ID NO: 199112 - protein, 177 aa, Glycine max
  Coding DNA Sequence Number=SeqID_82334
  Homolog annotation: Hit_ID=O21999; Match level="QueryCoverage=31%, HitCoverage=36%, E-value=6e-26, Identity=100%"; Hit description=LacZ- alpha
MVKTQDKGSKLDPRAIKCAFVGYFYAQMGYNSSSIQEIVSKDENLNKKHWLKMNLTQMLQPDLKNTRFGKKLVYTKSNVTPKSTDVHVANPTPLDQALSDKNWKQVMEALKKNKTREHASLALAVVLQRRDWENPGVTQLNRLAAHPPFASWRNSEEARTDRPSQQLRSLNGEWRLM

SEQ ID NO: 199113 - protein, 609 aa, Glycine max
  Coding DNA Sequence Number=SeqID_82335
  Gene Ontology: Mol. function=electron carrier activity; Cellular component=membrane; Biological process=electron transport
  Homolog annotation: Hit_ID=Q7XZU2; Match level="QueryCoverage=95%, HitCoverage=66%, E-value=1e-156, Identity=54%"; Hit description=SAC domain protein 3
  Pfam annotation: Domain name=Syja_N; Domain location=1-165; Score= -47.1; E_value=2.4e-08; Accession=PF02383.9; Description=SacI homology domain
MLHIFNTWIVNVLSSNLFLMYLRRGVNDEGRVANDVETEQIVFEDVPEGLPVQICSVVQNRGSIPLFWSQETSRLNLKPDIILSKKDQNYEATRLHFENLVKRYGHPVIILNLIKSHERKPRESILRSEFGKAIDFINKDLSQENRLRFLHWDLKHFQSKATNVLLLLGKVAAYALTLTGFLYCQVPPTPRPEDCIKCPSISFAYGNIDKGSFQPTRQSDVNNEDGNTLERKPSGENNLANGNHFVKPPMFQRGVLRTNCIDCLDRTNVAQYAYGLAALGHQLHALGIIDHPKIDLDDPLSDGLMGFYERMGDTLAHQYGGSAAHKKIFSERRGQWKTATQSQEFFRTLQRYYSNAYMDAEKQNAINIFLGHFQPQLGKPALWDLSSDQHYDIGRYGDDDASLCGNSELWLFRSFAKRCFSDGSITRDNSTPMSTPNPKLENFSKLGLQDQSEGSNTFFESSPEISTSSGTESDMSFSRLFCMRTEVKKNTSYPIAQRLFAMRRYTPSMPHKQLFGDIQRERFFHSDHISYSGHGDSFCSSNFIDLDWLSSSGNSCEEEPFERLSITNSSIARLSSKNVINGVITGGDTPSTSDLDSNTKFGDGSDTAI

SEQ ID NO: 199114 - protein, 78 aa, Glycine max
  Coding DNA Sequence Number=SeqID_82336
MCPHKFSEDDLILKKVSQVQKDHRGKWAPNYEGPFMVKKLGMNVHSRFLLTPTTSTPEPMVESARSKVACSARSVGVP

SEQ ID NO: 199115 - protein, 150 aa, Glycine max
  Coding DNA Sequence Number=SeqID_82337
MVDQGGEALGSMGGPHFVQSSHAHVPQPMGETHEVPRDHTLAEFEPHVGYAIKGQAFGGVPLPNALGGPQYRPQPQLQPLHFTMGRLPPAMVEREKFDHIEERIRTIEGGGDYPFVNMAKLCLVPDVIISPKFKVLDCDRYKGTTFPRIT

SEQ ID NO: 199116 - protein, 125 aa, Glycine max
  Coding DNA Sequence Number=SeqID_82338
MEAGMIKCDSNKEDPCLMHSRALHDVERCPIAKELLAVLWKYSAQGPDGRQDASVMHVRNDMPAARIMNISGMSDMTRSGRIFAPPELPARSKDKGKAKADTGEDEPDREWRGPCQNVCRGGGRP

SEQ ID NO: 199117 - protein, 36 aa, Glycine max
  Coding DNA Sequence Number=SeqID_82339
MGVVLSYTLGTLRLLEYDINDTITLVDKLLNKLIGA

SEQ ID NO: 199118 - protein, 87 aa, Glycine max
  Coding DNA Sequence Number=SeqID_82340
MVGDQYLFNLQKLQNNVVNLTCPESRCYGELSPLFFEPMLPNNVLVWRLFCAQCKAPWNQGIRYKEFQKLKKNEKERQDIMLMILDE

SEQ ID NO: 199119 - protein, 344 aa, Glycine max
  Coding DNA Sequence Number=SeqID_82341
  Homolog annotation: Hit_ID=Q1ST43; Match level="QueryCoverage=39%, HitCoverage=9%, E-value=2e-31, Identity=47%"; Hit description =Integrase, catalytic region; Peptidase aspartic, catalytic
  Subcellular localization annotation: CTP_CleavageSite=42; ConfidenceScore=5.46e-01
MVASITPVIFVIRSKEVSFPNASRPRLPNKSGNSSSGSINSVASDGSSRNPSDEECKDGYVPAPSPNITQAQFQQLMALLQKTSTGDMNFLPTPPLGQATSFDQTTSNPLDGSTISTETNPPTPPPTNDISPMSLTLEFLNPSPSSPSTSSFPPNSPPPINSPPRRSSRPRQPPPYLSEYKCDLPLLKSVQSSSTCSYQIQTSLTYDLISPSHHRYIMSLSSESEPTRFDDIVKHRYWREAMNCEIEALIMNQTWDVVHTPPHVRPIGCKWVYKIKRLPDGSVERYKARLVAKGFSQIEGVDYFETFSLVDSGIFGCKPPSTPMDFDFMSIPSAFLLIHFHIED

SEQ ID NO: 199120 - protein, 73 aa, Glycine max
  Coding DNA Sequence Number=SeqID_82342
MRTGSACLFQHTIHNFMERRRSKPELLLLIYFGKEYAADAATNAAATRLQCITKPLQCGHNCVCGPDQNLKPC

SEQ ID NO: 199121 - protein, 344 aa, Glycine max
  Coding DNA Sequence Number=SeqID_82343
  Homolog annotation: Hit_ID=Q0XGI5; Match level="QueryCoverage=40%, HitCoverage=50%, E-value=9e-45, Identity=61%"; Hit description=Site -specific DNA methylase-like
  Subcellular localization annotation: CTP_CleavageSite=45; ConfidenceScore=5.36e-01
DSSSSHAPRGSGTVAVGAKAAGLADDGGRPKSRRSSGTRYACPAPADPRRGCRRRRTRPWQKASAHKHEPGARHRLVRHGTDSRSHRPGRCRPLRRRAVCAAGRWRRPRRVRRSSDAGEGAGGSRAPGAISRRGSGSRGVWASCRSPGRATMARNTSGEAMNVRELITYIAKASLLCTVALLAGIGASAVFFSWTSGTYAPANSSDLAAWIQAVGSIGAILGAFWLANRQANEQRNQIREQRLLLDRQICGAIEVAYSVANAIREKADGTSLTMFLEVWNYYLGSHTGRPAAQCKTPPLLPEPRAGACPIGKWCQAIGVRTDVHANTHARQNPRQLDLAFSANE

SEQ ID NO: 199122 - protein, 292 aa, Glycine max
  Coding DNA Sequence Number=SeqID_82344
  Homolog annotation: Hit_ID=Q47522; Match level="QueryCoverage=17%, HitCoverage=62%, E-value=1e-21, Identity=94%"; Hit description=LacZ protein
YDGVFEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIAARLGQRAQHLQLEAAVAASAQLRIGQQGGDGIAHGTAVAKVQPPAQPGDGDVLHLVRGQAQAFHARPYAGIVGTLQRLGRGGPVALQHEDARMLQPRAGRHAGQLAFMIKLIDTVDLEGGPVGKPVVPAALMNRPTRGERRFAYWALAECILAYYVGTDEGVSEVLHVAGEKRLH

SEQ ID NO: 199123 - protein, 179 aa, Glycine max
  Coding DNA Sequence Number=SeqID_82345
  Gene Ontology: Mol. function=unfolded protein binding; Cellular component=phagocytic vesicle; Biological process=protein folding
  Homolog annotation: Hit_ID=P27323; Match level="QueryCoverage=61%, HitCoverage=24%, E-value=2e-30, Identity=50%"; Hit description=Heat shock protein 81-1
MADGDLVKEALQKGVGFYSTFLVADKLILEYLEETRIKDLVKKHSQFITHPIYLWTEKTTEKEISDDEPKKEGNVEDDDVAMEKDSKKKIKDVSHEWQLINIWLRKPEETTKEEESASFCSQDLSLSTGLQLQAEMETKFVAATSEKLRNHIPDDLAFSILSKLSQEVWMCLQIMGPLI

SEQ ID NO: 199124 - protein, 55 aa, Glycine max
  Coding DNA Sequence Number=SeqID_82346
MSAYAHQMEQQYSAPSLSDDSVFWGSQLCPTPPMTTKVGEVSYMVHMVSFDFVKD

SEQ ID NO: 199125 - protein, 190 aa, Glycine max
  Coding DNA Sequence Number=SeqID_82347
  Gene Ontology: Mol. function=hydrolase activity, hydrolyzing O -glycosyl compounds; Cellular component=membrane; Biological process =carbohydrate metabolic process
  Homolog annotation: Hit_ID=Q1S8W5; Match level="QueryCoverage=58%, HitCoverage=49%, E-value=2e-14, Identity=66%"; Hit description =Glycoside hydrolase, family 17
  Pfam annotation: Domain name=X8; Domain location=97-167; Score=40.8; E_value=3.5e-09; Accession=PF07983.3; Description=X8 domain
MSLQQVSSSEGSSKMVRDGDSVRFHDDDNNNFDEKGIKSNPDTIASKERDGKKRVSRNVKKKYGIFSIEYAFFLALPSMKQIVDSNTLFHYDSMFDVMVDAPLFNLHRRYGTSPHTWTPTLSNNMKSHASYVYNDYYQRKHNSGGTCDFDGTATITTKDPSSSSCIFARSYNSSTRLQWLLEIQAPLVRV

SEQ ID NO: 199126 - protein, 166 aa, Glycine max
  Coding DNA Sequence Number=SeqID_82348
  Gene Ontology: Mol. function=calpain activity; Cellular component =intracellular; Biological process=proteolysis
  Homolog annotation: Hit_ID=Q1S671; Match level="QueryCoverage=79%, HitCoverage=36%, E-value=8e-16, Identity=38%"; Hit description =Cyclin-like F-box; F-box protein interaction domain
  Pfam annotation: Domain name=F-box; Domain location=7-54; Score=40.3; E_value=6.6e-09; Accession=PF00646.23; Description=F-box domain
MRSEKKPWSPLLCDELIEEILSRLPVKPLIQFKCVCKGWNSLMSDPYFIKLHLSKSAAKDDLEHLQLMKNVCLGSIPEIHTESCDVSSIFHSLQMETFLFNFANMPGYHLVGSCNGLHCGVSEIPEGYRVCFWNKATRVISRESPTLSFSPGIGRRTTSVSAMIRQ

SEQ ID NO: 199127 - protein, 128 aa, Glycine max
  Coding DNA Sequence Number=SeqID_82349
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q27SZ0; Match level="QueryCoverage=82%, HitCoverage=79%, E-value=5e-52, Identity=93%"; Hit description=Endo -1,4-beta-glucancase precursor
  Pfam annotation: Domain name=Glyco_hydro_9; Domain location=15-128; Score=-252.3; E_value=0.016; Accession=PF00759.9; Description =Glycosyl hydrolase family 9
MAFSAQLSLAFTSQEYHEALEKSIIFFEGQRSGKLPSNQQQTWRGDSGLSNGSSYHVDLVCGYYDAGDNGKFELPMAFTITLLAWSVIEFGSSMQDQIENARAAIRWSTDYLLKAATTTSDALYVQVI

SEQ ID NO: 199128 - protein, 92 aa, Glycine max
  Coding DNA Sequence Number=SeqID_82350
  Subcellular localization annotation: CTP_CleavageSite=71; ConfidenceScore=5.35e-01
MAQIALIAPAATVIPIITGMGKQQKLSYAARRNKVSLASLVPSWRLERVPRLALSNNNNSGDDRKTSVVVKVSEGGAISLPHGWSAQKLYAL

SEQ ID NO: 199129 - protein, 1114 aa, Glycine max
  Coding DNA Sequence Number=SeqID_82351
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=94%, HitCoverage=67%, E-value=0.0, Identity=41%"; Hit description=Chromo
  Pfam annotation: Domain name=RVP_2; Domain location=342-472; Score= -18.0; E_value=2.6e-05; Accession=PF08284.2; Description=Retroviral aspartyl protease
  Pfam annotation: Domain name=zf-H2C2; Domain location=1051-1092; Score=30.5; E_value=6e-06; Accession=PF09337.1; Description=His(2) -Cys(2) zinc finger
  Pfam module annotation: Pfam domain module=RVP_2::RVT_1::Retrotrans _gag::zf-H2C2; Domain location=342-472::596-765::103-193::1051-1092
MSASDPPGSITKLEDALLLLAQQHLSLTTKIDELLHRLPPSHPSPSFSPFDSTNPPLRSPSPATTHKMKLDVPRFDGTDPNGWIFKINQFFEYHSTPFEDRLTIASFAMDGRALAWFQWMTSNGQLTSWSVFQQALQARFAQSQYEDPTGALFKLTQKGTVGDYLAEFEDLATRVVGLPPPFLLSCFVSGLSPDIRRDVQALQPLTLAQAAGLAKLQEEKFLDHRFPPKPRNPAHTTQPPFLRPSPPTSSPKSFFPTPISTAPAPLLTAPPRTPPPVKRLSPEEVASRRERGLCFSCDEKYHRGHKCASRVFLLIAADDDPHLPNLNPADPDPDPPDPPDNNPAQISLNTLAGNVAPETLRLVGIISDHHVILLVDGGSTHSFIQEQLVPQLQLSCQAIPPLRVMIGNGQHLVCSHMCPRVPITIQGAQFTADLYVLPIAGANVVLGVQWLKSLGPILTDYTTLCMQFFHEGRLVQLNGDRDASLNMLTLPQFRRFCRRHEDALYLHVSMASSETPHQTPAPVPSAIQDLLTHFASLFQEPHSLPPPRETDHHIHLLPHSCPVNVRPYRYPHFQKREIELQVELMLQKGLIQPSTSPFSSPVLLVRKQDGSWRFCVDYRALNLVTVKDRFPIPTIDELLDELGGARCFSKLDLLSGYHQIRMHSADIPKTAFRTHHGYYEFKVMPFGLCNAPSSFQATMNTIFRPYLRQFVIVFFDDILIYSGSLDEHLSHLQTTFQVLLENQFVLKFSKCFFAQPEVEYLGHVVSIRGVELVASKVETIRQWPTPQSTRALRSFLGLVGFYRRFIRSYATIADPLVKATTKDPLVWTKQTQTAFTHLKEALSTALVLILPDFTQPFTVETDASGVGMGVVLSQQGRPIAFFSKPFPPKLLHALTYVRELCVVTTAVKKWRQYLLGQRFTILTDHRSLKELLTQAIQTLEQHVYLARLLGYDYVIHYRSGLNNQVADALSRLPEQSATKLMILSVPSLTFIEDLRHQLTNHSGYQQMLQDIRESPSTHPEFSVTRDLITHKGRIWLTRDLPIIPVLLTEFHATPTGGHAGIVKTLARLTENFYWPGIRDDVTKFVTNCVECQVTKYETKRAAGLLCPLPVPSKP

SEQ ID NO: 199130 - protein, 138 aa, Glycine max
  Coding DNA Sequence Number=SeqID_82352
  Gene Ontology: Mol. function=protein binding; Cellular component =endoplasmic reticulum; Biological process=ER to Golgi vesicle -mediated transport
  Homolog annotation: Hit_ID=Q8IUR0; Match level="QueryCoverage=72%, HitCoverage=48%, E-value=4e-15, Identity=55%"; Hit description =Trafficking protein particle complex subunit 5
MIGVGKIKQYSNVLDKPLTKGKQEVSLSAFAFLFSELVQYNQTQVDNIGELERSLVINNVHPPDWRMLDMRLGLEFLSCFATEIRETEGRHGCWVFFLLYTVQYGKYYLERDMRFLSLEPLSSCYGMAFPDWRKDLVL

SEQ ID NO: 199131 - protein, 73 aa, Glycine max
  Coding DNA Sequence Number=SeqID_82353
MTVFLSDDCTKVFKTVGLPNSTVEISIELILLDRIDADRLTPNMIVPNMCILLIRVTNVGQKCKVYSTKTLLH

SEQ ID NO: 199132 - protein, 252 aa, Glycine max
  Coding DNA Sequence Number=SeqID_82354
  Gene Ontology: Cellular component=integral to membrane; Biological process=peroxisome organization and biogenesis
  Homolog annotation: Hit_ID=Q1S5G3; Match level="QueryCoverage=97%, HitCoverage=97%, E-value=1e-110, Identity=77%"; Hit description =Transmembrane amino acid transporter protein
  Pfam annotation: Domain name=Aa_trans; Domain location=1-238; Score= -42.0; E_value=6.4e-06; Accession=PF01490.8; Description =Transmembrane amino acid transporter protein
IPCYCALTNRTLSGLRSPPRDYEIPGEGVSKIFTIIGASANLVFAFNTGMLPEIQATIKQPVVKNMMKALYFQFTVGVLPLYLVAFTGYWAYGSSTEVYLLNSVNGAVWVKALANITAFLQSVIALHIFASPMYEFLDTKYGIKGSAMNVKNMSFRMVVRGGYLAFNTFVAAFLPFLGDFMSLTGAISTFPLTFILANHMYLKAKKDKLNSSQKLWHWLNIGFFSIMSLAATISAIRLIAIDSKTFHVFADL

SEQ ID NO: 199133 - protein, 321 aa, Glycine max
  Coding DNA Sequence Number=SeqID_82355
  Gene Ontology: Mol. function=sugar porter activity; Cellular component=membrane; Biological process=transport
  Homolog annotation: Hit_ID=Q59IV5; Match level="QueryCoverage=98%, HitCoverage=99%, E-value=1e-151, Identity=85%"; Hit description =Plastidic phosphate translocator-like protein2
  Pfam annotation: Domain name=DUF6; Domain location=15-148; Score=8.2; E_value=0.023; Accession=PF00892.11; Description=Integral membrane protein DUF6
  Pfam annotation: Domain name=Rhomboid; Domain location=32-173; Score=- 37.7; E_value=0.095; Accession=PF01694.12; Description=Rhomboid family
  Pfam annotation: Domain name=TPT; Domain location=157-315; Score =156.0; E_value=9.6e-44; Accession=PF03151.7; Description=Triose -phosphate Transporter family
  Pfam annotation: Domain name=UAA; Domain location=7-321; Score=-52.8; E_value=8.9e-08; Accession=PF08449.2; Description=UAA transporter family
  Pfam module annotation: Pfam domain module=DUF6::Rhomboid::TPT::UAA; Domain location=15-148::32-173::157-315::7-321
MKGSNNRFFTVGLVAAWYSSNIGVLLLNKYLLSNYGFKYPIFLTMCHMTACSLFSYVAIAWMKVVPLQTLRSKVQFFKISALSLVFCVSVVFGNISLRYLPVSFNQAIGATTPFFTAVFAYLMTFKREAWLTYLTLVPVVTGVIIASGGEPSFHLFGFIICVAATAARALKSVLQGILLASEGYIFKWVLTEFLCVREKLNSMNLLLYMAPMAVVFLLPATLIMEENVVGITLALARDDSKIIWYLLFNSSLAYFVNLTNFLVTKHTSALTLQVLGNAKGAVAVVVSILIFRNPVSVTGMMGYSLTVFGVILYSEAKKRSK

SEQ ID NO: 199134 - protein, 44 aa, Glycine max
  Coding DNA Sequence Number=SeqID_82356
MGYKMRKPQFEAKLLAMRMDFPRAPNWLDQISKSKWTHAHDEEK

SEQ ID NO: 199135 - protein, 236 aa, Glycine max
  Coding DNA Sequence Number=SeqID_82357
  Gene Ontology: Mol. function=sugar binding; Biological process =protein amino acid phosphorylation
  Homolog annotation: Hit_ID=Q1T2V3; Match level="QueryCoverage=60%, HitCoverage=42%, E-value=5e-24, Identity=41%"; Hit description =Concanavalin A-like lectin/glucanase
  Pfam annotation: Domain name=Lectin_legB; Domain location=1-151; Score=-13.2; E_value=1.6e-09; Accession=PF00139.10; Description =Legume lectin domain
DPTSLSTEFSFSVSGHGHGLLLVLAAAGNVSNYVGVEFDTSKDDNAGDPNANHVSIDVGSHVSVAIANVSDLNLVLNNGEKLQAWVDYEASSKVLEVRLSKWGEQKPSDPIVSHDIDFSKIWGKNPVIAALSSSNGAHSVQVVSVYSWRVSLKKVSNGLHSLPADPHSNNNNNKFEDEHKKSVCPLTVLAWVIFGTGCVALVTFVVLFMWVIFFQKGEEESLVKIPDHPSSDVRRL

SEQ ID NO: 199136 - protein, 143 aa, Glycine max
  Coding DNA Sequence Number=SeqID_82358
MVKSPVEGGDLGVKSKIELRQVKSNKKQKTTDKEVEERSRRGGHRSRLLRWLLVHAIALEVADAEAAFSASVTKGVEPTSPPVLLDGRTDFVEVRLYGDVMLRYVNYKNAGLQAPHVDPTGPYYCGTGANKAFGCDIVGISQK

SEQ ID NO: 199137 - protein, 103 aa, Glycine max
  Coding DNA Sequence Number=SeqID_82359
  Gene Ontology: Mol. function=zinc ion binding
  Homolog annotation: Hit_ID=Q1S5F3; Match level="QueryCoverage=60%, HitCoverage=26%, E-value=8e-16, Identity=63%"; Hit description=Zinc finger, C3HC4 type (RING finger), putative
  Pfam annotation: Domain name=zf-C3HC4; Domain location=20-74; Score =14.0; E_value=0.0056; Accession=PF00097.15; Description=Zinc finger, C3HC4 type (RING finger)
MSVAEDKSQSEYEIMVKRNCRICYLSMDMDMTNHNNESAGNAMTPIELGCSCKEDLAAAHKHCAEAWFKVKGNKLLNVNMACKASRKLKLKCLFLGKIWLKDQ

SEQ ID NO: 199138 - protein, 388 aa, Glycine max
  Coding DNA Sequence Number=SeqID_82360
  Gene Ontology: Mol. function=transferase activity, transferring glycosyl groups; Cellular component=integral to membrane; Biological process=metabolic process
  Homolog annotation: Hit_ID=Q9C768; Match level="QueryCoverage=95%, HitCoverage=81%, E-value=1e-106, Identity=52%"; Hit description =Glucosyl transferase, putative; 93894-95315
  Pfam annotation: Domain name=UDPGT; Domain location=4-370; Score= -101.1; E_value=1.6e-05; Accession=PF00201.9; Description=UDP -glucoronosyl and UDP-glucosyl transferase
MCYIVALNVKCLVPFKECVEKLLSDVSEEAVVSCFISDALCYFTQAVADNLQLPRIVLRTGGVSSFVAFAAFPILRQKGYLPIQECKLEEPVEELPPLRVKDLPMIKTEEPEKYYELLHIFVKESKSSLGVIWNSFEELESSALTTLSQEFSIPMFPIGPFHKYFPSSSSFCSSLISQDRSCISWLDSHTPNSVMYVSFGSVAAITETNFLEIAWGLVNSRHPFLWVVRPGLIEGSKWLEPLPSGFMENLEGRGLIVKWAPQQEVLAHSSIGAFWTHNGWNSTLEGICEGVPMRCMPCFTDQKVNARYVSHVWRVGLQLEKGVDRKEIEKTIRRLMDDNFEGKEIRDRALKLKEEAKVCLKQNGSSCSSLEVLVAYILSLESFAFEAS

SEQ ID NO: 199139 - protein, 66 aa, Glycine max
  Coding DNA Sequence Number=SeqID_82361
  Subcellular localization annotation: CTP_CleavageSite=48; ConfidenceScore=5.56e-01
MKAKCNQRWLGGAKTMSPKTPPPSFFIFWCRGCSPRRANLPFCFGAIMSMALYGSAFAYSNPLKVD

SEQ ID NO: 199140 - protein, 183 aa, Glycine max
  Coding DNA Sequence Number=SeqID_82362
  Gene Ontology: Mol. function=structural constituent of ribosome; Cellular component=ribonucleoprotein complex; Biological process =translation
  Homolog annotation: Hit_ID=Q9BBQ0; Match level="QueryCoverage=60%, HitCoverage=91%, E-value=4e-52, Identity=93%"; Hit description =Chloroplast 50S ribosomal protein L14
  Pfam annotation: Domain name=Ribosomal_L14; Domain location=62-183; Score=211.4; E_value=2e-60; Accession=PF00238.10; Description =Ribosomal protein L14pL23e
  Pfam annotation: Domain name=Ribosomal_L16; Domain location=1-113; Score=103.2; E_value=7.7e-28; Accession=PF00252.8; Description =Ribosomal protein L16
  Pfam module annotation: Pfam domain module=Ribosomal_L14::Ribosomal _L16; Domain location=62-183::1-113
MKGISYRGNHICFGRYALQALEPAWITSRHIEAGRRAMSRNVRRGGQIWVRIFPDKPVTVRPTETRMGSGKADNSGARELMCIRILGASNRRYAYIGDIVVAVIKQAVPNTNLERSEVIRAVIVRTCKELKRSNGIIIQYDDNAAVVIDQEGNPKLTRIFCAIARELRQLNFTKIVSLAPEVL

SEQ ID NO: 199141 - protein, 95 aa, Glycine max
  Coding DNA Sequence Number=SeqID_82363
MPHNQIDPRTCLFIYRREGGDDHGAPVRPASSSSRQTQTPALRAPRNSNLLSATPGGPETNPVNHRVFERKLRPKPLGRGHACLGVTHRFPNANM

SEQ ID NO: 199142 - protein, 352 aa, Glycine max
  Coding DNA Sequence Number=SeqID_82364
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-41, Identity=28%"; Hit description= UPI00006A17C9 related cluster
GLHALSFRGLHALSLRGLHVLGFRGLHVLSFRALHALAFRGLHVLTFKGLHALAFRGLQALAFGRLHVRAFRGLHVLAFRRLYVLIFRGLHALSFRGLHAVSLRGLHVLGFRGLHVLTFRGLHALPFRGLHTLAFSGLHILAIRGLCSLTFRGLHALSLRGLHVLGFRGLHVLGLRGLYVLAFRELYVLAFRGLHDITFRGLHVLDFRKTTRSRFQRTTHPQLLRTTCTRLQRATRRRLQRITRPDLQRTTNLAIRGLHVLTFRGLHVLSFRGLHALAFRGLHILTFRGLHVPTFRGLHILNFRGLHIHNIRGLHVLTFRGLHALTLKQLHILTFRGLHVLTFRGLHVPTFR

SEQ ID NO: 199143 - protein, 70 aa, Glycine max
  Coding DNA Sequence Number=SeqID_82365
  Subcellular localization annotation: CTP_CleavageSite=54; ConfidenceScore=5.14e-01
MKVEIVTSPTTRAHSLMESSLVTLRTLMMLGSSSVKSCVSQPTLQPEGEARFKGASSKKENARESPPTFI

SEQ ID NO: 199144 - protein, 109 aa, Glycine max
  Coding DNA Sequence Number=SeqID_82366
  Gene Ontology: Mol. function=amino acid transporter activity; Cellular component=plasma membrane; Biological process=response to nematode
  Homolog annotation: Hit_ID=Q9LZ20; Match level="QueryCoverage=69%, HitCoverage=13%, E-value=1e-13, Identity=48%"; Hit description=Amino acid transport-like protein
MHSISFLLCQYLLAKVCDIYPRIELANGQTKYAKYSDSKSIQMPKLRRISQMTRVMSKMTATATKSISLKPLGRDGTVRRHLVEEIPIVVPRYVIKPLATVTLESTDQR

SEQ ID NO: 199145 - protein, 141 aa, Glycine max
  Coding DNA Sequence Number=SeqID_82367
MVGAGLKKDLRVSRVVPGGSLNAFLFLLIGVISQRLAMLVELRSCNWVVAITGWMSNCPGGNDSILRAVKNVEEGFLIWDPGEEDQAGPCEQLDALSPFNPLSEMWQKEKESMDRPHRLHPVGTTRSPQGRLRHPGVADRP

SEQ ID NO: 199146 - protein, 257 aa, Glycine max
  Coding DNA Sequence Number=SeqID_82368
  Homolog annotation: Hit_ID=Q8TGM6; Match level="QueryCoverage=46%, HitCoverage=97%, E-value=5e-09, Identity=43%"; Hit description =Protein TAR1
  Subcellular localization annotation: CTP_CleavageSite=51; ConfidenceScore=5.50e-01
MSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRCSPTETLLRLLLPLNDKVQWTSHNVAGSEPLTSPQSEHFTGPFNR

SEQ ID NO: 199147 - protein, 66 aa, Glycine max
  Coding DNA Sequence Number=SeqID_82369
MRADALSAGAFKTQSSYGNAKRSCALSAPYETAKNYKAIRCICPYLASSPYIPAPLLFIAFIYTIQ

SEQ ID NO: 199148 - protein, 357 aa, Glycine max
  Coding DNA Sequence Number=SeqID_82370
  Gene Ontology: Mol. function=sulfuric ester hydrolase activity; Cellular component=integral to membrane; Biological process =metabolic process
  Homolog annotation: Hit_ID=Q7VWD3; Match level="QueryCoverage=99%, HitCoverage=63%, E-value=2e-64, Identity=36%"; Hit description =Putative outer membrane protein
  Pfam annotation: Domain name=Sulfatase; Domain location=125-351; Score=68.1; E_value=2.9e-17; Accession=PF00884.13; Description =Sulfatase
MSILGTHVAEVKSMSGLYLNCLPAVAAYFIVTWYAIKSASEHASSRVKAIGFVLLAVYLGWYSTANWLKKRHDLEVYYPLSSRILTNTPFYTGAEFIIAHRDNALAQKISQHSVNYPALQYQDTGIENYVVIVGESARRSNMQLYGFNQDTTPVEAGLAKDALIFSNAIAPASATVLSVPMILSKADPDHFTADKLADNIVSVAKKTGYHTEWISAQGNTGKSNNYIVAIASVSQKAQWIDTRYDTELLPALDEALKTPGKKLIFLHINGSHEMACDRYPASANILHTGNKYEDCYNNAILFTDAFIGEVVKRLQGSASSLLYFSDHGLEKNPQLNSLYMHGSRNPSKEAYQVPQFI

SEQ ID NO: 199149 - protein, 105 aa, Glycine max
  Coding DNA Sequence Number=SeqID_82371
MCKKEHESFKEYAQRWRDLAAQVAPPMMEREMITMIVDTLPVFYYEKLVGYTPSSFADLVFVGERIEVGLRRGKFDYPTLMNMKPGENGQSKNEGGTHVVTAIPT

SEQ ID NO: 199150 - protein, 218 aa, Glycine max
  Coding DNA Sequence Number=SeqID_82372
  Gene Ontology: Mol. function=protein binding
  Homolog annotation: Hit_ID=UPI0000E68FA8; Match level="QueryCoverage =73%, HitCoverage=100%, E-value=2e-28, Identity=42%"; Hit description= conserved hypothetical protein
  Pfam annotation: Domain name=DUF520; Domain location=59-217; Score =241.3; E_value=2e-69; Accession=PF04461.4; Description=Protein of unknown function (DUF520)
MPASISEKQASAATIQATAREGERCRFMAHYRRPRAPPGAGHGRRDRMAATEFRGATPMPSFDVVSEVDTHELTNAIDQANRELATRFDFKGVDAKFERDGDVINQTAPTEFQLKQMNDILRARLAARGIDVLSLEFGDIETNLAQARQKITVKQGIEQKIAKKIAAALKEAKLKVESQINGDKLRVQGKKRDDLQDAIAVLKAGKFELPLQFNNFRD

SEQ ID NO: 199151 - protein, 78 aa, Glycine max
  Coding DNA Sequence Number=SeqID_82373
  Subcellular localization annotation: CTP_CleavageSite=32; ConfidenceScore=5.15e-01
MSSRHRECLSPLARSSGPPYQSSFHQEVLRPQAGAGRNTTSALGWPVAGNRHTATNSRVHLSSSIKRLECCLRHMADP

SEQ ID NO: 199152 - protein, 90 aa, Glycine max
  Coding DNA Sequence Number=SeqID_82374
  Subcellular localization annotation: CTP_CleavageSite=53; ConfidenceScore=5.53e-01
MFAHSIKGCRPLGTGVWGANTFPVRKYNSPNLSLKSFVDRVFSGFSERFPQINVGGDSARIPFVEHASRESRVALPPKGVEPSPLTLDEE

SEQ ID NO: 199153 - protein, 67 aa, Glycine max
  Coding DNA Sequence Number=SeqID_82375
ERCSETGLEWFDPLGVEGSAAYCGEVVSATSAGSSGEASRDFSKVDAASMGYNYPPFPDQGLRSGRL

SEQ ID NO: 199154 - protein, 72 aa, Glycine max
  Coding DNA Sequence Number=SeqID_82376
MRIIPKTGYFKCEICKIGHIYRDPKDGNGLEVGTLGLEGRPKPLSSFSLDRGACSDNHKVSHCLGVKAKCRL

SEQ ID NO: 199155 - protein, 124 aa, Glycine max
  Coding DNA Sequence Number=SeqID_82377
MVFPTCIDEILLKTWAVRFKFRSQLRQSSVLDVSEELHHIQSLIATLGLKEQSSKGKGIAVEPESSPPIFVPTPSLSQSSDYDPGNSTCLTPTKRISCQQTSSDFDSDEHAQYQLSTNKHIKAE

SEQ ID NO: 199156 - protein, 94 aa, Glycine max
  Coding DNA Sequence Number=SeqID_82378
  Gene Ontology: Mol. function=dopamine beta-monooxygenase activity; Cellular component=integral to membrane; Biological process =histidine catabolic process
  Homolog annotation: Hit_ID=Q5QLG0; Match level="QueryCoverage=98%, HitCoverage=28%, E-value=1e-20, Identity=46%"; Hit description =Membrane protein-like
STSGNSNLNLLRSHGVLNIMGWSILMIIGSIIARYFKQWDPTWFYFHASIQAFSFVAGVIGIICGLVLSKKLNTKVTHHKNIGIVIIILGFLQV

SEQ ID NO: 199157 - protein, 168 aa, Glycine max
  Coding DNA Sequence Number=SeqID_82379
  Gene Ontology: Mol. function=oxidoreductase activity, acting on NADH or NADPH; Cellular component=photosystem II; Biological process =mitochondrial electron transport, NADH to ubiquinone
  Homolog annotation: Hit_ID=P31174; Match level="QueryCoverage=49%, HitCoverage=52%, E-value=1e-42, Identity=98%"; Hit description =NAD(P)H-quinone oxidoreductase chain J, chloroplast (EC 1.6.5.-) (NAD(P)H dehydrogenase, chain J)
  Pfam annotation: Domain name=Oxidored_q6; Domain location=1-70; Score= 77.8; E_value=3.5e-20; Accession=PF01058.12; Description=NADH ubiquinone oxidoreductase, 20 Kd
MAPSLVRLYEQMPEPKYVIAMGACTITGGMFSTDSYSTVRGVDKLIPVDVYLPGCPPKPEAIIDAITKLRKTNTKFIKKFRRSKKMQGRLSSWLVKHGLIHRSLGFDYQGIETLQIKPEDWHSIAVILYVYGYNYLRSQCAYDVAPGGLLASVYHLPRLEYGIDQPEE

SEQ ID NO: 199158 - protein, 138 aa, Glycine max
  Coding DNA Sequence Number=SeqID_82380
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=74%, HitCoverage=19%, E-value=6e-47, Identity=90%"; Hit description=NADH -plastoquinone oxidoreductase subunit 2
  Pfam annotation: Domain name=Oxidored_q1; Domain location=1-138; Score=-109.9; E_value=0.032; Accession=PF00361.10; Description=NADH -Ubiquinoneplastoquinone (comple
MFQFMFLSLSGYPKKDVRSNEATPKYLLMGGASSSILVHGFSWLYGSSGGEIELQEIVNGLINTQMYNSPGILIALLFITVGIGFKLSPAPSHQWTPDVYEGVRVRNNESLYDKQIHFASSLLRVVPTKDRTNDVYNT

SEQ ID NO: 199159 - protein, 192 aa, Glycine max
  Coding DNA Sequence Number=SeqID_82381
  Gene Ontology: Mol. function=nucleic acid binding; Biological process= DNA integration
WDDLKRVFLEKFFPESRTTAIRKDISSIRQLSGESLYEYWERFKKLCASYPHHQISEQLLLQYFYEGLSNMERSMIDATSGGALGVHEVATDSSSSAENKKLKGKLDALVNLVTQLAMNKKSALIARIQSRLEESSKSKTGKSSTTTTACPAFQNGVGPSKPYVPPPMQQQQQQQQRQQATKAPSQPSLEEL

SEQ ID NO: 199160 - protein, 77 aa, Glycine max
  Coding DNA Sequence Number=SeqID_82382
MNSVIIELYFKGRIYEDNDGVIFEGSKKAIQIKRGISFNALKKKIGDKENILRCKFAMTKSLKRCRKVLNNNKKCQF

SEQ ID NO: 199161 - protein, 133 aa, Glycine max
  Coding DNA Sequence Number=SeqID_82383
  Gene Ontology: Mol. function=calcium ion binding; Cellular component =mitochondrial inner membrane; Biological process=transport
  Homolog annotation: Hit_ID=Q9LY28; Match level="QueryCoverage=92%, HitCoverage=25%, E-value=1e-48, Identity=75%"; Hit description =Peroxisomal Ca-dependent solute carrier-like protein
  Pfam annotation: Domain name=efhand; Domain location=29-57; Score =12.2; E_value=0.61; Accession=PF00036.22; Description=EF hand
  Pfam annotation: Domain name=efhand; Domain location=65-93; Score =26.4; E_value=0.0001; Accession=PF00036.22; Description=EF hand
  Pfam annotation: Domain name=efhand; Domain location=96-124; Score =13.7; E_value=0.4; Accession=PF00036.22; Description=EF hand
  Pfam module annotation: Pfam domain module=efhand::efhand::efhand; Domain location=29-57::65-93::96-124
MGMKKVASGVTMDHVLLASQETKEAREARIRSLFDFFDRENLGFLDYSHIEAGLSALQIPAEYKYAKDLLNACDANKDGRVDFQEFRKYMDDKELELYRIFQAIDVAHNGCILPEELWEALVRAGMCLVPLVF

SEQ ID NO: 199162 - protein, 112 aa, Glycine max
  Coding DNA Sequence Number=SeqID_82384
MAKFDPDIVMEFYANAWPTKEGRASSVSIARGGDRSLALMRRLLPNYYAYWARFCPDCRRETGADHAHQHDHPYTNMDDVSVAPTRYPIDQEKSNRALGFPTLITGLCQFYG

SEQ ID NO: 199163 - protein, 334 aa, Glycine max
  Coding DNA Sequence Number=SeqID_82385
  Gene Ontology: Mol. function=chitin binding; Cellular component =extracellular region; Biological process=chitin metabolic process
  Homolog annotation: Hit_ID=UPI000044A8F0; Match level="QueryCoverage =48%, HitCoverage=99%, E-value=4e-27, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTFRGLHALAFRGLHVLAFRGLHVLTFRGLHILAFRGLHVLAFRGLHVLAFKGLHVLAFRGLHALAFRGLHVLTFRGLHVLTFRGLHALAFKGLYVLPFRGLHVLAFRGLHVLAFRGLHVLAFRGLHVLTLRGLHALAFRGLHILAFRGLHVLTFRGLHICAFRELKLLCHPPDLGGGPTVEAQPEREAIMQLLCVPGLDFTQTAIGRRVRIMRTTRTPISPCRSARIVPIRHLVDLEKSSMALRFPTLFTSLCQSYRMPVPQARSCHRDIGIAPARHPVDLEKSNRVLGFPALITGLYQFYRVPVTPSKVIRPPTNRAFIKKYCAPRQA

SEQ ID NO: 199164 - protein, 124 aa, Glycine max
  Coding DNA Sequence Number=SeqID_82386
MVHPYEKSRDRLTERAGLVEILIPMTDVVPDVTTSRFRTCRLYLTIYVSSIFGQDVLDIVSDIVDPAASILHLTFILPCALYSNSSIFGQDVLDIVSDIVDPAASILHLTFYLALCIVQPDLIP

SEQ ID NO: 199165 - protein, 115 aa, Glycine max
  Coding DNA Sequence Number=SeqID_82387
  Gene Ontology: Mol. function=DNA binding; Cellular component =chromatin; Biological process=DNA integration
MAHFIPCEKVDDASHVADLFFMEIVRFHEGQAKVDYVKKLHERVKDQIERKNKSYAKQANKGRKKVVFEPGDWVWVHMRKERFPEQRKSKLQPRGDGPFQVFERINDNASKVELP

SEQ ID NO: 199166 - protein, 72 aa, Glycine max
  Coding DNA Sequence Number=SeqID_82388
MTVKKRLSFELQSVAVGIRSAVGLSAYPPLSTASARLVQRRICFYRWPGHRIPEQTQAYLGKRALEAKKRSS

SEQ ID NO: 199167 - protein, 173 aa, Glycine max
  Coding DNA Sequence Number=SeqID_82389
  Homolog annotation: Hit_ID=Q47522; Match level="QueryCoverage=30%, HitCoverage=64%, E-value=5e-24, Identity=100%"; Hit description=LacZ protein
MDGAVRGLGVHALAEETQVLHLLPDEPTGDANLLAAYHHHLLPIQKFFRHDSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 199168 - protein, 44 aa, Glycine max
  Coding DNA Sequence Number=SeqID_82390
VWRQATAAHGGHRWSWVVEKEILLSELISLSRSPLFALSATIHA

SEQ ID NO: 199169 - protein, 87 aa, Glycine max
  Coding DNA Sequence Number=SeqID_82391
MSANDHAILRDITPSTHKEEPIGAKHHMMLCWHRTSCTMCGEAHEIGQCIPTDDNTQEIHFIGNQQRQGYTQGGFPGFQQGLYNQQG

SEQ ID NO: 199170 - protein, 51 aa, Glycine max
  Coding DNA Sequence Number=SeqID_82392
MFDWLHPVILFGIQRQANVDRNTTAVEFPRKTTGKLDGKPIIERNQQGKFA

SEQ ID NO: 199171 - protein, 123 aa, Glycine max
  Coding DNA Sequence Number=SeqID_82393
  Gene Ontology: Mol. function=sequence-specific DNA binding; Cellular component=nucleus; Biological process=regulation of transcription, DNA-dependent
  Homolog annotation: Hit_ID=Q2TUV5; Match level="QueryCoverage=80%, HitCoverage=39%, E-value=2e-21, Identity=61%"; Hit description=MADS -box protein
  Pfam annotation: Domain name=K-box; Domain location=21-120; Score =113.3; E_value=7.2e-31; Accession=PF01486.8; Description=K-box region
MEKLRHASVKATIERYKKACSDSSGAGSASEANAQFYQQEADKLRAQISSLQNNNRQVESQMMGESLGPLTAKELKNLETKLEKGISRIRSKKNELLFAEIEYMQKRLYLHILSCQQLALDWS

SEQ ID NO: 199172 - protein, 58 aa, Glycine max
  Coding DNA Sequence Number=SeqID_82394
MHMILMLSLKLSKLLRVKIHLDSVMLVSDSTWIPVVQELINKVNGMHLSLTKWRLRWR

SEQ ID NO: 199173 - protein, 169 aa, Glycine max
  Coding DNA Sequence Number=SeqID_82395
PAKPICYIFEGALSELYPAKRLMKSRERARTGDIPSSSTQAPLLQELAHNKPIITMKHFLEQVAWPEAQLPLVRPNEAAPPEPTPVHVDPKPANPQSPVVNPLSSPECEVVPPSPPLIIIFDASSDEVAAPPDSPAGEIADLPTSPVGGISDLSDSSSGEVVALTMSAY

SEQ ID NO: 199174 - protein, 81 aa, Glycine max
  Coding DNA Sequence Number=SeqID_82396
MSSGCLLVDPKGQNLVLFECCFALMLGKLGRIDGDPVLRETRIWATWEYVSSVGGGQQGMVGLCALCGCGKLVVHHRPTAT

SEQ ID NO: 199175 - protein, 85 aa, Glycine max
  Coding DNA Sequence Number=SeqID_82397
MVRTKGLEHTLGRTIGKALRSREASDDDNDVPQRRRPIAYSRAFHSFEQLHVDNVVDMLVELLELSAVEAGAEMIQCHDSYVRLS

SEQ ID NO: 199176 - protein, 92 aa, Glycine max
  Coding DNA Sequence Number=SeqID_82398
MVVILPKENVVIWFCSLHTRPDNYLKGIINSIHVCIQQCFEGLDDTPQSKSKAGARLIVVKYFNDVRPLEPERLKALRIQWAKYYLKVRNET

SEQ ID NO: 199177 - protein, 234 aa, Glycine max
  Coding DNA Sequence Number=SeqID_82399
  Gene Ontology: Cellular component=mitochondrion
  Homolog annotation: Hit_ID=Q8TGM6; Match level="QueryCoverage=51%, HitCoverage=97%, E-value=1e-09, Identity=43%"; Hit description =Protein TAR1
MLSLEPFTEDQGRSAVQTHRGIPPNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFP

SEQ ID NO: 199178 - protein, 138 aa, Glycine max
  Coding DNA Sequence Number=SeqID_82400
MLTTPKRVQMSTLASDCQSNLGSPNDEVRITVRCLRMLPDSRVMIAKGGVVDKSGAFAPTYPQFVMRNSNLHSSCKALRIIVRCLHMLPDSRVMIAKGGVVDKSGAFTPTYPQFVMRNSDLRSSCERCETKIVSTFFH

SEQ ID NO: 199179 - protein, 401 aa, Glycine max
  Coding DNA Sequence Number=SeqID_82401
  Gene Ontology: Mol. function=protein-tyrosine kinase activity; Cellular component=cytoplasm; Biological process=protein amino acid phosphorylation
  Homolog annotation: Hit_ID=Q1ENV7; Match level="QueryCoverage=80%, HitCoverage=71%, E-value=1e-136, Identity=72%"; Hit description =Protein kinase family protein
  Pfam annotation: Domain name=Pkinase; Domain location=98-351; Score =205.8; E_value=1e-58; Accession=PF00069.15; Description=Protein kinase domain
  Pfam annotation: Domain name=Pkinase_Tyr; Domain location=98-351; Score=184.6; E_value=2.4e-52; Accession=PF07714.7; Description =Protein tyrosine kinase
  Pfam module annotation: Pfam domain module=Pkinase::Pkinase_Tyr; Domain location=98-351::98-351
MVDLVLEIVLGFSKIVVVLILSLIPNINRLMLYHVSAERLIINLLSLKQPLADAIFYKKNDVIKLLEKHGAKPLMAPMHVNHAREVPEYEINPKELDFTNSVEITKGTFCSALWRGTKVAVKKLGEDVISDEEKVKAFRDELALFQKIRHPNVVQFLGAVTQSSPMMIVTEYLPKGDLRDFMKRKGALKPSTAVRFALDIARGVGYLHENKPSPIIHRDLEPSNILRDDSGHLKVADFGVSKLLAVKEDKPLTCQDTSCRYVAPEVFRQEEYDTKVDVFSFALILQEMIEGCPPFSAKQDDEVPKVYAAKERPPFQAPAKRYSHGIRELIEECWNENPAKRPTFRQIITKLESIYNTIGHKRHWKEECIQQLIHLPPVKVRAIEMLPKSGGLVEERSFKWK

SEQ ID NO: 199180 - protein, 79 aa, Glycine max
  Coding DNA Sequence Number=SeqID_82402
WPKLCKPEAMQKKDVNEVPGSRWCYWRNAQSQSAPISLVLLAIPAQSTLVPLLAMAVHMCITDGSGDTCLPPVGMTEST

SEQ ID NO: 199181 - protein, 230 aa, Glycine max
  Coding DNA Sequence Number=SeqID_82403
  Gene Ontology: Mol. function=protein binding; Cellular component =integral to membrane; Biological process=protein amino acid phosphorylation
  Homolog annotation: Hit_ID=Q1SL70; Match level="QueryCoverage=66%, HitCoverage=18%, E-value=2e-43, Identity=51%"; Hit description =Leucine-rich repeat; Leucine-rich repeat, cysteine-containing type
  Pfam annotation: Domain name=LRR_1; Domain location=108-130; Score =16.0; E_value=0.13; Accession=PF00560.23; Description=Leucine Rich Repeat
  Pfam annotation: Domain name=LRR_1; Domain location=83-106; Score =0.4; E_value=2.4e+02; Accession=PF00560.23; Description=Leucine Rich Repeat
  Pfam module annotation: Pfam domain module=LRR_1::LRR_1; Domain location=108-130::83-106
MAGTKLSLGYSVIPILVLFVSTLYEVTSLNVSINLCIKEERITLFEIKKDLNDPGNSLSSRIGKDCCNWIGGELNGALTDLKHLSHLDQSDNDFEGIAIPELLGSLNKLRYLDLSRTNFSGMIPAHLENVSNLHYLDISAPSLGIFTWILSQLPAHLMSRHDKKTRTRRYPSESVPTLTGNTRVDRVWVWVRVFPDNQKSGLEIPDTRRVREWDNKLKPVGSGIEYEYDM

SEQ ID NO: 199182 - protein, 1404 aa, Glycine max
  Coding DNA Sequence Number=SeqID_82404
  Homolog annotation: Hit_ID=Q1SL67; Match level="QueryCoverage=39%, HitCoverage=91%, E-value=0.0, Identity=79%"; Hit description=TGF -beta receptor, type I/II extracellular region
  Pfam annotation: Domain name=DUF1264; Domain location=675-809; Score =107.4; E_value=4.3e-29; Accession=PF06884.2; Description=Protein of unknown function (DUF1264)
  Pfam annotation: Domain name=LRR_1; Domain location=1000-1019; Score =12.4; E_value=1.4; Accession=PF00560.23; Description=Leucine Rich Repeat
  Pfam annotation: Domain name=LRR_1; Domain location=1045-1068; Score =3.2; E_value=72; Accession=PF00560.23; Description=Leucine Rich Repeat
  Pfam annotation: Domain name=LRR_1; Domain location=1070-1092; Score =8.7; E_value=6.6; Accession=PF00560.23; Description=Leucine Rich Repeat
  Pfam annotation: Domain name=LRR_1; Domain location=1094-1114; Score =13.2; E_value=0.94; Accession=PF00560.23; Description=Leucine Rich Repeat
  Pfam annotation: Domain name=LRR_1; Domain location=1118-1139; Score =14.7; E_value=0.34; Accession=PF00560.23; Description=Leucine Rich Repeat
  Pfam annotation: Domain name=LRR_1; Domain location=1162-1181; Score =12.1; E_value=1.5; Accession=PF00560.23; Description=Leucine Rich Repeat
  Pfam annotation: Domain name=LRR_1; Domain location=1221-1243; Score =7.7; E_value=10; Accession=PF00560.23; Description=Leucine Rich Repeat
  Pfam annotation: Domain name=LRR_1; Domain location=1245-1267; Score =17.8; E_value=0.039; Accession=PF00560.23; Description=Leucine Rich Repeat
  Pfam annotation: Domain name=LRR_1; Domain location=1269-1293; Score =1.6; E_value=1.4e+02; Accession=PF00560.23; Description=Leucine Rich Repeat
  Pfam annotation: Domain name=LRR_1; Domain location=861-883; Score =19.6; E_value=0.011; Accession=PF00560.23; Description=Leucine Rich Repeat
  Pfam annotation: Domain name=LRR_1; Domain location=885-907; Score =14.2; E_value=0.48; Accession=PF00560.23; Description=Leucine Rich Repeat
  Pfam annotation: Domain name=LRR_1; Domain location=909-931; Score =12.3; E_value=1.4; Accession=PF00560.23; Description=Leucine Rich Repeat
  Pfam annotation: Domain name=LRR_1; Domain location=951-973; Score =1.5; E_value=1.5e+02; Accession=PF00560.23; Description=Leucine Rich Repeat
  Pfam annotation: Domain name=LRR_1; Domain location=975-997; Score =0.7; E_value=2.1e+02; Accession=PF00560.23; Description=Leucine Rich Repeat
  Pfam annotation: Domain name=MFS_1; Domain location=85-576; Score =18.6; E_value=4.5e-05; Accession=PF07690.6; Description=Major Facilitator Superfamily
  Pfam annotation: Domain name=PTR2; Domain location=146-560; Score =338.7; E_value=9.6e-99; Accession=PF00854.12; Description=POT family
  Pfam module annotation: Pfam domain module=DUF1264::LRR_1::LRR_1::LRR_ 1::LRR_1::LRR_1::LRR_1::LRR_1::LRR_1::LRR_1::LRR_1::LRR_1::LRR_1::LRR_ 1::LRR_1::MFS_1::PTR2; Domain location=675-809::1000-1019::1045 -1068::1070-1092:...
  Pfam module annotation: Domain location=:1094-1114::1118-1139::1162 -1181::1221-1243::1245-1267::1269-1293::861-883::885-907::909 -931::951-973::975-997::85-576::146-560
GLPYCHCNFARPAFSFESATNKCSAYIAMEKPEVVDVKEEADFQLVDENKVDWKGRRALKFKYGGMCASVLILVTYAFTNFNLDAAMIGFENLGTFSLAVNSVPYFSGIMHYSIPDAANMLTNYMGTGYILAIPVAVLADTWIGRYRSVLISGVFEFVGLALLTAQAHYPSLKPPLCNIYDITAHCKTPSGGQEALLFIGLYLLAFGTAGVKAALPSHGADQFDEKDPREERRMSTFFNTLLLAICFGGAVSLTFIVWIQINKGWDWGFGIGTIAIFLGIVIFAAGLPLYRFRVGQGTNAFNEIIQVYVAAIRNRNLPLPEDPTELYEIEQDKEAAEEIEFLPHRDTLRFLDRAAIQIKHGVQSEKPSSPWKLCRVTQVENAKIVLGMIPIFCCTIIMTLCLAQLQTFSIQQGYTMDTTFTKHFHIPPASLPIIPVSFLIIIVPIYDFIFVPVMRKITGIPTGVTHLQRIGVGLVLSCISMAVASVIEVKRKRVARDNNMLDAVPILMPPLPISTFWLSFQYFIFGIADMFTYVGLLQFFYSEAPKGLKSTSTCFLWSSMALGYFASTIVVKSVNGATKHITSSGGWKIAKWNLLTSTALVVSELQLLTPSSTKMPTQSLYTEPPMRCLRRRSATLYRTSLIQSNFQQSNNGFNRQDSTCVPSPSIAMTCLARLRHTTTAPDSARTSSSVLSMIPMKSMLVSSYIVPADVFETFPPEEQKLWHSHAYEIKSGLLVNLRVPEVIAMPDLENFAQTYGKFWCTWQVDRALMMSPQAVSPGLVRADLVLERDAKYNISSDGLKSSRLEIPEPEMINPLADYWKQHGKGFGINIEETEMKSPWGNDLTGDIIQMLETLSSCCYQSLEFLDLSSNQLSGKLPHSLGQLSRLSHLDLSSNSLSGLVPATMGNLSNLDTLNLEGNMMNGKIPESIGQLTKLNPFALKVTQDWIPPFKHLYQVEIRDCQVGPTFPNWLRNQMSLENVILENVGISEEILGWLYNMSSHIEQLDLSHNKISRYLPKKMNFSSSNSPKVNFAFNQLKGPIPIWSGVTALYLRYSLLSGTLPANIGEEMSHLKELDLSNDLLNRSIPLSITRIQNLSYLDLSKNHLTGEIPVFGMGMQRLEIIDLSNNSLSEITKNLPLLSELLSRGNTLTGSIPEELCRLPYLHLLDLANNNLSGSIPLCLGDVDGRLIEYLNQMPVHSTIDLSNNYLPGEIPESLTELTHLGVLNLACNRLIGNIPNNVGSLTDLESLDLSHNSLSGPIPASMTSMTFLSFLNLSYDNLSVQIPVANQFGTFNDPSTYEGNPQLCGGQLPTNFSLFFPENGAQEKKHEDGADEDDDKTERLWLYASIAIGYITGFWLVCGSLVLKRSWRHAYFKFVFDMRDNLLVWIAINLAGVKRRFGLERN

SEQ ID NO: 199183 - protein, 102 aa, Glycine max
  Coding DNA Sequence Number=SeqID_82405
  Homolog annotation: Hit_ID=Q1SL66; Match level="QueryCoverage=72%, HitCoverage=13%, E-value=2e-26, Identity=77%"; Hit description =Aldehyde oxidase and xanthine dehydrogenase, a/b hammerhead; Membrane attack complex ...
  Homolog annotation: Hit description=component/perforin/complement C9
MENPTSDSLSATLGNSIQALGRGFDVTSDIRLLYCKGAPGSRLVHLDEDHTKNLPLSHDLVIPNVSVDIDWSPGKREHVQGVHLKHTLHDLDPALVFNNLKL

SEQ ID NO: 199184 - protein, 443 aa, Glycine max
  Coding DNA Sequence Number=SeqID_82406
  Homolog annotation: Hit_ID=Q1SL66; Match level="QueryCoverage=99%, HitCoverage=78%, E-value=0.0, Identity=85%"; Hit description =Aldehyde oxidase and xanthine dehydrogenase, a/b hammerhead; Membrane attack complex ...
  Homolog annotation: Hit description=component/perforin/complement C9
  Pfam annotation: Domain name=MACPF; Domain location=37-206; Score =130.9; E_value=3.5e-36; Accession=PF01823.10; Description =MACPerforin domain
MAKYFNGRSGIAGQIPLGSFNSMFNFTGCWMADAAATKSLAMVGYFIPLVEVKLNKLNLVLTDEVKRAVPYSWDPTSLASFIENYGTHIVTSATVGGRDVVYIRQHQSSSLSASDIENYVKDIGDDRFRDVKNFSGPGPLKYKEKDVTVIFRRRGGDDLEQSHTKWAETVKLAPDIINMNFTPIVSLLEGVPGVKYLARAIDLYLEYKPPIEDLQYFLDFQITRVWAPEQNNLQRKEPVCQSLQFSLMGPKLFVSPDQVTVGRKPVTGLRLSLEGSKQNRLAIHLQHLVSLPKNLQPHWDAHMAIGAPKWHGPEEQDSRWFEPIKWKNFSHVSTAPIEYTETSIGDLSGVHIVTGAQLGVWDFGAKNVLHLKLLFSKVPGCTIRRSVWDHNPSTPAAQRSDGASSSLTKKTSEDKKEDSSIHIGKLAKIVDMTEMSKGPQDIP

SEQ ID NO: 199185 - protein, 601 aa, Glycine max
  Coding DNA Sequence Number=SeqID_82407
  Gene Ontology: Mol. function=ATP binding; Cellular component =chloroplast; Biological process=response to heat
  Homolog annotation: Hit_ID=Q1SL65; Match level="QueryCoverage=99%, HitCoverage=99%, E-value=0.0, Identity=76%"; Hit description=Heat shock protein Hsp70; Actin/actin-like
  Pfam annotation: Domain name=HSP70; Domain location=8-601; Score =1073.9; E_value=0; Accession=PF00012.10; Description=Hsp70 protein
  Pfam annotation: Domain name=MreB_Mbl; Domain location=105-396; Score= -260.1; E_value=0.068; Accession=PF06723.3; Description=MreBMbl protein
  Pfam module annotation: Pfam domain module=HSP70::MreB_Mbl; Domain location=8-601::105-396
MAPRKVKAMGIDLGTTYSCVAVWNHNRVEVIPNDQGNRTTPSYVAFTDTQRLLGDAAINQRSMNPQNTVFDAKRLVGRRFSDQSVQQDIKLWPFKVVPGARDKPMIAVTYKDEEKLLAAEEISSMVLFKMKEVAEAHLGHFVKDAVITVPAYFSNAQRQATKDAGKIAGLNVLRIINEPTAAAIAYGLDKKGWREGEQNVLVFDLGGGTFDVSLVTIDEGMFKVKATVGDTHLGGVDFDNKLVNYLVGIFKRRYKKDIGENPKALGRLRSACEKAKRILSSSSQTTIELDSLCGGADLHAIVTRALFEELNKDLFMKCMETVEKCLKEARIAKSQVHELVLVGGSTRIPKVQQLLKDMFSVNGNKELCKSINPDEAVAYGAAVQAAILSGEGDKKVEELLLLDVMPLSLGIETDAGEMSVLIPKNTMIPTKRESVFSTFSDNQTSVLIKVFEGEHAKTEDNFLLGKFELSGFTPSPRGVPQINVGFDVGVDGIVEVTARDRSTGLKKKITISNKHGRLSPEEMRRMVRDAEKYKAEDEEVSNKVRAKNLLENYAFEMRDRVKNLEKVVEETIEWLDRNQLAETDEFEYKKQELEEKFRKFR

SEQ ID NO: 199186 - protein, 287 aa, Glycine max
  Coding DNA Sequence Number=SeqID_82408
  Gene Ontology: Mol. function=DNA binding; Biological process=DNA integration
  Homolog annotation: Hit_ID=Q1S3I6; Match level="QueryCoverage=58%, HitCoverage=10%, E-value=3e-69, Identity=73%"; Hit description =Integrase, catalytic region
MVISYSDFDTNPSNPYYMHPNENPSLVLVQPVLDNKNYQIWCRSMKVALISKNKVKFVDGTLSPPPISDPLYEPWLRCNNLVLSWLQRSISEEIAKSLLWCDRASLVWKSLENRFSQGDIFHVVDIQEGDIFRVADIQEEVARLQQGTLDISSYFTKLMTLWEEIENFRPIRDCTCAMPCSCGAATDLRKFKEQDKVIKFLKGLGDQYSHVRSCLAVRFGRRIVDQSNVCNVGRGGAVALVVGNDLDAVVLPHSHTAVAGAQVNAYSFDFFCCHWKSLTEKKKRDES

SEQ ID NO: 199187 - protein, 412 aa, Glycine max
  Coding DNA Sequence Number=SeqID_82409
  Gene Ontology: Mol. function=protein binding; Cellular component =protein complex; Biological process=protein catabolic process
  Homolog annotation: Hit_ID=Q9LT08; Match level="QueryCoverage=88%, HitCoverage=100%, E-value=1e-142, Identity=75%"; Hit description=26S proteasome non-ATPase regulatory subunit 14
  Pfam annotation: Domain name=Mov34; Domain location=74-188; Score =163.1; E_value=7.2e-46; Accession=PF01398.11; Description =Mov34MPNPAD-1 family
  Subcellular localization annotation: CTP_CleavageSite=17; ConfidenceScore=5.07e-01
MATTYLVQKRSNVFRLECNKKETFRFNFKFSVKPIQFSPNPKSEVRFAMERLQRMFAGAGGALGHPPPDSPTLDSSEQVYISSLALLKMLKHGRAGVPMEVMGLMLGEFVDEYTVRVVDVFAMPQSGTGVSVEAVDHVFQTNMLDMLKQTGRPEMVVGWYHSHPGFGCWLSGVDINTQQLMPKRYAQFPFDNDDTKSFEALNQRAVAVVVDPIQSVKGKVVIDAFRLINPQTMMLGQEPRQTTSNLGHLNKPSIQPLCICKGKAAYNIPPPYLRIAKSLWAMGYEQRASPGAAALIHGLNRHYYSIAINYRKNELEEKMLLNLHKKKWTDGLTLRHFDTHSKTNEQTVQEMLNLAIKYNKAVQEEDELPPEKLVIANVGRQDAKKHLEEHVSNLMSSNIVQTLGMMLDTVVF

SEQ ID NO: 199188 - protein, 667 aa, Glycine max
  Coding DNA Sequence Number=SeqID_82410
  Gene Ontology: Mol. function=ATP binding; Cellular component =chloroplast; Biological process=response to heat
  Homolog annotation: Hit_ID=Q1SL65; Match level="QueryCoverage=73%, HitCoverage=81%, E-value=1e-180, Identity=66%"; Hit description=Heat shock protein Hsp70; Actin/actin-like
  Pfam annotation: Domain name=HSP70; Domain location=1-503; Score =652.8; E_value=2.8e-193; Accession=PF00012.10; Description=Hsp70 protein
  Pfam annotation: Domain name=MreB_Mbl; Domain location=1-293; Score= -257.7; E_value=0.052; Accession=PF06723.3; Description=MreBMbl protein
  Pfam module annotation: Pfam domain module=HSP70::MreB_Mbl; Domain location=1-503::1-293
MVTVTYKGEEKLLAPEEISSMVLFKMKEVVEAHLGHFVKDAVITVPAYFSNAQRQATKDVGKIAGLNVLRIISEPTAAAIAYGLDRKGLRVGEQNVLVFDLGGGTFDVSLVTIYEGMFKVKASVGDTHLGGVDFDNKLVNHLVNVFREKHKKDISGNAEALVRLRSACEKAKRILSSTAQTTIELDCLYEGVDLYATVTRALFEELNKDLFMKCMETVEKCLLEARSDKIQVHEIVLVGGSTRIPKVQQLLKDMFSLNGTTKELCKGINPDEAVAYGAAVQAAILSGEGDKKVEELLLLDVMPISIGFEGAGGVMSVLIPKNTAIPTKKERVCSIFYDNQKSLTVKVFEGEQVKTKDNFFLGKFILYRFDPLPKGVSQISVIFDVDADGIVEVTAEDQAKGLKKKITINSKHGRLSPEEIRRMVRDSKRYKAEDEVAKKKVKAKNTLENYAYEMRERAKKIEEAVEETIEWLECNQLAEIEEFDCKKQELGRYLRDDPNYSNTSNSGVKVPIWCTWRCPPNGWVCLNTDGSVFENHRNGSTGSACGGLVRDSSGCFLGGFTVNLGITAVTLAELWGVVHGLKLAHDPVAKDLAFALVSEINELVRKEWLVEFSHVFRESNRAADKLAHLGHSHSSESGAKRFSDPPFALLAILQDDLAGVAKQCGVP

SEQ ID NO: 199189 - protein, 489 aa, Glycine max
  Coding DNA Sequence Number=SeqID_82411
  Homolog annotation: Hit_ID=Q9FFD9; Match level="QueryCoverage=47%, HitCoverage=57%, E-value=5e-31, Identity=34%"; Hit description =Genomic DNA, chromosome 5, P1 clone:MQK4
MDPPSSVDQDDDVFLDAFHQCPAEGSTEPSDSASTLLDHKPHSPPTTIRRRPLRRGIPGTQSSDSSIVSDLIDVDSRRSFRHKSRLRNLNKNENSEEKPDSEEPRQVNASPEENNEGSTVTSAANDDAAGDSIDSAPRLGDSSSSLLELAAGLVINLLGFQMKLIFMFITSPFLFMFYSCMFFMDPLGTTRKGKDFVIGILNRMRCFAFSCIRPYVNRWVKENDSFWSVAFRWGWGFMWSIGFVMKCLVEKPIQMREVLNFDYTKLSPVAYVPVMSCAGVVGGRSSENKVDARKWAGERVIPSKHKVQVTVELRVPESGYNRNLGIFQTRVDFLLSNGKAIASSSQPCMLRFRSEPIRLITTFLKIAPLLTGYISETQTLNVKMRGFVEGDVPTSCLKVTLEQRAEYQPGAGIPEIYDASLIIESELPLFKRMIWLWKMSIFIWIAMMAFFAELLFALVCCTPIIIPKTRQRVASGRSPATLNHLQAQH

SEQ ID NO: 199190 - protein, 732 aa, Glycine max
  Coding DNA Sequence Number=SeqID_82412
  Gene Ontology: Mol. function=transferase activity
  Homolog annotation: Hit_ID=Q1RWV8; Match level="QueryCoverage=96%, HitCoverage=98%, E-value=1e-138, Identity=39%"; Hit description=IMP dehydrogenase/GMP reductase
  Pfam annotation: Domain name=Ank; Domain location=128-159; Score=8.2; E_value=2.1; Accession=PF00023.20; Description=Ankyrin repeat
  Pfam annotation: Domain name=Ank; Domain location=426-456; Score =10.7; E_value=0.9; Accession=PF00023.20; Description=Ankyrin repeat
  Pfam annotation: Domain name=Ank; Domain location=497-536; Score=3.0; E_value=12; Accession=PF00023.20; Description=Ankyrin repeat
  Pfam annotation: Domain name=Ank; Domain location=53-93; Score=15.5; E_value=0.18; Accession=PF00023.20; Description=Ankyrin repeat
  Pfam annotation: Domain name=Ank; Domain location=94-126; Score=14.7; E_value=0.24; Accession=PF00023.20; Description=Ankyrin repeat
  Pfam module annotation: Pfam domain module=Ank::Ank::Ank::Ank::Ank; Domain location=128-159::426-456::497-536::53-93::94-126
MANIELDDRVMSEETEETIKRRLFKLCMKGEWGKVVDTYESDKMAHMARITSTGDTALHLAVTDGQNYVVQQLVKVLMCEEGQRKESLMIQNDRGNTALHFAASGGSVEMCECIAYAEPSLLRMRNVDGETPIFLAALHGRKEAFLCLHYRSDYTNQMHFNYDSNCTRNDGDTILHSAIAGDFFDRENVSGFTPLHLLANKPSVFRSGNRLGRFEAMIYYAITVKELEVAPSYQQQCPTTGKEKNSYPKNYQTCMGFLRLIKIFTLFVTKLFTQFLYIKQQQDQIGTERDLEASTKIATNNGAETNSPGSETSDRSSPLFPVNYQSCVDLYKFIFIKIMLTFFATEPTIRNIQEIKEKNVWSGQIMDELLKRASMYECDDKGSKPLQNWGEHQDQTNPYSFNEGDNALDDIIEKQHSYTTQGDDEKMETPVLIAAKNGVTEMVEKILEVYPIAVDDLDAKKKNIVLLAIENRQIYLYESLLRNKSLRESTFRKVDSEGNTALHLAAKLGNYKPWLISGDALQMHCELKWYLFVRDSMPSHFFRYKYNNENKTPRDIFIETHRDLVRAAGEWQKRTSECSSVVAALIATVAFSSSTNVPGGFQEDAGTPILENRPEFKTFAISSIVALCCSVASMVCFLSILTSRYQEHDFGKTLPWKLIFSLTLLYVAITSSIVSFCAGHFYVDQLGSLALPVYAILCLSMAIFALSQFPLYIDLIRATKKVPERDQETFLQ

SEQ ID NO: 199191 - protein, 318 aa, Glycine max
  Coding DNA Sequence Number=SeqID_82413
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=49%, HitCoverage=40%, E-value=7e-43, Identity=54%"; Hit description =Integrase, catalytic region
  Pfam annotation: Domain name=Chromo; Domain location=226-279; Score =22.1; E_value=0.002; Accession=PF00385.14; Description='chromo' (CHRromatin Organisation MOdifier
  Pfam module annotation: Pfam domain module=Chromo::Retrotrans_gag; Domain location=226-279::1-85
MDGPALSWYQWMHWNGLFSSWPAMLQALESRFAPSYYDDPQGTLFKLQQTGSVGDYLTAFERLANRTIGIAPSSLLSCFISGLIPELRRERSSHCAVTRGSVTIVTTNGPPVTAANHDCTFSSQMKTNADKHRRDVQYTVGDWVYLRLRPYRQKSLNPTYSKLAKRYFGPYQVTERIGPVAYKLALPNDSRIHNVFHISLLKAHQGAPPSDIIPLPPLAVDHHPVVTPLTILDWKLDSSVTPPRRLVLVQWMGLPPEDTSWELWDDLQQSYNLEDEVVFGGAGVDSNMQNREPHNSINGNNSRPKMVTRKPTYLNDFE

SEQ ID NO: 199192 - protein, 117 aa, Glycine max
  Coding DNA Sequence Number=SeqID_82414
  Gene Ontology: Mol. function=transporter activity; Cellular component= integral to membrane; Biological process=transport
  Homolog annotation: Hit_ID=Q1SL54; Match level="QueryCoverage=55%, HitCoverage=23%, E-value=2e-27, Identity=86%"; Hit description=Major intrinsic protein
MGYMTVTRQERIRSDMAELLNVDIACVKILSESHECYALIHEDNALIVPITGASMNPARSLGPAILHHEYRGIWMYLASPILGALAGTWVYTFIRYTNKPVREITRSASFLKGREAE

SEQ ID NO: 199193 - protein, 108 aa, Glycine max
  Coding DNA Sequence Number=SeqID_82415
MLRSIHQGQIILLQSLQLVAPPNSIPTVEQFNEWVAWPGTQPPPHRDDEDPAAQVPHQPADESSESSTPEPLIRKRRVVVTQEAAATPEKSPEATPEPSAPMADTTSP

SEQ ID NO: 199194 - protein, 124 aa, Glycine max
  Coding DNA Sequence Number=SeqID_82416
MASVETSTMAKSQILPYNVLGVAKCLTYIFKKVAQTLRWFAKERGSRQDPCVMHMRKAQHGNVHSMTIFTKYKQKGYMTLMHGSVKNGTQRVRSVPLFKGPIWERAKRAFSDNPQGGHISLDGL

SEQ ID NO: 199195 - protein, 74 aa, Glycine max
  Coding DNA Sequence Number=SeqID_82417
MKVQLVRQTLNTFLAWSAHLVKPYPEQDKQVTEGPTKPVAMLNPDIDPLYLMTLTIPQIFLKPLPVSWDASVFW

SEQ ID NO: 199196 - protein, 106 aa, Glycine max
  Coding DNA Sequence Number=SeqID_82418
MLNNQNLICGYEKISSADSPSPIDTLFFVRKAYVDLISWKFYLFTKARSHFSEENTETISSLTSYQELRRSEFLIGGYVGAKASLLSTTPLSVTMTQELVACGDTL

SEQ ID NO: 199197 - protein, 81 aa, Glycine max
  Coding DNA Sequence Number=SeqID_82419
WPKLCKPEAMQKKDVKDVNEVPGSRWCYWRNAQSQSAPISLVLLAIPAQSTLVPLLAMAVHMCITDDSGDTCLPPVGMTES

SEQ ID NO: 199198 - protein, 81 aa, Glycine max
  Coding DNA Sequence Number=SeqID_82420
MGYEGGIQFQDDPMVWVYARKRKGFGRARRENEFGRKREQKMYIEKVVQEVISFNNQPSGRLKNIVIIDLDDRLEETPSLN

SEQ ID NO: 199199 - protein, 228 aa, Glycine max
  Coding DNA Sequence Number=SeqID_82421
MQNAQVVSIGEINNLRQDCYCLTVGTVDEIIIEAPWSYDSCPNCTTTFDPSKGDSACRSCHTSVIDTVPQLAIIIFCTDYLFTRFPVLSNFPEISMDVKAGDDIKVFPTCVDEILFKTWVVRFKFHSQLRQSSVLDVSEELHHIQSLIATLGLKEQSSKGKGIAVEPESSPPIFVPMPSLSQSSDYDPENSSCLTPTKRISCQQTSSDFDSDEHTQYQLSNNKHIKAE

SEQ ID NO: 199200 - protein, 91 aa, Glycine max
  Coding DNA Sequence Number=SeqID_82422
MDRCEKCHYDKFYCSDSNQWLRTCAKPKRGERSQLYPQNPFVSSEMIHGPVFHVNIIAGGHVDEVHKDLRVSSAGEGGVDGYVVDDTNEVQ

SEQ ID NO: 199201 - protein, 216 aa, Glycine max
  Coding DNA Sequence Number=SeqID_82423
  Gene Ontology: Mol. function=hydrolase activity, acting on ester bonds; Cellular component=nucleus; Biological process=lipid metabolic process
  Homolog annotation: Hit_ID=Q1SYS9; Match level="QueryCoverage=97%, HitCoverage=58%, E-value=4e-59, Identity=57%"; Hit description=GDSL -like Lipase/Acylhydrolase
  Pfam annotation: Domain name=Lipase_GDSL; Domain location=37-214; Score=-6.7; E_value=0.0063; Accession=PF00657.12; Description=GDSL -like LipaseAcylhydrolase
MEMEAKTKPWLDLSLLLLAAYCMQQCVHGQSQQTPCMFIFGGYLSDNGNNNNLRTYSKSNYRPYGIDFPAGTTGRFTNGLTQADIIAELLGFTERIPPNANTSGSDILKGANYASGSAGIRPETGTHLGANINLERQIMNHRMNIYYQIAPRLGSLEKAGQHLNKCLYYVHIGNSDYINNYFLPLYYRTSRVYDLEGYANDLIRRYSRYIQKILKK

SEQ ID NO: 199202 - protein, 146 aa, Glycine max
  Coding DNA Sequence Number=SeqID_82424
  Gene Ontology: Mol. function=hydrolase activity, acting on ester bonds; Biological process=lipid metabolic process
  Homolog annotation: Hit_ID=Q1SYS9; Match level="QueryCoverage=93%, HitCoverage=37%, E-value=1e-26, Identity=46%"; Hit description=GDSL -like Lipase/Acylhydrolase
MGRIGCSPYAITTYKTNGSCYEVMNNAAGIFNGKLRSLVDQYNNRAPDSKFIFVNNTARNLGIVNTGGFTVTNASCCPIGLNVLCVQNSTACQNRAQHVFWDGLSTTEAFNRFVATLAYNGSNPAFTYPGNIKSLVQSNYNTSLNN

SEQ ID NO: 199203 - protein, 248 aa, Glycine max
  Coding DNA Sequence Number=SeqID_82425
  Gene Ontology: Mol. function=hydrolase activity, acting on ester bonds; Cellular component=nucleus; Biological process=lipid metabolic process
  Homolog annotation: Hit_ID=Q1SYS9; Match level="QueryCoverage=99%, HitCoverage=64%, E-value=8e-78, Identity=58%"; Hit description=GDSL -like Lipase/Acylhydrolase
  Pfam annotation: Domain name=Lipase_GDSL; Domain location=34-248; Score=49.1; E_value=1.4e-11; Accession=PF00657.12; Description=GDSL -like LipaseAcylhydrolase
MACETKSWLVMFLVFLVANCMQHCVHGVSQVPCLFIFGDSMSDSGNNNELPTTSKSNFRPYGIDFPLGPTGRYTNGRTEIDIITQFLGFEKFIPPFANTSGSDILKGVNYASGGSGIRNETGWHYSACVTILMHATKLTQMQGAAIGLGLQLANHRVIVSEIATKLGSPDLARQYLEKCLYYVNIGSNDYMGNYFLPPFYPTSTIYTIEEFTQVLIEELSLNLQALHDIGARKYALAGLGLIGCTPGM

SEQ ID NO: 199204 - protein, 82 aa, Glycine max
  Coding DNA Sequence Number=SeqID_82426
MATSMKLRQFVLLLIVLTLLVVSSEAIQVPEFSTLSKKINRKLGLRELINNVRNGGEWHQKRSMLGGRLERVSPAGPDSQHH

SEQ ID NO: 199205 - protein, 51 aa, Glycine max
  Coding DNA Sequence Number=SeqID_82427
  Gene Ontology: Mol. function=structural constituent of ribosome; Cellular component=intracellular; Biological process=translation
  Homolog annotation: Hit_ID=Q1STG0; Match level="QueryCoverage=67%, HitCoverage=28%, E-value=5e-13, Identity=97%"; Hit description =Ribosomal L22e protein
  Pfam annotation: Domain name=Ribosomal_L22e; Domain location=3-51; Score=-2.3; E_value=4.6e-05; Accession=PF01776.7; Description =Ribosomal L22e protein family
MYIRYLKYLTKKYLKKHNVRDWLRVIASNKERNVYELRYFNIAENEGEEED

SEQ ID NO: 199206 - protein, 156 aa, Glycine max
  Coding DNA Sequence Number=SeqID_82428
  Gene Ontology: Mol. function=ribonuclease H activity; Biological process=DNA integration
  Subcellular localization annotation: CTP_CleavageSite=12; ConfidenceScore=5.06e-01
MFSANKSWWRLRAFSSFGRRTREPRLARPQKGRLRQEVLSLRILAESKLKDSKWAQACFDQLNLIEGKRLAAMSHGRLYQRRVKNHFDKKVHRCKFNEGDLVLKKVFHALKDNMGKWAPNYEGPFIMKKAFSERALVLAIMDYEELPSPVNADIVK

SEQ ID NO: 199207 - protein, 86 aa, Glycine max
  Coding DNA Sequence Number=SeqID_82429
MEYESIQSVIVGSEIPRWFNIQHVDSLMSIDTSPVMHDNNWIGVVCGAIFLLVLDELDHMWLFYFTRRKFIEGYNLKGIPYLGSQK

SEQ ID NO: 199208 - protein, 484 aa, Glycine max
  Coding DNA Sequence Number=SeqID_82430
  Gene Ontology: Mol. function=transmembrane receptor activity; Cellular component=membrane; Biological process=defense response
  Homolog annotation: Hit_ID=Q1SGR7; Match level="QueryCoverage=76%, HitCoverage=44%, E-value=8e-53, Identity=50%"; Hit description=TIR; Disease resistance protein; AAA ATPase
  Pfam annotation: Domain name=LRR_1; Domain location=405-427; Score =6.9; E_value=15; Accession=PF00560.23; Description=Leucine Rich Repeat
  Pfam annotation: Domain name=LRR_1; Domain location=428-450; Score =14.8; E_value=0.31; Accession=PF00560.23; Description=Leucine Rich Repeat
  Pfam annotation: Domain name=LRR_3; Domain location=382-401; Score =23.2; E_value=0.00091; Accession=PF07725.3; Description=Leucine Rich Repeat
  Pfam annotation: Domain name=NB-ARC; Domain location=77-313; Score= -118.1; E_value=0.0093; Accession=PF00931.13; Description=NB-ARC domain
  Pfam annotation: Domain name=TIR; Domain location=6-142; Score=178.7; E_value=1.5e-50; Accession=PF01582.10; Description=TIR domain
  Pfam module annotation: Pfam domain module=LRR_1::LRR_1::LRR_3::NB -ARC::TIR; Domain location=405-427::428-450::382-401::77-313::6-142
MRTYDVFVSFRSEDTRNNFTGFLFQALSRKGIDAFKDDKDLKKGESIAPELLQAIEGSCLFVVVFSKNYASSTWCLRELAEICNCIETSQRRVLPIFYDVDPSEVRKQSGYFEKAFAEHEKRFKEDKKKMQEVQGWREALKQVTSDQSLWPQCAEIEEIVEKIKYILGQNFSSLPNDDLVGMKSRVEELAQLLCLGDQHILRAHGVEEVYQVQPLNEDVVRLFCRNAFKRHPLAIEVLSSSLFCRNVLQWRTALAKFKNNKSKDITNVLRISFDELEDIEKDIFLDIVCFFPICGEQYAKKILDFRGFHHEYGLQILVDISLICMKKGIIHMHSLLSNLGRCIVREKSPKEPRKWSRLWDYKDFHNVMSNNMCLPPSFEANKLVELILYASNIKQLWKGRKCLHNLIYLILSHSKNLIEIHDLIEALNLERLDLQGCIQLKKIHPSIGLLRKVIDAIFPRKGPVTRAMSKRIGLELLKKALGFS

SEQ ID NO: 199209 - protein, 66 aa, Glycine max
  Coding DNA Sequence Number=SeqID_82431
  Gene Ontology: Mol. function=oxidoreductase activity
  Homolog annotation: Hit_ID=Q9AYU0; Match level="QueryCoverage=98%, HitCoverage=32%, E-value=1e-09, Identity=44%"; Hit description =Quinone-oxidoreductase QR2
MIFVPFGIRFAYSNEFGNVKEVKGGSPYGAGTYAETEGPTSIESMHAFDHGYYFANITKQLKEATA

SEQ ID NO: 199210 - protein, 328 aa, Glycine max
  Coding DNA Sequence Number=SeqID_82432
  Gene Ontology: Mol. function=nucleic acid binding; Cellular component= intracellular; Biological process=DNA integration
LDAFKVFKAEVEKQCEKQIKIMRSERGGEFYGKYTMSGLLNQNGVVERRNRTLMDMVRSMLSNSKLPHSLWNEALKTVAYILNRVPTKAVPKTSFELLKAEVTIYNPNEKKLDPRTISAYFIGYVERSKGYRFYCPTHSTRIVESRNVKFQENDVASGSDLTQGIGLEKNQYEGAVPTSSYKLVVFYNTHQNCVTQAPHQVDPILEDPIEQHQTKNVEQHQTQDVEQPIEQQPEESQYDFGVENDPELFLQAIKNFNSKLWYDAMKDELESMTNNKVWDLIELPKGIKPIGCKWVFKTKKDSLGNVERHKDSLKEKEFTTEKPFLAYP

SEQ ID NO: 199211 - protein, 189 aa, Glycine max
  Coding DNA Sequence Number=SeqID_82433
  Gene Ontology: Mol. function=nucleic acid binding; Cellular component= intracellular; Biological process=DNA integration
MDFLNGDLEEEVYMTQPEGFSSSDGAHFVCKLKNSIYGLKQASRQWYLKFHSVISSFGFVENNMDRCIYHKDYINEVLEIFWMKDCSPDMAPIVKGNRFNSNQCPKNELEREQMRNIPYAYVVGSLMYVQVCTRPDIAFVVGMLRRYQSNPEIKHWTIAKRVLRYLQGTKDYKLIYKKSDNLEVVGYSD

SEQ ID NO: 199212 - protein, 119 aa, Glycine max
  Coding DNA Sequence Number=SeqID_82434
MERVMAGGVVDLDYALRRNEPAELIDSSTSKEIVLYELRERSNHLSIFFMKTHIYASIHGSIPKCQKVKDFMKAIDEQFESFEKVLSSTLMSKLSSMRLIGVVGVRNTHYGNEGSSSST

SEQ ID NO: 199213 - protein, 62 aa, Glycine max
  Coding DNA Sequence Number=SeqID_82435
MEAIGSVDDLLDFSLDIGEKDDDDDKPRKACPSLNSKCGDPSLFNPLVQVDPNHSFSECLSP

SEQ ID NO: 199214 - protein, 1484 aa, Glycine max
  Coding DNA Sequence Number=SeqID_82436
  Gene Ontology: Mol. function=protein serine/threonine kinase activity; Biological process=protein amino acid phosphorylation
  Homolog annotation: Hit_ID=Q5ZDE5; Match level="QueryCoverage=99%, HitCoverage=93%, E-value=0.0, Identity=46%"; Hit description=BWF1 -like protein
  Pfam annotation: Domain name=Beach; Domain location=347-579; Score =17.5; E_value=2.6e-18; Accession=PF02138.8; Description=BeigeBEACH domain
  Pfam annotation: Domain name=Pkinase; Domain location=176-791; Score=- 85.9; E_value=0.0019; Accession=PF00069.15; Description=Protein kinase domain
  Pfam annotation: Domain name=WD40; Domain location=1218-1253; Score =2.0; E_value=21; Accession=PF00400.22; Description=WD domain, G-beta repeat
  Pfam annotation: Domain name=WD40; Domain location=1264-1300; Score =21.2; E_value=0.0036; Accession=PF00400.22; Description=WD domain, G- beta repeat
  Pfam annotation: Domain name=WD40; Domain location=1445-1482; Score =31.0; E_value=4.3e-06; Accession=PF00400.22; Description=WD domain, G-beta repeat
  Pfam module annotation: Pfam domain module=Beach::Pkinase::WD40::WD40: :WD40; Domain location=347-579::176-791::1218-1253::1264-1300::1445 -1482
MEEEEEIECFECLQLRIKSDFSEQVFFNYAISTSAFPFGSSAIISGTADGEASGAQFILQYMPSRDKNCFINYVNEYILDSGEITTRSSDPGIGSSEDNNAVNVRITSSDDSDSGKAFSGSTSCSHSERFSCLRTITSLAPVARVGISSYSTFQEVSTDFLSGLIEDHVLESLDLFIEGKASGRDSVNFLSLIGLPSFEEDPFPGSLRHPNIAPVLAIFKTSDHVNVVLPKNPYNLESILHFNPDALKSNWNRIFLMYQLLSALSYIHGLGVSHGNICPSNIMLTDSLWSWLRLWNEPVLESNLTLQESERVNSEPARIGCCNVGCRSYGLYADLRLSPTIDWQSCFHKWWRGELSNFEYLLILNRLAGRRWGDHTFHPVMPWVIDFSSKPDDNCDTGWRDLSKSKWRLAKGDEQLDFTYSTSEIPHHVSDECLSELAVCSYKARRLPLSVLRVAVRSVYEPNEYPSTMQRLYQWTPDECIPEFYCDAQIFKSIHDGMADLAVPSWAESHEDFIKLHRDALESNRVSFQLHHWIDITFGYKISGQAAIAAKNVMLPISEPMMPRSTGRRQLFTQPHPIRHATTSTKRHGSNKYAKVWSQANATHRETSLLSETAYLQELEQASTFSEHARHLNAFYHYPLNQTRGKNISSSGDPTTETFSESISKLSLIDRNYQVPYKMNLISFLQHMKEEDKGSSGYPDLLLWKQKLSSSRLCSEDIARDIFSVGCLLAELHLCRPLFDPISLAIYLEDGTLPGYLQDLPPDIRLLVEACIQKDWMRRPSAKILLESPYFPNTVKSSYLFLAPLQLVAKDETRLRYAANLAKHGALREMGTFATEMCTTYCLPLIVTAVSDTEAEWAYMLLKEFMKCLTVQAVSLLQDSFVREIWNRVGKQAYLETIHPLVLSNLYISPDKSSAASASVLLISSSEELGVPITIHQTILPLVHCFGKGLCSDGIDVLVRIGGIFGELFIVKQMVPLLKNVVRSFIDVSCMNKPDPVQSWSALALIDCMLTLDGLVAFLTEEVIVKELLEDLSCIHIGVLMQKHMEIAVLQVAASTLFGICQRIGADLTALHILPKLKELFDELAFSQEISKGSTTVGRNLKWEYAGESSKNGSEIVLARRPVIAHGFTSEYNPAKLLLNGVGWSIPQSQGRSAKNLIPQRQPFKVHQSPVAVHEEMSYQMNHEPWFWFPSPATIWDGPEFLGRVGVQKDDLPWKIRATVIYSIRAHHGAVRSLAVNQDECTVFTAGIGQGYKGTVQKWELSRTNCLSGYHGHEEVVNDICILSSSGRVASCDGTIHIWNSQTGKQILVFAESQTESGHPTSHPSSSSKINSDQANVLNLNTLSSGILSSAFDSSLYTCMHLLNSAETLVVGTGNGSLRFFDVARGQKLHIWRGESTESSFPSLISAICSTGSDKMQAGGISTFPSFIAAGLSSGHCKLFDAKSGNVISSWRAHDGYVTKLAAPEEHLLVSSSLDRTLRVWDLR

SEQ ID NO: 199215 - protein, 187 aa, Glycine max
  Coding DNA Sequence Number=SeqID_82437
  Gene Ontology: Mol. function=ATP-dependent helicase activity; Cellular component=integral to membrane; Biological process=transport
  Homolog annotation: Hit_ID=Q9LIL4; Match level="QueryCoverage=75%, HitCoverage=66%, E-value=9e-68, Identity=86%"; Hit description =Coated vesicle membrane protein-like
  Pfam annotation: Domain name=EMP24_GP25L; Domain location=41-95; Score=43.4; E_value=7.8e-10; Accession=PF01105.14; Description =emp24gp25Lp24 family
MAESGDMGGLKDMMHFTNGWHLFNVQVLYIFVYCGVHLGTLSPLEVTSAAGNTVHNIKGTSGDKFSFKAPTHGMYKFCFHNPYSTPETVSFYIHVGHIPSEHDLAKDEHLDPINVKIAELREALESVTAEQKYLKARDARHRHTNESTRKRVVFYTVGEYLLLAAVSALQVIYIRRLFSKSVAYNRV

SEQ ID NO: 199216 - protein, 56 aa, Glycine max
  Coding DNA Sequence Number=SeqID_82438
MMKIARLFPGLGKDRRGHGFKHLDLQQCEKFKEFGAPEFHHDCAKELEIHSEFKVC

SEQ ID NO: 199217 - protein, 315 aa, Glycine max
  Coding DNA Sequence Number=SeqID_82439
  Gene Ontology: Mol. function=nucleoside-triphosphatase activity; Cellular component=nucleus; Biological process=meiotic recombination
  Homolog annotation: Hit_ID=Q96449; Match level="QueryCoverage=94%, HitCoverage=86%, E-value=1e-166, Identity=99%"; Hit description =Meiotic recombination protein DMC1 homolog
  Pfam annotation: Domain name=HHH; Domain location=35-64; Score=16.0; E_value=0.027; Accession=PF00633.13; Description=Helix-hairpin-helix motif
  Pfam annotation: Domain name=Rad51; Domain location=65-313; Score =581.4; E_value=8.5e-172; Accession=PF08423.2; Description=Rad51
  Pfam annotation: Domain name=RecA; Domain location=60-314; Score= -159.9; E_value=0.025; Accession=PF00154.11; Description=recA bacterial DNA recombination protein
  Pfam module annotation: Pfam domain module=HHH::Rad51::RecA; Domain location=35-64::65-313::60-314
NTFCLRFTTICIYAVIAQGINAGDVKKLQDAGIYTCNGLMMHTKKNLTGIKGLSEAKVDKICEAAEKLVNFGYITGSDALLKRKSVIRITTGSQALDELLGGGVETSAITEAFGEFRSGKTQLAHTLCVSTQLPTNMRGGNGKVAYIDTEGTFRPDRIVPIAERFGMDPGAVLDNIIYARAYTYEHQYNLLLGLAAKMSEEPFRLLIVDSVIALFRVDFSGRGELADRQQKLAQMLSRLIKIAEEFNVAVYMTNQVISDPGGGVFVTDPKKPAGGHVLAHAATVRLMFRKGKGEQRICKVFDAPNLPEAEAISFT

SEQ ID NO: 199218 - protein, 212 aa, Glycine max
  Coding DNA Sequence Number=SeqID_82440
  Gene Ontology: Mol. function=sodium:dicarboxylate symporter activity; Cellular component=integral to membrane; Biological process =dicarboxylic acid transport
  Homolog annotation: Hit_ID=Q13S12; Match level="QueryCoverage=95%, HitCoverage=85%, E-value=4e-40, Identity=41%"; Hit description =Putative membrane protein
MVSNFGPKVAMPVMAIAAILGNLSRIAVWWREIDWRATLAYSLPGVPAASLGAHVLLSLPAWITDGALGLFFWVMILVRRNLKNSHWTLSIKQLGLCGGVVGFLTGLVLSTGPVSVLIFTAYGLSRGAFIGTEASSALLLYFSKVSTFAFQHALSMQIVLTGVLVGSGIMLGTLSTKVIVQRLSVTQFAVLIDAILFISGAGLIVNAWSGAP

SEQ ID NO: 199219 - protein, 297 aa, Glycine max
  Coding DNA Sequence Number=SeqID_82441
  Gene Ontology: Mol. function=transcription factor activity; Biological process=regulation of transcription, DNA-dependent
  Homolog annotation: Hit_ID=Q0K2Z5; Match level="QueryCoverage=96%, HitCoverage=96%, E-value=1e-59, Identity=45%"; Hit description =Transcriptional regulator of phosphonate operon,LysR-family
  Pfam annotation: Domain name=HTH_1; Domain location=9-68; Score=59.1; E_value=1.4e-14; Accession=PF00126.17; Description=Bacterial regulatory helix-turn-helix protein, lysR family
  Pfam annotation: Domain name=LysR_substrate; Domain location=90-296; Score=119.6; E_value=8.8e-33; Accession=PF03466.10; Description=LysR substrate binding domain
  Pfam module annotation: Pfam domain module=HTH_1::LysR_substrate; Domain location=9-68::90-296
MKKRNLPPLNALRLFETAAHANSLSDAAEELGMTHGAVSRQIKLLEEWLGQPLFERQGQRSVAAEHARAFAAEISTAFDIISDAAVRFGKTPNTRTIRVNAQTTFAMHWLIPRLPAFHRQYPDIEISVSTSNSSEVKGLSGFDVLIRRDALNKPEWRYFEKKALFEEKLTLIAAPKLLATKALDTPADLATHVVVLSSTRSGEWERWMKQAGVGEVRPERFQRFEHNYISLQAIIDGVGVGIGGIQMLGHDLQGNRLVTPLAVEAKGSRYVALIAPDVDKSSSLNRFVAWLEREACG

SEQ ID NO: 199220 - protein, 488 aa, Glycine max
  Coding DNA Sequence Number=SeqID_82442
  Gene Ontology: Mol. function=transporter activity; Cellular component= integral to membrane; Biological process=transport
  Homolog annotation: Hit_ID=Q13YN1; Match level="QueryCoverage=94%, HitCoverage=89%, E-value=1e-134, Identity=54%"; Hit description =Major facilitator superfamily (MFS) transporter
  Pfam annotation: Domain name=DUF554; Domain location=80-242; Score= -142.2; E_value=0.063; Accession=PF04474.3; Description=Protein of unknown function (DUF554)
  Pfam annotation: Domain name=MFS_1; Domain location=51-449; Score =112.2; E_value=1.5e-30; Accession=PF07690.6; Description=Major Facilitator Superfamily
  Pfam annotation: Domain name=Sugar_tr; Domain location=46-484; Score =33.6; E_value=6.3e-08; Accession=PF00083.14; Description=Sugar (and other) transporter
  Pfam module annotation: Pfam domain module=DUF554::MFS_1::Sugar_tr; Domain location=80-242::51-449::46-484
  Subcellular localization annotation: CTP_CleavageSite=25; ConfidenceScore=5.06e-01
MSDLTSSAHVALAGNTPQGETQWIRSAADVTRLVNNSNASRSNARIVIAIALGGVFLDAYDLGALAFGIKDVTREFNLTPAGTGMVASAITFGAIVGALIGGYLTDKIGRYRVFMADMFFFVVAALACAFAPNEYVLAAARFVMGLGVGIDLPVAMAFLAEFSRLRGQGNKAASVAMWCPTWYAAISISYLLVLLLYAVLPESHTDWLWRLILGFGAVPALLIIAIRSRYMSESPIWAANQGNLQGAAAILRRSYNINAEVAQDADLTAAQPVRKASWRNYGALLQGVYRRRTLLATITSIASSFAYNAVAFGLPVIISSFLAQSMLTTILVSLALNLLFAFVGGLLAVRLVPRLGAWKMSVAGYACQCAALLGLALVGRPAGGEEAALAIAMLALFLFGQGFGPGSHTMTFASLSYPASLRGVGVGFNQTLMRASSTVSLFVFPLLVAAFGTGVFWVILLAPLAGLLALLAIRWEPSGYDVDAEDFQ

SEQ ID NO: 199221 - protein, 364 aa, Glycine max
  Coding DNA Sequence Number=SeqID_82443
  Gene Ontology: Mol. function=signal transducer activity; Cellular component=membrane; Biological process=signal transduction
  Homolog annotation: Hit_ID=Q6D3F5; Match level="QueryCoverage=46%, HitCoverage=93%, E-value=4e-56, Identity=61%"; Hit description =Isopentenyl-diphosphate Delta-isomerase
  Pfam annotation: Domain name=MCPsignal; Domain location=1-155; Score =152.8; E_value=9.2e-43; Accession=PF00015.11; Description=Methyl -accepting chemotaxis protein (MCP) signaling domain
  Pfam annotation: Domain name=NUDIX; Domain location=217-349; Score =73.2; E_value=8e-19; Accession=PF00293.18; Description=NUDIX domain
  Pfam module annotation: Pfam domain module=MCPsignal::NUDIX; Domain location=1-155::217-349
IISVIDSIAFQTNILALNAAVEAARAGEQGRGFAVVASEVRNLAQRSANSAREIKKLIEESVANIDTGSQLVEQAGQTMDELMQGVSSVTTLMSEIMSASREQSMGIEQVNVAITQLDGSTQQNAALVEQVSAAARAMEEQSVQLEQVVHGFKLLLLIAPAHGMCAIFSAAASAIVYNSGDFSEGVVMPAIEVILVDHLDRPTGKMEKLEVHEKGLLHRAVTVYVFNSRHELLLQRRAQSKYHCGGLWSNTCCSHPYPQEPTRDAAERRLREEMGLDLALTPVFELSYNLPLSNGLIEHEYGHVFFAISDEVPVLNLDEADDWCYRSVEQIQQEMRDNPAKFTPWFLHTFPRIPNTLGDFRLTA

SEQ ID NO: 199222 - protein, 241 aa, Glycine max
  Coding DNA Sequence Number=SeqID_82444
  Gene Ontology: Mol. function=transporter activity; Cellular component= integral to membrane; Biological process=transport
  Homolog annotation: Hit_ID=Q5PE80; Match level="QueryCoverage=79%, HitCoverage=86%, E-value=6e-59, Identity=60%"; Hit description =Putative permease transmembrane component
APLVCALVSAAGASAVPAGEFLAAGAGPSVAGDQRQRAGDSGGRWLCGLRYPSRRQGVPPAAGDAGGCRSDLSAGGGAGDCRAGHGLWRCAGGDGAVSIWAVADSAGHAGGTGQRSGQQPAGAGGTGDYGRRAHLCDDQHRHRDHRLNRRGGESGFAGDYRSERLQYRLCDSGRAAGGAAGADLRPAAGAVAARTQWPTSIMPPMPPIAMMANRVPMRILFQFIGKPEKSHEVRHDNAHMR

SEQ ID NO: 199223 - protein, 187 aa, Glycine max
  Coding DNA Sequence Number=SeqID_82445
  Gene Ontology: Mol. function=sequence-specific DNA binding; Biological process=regulation of transcription, DNA-dependent
  Homolog annotation: Hit_ID=Q9L230; Match level="QueryCoverage=88%, HitCoverage=86%, E-value=3e-41, Identity=53%"; Hit description =Putative DNA-binding protein
  Pfam annotation: Domain name=Cupin_2; Domain location=112-184; Score =5.3; E_value=0.078; Accession=PF07883.2; Description=Cupin domain
  Pfam annotation: Domain name=HTH_3; Domain location=14-68; Score =60.0; E_value=7.6e-15; Accession=PF01381.12; Description=Helix-turn -helix
  Pfam annotation: Domain name=HTH_AraC; Domain location=10-54; Score =16.9; E_value=0.029; Accession=PF00165.13; Description=Bacterial regulatory helix-turn-helix proteins, araC family
  Pfam module annotation: Pfam domain module=Cupin_2::HTH_3::HTH_AraC; Domain location=112-184::14-68::10-54
MSALNTEDRLAARLAELRLQRGWSLDELALATGISRASLSRIERAETSPTAALLNRLCVAYGLTMSRLLSEVEEEAALLLKAEQQPVWQDTLSGFQRRNVSPPASQFKAELVEGVLRPGARIDYDAPPVQGLEQHIWLQSGELTITMETQSWTLQAGDCLRFHLSGRSSFQAHAEGGARYILVVCKP

SEQ ID NO: 199224 - protein, 262 aa, Glycine max
  Coding DNA Sequence Number=SeqID_82446
  Gene Ontology: Mol. function=transcription factor activity; Biological process=regulation of transcription, DNA-dependent
  Homolog annotation: Hit_ID=Q3KCB3; Match level="QueryCoverage=99%, HitCoverage=81%, E-value=5e-71, Identity=50%"; Hit description =Transcriptional Regulator, LysR family
  Pfam annotation: Domain name=HTH_1; Domain location=28-87; Score =47.1; E_value=5.9e-11; Accession=PF00126.17; Description=Bacterial regulatory helix-turn-helix protein, lysR family
MESKVSQSGNNANNRGDNAVLALSNIDLKLLRVFKCVVEAGGLTAASHELNIGLAAISKQVSDLEIRLGMTLCSRGREGFELTQYGINVYQATLELFVSLNLFRERLHNSRNELLGDIAICVVDNTISDPHSPVTSAVQQLHQKAPKVQIRLQTAQLDDIERGISEGRFHCGIAPVYEMKNEFDYFELYKEYAKLYCAASHPLYCGSCDKNISVDVLRQQKIINHLYVTPRDERRLIPVQESGVQAVQVESVAMLILTGHFI

SEQ ID NO: 199225 - protein, 303 aa, Glycine max
  Coding DNA Sequence Number=SeqID_82447
  Gene Ontology: Mol. function=argininosuccinate lyase activity; Cellular component=cytosol; Biological process=arginine biosynthetic process via ornithine
  Homolog annotation: Hit_ID=Q3KCB2; Match level="QueryCoverage=100%, HitCoverage=63%, E-value=5e-96, Identity=57%"; Hit description =Argininosuccinate lyase 1
  Pfam annotation: Domain name=Lyase_1; Domain location=11-303; Score =179.1; E_value=1.1e-50; Accession=PF00206.10; Description=Lyase
MSENAELLWGARFKAAPAASLTALSRSPDYYFALAPYDLAGCRAHARELARAGLLSADELDTMLAAIDALDADYRAGQLQPIAADEDVHTFIERALTERLGALGGKLRAGRSRNDQTVNDLRLYLRDNGRKLVSALLQLQQALVTQAAQHTDSVAPGFTHLQQAQPIVFGHQLLAHAQSFARDIERMQDWDRRSARCPLGAAAMAGSAIARQPQLAAADLAYLAPCENSIDAVASRDYAAEFLFVTSMIGINLSRLCEEVCLWASRQFRWVELHDSYATGSSIMPQKKNPDIADLTRGRSGRL

SEQ ID NO: 199226 - protein, 1005 aa, Glycine max
  Coding DNA Sequence Number=SeqID_82448
  Gene Ontology: Mol. function=hydrolase activity, acting on carbon -nitrogen (but not peptide) bonds; Biological process=carbohydrate metabolic process
  Homolog annotation: Hit_ID=Q3KCA6; Match level="QueryCoverage=44%, HitCoverage=99%, E-value=1e-124, Identity=52%"; Hit description =MmgE/PrpD
  Pfam annotation: Domain name=MmgE_PrpD; Domain location=554-998; Score=221.3; E_value=2.2e-63; Accession=PF03972.4; Description =MmgEPrpD family
  Pfam annotation: Domain name=Polysacc_deac_1; Domain location=295 -442; Score=51.8; E_value=2.2e-12; Accession=PF01522.11; Description =Polysaccharide deacetylase
  Pfam annotation: Domain name=Polysacc_deac_1; Domain location=31-178; Score=86.1; E_value=1.1e-22; Accession=PF01522.11; Description =Polysaccharide deacetylase
  Pfam module annotation: Pfam domain module=MmgE_PrpD::Polysacc_deac _1::Polysacc_deac_1; Domain location=554-998::295-442::31-178
MGPERQRHCRSYGESGLRSGRMQQPGAVRWPQGKRGCMALAFDLDGPTGDAMLNGSLWSTPEYFTFGAYGPFRALGRLLDLLRAFQLPATFFVPAWVVEQWPRQCQAIIEQGHEVAYHGYRHESFWAITPDEQRAVMARSAAIFQQHLGIRACGFRTPSGDWHAETPQILREAGVIYSSSMRGDDRPYSIAVAGHTPLVEIPGKWEMDDYASLAYTRQPDFPQGGDRIASYAHTGDNWQREFDGAMAEGLCLTTLFHPKISGQPGRLLLLEQLFAHMTARDDVWSSNMTEHSRWPSGKQSAAIITIDYHDIHGILTQAPVVAGRDKTLSVWRYGTLRGVDRLLDLLAEKQLLASWCLPAIVAEEQPQVLQRIVAAGHEIACSGERHEDFSALTLAQQIASVTRGCERLAQLTGQPIAGFRTPAGQWKPGLAAALATHGIRWSSSWRGDDLPYFHPGTRLVELPMHYTLEDAPYFAFNLSPAIPPGQSRIAPYGETLANLTQDFHGFHRFGLCYLLRLHPEIIGTAGRIGLLRQLLETLQQHEVWIATAGQVNMNTTLDRLADFIATTRFAQLPEPLVAQAKRHLLDTLGAALAGCDSPIWRECRALVAEEGGSAVAQLWGCAQQASPRQAAWLNGVAAHMYELDDTGGCDHSGAVVLPALLAALPLATQPVDGREFLTAMVVGYDIGRRVLEACGGYAAHNGAGWHSTASCGVFGAAAAVSCLLRLPAAQCASALGIAASFSGGLWGFIHDGSHTIKLHAARAAEGGVQAALLAQRGISGPAAVFEARWGGFLQTLAGETQQPAALTAQLGEVWKLARCSIKPYAACRGTHAAIDALGLLLEQHAVATGDIARIVVGLNPFLLEMCGTRELTSLAAAQMSLPYALTARALFGSAELASYDDSRRLSAEAAALMARIELEIDHQQGRDDEPWVRLETVQGQQWQQHVAVPSGSPANPLSDAALHAKYRSLAARVLPAAQVQQLETLCLTLDNVADVRQVAALLATR

SEQ ID NO: 199227 - protein, 214 aa, Glycine max
  Coding DNA Sequence Number=SeqID_82449
  Gene Ontology: Mol. function=oxidoreductase activity; Biological process=metabolic process
  Homolog annotation: Hit_ID=Q2RL94; Match level="QueryCoverage=97%, HitCoverage=58%, E-value=5e-21, Identity=34%"; Hit description=Iron -containing alcohol dehydrogenase
APAAVIIDSELLAAAPARWLAAGLGDTLAKWYEFRAVSTRHPARTGNALSSLAHSQICYEVIAEHGPAAYAAVLRGESGTSLDQVLDAIFTWAGLTSLMSNGAHAAAAHAIYEGFTFCDKTREFGHGLLVGYGNLCLLALEDRSDEELVDEMRLARDCGVPLTLAEIAALDESELALIIRESVHAPDMANMAEPVNEARLRAAMARIEGLAERV

SEQ ID NO: 199228 - protein, 350 aa, Glycine max
  Coding DNA Sequence Number=SeqID_82450
  Gene Ontology: Mol. function=oxidoreductase activity; Cellular component=intracellular; Biological process=auxin mediated signaling pathway
  Homolog annotation: Hit_ID=Q52QX9; Match level="QueryCoverage=98%, HitCoverage=98%, E-value=1e-156, Identity=78%"; Hit description =Aldo/keto reductase AKR
  Pfam annotation: Domain name=Aldo_ket_red; Domain location=10-318; Score=160.5; E_value=4.4e-45; Accession=PF00248.11; Description =Aldoketo reductase family
MARVGRMKLGSEGMEVSMQGLGCMGMSAFYGPPKPEPDMIALIHHAIQSGVTLLDTSNVYGPHTNELLLGKIYDNEQALKGGMRQNVELATKFGINIAEGKREARGDPAFVRESCYGSLKRLGIDCIDLYYQHRVDTRVPIEVTIGELKKLVKEGKIKYIGLSEASASTIRRAHAVHPITAVQLEWSLWSRDVEEEIVPTCRELGIGIVAYSPLGRGFLSSGTKLLENLTKEDYRQRLPRFQPENLEQNKTIFERIDELAAKKRCTPSQLALAWVHHQGKDVCPIPGTTKLKNFEENIGALSVKLTPEEMAELESFAAVDAVKGDRYGDDGFSLWQNSDTPPLSSWKAAL

SEQ ID NO: 199229 - protein, 70 aa, Glycine max
  Coding DNA Sequence Number=SeqID_82451
  Gene Ontology: Mol. function=metal ion binding; Biological process =metal ion transport
  Homolog annotation: Hit_ID=Q6J338; Match level="QueryCoverage=64%, HitCoverage=54%, E-value=8e-13, Identity=76%"; Hit description =Copper chaperone
MKKPHQIQCYILITSINSVESYDIDLKEQKVVVKGNVQPDTVLATVSKTGKKTTFWEGEAAASETSTATA

SEQ ID NO: 199230 - protein, 422 aa, Glycine max
  Coding DNA Sequence Number=SeqID_82452
  Gene Ontology: Mol. function=protein serine/threonine kinase activity; Cellular component=cytoplasm; Biological process=protein amino acid phosphorylation
  Homolog annotation: Hit_ID=Q0WN21; Match level="QueryCoverage=89%, HitCoverage=86%, E-value=1e-141, Identity=63%"; Hit description =Protein kinase like protein
  Pfam annotation: Domain name=Pkinase; Domain location=53-383; Score =204.3; E_value=2.9e-58; Accession=PF00069.15; Description=Protein kinase domain
  Pfam annotation: Domain name=Pkinase_Tyr; Domain location=53-383; Score=-51.1; E_value=2.5e-09; Accession=PF07714.7; Description =Protein tyrosine kinase
  Pfam module annotation: Pfam domain module=Pkinase::Pkinase_Tyr; Domain location=53-383::53-383
MHSSAEEDSDNSATTATASTEWTFSAKSHAPSSDPSWDAIQRGGGATLALGDLRFVQRVGSGDIGSVYLVELKGSSGCLFAAKVMDKKELVARNKDTRAKVEREILQMVDHPFLPTLYASLDSPRWSCLLTEFCPGGDLHVLRQRQPDKRFHLAAVRFYASEVVVALEYLHMMGIIYRDLKPENVLIRSDGHIMLTDFDLSLKGDDTASTAQMVFDEDPPSNTCSKEHSRKQCTPTMSSCMLPNCIVPSVPCFHPKRGRSKRFSRCGSLEIIAEPIEIRSTSFVGTHEYLAPEVISGEGHGNAVDWWTLGVFIFEMFYGITPFKGLENELTLANIVARALEFPKEPMIPGPARDLISQLLVKDSTMRLGSTMGALAIKHHPFFNGVNWPLLRCATPPYIPSSDKCKELLPLYNCTNNAIDFY

SEQ ID NO: 199231 - protein, 36 aa, Glycine max
  Coding DNA Sequence Number=SeqID_82453
MVSDANKKKVANEIVDILDFGFDLHLSPEMFKYTKI

SEQ ID NO: 199232 - protein, 302 aa, Glycine max
  Coding DNA Sequence Number=SeqID_82454
  Gene Ontology: Mol. function=RNA-directed DNA polymerase activity; Cellular component=chromatin; Biological process=chromatin assembly or disassembly
MEVDALSCFPKPPRAAYHHLLVSQFVFLEELKKELHTNLVFTDLCDKCLTSPTSLPDFIYRGRVFHESLYGGHPGVSKNLKDLIENFLWIDIRSDAQDFVAQCVDLSLDFVTRLPTSQGLMIILILVDHFSEGVQMGVFLANFTATCVVELFVSMVCKQHGFPKSLVSDSDPVINRIIEQYLRAFVHQKPSMWPPSFISVYVVGSSSIEVCDFVLLTHDEIFVILYNNLRKAQGTLYAKLDSSPPLTLGNDPIVSPLAILDSKGTTWEKWDELCKAYNLKDKVDFERGNIDRNVPNIIEPID

SEQ ID NO: 199233 - protein, 133 aa, Glycine max
  Coding DNA Sequence Number=SeqID_82455
MIEKKMMLGDKSKNLSKMLVVKLRGCVEHQDIVKKDYETFAQKWSKNVIHGCLKCNSRLMEAQGWKLGGRIFGPKHAGHLGQNYSTKHLSYAESNRPLFLVMGWIPHRLKMATTHPKSCLCGLSRSFMTITKK

SEQ ID NO: 199234 - protein, 200 aa, Glycine max
  Coding DNA Sequence Number=SeqID_82456
  Homolog annotation: Hit_ID=Q1SAV4; Match level="QueryCoverage=31%, HitCoverage=16%, E-value=2e-09, Identity=50%"; Hit description =Integrase, catalytic region
MEVDALCCFPKPPGAAYHHLLVSQFVFLEELKKELHTNLVFIDLCDKCLTSPTSLPDFIYRDKLLLHKGVLQLLPILTGVWEDLSLDFFTRLPTSQGLMIILILVDHFADWVQMGAFLTNFTATCVIELFVSMAYKQHVDLWVYVKLCPHRQTTWMEFSPEGTTWEKWDELCKAYNLKDKVDFERGNIDRNEPNIIEPID

SEQ ID NO: 199235 - protein, 80 aa, Glycine max
  Coding DNA Sequence Number=SeqID_82457
MAVDCVENNECTTSKSSSQSVAAVSHRQTPTKVPAAAEKISLKAMLIKEKSEERRKVNSQSRKIIIAKSVFTLLFFLATF

SEQ ID NO: 199236 - protein, 227 aa, Glycine max
  Coding DNA Sequence Number=SeqID_82458
  Gene Ontology: Mol. function=oxidoreductase activity; Cellular component=membrane fraction; Biological process=negative regulation of transcription
  Homolog annotation: Hit_ID=Q9LSQ5; Match level="QueryCoverage=84%, HitCoverage=94%, E-value=6e-80, Identity=76%"; Hit description=1,4 -benzoquinone reductase-like; Trp repressor binding protein-like
  Pfam annotation: Domain name=FMN_red; Domain location=27-204; Score= -41.3; E_value=0.049; Accession=PF03358.6; Description=NADPH -dependent FMN reductase
  Pfam annotation: Domain name=Flavodoxin_1; Domain location=21-151; Score=48.1; E_value=3.1e-11; Accession=PF00258.15; Description =Flavodoxin
  Pfam module annotation: Pfam domain module=FMN_red::Flavodoxin_1; Domain location=27-204::21-151
MKAHFKIVTQLENRFSELDKLYYSMYGHVEALAREILRGANSVEGVEAKLWQIPETLPPEELVRLRAPPKSDVPIINPFKLPVADGFVFGFPTRLGMMAAQFKAFLDSTQYLWKAQMLACKPAGIFYSTSCQGVGQETAPFTAITQLVHHGMIFVPIGYTFGPGMFEMKEPKGGSPYGAGTYTGDGSRQPTELELQQAFHQGNHIATIIKKFKEDAHPIFTLHNRGY

SEQ ID NO: 199237 - protein, 63 aa, Glycine max
  Coding DNA Sequence Number=SeqID_82459
MCRPDPPRTLSQDSLKPLALLLVNVAPCTACRPWIFFINEVLCFLKINGSGMEKKERLLEMPL

SEQ ID NO: 199238 - protein, 734 aa, Glycine max
  Coding DNA Sequence Number=SeqID_82460
  Gene Ontology: Mol. function=protein serine/threonine kinase activity; Biological process=protein amino acid phosphorylation
  Homolog annotation: Hit_ID=Q4QJG3; Match level="QueryCoverage=24%, HitCoverage=19%, E-value=4e-12, Identity=31%"; Hit description =Protein kinase, putative
  Pfam annotation: Domain name=Pkinase; Domain location=527-734; Score=- 24.5; E_value=4.2e-07; Accession=PF00069.15; Description=Protein kinase domain
  Pfam annotation: Domain name=Pkinase_Tyr; Domain location=516-732; Score=-95.8; E_value=1.4e-06; Accession=PF07714.7; Description =Protein tyrosine kinase
  Pfam module annotation: Pfam domain module=Pkinase::Pkinase_Tyr; Domain location=527-734::516-732
MDGNDKARCKDDCSSSVEMDLYESNFQENDETLSDGPHNTSSSMLTSSSSSSRCFASRKSGKRWKRRHHLQQKARQERLNNSRKWKAVDHDDQLLSKKIHRISEPENHDSLASESCAEIVSENGSLDDNNKRISSERAVNDNAIDNDNNDEVITEKQFSGEDCCTTESKDEKEESLCSLDKRPSEQDEASCLELLECVSKSKRHLDRDLDNPKPCKSRKSISSSSLLSCKYSKISFCGIEDHLSDGFYDAGRDRLFMPLECYEQNHCLASREVILLDRKIDEELDAVMLAAQALVYNLKKLNGLSRYGNQDGVDNLQMASLLALFVSDHFGGSDRSGIVERTRKSVSGSNYNKPFVCTCSAGSSTSISSPTEPVANTIEDITLSKMSEKSLDSIKKRRNSIIIPIGSVQYGVCRHRALLFKYLCDHMEPPVPCELVRGYLDFSPHAWNIILIKRGATWVRMLIDACRPLDIREEKDPEYFCRYIPLNRTTIPISSIGSPGPDYSFPSLTTCDELETKASTTLVKCKFGSVEAAAKVRTLEEQGSSADKIKNFEYNCLGEIRILGALKHPCIVEMYGHQISCQWSVSADGNPEHRVLRSAIFMEYVEGGSLKNYLEKLSEAGEKHVPVELALHIAKDVSCALSELHSKHIIHRDIKSENILFNLDRKRDDGTPTVKLCDFDSAVPLRSTLHVCCIAHAGTPPPCICVGTPRWMAPEVMRTMYKKNSYGLVRSSSY

SEQ ID NO: 199239 - protein, 301 aa, Glycine max
  Coding DNA Sequence Number=SeqID_82461
  Homolog annotation: Hit_ID=O48767; Match level="QueryCoverage=89%, HitCoverage=90%, E-value=1e-111, Identity=74%"; Hit description =Expressed protein
MELKLKSNLRYPRIILQVVHVIIVMNLKMSMASESSWVGRKPVKRIGGMSDALSIAADLGFSLSPPPSQEGLQNSSPTTGEKGEDLIRVLRELTTVQRKIADLQVELQGRKDDKNVAHLTHVSEMEKKIETLARITTILKDVIQNKDRIIARLQQPYSLDCIPVEAEYQKQFSELLMKAASDYGALTASVADFQWSQNFKEPPSVWGEMLRPIPVALASCTRFFEAMSATRESFASLQKLRVGHFDSPLSRTPAVDSSQRVSGVSDYLTPPPWKTETNFDDLGIRNQRRQHLDQQVEDLNS

SEQ ID NO: 199240 - protein, 43 aa, Glycine max
  Coding DNA Sequence Number=SeqID_82462
MDCLIDIDEGKESTWNCILYGYFICGGGGYDFCEIRMVQGGLK

SEQ ID NO: 199241 - protein, 42 aa, Glycine max
  Coding DNA Sequence Number=SeqID_82463
  Gene Ontology: Mol. function=pyruvate kinase activity; Biological process=glycolysis
  Homolog annotation: Hit_ID=Q1SGD3; Match level="QueryCoverage=83%, HitCoverage=12%, E-value=5e-09, Identity=83%"; Hit description =Pyruvate kinase
ARIKQRLALYRGVMSIYMQFSNDAEETFSRALKLLLVSKVHG

SEQ ID NO: 199242 - protein, 312 aa, Glycine max
  Coding DNA Sequence Number=SeqID_82464
  Homolog annotation: Hit_ID=Q1SLA3; Match level="QueryCoverage=41%, HitCoverage=17%, E-value=3e-21, Identity=30%"; Hit description=RNA -directed DNA polymerase
MTAIDPNGGRREERCWTLETPHDFQMQVADPGERKDVSIPHLVCPDRLVWAIESSLITVEEAQGHSGVYASPNLHLCSQLWDHLRSVNLLLQHPWVAIGDTNDTISPPDVKEFSRQAGLRGLEKALDTVDSAFLMQLLGSKNMTFFRFQPIFYKIFLDDVGDDVWNFVKQTFDSGNFDPLVAGTLVVLIPKVLVNRMKPLLNPSVSPLQNSFIPGRGTSDNGIILQKQVLFDFGFPEPTINLMFYPLSPYLFVLCLERMGHSIMDAKDRGLWNPISLSRGVTNHRKDKIEGSKEVASLEGSPSNRPGRVTLV

SEQ ID NO: 199243 - protein, 354 aa, Glycine max
  Coding DNA Sequence Number=SeqID_82465
  Gene Ontology: Mol. function=translation initiation factor activity; Cellular component=cytoplasm; Biological process=multicellular organismal development
  Homolog annotation: Hit_ID=Q9XGW1; Match level="QueryCoverage=97%, HitCoverage=36%, E-value=1e-129, Identity=65%"; Hit description =Protein PINHEAD
  Pfam annotation: Domain name=DUF1785; Domain location=275-327; Score =100.9; E_value=3.8e-27; Accession=PF08699.1; Description=Domain of unknown function (DUF1785)
PALINNKANMPVRQMKESSEQHLVIKPHLQNPMNQAKKTTKAAQNGKGPPPQENHNQTSPHSKNKGRRRGRGGRKPDQGDVMMRPSCRPCTATLTSTANENAENGCISDMGFPTSSKSLTFAPRPGYGQVGTKCIVKANHFFAELPDKDLNQYDVTITPEVSSRTVNRSIIAELVRLYKESDLGMRLPAYDGRKSLYTAGQLPFAWREFKIKLIDEEDGVNGPKEREYRVVIKFVARANLYHLGQFLAGRRADAPQEALQILDIVLRELSTKRYCPIGRSFFSPDIRTPQRLGEGLESWCGFYQSIRPTQMGLSLNIDMASAAFIEPLPVVEFVGQLLAKDVLSRPLSDADRIK

SEQ ID NO: 199244 - protein, 49 aa, Glycine max
  Coding DNA Sequence Number=SeqID_82466
DVPQWISAKDDLHKHDLHNVVAVTKAQATLTQGERRRTIGFKRKEKEEE

SEQ ID NO: 199245 - protein, 51 aa, Glycine max
  Coding DNA Sequence Number=SeqID_82467
MKMGSPSMGGSKRRLSSRGLGGALREQRARLYIIRSFPLIYPFFSFFAVTG

SEQ ID NO: 199246 - protein, 173 aa, Glycine max
  Coding DNA Sequence Number=SeqID_82468
  Gene Ontology: Mol. function=receptor activity
  Homolog annotation: Hit_ID=Q5ZDH7; Match level="QueryCoverage=87%, HitCoverage=24%, E-value=2e-32, Identity=48%"; Hit description =Senescence-induced receptor-like serine/threonine kinase-like
  Subcellular localization annotation: CTP_CleavageSite=33; ConfidenceScore=5.09e-01
MKCGSISKPNSCGLTSPTVQGDLSNNQLMGFIPDSLASSNLKLVLLNGNLLEGRVPEQLYSVGVHGGAIDLSGNKGLCGVPSLPSCPMFWEHGRLSTRGKIAIALSCLFVFCVVLLVAYIYIRRKRNDYDFALPHELMSLAAKRNRYQRQKSLMLLELESQHAKGLPSPFTPQ

SEQ ID NO: 199247 - protein, 351 aa, Glycine max
  Coding DNA Sequence Number=SeqID_82469
  Gene Ontology: Mol. function=protein binding; Biological process =protein amino acid phosphorylation
  Homolog annotation: Hit_ID=Q5ZDH7; Match level="QueryCoverage=94%, HitCoverage=55%, E-value=1e-94, Identity=49%"; Hit description =Senescence-induced receptor-like serine/threonine kinase-like
MQNRESENETLERESGRVNRDQGVILDGTNERSPNSWHELECQDVIAQVLDGEIQSQRGESTDVVVYVKPGDVVVVDEDIEDPLPCFVDAGIDLREVQPHRIVQFRVHTQFVPQRPLRGHRGLIQLHRERADLVAIFRYCSEVVVRLPGAGEAVGVVGEAGAPGFGGSAAGNAAVVNENEVVGVGVGGGVDLDEFNGGDERGIGGEAVEAEIEGGGVGEGGEEVGVGAIAGGGLRPGGAPAEEDGGGERDVEGGRAGLGVVVVVDGECAEEVAGGGRERREGVAVSLAGGGGREEAEGFLGGEREMERLGDESGGAGGEEAVGEPGGVEGVGGVGGSTAVDVVGEGFHLRC

SEQ ID NO: 199248 - protein, 308 aa, Glycine max
  Coding DNA Sequence Number=SeqID_82470
  Gene Ontology: Mol. function=DNA binding; Biological process =regulation of transcription
  Homolog annotation: Hit_ID=Q6ZI65; Match level="QueryCoverage=53%, HitCoverage=45%, E-value=7e-38, Identity=47%"; Hit description=No apical meristem (NAM)-like protein
  Pfam annotation: Domain name=NAM; Domain location=2-85; Score=-1.2; E_ value=2.2e-07; Accession=PF02365.6; Description=No apical meristem (NAM) protein
VKQDGSSSHFFHRVIKAYNTGSRKRRKICGQDFGDVRWHKTGRTKPVILNGIQKGCKKIMVLYISPVRGGKSEKTNWVMHQYHLGTEEDEKDGEYVISKVFYQQQQVKFGEKDDQDIPEITEATTVKVDPATPKSVTPEPPRIEKRCSNLDLGQESHHIPQTDYLDDLQAVCEDLAKDDLLIVETQNNEAIDNIENNAEEDSKWWDSESQNLLSSQQLVEALFLCDDLLQSQSPKRDEENEHKKRPSLSVYADLGPEHLKKDIEECQNLVLDPANVVPETPPSEFRLSQLDFSSQDSFVSWCANKAID

SEQ ID NO: 199249 - protein, 102 aa, Glycine max
  Coding DNA Sequence Number=SeqID_82471
MALSPIANIASYILAMTYGLINLGLNVNIKVDFAIDPEHLEENIYKINILYQLLKQCNSCRECHSVRGLTHQHHAKLLVSSLTASNLIYVDELTENTYILNW

SEQ ID NO: 199250 - protein, 75 aa, Glycine max
  Coding DNA Sequence Number=SeqID_82472
  Gene Ontology: Mol. function=DNA binding; Biological process =regulation of transcription
MLKTILNLSHLIASFSDLFPMAGPSWLVDKSRIATKIKSASGTCGKVIWKSNPSRACPSCHHVIDNSDSFDSDLL

SEQ ID NO: 199251 - protein, 108 aa, Glycine max
  Coding DNA Sequence Number=SeqID_82473
  Gene Ontology: Mol. function=transcriptional repressor activity; Biological process=regulation of nitrogen utilization
  Homolog annotation: Hit_ID=Q3KN80; Match level="QueryCoverage=99%, HitCoverage=30%, E-value=6e-39, Identity=81%"; Hit description =Leucoanthocyanidin reductase
MVTSPPAIPTTTKDRVLIIGATGFIGKFVAEASLTSEHPTCLLVRPGPLVPSKDAIVKTFQDKGAIVIHGVINNKDFVEKILKEYEIDIVILLLGLRACWISLYWWRP

SEQ ID NO: 199252 - protein, 101 aa, Glycine max
  Coding DNA Sequence Number=SeqID_82474
  Gene Ontology: Mol. function=transcriptional repressor activity; Biological process=regulation of nitrogen utilization
  Homolog annotation: Hit_ID=Q3KN80; Match level="QueryCoverage=99%, HitCoverage=28%, E-value=2e-44, Identity=82%"; Hit description =Leucoanthocyanidin reductase
MLQRFLPSEFGHDVDKADPVEPGLTMYKEKRLVRRVVEESGVPFTNICCNSIASWPYHDNCHPSQLPPPLDQLQIYGHGNVKAYFVDGIDIGKFTMKVIDD

SEQ ID NO: 199253 - protein, 94 aa, Glycine max
  Coding DNA Sequence Number=SeqID_82475
SGSIVEVNPYLSQVEKLKHKVITIEQKLASHEKRIRLYDEQVKEVKKILAKEEAQSHGYANGIEELWKKITKQQMKTNIKRKRVKVLRCIGVFL

SEQ ID NO: 199254 - protein, 329 aa, Glycine max
  Coding DNA Sequence Number=SeqID_82476
  Homolog annotation: Hit_ID=Q9FLJ1; Match level="QueryCoverage=76%, HitCoverage=90%, E-value=1e-10, Identity=32%"; Hit description =Arabidopsis thaliana genomic DNA, chromosome 5, P1 clone:MIO24
MNETGKKKHVREPPSVPFIWEVKPGIPKKDWKPEPEPEVPKTPLKLIASVPFVWEEKPGKPLPNFSVDHPVPPKPLLIHVASSSAFSFACNFGHDHDKDKGSLSSSDNESITTLDLEAFSFDEDESFVSSVPSLLANCLVPSAKVSTAIPLRETTPSSPASSSETDSGTSSYATGMSSPIGATFLECLFPLFPPKSGFLERDENLEKVTSSPQELREKELVHENCASDLVRKPPTLGELIMISRRRSCRRKAIQMKKWDPPKLCPTESSTILPLNIAQKITRKQAFGCFSVVTDSNMIEGLLKRKYFPKLKLVSCNLWVSCVKNVESGF

SEQ ID NO: 199255 - protein, 147 aa, Glycine max
  Coding DNA Sequence Number=SeqID_82477
MKLASTATGKADGPHQKKLRTYLGIATRDKVEFQIAEASGSRTKKKILQTVGERRQQFKLDLTRKWALAADQDGVDDTVCEKYGISKEKWAQFCQTCRYPSWENGRKKAQAIQKQNTAPHVLSRGGYEYLEQKLMAENTKKKLEEAA

SEQ ID NO: 199256 - protein, 70 aa, Glycine max
  Coding DNA Sequence Number=SeqID_82478
MRVLGLAPRYALSEFCNSNWSAASANACDRLVRPHHPLDEGLVRLARVLLAQRIGYVWLSAGVMLSELDD

SEQ ID NO: 199257 - protein, 60 aa, Glycine max
  Coding DNA Sequence Number=SeqID_82479
MGRFLLLFENGILGRVKSMLELHLTKATWGHLVGYLLEYHLSDPNFVRGLSFANVLILAS

SEQ ID NO: 199258 - protein, 922 aa, Glycine max
  Coding DNA Sequence Number=SeqID_82480
  Gene Ontology: Mol. function=protein serine/threonine kinase activity; Cellular component=integral to membrane; Biological process=protein amino acid phosphorylation
  Homolog annotation: Hit_ID=Q6XAT3; Match level="QueryCoverage=99%, HitCoverage=96%, E-value=0.0, Identity=69%"; Hit description=ERECTA -like kinase 1
  Pfam annotation: Domain name=LRRNT_2; Domain location=1-34; Score =16.2; E_value=0.018; Accession=PF08263.3; Description=Leucine rich repeat N-terminal domain
  Pfam annotation: Domain name=LRR_1; Domain location=111-133; Score =12.5; E_value=1.3; Accession=PF00560.23; Description=Leucine Rich Repeat
  Pfam annotation: Domain name=LRR_1; Domain location=135-156; Score =13.2; E_value=0.92; Accession=PF00560.23; Description=Leucine Rich Repeat
  Pfam annotation: Domain name=LRR_1; Domain location=159-181; Score =8.1; E_value=8.7; Accession=PF00560.23; Description=Leucine Rich Repeat
  Pfam annotation: Domain name=LRR_1; Domain location=205-227; Score =15.1; E_value=0.25; Accession=PF00560.23; Description=Leucine Rich Repeat
  Pfam annotation: Domain name=LRR_1; Domain location=228-249; Score =10.6; E_value=3; Accession=PF00560.23; Description=Leucine Rich Repeat
  Pfam annotation: Domain name=LRR_1; Domain location=252-274; Score =14.4; E_value=0.43; Accession=PF00560.23; Description=Leucine Rich Repeat
  Pfam annotation: Domain name=LRR_1; Domain location=276-298; Score =7.9; E_value=9.3; Accession=PF00560.23; Description=Leucine Rich Repeat
  Pfam annotation: Domain name=LRR_1; Domain location=300-322; Score =15.2; E_value=0.24; Accession=PF00560.23; Description=Leucine Rich Repeat
  Pfam annotation: Domain name=LRR_1; Domain location=324-346; Score =9.8; E_value=4.1; Accession=PF00560.23; Description=Leucine Rich Repeat
  Pfam annotation: Domain name=LRR_1; Domain location=348-370; Score =9.8; E_value=4.3; Accession=PF00560.23; Description=Leucine Rich Repeat
  Pfam annotation: Domain name=LRR_1; Domain location=372-394; Score =11.9; E_value=1.7; Accession=PF00560.23; Description=Leucine Rich Repeat
  Pfam annotation: Domain name=LRR_1; Domain location=39-61; Score=4.7; E_value=38; Accession=PF00560.23; Description=Leucine Rich Repeat
  Pfam annotation: Domain name=LRR_1; Domain location=396-418; Score =16.1; E_value=0.13; Accession=PF00560.23; Description=Leucine Rich Repeat
  Pfam annotation: Domain name=LRR_1; Domain location=420-442; Score =15.3; E_value=0.22; Accession=PF00560.23; Description=Leucine Rich Repeat
  Pfam annotation: Domain name=LRR_1; Domain location=444-466; Score =18.8; E_value=0.02; Accession=PF00560.23; Description=Leucine Rich Repeat
  Pfam annotation: Domain name=LRR_1; Domain location=468-490; Score =8.0; E_value=9.2; Accession=PF00560.23; Description=Leucine Rich Repeat
  Pfam annotation: Domain name=LRR_1; Domain location=492-513; Score =17.2; E_value=0.06; Accession=PF00560.23; Description=Leucine Rich Repeat
  Pfam annotation: Domain name=LRR_1; Domain location=63-85; Score =18.5; E_value=0.023; Accession=PF00560.23; Description=Leucine Rich Repeat
  Pfam annotation: Domain name=LRR_1; Domain location=87-109; Score =15.7; E_value=0.17; Accession=PF00560.23; Description=Leucine Rich Repeat
  Pfam annotation: Domain name=Pkinase; Domain location=595-860; Score =115.2; E_value=1.8e-31; Accession=PF00069.15; Description=Protein kinase domain
  Pfam annotation: Domain name=Pkinase_Tyr; Domain location=595-860; Score=88.6; E_value=2e-23; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=1-34::111 -133::135-156::159-181::205-227::228-249::252-274::276-298::300 -322::324-346::348-370::372-394::39-61::396-418::420-442::444 -466::468-490::492-513::63-85::87-109::595-860::595-860
MAMKALFSNMADVLLDWDDAHNDDFCSWRGVFCDNVSHTVVSLNLSSLNLGGEISPAIGDLTNLQSIDLQGNKLTGQIPDEIGNCAALVHLDLSDNQLYGDIPFSLSKLKQLELLNLKSNQLTGPIPSTLSQIPNLKTLDLARNRLSGEIPRILYWNEVLQYLGLRGNMLSGTLSRDICQLTGLCDVRGNNLTGTIPDNIGNCTSFEILDISYNQITGEIPFNIGFLQVATLSLQGNRLTGKIPEVIGLMQALAILDLSENELVGSIPPILGNLTFTGKLYLHGNMLTGPIPPELGNMSKLSYLQLNDNGLVGNIPNEFGKLEHLFELNLANNHLDGTIPHNISSCTALNQFNVHGNQLSGSIPLSFRSLESLTCLNLSSNNFKGIIPVELGHIINLDTLDLSSNNFSGHVPASVGYLEHLLTLNLSHNHLDGSLPAEFGNLRSIEILDLSFNNISGSIPPEIGQLQNLMSLFMNHNDLRGKIPDQLTNCFSLTSLNLSYNNLSGVIPSMKNFSWFSADSFLGNSLLCGDWLGSKCRPYIPKSRAFYRSSQSKQLMKGTSGTGQGMLNGPPKLVILHMDMAIHTLDDIIRGTENLSEKYIIGYGASSTVYKCVLKNSRPIAIKRLYNQQPHNIREFETELETVGSIRHRNLVTLHGYALTPYGNLLFYDYMANGSLWDLLHGPLKVKLDWETRLRIAVGAAEGLAYLHHDCNPRIVHRDIKSSNILLDENFEAHLSDFGTAKCISTAKTHASTYVLGTIGYIDPEYARTSRLNEKSDVYSFGIVLLELLTGKKAVDNESNLHQLILSKADNNTVMEAVDPEVSITCTDLAHVKKTFQLALLCTKKNPSERPSMHEVARVLVSLLPSPPSKILAPPAKKFDYAHFVIEKGQQRKMEEQKPQQDNNSSNAQWFVRFGDVISKST

SEQ ID NO: 199259 - protein, 150 aa, Glycine max
  Coding DNA Sequence Number=SeqID_82481
  Subcellular localization annotation: CTP_CleavageSite=93; ConfidenceScore=5.86e-01
VKSMSKGSNAAKTKKKSMLPTSKASPISTPQSSKPASKTPTKTVTPASSTRKGSSPSLTRRQITSSRESRKFANKPLHMSLTLPPSNPDPAPQSTMRRSLIMENMGDKDIVKRAFKTFQNSFNQPKTSVEDKSLIKKQYKWLFLNCTKSD

SEQ ID NO: 199260 - protein, 66 aa, Glycine max
  Coding DNA Sequence Number=SeqID_82482
MEVEVVIVHNYEENTVNPNRRAIIQLNFIDEIRHLVASTMNAPRCLRSQRYAPFGANVTAAPVNTC

SEQ ID NO: 199261 - protein, 133 aa, Glycine max
  Coding DNA Sequence Number=SeqID_82483
  Homolog annotation: Hit_ID=Q1S104; Match level="QueryCoverage=38%, HitCoverage=27%, E-value=4e-20, Identity=86%"; Hit description =Embryo-specific 3
  Pfam annotation: Domain name=ATS3; Domain location=31-132; Score=7.7; E_value=1.4e-08; Accession=PF06232.2; Description=Embryo-specific protein 3, (ATS3)
MIKQVLLVLLFLASGLTLSVSETESVSLLPHAAESFNVSYIQMKNAGTCSYLVVISTSCSSPRYTRDQISISFGDAYGNQLMFLASSSQADESWISSLDILLGPSVVSSFMSLSYRFLSARIASIFVYRKANG

SEQ ID NO: 199262 - protein, 123 aa, Glycine max
  Coding DNA Sequence Number=SeqID_82484
MQQGQADILIARFPDPNYGVKTKTKGQIRVFVLYRNRKPSWKIPLRLKGSSRCGFSMEKNDAHSRHLLKDPNGQIMETCLVKLQTKFRDDPTVNERWASFLPRQLHVVFSRSFIKRLPPEASL

SEQ ID NO: 199263 - protein, 706 aa, Glycine max
  Coding DNA Sequence Number=SeqID_82485
  Gene Ontology: Mol. function=ATP-dependent helicase activity; Cellular component=nucleus; Biological process=metal ion transport
  Homolog annotation: Hit_ID=Q9M6R6; Match level="QueryCoverage=93%, HitCoverage=93%, E-value=0.0, Identity=78%"; Hit description=RNA helicase
  Pfam annotation: Domain name=DEAD; Domain location=142-320; Score =226.9; E_value=4.4e-65; Accession=PF00270.19; Description=DEADDEAH box helicase
  Pfam annotation: Domain name=GUCT; Domain location=552-648; Score =192.5; E_value=1e-54; Accession=PF08152.3; Description=GUCT (NUC152) domain
  Pfam annotation: Domain name=Helicase_C; Domain location=392-463; Score=99.7; E_value=8.9e-27; Accession=PF00271.21; Description =Helicase conserved C-terminal domain
  Pfam module annotation: Pfam domain module=DEAD::GUCT::Helicase_C; Domain location=142-320::552-648::392-463
MPSLSLSETDTTTPKPISNKKKPKTQSLTDPDLDGVSGKKTKKRKASDLLEPEAMPAAYSYNNGDDETSSDLVEPEPASREDDSQNKKKKKKKVVKSEEKEQPLLVTEPKEEKKDDPNAISNFRISEPLREKLKEKGIESLFPIQAMTFDTVLDGSDLVGRARTGQGKTLAFVLPILESLINGPAKSARKTGYGRTPSVLVLLPTRELACQVHADFEVYGGAMGLSSCCLYGGAPYQGQELKLRRGVDIVIGTPGRVKDHIEKGNIDLSQLKFRVLDEADEMLRMGFVEDVEMILGKVENVNKVQTLLFSATLPDWVKQIALKFLKPDKKTADLVGNTKMKASTNVRHIVLPCTSSARAQLIPDIIRCYSSGGRTIVFTETKECASQLAGILNGAKALHGDIQQSTREVTLSGFRSGKFMTLVATNVAARGLDINDVQLIIQCEPPRDVEAYIHRSGRTGRAGNTGVAVMLYDPKRSNIPRIERESGVKFEHVSAPQPDDIAKAVSGEAAEMIIQVSDSVVPAFKSAAEELLNSSGLPVIELLAKALAKAVGYTDVKQRSLLTSMENYVTLVLETGKPIYTQSYGYSILRRFLPEEKVEAVKGLSLTADGNGVVFDVPAKDLDIYLNGQENASNVCLEVVKTLPQLQQKEPQSRGGRFGLVEEVEEAGMVGSPMVVGVAATGVERDGEAEKGLWELSVFTLLGVGS

SEQ ID NO: 199264 - protein, 74 aa, Glycine max
  Coding DNA Sequence Number=SeqID_82486
MWILALAAKNVKGALSAVDPLKKGCLYMMYRPSSMKMYRLRRDVYKLIFVSTPKDVVPEQYPFTIVGFKGLLFV

SEQ ID NO: 199265 - protein, 60 aa, Glycine max
  Coding DNA Sequence Number=SeqID_82487
MERVGWVPCKSDQLIVAKGKITERNLEFENKRPPYYTKESHSITNRIHVPPLTNYVTNNY

SEQ ID NO: 199266 - protein, 88 aa, Glycine max
  Coding DNA Sequence Number=SeqID_82488
  Gene Ontology: Mol. function=ribonuclease H activity; Biological process=DNA integration
MSHGRLYQSWVKNTFDKKVRPCKFNERDLVLKKVSQTQKDHRGKWALNYEGPFVVKKAFSRGALLLANMDNEELPSPVNSDIIKRYYA

SEQ ID NO: 199267 - protein, 269 aa, Glycine max
  Coding DNA Sequence Number=SeqID_82489
  Gene Ontology: Mol. function=transcription regulator activity; Cellular component=nucleus; Biological process=regulation of transcription
  Homolog annotation: Hit_ID=Q1SBF4; Match level="QueryCoverage=71%, HitCoverage=55%, E-value=7e-36, Identity=47%"; Hit description =Probable DNA-binding protein T6L1.1 [imported]-Arabidopsis thaliana
  Pfam annotation: Domain name=HLH; Domain location=228-266; Score =11.6; E_value=0.0084; Accession=PF00010.16; Description=Helix-loop -helix DNA-binding domain
MGREREVGVECVPRHNDYMVLGKHKGWRGHSKSIEERGGGLTEVRRKRKRLKAKEATTATAAIDPREMIQEDQGQCSSQAINNYHQAYQEQLLLQQQMQQQQQQQQQNNDIFGGGLNMYPGGEVSQIMHHHHHQPWSMTMPHHHHHHHQVHDPFLVPPQTSPYASLFNRRGPSLQFAYDHGSSSDHLRIISESFVGPVVQPGSAPFGLQTELAKMTAQEIMEAKALAASKSHSEAERRRRERINNHLAKLRSLLPSTTKFRGTQLARKK

SEQ ID NO: 199268 - protein, 118 aa, Glycine max
  Coding DNA Sequence Number=SeqID_82490
MENNDGLWWLMVAVGDGESSWNFRNGFGRKKEEEMTFFLSYTKAKAEMLKYEMLSGTEASSTLQTSSQRSQQSDHGQLSLEASLRGFLQKLPRGFFEKLSQEASLRSWILICPHPSIN

SEQ ID NO: 199269 - protein, 129 aa, Glycine max
  Coding DNA Sequence Number=SeqID_82491
  Gene Ontology: Mol. function=protein serine/threonine kinase activity; Cellular component=ubiquinol-cytochrome-c reductase complex; Biological process=protein amino acid phosphorylation
  Homolog annotation: Hit_ID=Q2RAY6; Match level="QueryCoverage=70%, HitCoverage=10%, E-value=5e-26, Identity=59%"; Hit description=D -mannose binding lectin family protein
  Pfam annotation: Domain name=Pkinase; Domain location=1-129; Score= -110.1; E_value=0.053; Accession=PF00069.15; Description=Protein kinase domain
MGEVERGYIPSFISLLSLSINLISYKLSLRNNKRSYIHEECLEWILHFHVKPQNILLNSNYQPMVANFGLSKLRNRNDTSTYFTFSRIRGTRGYMSPEWVFNQRITSKVDVYSYGIVVLEMVTGKSNFL

SEQ ID NO: 199270 - protein, 69 aa, Glycine max
  Coding DNA Sequence Number=SeqID_82492
MGLDQLARDASQRHNVDQSVCLKDHGALLHPAMMMEEEEMTKGEKWKHMGRYGGKCRDREKNLGDGVLK

SEQ ID NO: 199271 - protein, 686 aa, Glycine max
  Coding DNA Sequence Number=SeqID_82493
  Gene Ontology: Mol. function=identical protein binding; Cellular component=cytoplasm; Biological process=negative regulation of enzyme activity
  Homolog annotation: Hit_ID=Q1S0Z4; Match level="QueryCoverage=99%, HitCoverage=87%, E-value=0.0, Identity=77%"; Hit description =Orn/DAP/Arg decarboxylase 2; Protease-associated PA; Proteinase inhibitor I9, subtilisin propeptide
  Pfam annotation: Domain name=PA; Domain location=380-481; Score =105.1; E_value=2e-28; Accession=PF02225.12; Description=PA domain
  Pfam annotation: Domain name=Peptidase_S8; Domain location=131-621; Score=70.7; E_value=4.6e-18; Accession=PF00082.12; Description =Subtilase family
  Pfam annotation: Domain name=Subtilisin_N; Domain location=35-120; Score=97.2; E_value=4.9e-26; Accession=PF05922.7; Description =Subtilisin N-terminal Region
  Pfam module annotation: Pfam domain module=PA::Peptidase _S8::Subtilisin_N; Domain location=380-481::131-621::35-120
MFMSPITPMEKMVLILASYLLLSTLFSANAEFVKKTYIIQMDKSAKPDTFSNHLDWYSSKVKSILSKSVEAEMDKEERIIYTYQTAFHGVAAKLSQEEAEKLEAEEGVVAIFPDTKYQLHTTRSPTFLGLEPTQSTNNVWSEKLANHDVIVGVLDTGVWPESESFNDTGMRPVPSHWKGACETGRGFRKHHCNNKIVGARMFYHGYEAATGKIDEQAEYKSPRDQDGHGTHTAATVAGSPVHGANLLGYAYGTARGMAPGARIAAYKVCWTGGCFSSDILSAVDRAVDDGVDVLSISLGGGVSSYYRDSLSVASFGAMEKGVFVSCSAGNAGPDPVSLTNVSPWITTVGASTMDRDFPADVSLGNGRKITGTSLYKGRSMLSVKKQYPLVYMGDTNSSIPDPKSLCLEGTLDRRMVSGKIVICDRGISPRVQKGQVVKNAGGVGMILINTAANGEELVADCHLLPAVAIGEKEGKELKHYVLTSKKKATATLGFRATRLGVRPSPVVAAFSSRGPNFLTLEILKPDVVAPGVNILAAWSEAIGPSSLPTDHRRVKFNILSGTSMSCPHVSGIAALLKARHPDWSPAAIKSALMTTAYVHDNTIKPLRDASNAEASTPYDHGAGHINPRRALDPGLVYDIQPQDYIEFLCSLKLTTSELGVFAKYSNRTCRHSLSSPGDLNYPAISV

SEQ ID NO: 199272 - protein, 115 aa, Glycine max
  Coding DNA Sequence Number=SeqID_82494
MPHNNILNITNPSMVYAASGQHDLKVASEEMGQQTCGPTLSAPKLEKSIVDFNPASKTDPPPSLNEDSIELQCALLKEMGLTYGEDDNKVKGLLLDMENKYNMMAAEKGIKIQQL

SEQ ID NO: 199273 - protein, 133 aa, Glycine max
  Coding DNA Sequence Number=SeqID_82495
MAAVVVTTDDKGGGNDNHGGVAMVVMVVVATLTKDGNDGFDNYNGATTVVMMLTTTIMMVMGQFSSLSQTGLRFRDCNHIVEIVFVEIVSTTYRLRSKKTRKGKSPGKGTPRAFLLFLLLPELVFVANWAALP

SEQ ID NO: 199274 - protein, 202 aa, Glycine max
  Coding DNA Sequence Number=SeqID_82496
  Gene Ontology: Mol. function=protein-tyrosine kinase activity; Cellular component=integral to membrane; Biological process=protein amino acid phosphorylation
  Homolog annotation: Hit_ID=Q1S0Z5; Match level="QueryCoverage=83%, HitCoverage=36%, E-value=4e-50, Identity=62%"; Hit description =Protein kinase
VDDVYGDAHGYKREKNRSRKSGGSVDSWFSGELRGIGWNSYDSATGSGEIVAKSGGVSSTPSMRGTVFYVAPEYGYNGDASEKCDVYSLGVLLLVIVSGRRPLQVSGSAIWEYKRANLVSWARQCERRGKLLEVVDESVEGLDKEQASLCVTVALMCLLKSPARRPSMKEVVGMLSGEMEPPQYSLQQQKAKFPFQPPKVGP

SEQ ID NO: 199275 - protein, 248 aa, Glycine max
  Coding DNA Sequence Number=SeqID_82497
  Gene Ontology: Mol. function=transcription regulator activity; Cellular component=nucleus; Biological process=regulation of transcription
  Homolog annotation: Hit_ID=Q1S0Z7; Match level="QueryCoverage=99%, HitCoverage=100%, E-value=2e-57, Identity=55%"; Hit description =Helix-loop-helix DNA-binding
  Pfam annotation: Domain name=HLH; Domain location=76-128; Score=40.5; E_value=5.9e-09; Accession=PF00010.16; Description=Helix-loop-helix DNA-binding domain
MFPLQRGNELVIHFSNGLYPQHKISQDLIRDDQNIDQSPHVGYSDKKWRTSRPKKLFYHEAAATSHANSSNQEYAKKMVHREIERQRRQEMATLHASLRSLLPLRFIKGKRSISDQMNEAVNYINHLQKNIKELSDKRDKLKKKPSINSTPEGHENCKHVSSGFTIHQNSGGAVGIEISGFSEEEVPLSKLLKLVLEERLEVVSCLSTKVNGRLLHSLQCEVDNSDSVDLSELRRKFSNVIPSLRCSE

SEQ ID NO: 199276 - protein, 184 aa, Glycine max
  Coding DNA Sequence Number=SeqID_82498
DIKAGEEKCFGIEVRDFGDGPSNSKTVSLQQVGNSEGSSKTVRYHDNDDNNFDEKEIKSNLDIVASKEHDVKNRTYYDEKSDFSAEIQDMLTYHHRIYMKKRCAFNASIKCSNELKTLDEEHNEESYRCETTNTWRCSIAHHMIGLSLRNSNLKEYKLDLSQPIFNVWPNGLDQTDSTCPFYQT

SEQ ID NO: 199277 - protein, 253 aa, Glycine max
  Coding DNA Sequence Number=SeqID_82499
  Gene Ontology: Mol. function=transcription regulator activity; Cellular component=nucleus; Biological process=regulation of transcription
  Homolog annotation: Hit_ID=Q1S0Z9; Match level="QueryCoverage=69%, HitCoverage=92%, E-value=1e-27, Identity=39%"; Hit description=Helix- loop-helix DNA-binding
  Pfam annotation: Domain name=HLH; Domain location=70-122; Score=29.7; E_value=1e-05; Accession=PF00010.16; Description=Helix-loop-helix DNA- binding domain
MNPLHPTDELYFQIAPDNNYYSLPIQTTPENQILHDPVMDGSALIHFTSQMGTKGKQREDFKTTTIDENKKWMHRETEKQRRQEMTRLCTNFRSLLPLEYIKGKRSISDHMHEGTNYIKYLQNKVKQLQATRDKLMKLSNLSPVGSESGSLSTTHLPVCVIVHPCPGGVQIKCSYSFGKYACPLSRVLDIVLKEGLDVVNCTSTKPDDRFIHTIRCEVPHMMTGNNYTELQRKFVEAISSSSLEERLSAPENC

SEQ ID NO: 199278 - protein, 169 aa, Glycine max
  Coding DNA Sequence Number=SeqID_82500
  Pfam annotation: Domain name=Transposase_23; Domain location=52-119; Score=-13.0; E_value=0.03; Accession=PF03017.5; Description =TNP1ENSPM transposase
MSISIALGVWLALPDAVPVLVADPEVGPSTARVSIKESCVDPSGNDPNTGDSGKYGLYIEENPPCLVALGRLYEGSTIVHNIPLLHDQVKVGVEEVRDADAPIPVPTEEVKLVGQTLNTFLAWPTHLVKRLSEQGAVGPVKPVDRPDHDIDDPLYLMTLTIPQLFLKPL

SEQ ID NO: 199279 - protein, 55 aa, Glycine max
  Coding DNA Sequence Number=SeqID_82501
MKMKIPKLHSRRPRKGLKNWSRTLSASTTAQREELTWRPGEAKPSIVGSSVIKYS

SEQ ID NO: 199280 - protein, 563 aa, Glycine max
  Coding DNA Sequence Number=SeqID_82502
  Gene Ontology: Mol. function=nucleic acid binding
  Homolog annotation: Hit_ID=Q1SM16; Match level="QueryCoverage=83%, HitCoverage=91%, E-value=1e-152, Identity=58%"; Hit description =Single-stranded nucleic acid binding R3H
  Pfam annotation: Domain name=R3H; Domain location=145-206; Score =10.7; E_value=0.027; Accession=PF01424.13; Description=R3H domain
MEGSAEDFGAPESWEVADLDESMNRLNLMLSSNNDSKQPHQRVADDDDAMPPPIPPPSSSGDEVSDDVINQVDQFLREAIQNPRERLSMNASFQRIQIPYESSTKLPPDSDFEFEASNKLYVLRLLYLAQLIKASNLINSVLRMEQDVENFIRDPTQQQLEFKQLPTSYLRLAAHRVAQHYSLQSMVLLDNSLPDGSGSRIIVRKTFECKLPVIRLADIPVKLSPENSAVMKVAIKQRPQKWTQMLSNANSNSVKNNNSKSVEERKEEYNRARARIFSSSNNGGTVGGKPECESRQQDNSLHGSLVVPRVEDKSASVSDVTSGRGLVESSTNTNRARSRTEKEPVGRYRQNNRVAIFRDREVDRKDPDYDRNYDRYMQRFDPGFGFNGGSYAIQPMYTAVLNYNTEFPQLGSAHRPHLSAEHQPRPLPQHIPGPWAAQSTPAGIGYGHPETMMPPFNPNQVGAHSSSAIPPALIYPSNLGFARMLPASSTTHILLIMKSKLRTSSEEMEPKKFVLDLDEGEEAEKGVVKDELGDAYAGQQKFGMQCMWLAQRLGVPANLQQPA

SEQ ID NO: 199281 - protein, 102 aa, Glycine max
  Coding DNA Sequence Number=SeqID_82503
MVVLGEIALELQHAVAVGEAEIVEMGDCMRHAARVPVLGVVDAKLEEAVDDDGRDKDGEVVVIGEGKGVDEKGDHVFVGKTCTKMIVILRTLHKRLTLLVTV

SEQ ID NO: 199282 - protein, 390 aa, Glycine max
  Coding DNA Sequence Number=SeqID_82504
  Gene Ontology: Mol. function=nucleic acid binding; Cellular component= mitochondrion
  Homolog annotation: Hit_ID=Q9LIH1; Match level="QueryCoverage=84%, HitCoverage=83%, E-value=1e-104, Identity=59%"; Hit description =Arabidopsis thaliana genomic DNA, chromosome 3, P1 clone:MFD22
  Pfam annotation: Domain name=RRM_1; Domain location=303-374; Score =95.0; E_value=2.2e-25; Accession=PF00076.12; Description=RNA recognition motif. (a.k.a. RRM, R
  Subcellular localization annotation: CTP_CleavageSite=58; ConfidenceScore=5.31e-01
MELLSVSVSLSKCQTLSFPKPKAPQIHELPLNIRLPNKTNHFSLSSSSSPCCNWSITRVAAATTYPSFNPSTTQNPHWMVLMDTPPQGVNSKPQVIDYYVKTLQTVLGSEKDAQMCIYDASWNTHFGFCCDIDEEISAQLASLPEVLLVRPDLEFNSLKKDYSLSSGEAGHLSGLRTRTNMLFPAGNSKHWLVKMDKPGVEAVTKAQIVDYYAQILTKVMGNEKDAQMCIYHVSWKTNFGFCCELDEDCAQELAGVLGVLSVQPDNNFESENKDYAGSNLENSWNVSNSSEASQEAPLKTKKLFVTGLSFYTSEKTLRAAFEGFGELVEVKVIMDKISKRSKGYAFVEYTTEEAASAALKEMNGKIINGWMIVVDVAKPNPPRYHRNHAG

SEQ ID NO: 199283 - protein, 40 aa, Glycine max
  Coding DNA Sequence Number=SeqID_82505
  Homolog annotation: Hit_ID=Q1SBE3; Match level="QueryCoverage=90%, HitCoverage=3%, E-value=5e-10, Identity=78%"; Hit description =Unnamed protein product; contains similarity to pherophorin gene _id:T5M7.14-related
MYMKRVASELEILSGPKKEPTREFLILQGVHFAFRVHQLK

SEQ ID NO: 199284 - protein, 213 aa, Glycine max
  Coding DNA Sequence Number=SeqID_82506
  Homolog annotation: Hit_ID=Q9LI74; Match level="QueryCoverage=94%, HitCoverage=30%, E-value=3e-24, Identity=38%"; Hit description =Similarity to pherophorin
MIVRLGLIVAASIAALTVKQLNVNDTRSERGEARIRNDQDEATEEAQVTCSIDGHTEKREKEEQEEVKLISNIINQTDDFEDDILPEFEKLLFEEIDFLSLDEKTDEDKKWRVYAIEMANSASELEWLHNQVKELEEREVKLDGELLEYYVEIGKKLKALNDLEVEVVELKRENKELQHKKREMTLNSMLLNLKLQNSPMSQRSQSLSRSIFL

SEQ ID NO: 199285 - protein, 947 aa, Glycine max
  Coding DNA Sequence Number=SeqID_82507
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=70%, E-value=0.0, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=517-680; Score =179.3; E_value=9.3e-51; Accession=PF00665.16; Description=Integrase core domain
  Pfam annotation: Domain name=zf-CCHC; Domain location=273-290; Score =28.0; E_value=2.4e-05; Accession=PF00098.13; Description=Zinc knuckle
  Pfam module annotation: Pfam domain module=RVT_2::rve::zf-CCHC; Domain location=839-947::517-680::273-290
MATTLSNNGFPAHLPIFDGKNYDQWIAKMKVIFRFQDVVEIVNTGVAALPRNPTDDQNAAHKEQKKRDGKALFIIHQCLDADIFEKIVHCENAKEAWDTLARNYCGDEKLKKVRLQALRRQYELLQMTEGETVNQYFVRLTSLTNQMVRNGEKISDLMKIEKVLRTLTPKFDHIVVAKEESKNLDELKIEELQASLEAHELRLNERSKIKDKSNESAADQALQAQHQKKGKYKKGKRKNQNSKNSNEGTSKGHDHSSQEGNKGQKKKINKKDIQCYNCQKWGHFAAECKSKKVPRGESDEAQFVHDNEGYDSEGAMLMAIIKEEDDDDQWYLDTGCSNHMSGKKTWFCELDESVTRKIRFADDSVVNAEGIGKIKIQSKDGKDSFISDVLYVPNMKSNLISIGQLLEKGYTVRMEDKILRIFDNKMRTILKVQMSRQRTFKIGINIVENQCLLTKAGNENWLWHQRFGHLNFGDLNKLQKKKMVIGLPQITEPDKVCDKCCISKQSRSSYNTEIPTRATRKLETIHSDVCGPFEVKSMGGNNYFVSFIDEFTRKLWIYLIVKKSEVLDVFKKFRIMVQNESGEVVSKLRTDGGGEYTSNEFRSFCESNGIKHEVTAPYTPQHNGIAERKNRTIVNMVRSMIKEKGLPTYLWGEATATAVYLLNRCPTKRLEYVTPEEAWSGIKPCVKHLRVFGSLCFRHIPDQLRRKLDDKAQAVVMVGYHSTGSYKLYDPIEKKIMFSKDVKFDEASSWNWEGSSSRKNSMVYLNDTESPVQEVNTNQGGASERPTRNVQAPQRLNDCVRFPDTAVADDGELIQLAMLAESEPVSLEQAMKEEHWRNAMLDELQSIEKNETWSLVKLPTSKKCIDVKWVYKTKLKPDGQVAKYKARLVARGFLQRQGLDYNEVFAPVARMETIRLIIAIASWKSWKMFQLDVKSAFLNGELEEEVY

SEQ ID NO: 199286 - protein, 49 aa, Glycine max
  Coding DNA Sequence Number=SeqID_82508
MEKLVQNGHHVHLNSEEWKPPMMQEPTRSKKARRIAREKALHGRCKVLE

SEQ ID NO: 199287 - protein, 477 aa, Glycine max
  Coding DNA Sequence Number=SeqID_82509
  Gene Ontology: Mol. function=receptor activity; Cellular component =anchored to membrane; Biological process=protein amino acid phosphorylation
  Homolog annotation: Hit_ID=Q1SBD8; Match level="QueryCoverage=98%, HitCoverage=98%, E-value=1e-177, Identity=65%"; Hit description =Unnamed protein product; contains similarity to elicitor-inducible receptor EIR gene_id:T5M7.12
  Pfam annotation: Domain name=LRR_1; Domain location=145-168; Score =13.2; E_value=0.93; Accession=PF00560.23; Description=Leucine Rich Repeat
  Pfam annotation: Domain name=LRR_1; Domain location=170-192; Score =10.9; E_value=2.5; Accession=PF00560.23; Description=Leucine Rich Repeat
  Pfam annotation: Domain name=LRR_1; Domain location=194-216; Score =15.3; E_value=0.22; Accession=PF00560.23; Description=Leucine Rich Repeat
  Pfam annotation: Domain name=LRR_1; Domain location=218-240; Score =10.3; E_value=3.4; Accession=PF00560.23; Description=Leucine Rich Repeat
  Pfam annotation: Domain name=LRR_1; Domain location=242-264; Score =8.8; E_value=6.5; Accession=PF00560.23; Description=Leucine Rich Repeat
  Pfam annotation: Domain name=LRR_1; Domain location=266-288; Score =10.6; E_value=2.9; Accession=PF00560.23; Description=Leucine Rich Repeat
  Pfam annotation: Domain name=LRR_1; Domain location=290-313; Score =12.0; E_value=1.6; Accession=PF00560.23; Description=Leucine Rich Repeat
  Pfam annotation: Domain name=LRR_1; Domain location=315-337; Score =14.4; E_value=0.41; Accession=PF00560.23; Description=Leucine Rich Repeat
  Pfam annotation: Domain name=LRR_1; Domain location=339-361; Score =12.1; E_value=1.6; Accession=PF00560.23; Description=Leucine Rich Repeat
  Pfam annotation: Domain name=LRR_1; Domain location=363-388; Score =9.9; E_value=3.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=145 -168::170-192::194-216::218-240::242-264::266-288::290-313::315 -337::339-361::363-388
MKRIKAISHAIFVMFIFSLSARSCGQEDLDILAPMEKAEQEALYSTIQGFVGDSWNGSDLYPDPCGWTPIQGVSCDLFDGFWYVTALNIGPVHDNSLSCAQDLEFRQHLFELKHLKSLSFFNCSQSQYMFPATIPTGNWQKLAGSLESLEFRSNPGLIGNIPSSFGVLKNLQSLVILENSVTGEIPSSIGNLIKLKKLVLAGNYLTGRIPDVFDGLNELLIFDLSSNSLSGSLPLTLGSLTSALKLDVSNNHLEGNLLNQFANLKNLTLMDLRNNRFTGGLTLSLQEMSSLEELVLSNNPLGGDVRFLKWENLKNLAILELSNMGLTGEIPESLSELKRLRFLGLSDNNLTGNPSPKLETLPCLNALYLSGNNLTGELSFSKDFFGKMGRRFGAWNNPNLCYQIGLMSSSHVPYGVKPCQKEVNLLESDSKTELINGDMNETFHFIASKGFSSCATNGFWWTFLEKILMMGLFLSLI

SEQ ID NO: 199288 - protein, 285 aa, Glycine max
  Coding DNA Sequence Number=SeqID_82510
  Gene Ontology: Mol. function=aminopeptidase I activity; Cellular component=vacuole; Biological process=proteolysis
  Homolog annotation: Hit_ID=Q1SM19; Match level="QueryCoverage=95%, HitCoverage=53%, E-value=6e-99, Identity=66%"; Hit description =Peptidase M18, aminopeptidase I
  Pfam annotation: Domain name=Peptidase_M18; Domain location=61-284; Score=-39.6; E_value=9.1e-15; Accession=PF02127.6; Description =Aminopeptidase I zinc metalloprotease (M18)
  Subcellular localization annotation: CTP_CleavageSite=45; ConfidenceScore=5.67e-01
MASITGPQILLHSGSPWLKQTMKPSSSPFLLFPKHTPRRTFCSINSNSKGSSSIVPDLLHYLNHSWTQFHATAEAKRQLLAAGFHMLDENHDWHLKPGGRYFFTRNMSCLVAFAIGDKYNVGDGFHVIAAHTDSPCLKLKPKTASCKCNYSMVNVQTYGAGLWYTWFDRDLSVAGRVILRSSHNSYVHKLVKINRPILRIPTLAIHLDRTVNQDGFKPNLETHLHPLLSMKPEDTSLESNSKEKNSALSSKAHHHRLLMQFITKQYANELVALDVWHVNMWEDGE

SEQ ID NO: 199289 - protein, 125 aa, Glycine max
  Coding DNA Sequence Number=SeqID_82511
  Gene Ontology: Mol. function=protein binding; Cellular component =histone deacetylase complex; Biological process=regulation of transcription, DNA-dependent
  Homolog annotation: Hit_ID=Q6ZH90; Match level="QueryCoverage=67%, HitCoverage=55%, E-value=1e-30, Identity=75%"; Hit description =Putative P18
  Pfam annotation: Domain name=SAP18; Domain location=39-125; Score =82.8; E_value=1.1e-21; Accession=PF06487.3; Description=Sin3 associated polypeptide p18 (SAP18)
MANPIAIILNAPMILSRTAGGRALLSLPRGPPPPPSCPCLEPINHKKTRPLLLIVFTKIGSHHSMEDFVVRGKESKDEVQIYTWKDATLRELTNLVKEVALTARRRNAKLSFAFVFPDKNDRFKV

SEQ ID NO: 199290 - protein, 375 aa, Glycine max
  Coding DNA Sequence Number=SeqID_82512
  Gene Ontology: Mol. function=oxidoreductase activity, acting on single donors with incorporation of molecular oxygen, incorporation of two atoms of oxygen; Cellular component=plasma membrane; Biological process=...
  Gene Ontology: Biological process=methionine biosynthetic process
  Homolog annotation: Hit_ID=Q8H185; Match level="QueryCoverage=55%, HitCoverage=100%, E-value=6e-83, Identity=71%"; Hit description=1,2 -dihydroxy-3-keto-5-methylthiopentene dioxygenase 4
  Pfam annotation: Domain name=ARD; Domain location=171-346; Score =254.6; E_value=2e-73; Accession=PF03079.5; Description=ARDARD' family
  Pfam annotation: Domain name=AraC_binding; Domain location=260-375; Score=-2.1; E_value=0.055; Accession=PF02311.9; Description=AraC -like ligand binding domain
  Pfam annotation: Domain name=Cupin_2; Domain location=266-338; Score =26.6; E_value=8.6e-05; Accession=PF07883.2; Description=Cupin domain
  Pfam annotation: Domain name=Zim; Domain location=1-29; Score=38.7; E_ value=2.1e-08; Accession=PF06200.4; Description=ZIM motif
  Pfam module annotation: Pfam domain module=ARD::AraC_binding::Cupin _2::Zim; Domain location=171-346::260-375::266-338::1-29
MTIFYCGKVNVYDRVSPDKARAIMQLATSPVQLTQDDPLNGNAAVWTSPCHLPMDKDVLVPVDTTILQVAQADKMVEYPLQYREKGSIARDAGKKLTGITSSNFEMYLNLPVKVHSSNGNSSRSSTSSPPQPRLPLVSSGSDQLKVALPIDLNDKERTSQSKKGVSFMAIEAWLMDDSNEDPRLSHRRNPNESVSLDQLAELGVLYWKLNPTIYENDQELTKIRQDRGYNYMSLRLNMFLPVDESISIIKENKDLLDLCPEKVENYEQKLKNFYTEHIHQDEEIRYCLEGSGYFDVRDKDDRWIRILIKAGDLIILPAGIYHRFTLDPSNYVKLMRLFKGEPVWTAYNRPQEDNPARKEYIKGLTEKFGVPLAAH

SEQ ID NO: 199291 - protein, 40 aa, Glycine max
  Coding DNA Sequence Number=SeqID_82513
MGAIEHSLHNWVIRQTNINTMFHVRAKENPEEEAAKHCWS

SEQ ID NO: 199292 - protein, 238 aa, Glycine max
  Coding DNA Sequence Number=SeqID_82514
  Gene Ontology: Mol. function=oxidoreductase activity, acting on single donors with incorporation of molecular oxygen, incorporation of two atoms of oxygen; Cellular component=plasma membrane; Biological process=...
  Gene Ontology: Biological process=methionine biosynthetic process
  Homolog annotation: Hit_ID=Q8W108; Match level="QueryCoverage=97%, HitCoverage=97%, E-value=9e-87, Identity=65%"; Hit description=1,2 -dihydroxy-3-keto-5-methylthiopentene dioxygenase 3
  Pfam annotation: Domain name=ARD; Domain location=14-168; Score =274.6; E_value=2e-79; Accession=PF03079.5; Description=ARDARD' family
  Pfam annotation: Domain name=Cupin_2; Domain location=88-160; Score =20.9; E_value=0.0024; Accession=PF07883.2; Description=Cupin domain
  Pfam module annotation: Pfam domain module=ARD::Cupin_2; Domain location=14-168::88-160
MVSSDKDPREEVLQAWYMDDSDEDQRLPHHKEPKEFVSLDQLAELGVLSWKLDADNHENDPELKKIREERGYTYMDVCEVCPEKLPNYEQKIKSFFEEHLHTDEEIRFCAAGSGYFDVRDCNDAWIRVWVKKGGMIILPAGIYHRFTLDESNYIKFISVSKRFQSCVGFGEGICSCLYPRQVERLSPCPLGHKALRFFVGEPVWTPHNRPNDHLPARQQYVKDFVEKDVGNHAVDAAA

SEQ ID NO: 199293 - protein, 382 aa, Glycine max
  Coding DNA Sequence Number=SeqID_82515
  Gene Ontology: Mol. function=oxidoreductase activity; Cellular component=intracellular; Biological process=auxin mediated signaling pathway
  Homolog annotation: Hit_ID=Q338B1; Match level="QueryCoverage=97%, HitCoverage=98%, E-value=1e-135, Identity=62%"; Hit description =Auxin-induced protein PCNT115, putative, expressed
  Pfam annotation: Domain name=Aldo_ket_red; Domain location=14-353; Score=198.5; E_value=1.6e-56; Accession=PF00248.11; Description =Aldoketo reductase family
MEKAHMQVPRVKLGNQGLEVSRLGFGCGGLSGIYNAPLSHEEGCSIIKEVFNKGVTFFDTSDLYGQNHDNEIMVGKVLKAHNHIVLVSNCNNLISHLLTVHSQIDLYLDEALKQLPREKVQLATKFGVTVSGPDGLDFGVKGTPEYVRQCCEASLKRLDVDHIDLYYQHRVDTSVPIEDTMGELKQLVNEGKIKYIGLSEANADTIRRAHAVHPITALQMEYSLWTRDIEEEIIPLCRQLGIGIVAYSPLGRGFFAGKAVVETLPSQSLLSMHPRFTGENLEKNKLFYKRLDDLASKHACTPSQLALAWLLHQGNDIIPIPGTTKLKNFENNIGSLTVKLTEEDLRELSEAVPVYEVAGTREYGMLSNYTWKFATTPPKQLS

SEQ ID NO: 199294 - protein, 542 aa, Glycine max
  Coding DNA Sequence Number=SeqID_82516
  Gene Ontology: Cellular component=integral to membrane
  Homolog annotation: Hit_ID=Q5ZBZ3; Match level="QueryCoverage=96%, HitCoverage=73%, E-value=0.0, Identity=66%"; Hit description =Putative dymeclin
  Subcellular localization annotation: CTP_CleavageSite=87; ConfidenceScore=5.28e-01
MSTQLLCGPSPGPNDVNPFLDAAMDQDSSLVGAVVRRLLLNFMVRSNVPSNRATYSILYDGNQSSVLQRVGSAAANIVLFPFSYLVSSGGEESKSPIADISIHVLLVLVHYHKCLVSEDYANHKSSTSDSLLKENPHFSDNPYCKALEHAIDCEYIEGNAHSAPHIKLPFASLFDTLGICLADEAAVLLLYSLLQGNSAFLEYVLVRTDLDTLLMPILEALYNAPSRTANQIYMLLIILLILSQDSSFNASIHKLILTGVPWYKERLLHQTSLGSLMVVILIRTVQYNLSKLRDVYLQTTCLATLANVAPHVHRLSAYASQRLVSLFDMLSRKYIKLAERRDNKLHTAKGDSEGNNLVEDMTLLVQSTELHIYTDFLRLVLEIINAILTYALPRNPEVVYAIMHRQEVFQPFKNHPRFNELIDNIYTVLDFFNSRMDAQREDGDWSVHEVLQVIIVNCRSWRGDGMKMFTQLRFTYEQESHPEEFFIPYVWQLVLSRCGFSFNTGAINLFPVDLQTERLENGVVGTTLQNGDFDKPEYQLDP

SEQ ID NO: 199295 - protein, 608 aa, Glycine max
  Coding DNA Sequence Number=SeqID_82517
  Gene Ontology: Mol. function=microtubule motor activity; Cellular component=microtubule associated complex; Biological process =microtubule-based movement
  Homolog annotation: Hit_ID=Q5VQ09; Match level="QueryCoverage=95%, HitCoverage=64%, E-value=0.0, Identity=67%"; Hit description =Putative kinesin
  Pfam annotation: Domain name=Arm; Domain location=339-379; Score =14.6; E_value=0.18; Accession=PF00514.13; Description=Armadillobeta -catenin-like repeat
  Pfam annotation: Domain name=Arm; Domain location=380-421; Score =33.7; E_value=6.5e-07; Accession=PF00514.13; Description =Armadillobeta-catenin-like repeat
  Pfam annotation: Domain name=Arm; Domain location=422-463; Score =22.0; E_value=0.0022; Accession=PF00514.13; Description =Armadillobeta-catenin-like repeat
  Pfam annotation: Domain name=Arm; Domain location=464-504; Score =19.8; E_value=0.0097; Accession=PF00514.13; Description =Armadillobeta-catenin-like repeat
  Pfam annotation: Domain name=Arm; Domain location=514-554; Score=6.4; E_value=1.9; Accession=PF00514.13; Description=Armadillobeta-catenin -like repeat
  Pfam annotation: Domain name=Arm; Domain location=555-596; Score=0.6; E_value=10; Accession=PF00514.13; Description=Armadillobeta-catenin -like repeat
  Pfam annotation: Domain name=Kinesin; Domain location=3-113; Score= -98.7; E_value=4.7e-08; Accession=PF00225.13; Description=Kinesin motor domain
  Pfam module annotation: Pfam domain module=Arm::Arm::Arm::Arm::Arm::Ar m::Kinesin; Domain location=339-379::380-421::422-463::464-504::514 -554::555-596::3-113
MKQKMKINNIFSKPNKLQYSLFRVAFEIGSEGHMLEEAKSINLSLSSLGKCINALAENNAHVPFRDSKLTRMLRDSFGGTARTSLIVTIGPSPRHRGETSSTILFGQRAMKVENMLKIKEEFDYKSLSRKLEIQLDKLIAENERQQKAFEDEVEKVNFEAQCRIAEVERNFADALEKERLKCQMEYMELVKELEQKLVLNQERHDCNSFVADNEEGPASSSTDDVAEVKMLLETERNRRKAAEEEVEHLKSQLGKHTQAEAGGDVEIIKLRNLLEDEANQKKRLEEEIILLRSQLLQLNFEADQMRRCLDGSSGSTYSAMDSSTTQVRHSQFKDVANGQKSSVATLFEQVGLQKILSLLESDDANVRIHAVKVVANLAAEEANQKRIVEAGGLTSLLMLLRRYEDETVRRVAAGAIANLAMNEANQELIMAEGGITLLSMTASDAEDPQTLRMVAGAIANLCGNDRILMTLRSQGGIKALLGIVRCGHPDVLSQVARGIANFAKCESRASNQGIKSGRSFLIEDGALPWIVQNANNEAAPIRRHIELALCHLAQHEVNAKDLISGGALWELVRISRDCSREDIRNLARRTLSSVSTFKLELRRLRIDF

SEQ ID NO: 199296 - protein, 1366 aa, Glycine max
  Coding DNA Sequence Number=SeqID_82518
  Gene Ontology: Mol. function=ARF guanyl-nucleotide exchange factor activity; Cellular component=intracellular; Biological process =regulation of ARF protein signal transduction
  Homolog annotation: Hit_ID=Q9LZX8; Match level="QueryCoverage=99%, HitCoverage=76%, E-value=0.0, Identity=75%"; Hit description=Guanine nucleotide exchange factor-like protein
  Pfam annotation: Domain name=DUF1981; Domain location=748-833; Score =167.7; E_value=3e-47; Accession=PF09324.1; Description=Domain of unknown function (DUF1981)
  Pfam annotation: Domain name=Sec7; Domain location=197-382; Score =334.6; E_value=1.7e-97; Accession=PF01369.11; Description=Sec7 domain
  Pfam module annotation: Pfam domain module=DUF1981::Sec7; Domain location=748-833::197-382
MAMKVLCLSKLSCSIFISLVSRFRAGLKAEIGVFFPMIVLRVLENVSQPNFQQKMTVLRFLDKLCVDSQILVDIFINYDCDVNSSNIFERMVNGLLKTAQGVPPGVMTTLLPPQEATLKLEAMKSLVAVLKSMGDWMNKQLRIPDPHSAKKVEATDNSPESGGFTMVNGNGEDPVDGSDSQSEVSNDVSDVSTIEQRRAYKLELQEGISLFNRKPKKGIEFLINANKVGDSPEEIAAFLKDASGLNKTLIGDYLGEREELSLKVMHAYVDSFNFQGMEFDEAIRVFLQGFRLPGEAQKIDRIMEKFAERYCKCNPKAFSSADTAYVLAYSVIMLNTDAHNPMVKNKMSANDFIRNNRGIDDGKDLPEEYLRALFERISRNEIKMKENDVAPQQKQAVNPNRLSGLDSILNIVIRKRGEGNMETSDDLIRHMQEQFKEKARKSESIYYAATDVVILRFMIEVCWAPMLAAFSVPLDRSDDEVVISLCLEGFRYAIHVTSVMSMKTHRDAFVTSLAKFTSLHSPADIKQKNVDAIKAIVVIADEDGNYLQEAWEHILTCVSRFEHLHLLGEGAPPDATFFAFPQNDSEKTKPAKSTILPVLKKKGPGRMQYAAATLMRGSYDSAGIGSNGSGVTSEQVNNLVSNLNMLEQVGSSEMNRIFTRSQKLNSEAIIDFVKALCKVSMEELRSPSDPRVFSLTKIVEIAHYNMNRIRLVWSSIWHVLSDFFVTIGCSANLSIAIFAMDSLRQLSMKFLEREELANYNFQNEFMKPFVIVMRKSSAVEIRELIIRCVSQMVLSRVNNVKSGWKSMFMVFTTAAYDDHKNIVLLAFEIMEKIIRDYFPYITETESTTFTDCVNCLIAFTNSRFNKEISLNAIAFLRFCATKLAAGDLGSSSRNKDKEVTGKISSSSAQTGKEGKKDNGEVIDKDDHLYFWFPLLAGLSELSFDPRPEIRKSALEVLFETLRNHGHLFSLPLWERVFESILFPIFDYVRHSIDPSGSSSPINEVEADGELDQDAWLYETCTLALQLVVDLFVNFYDTVNPLLRKVLMLLVSFIKRPHQSLAGIGIAAFVRLMSNAGGLFSDEKWLEVVFSLKEAANATLPNFLFVESEDFTKNQEHASTAEDDRDRAESGSPDNLESLRIRRLYTHLTDAKCRAAVQLLLIQAMMEIYNMYRPHLSAKAMLVLFDALHDVAIHAHQINGNTILRSKLQEFGSVTQMQDPPLLRLENESYQTCLTFLQNLVIDKPPSYEVDEVESHLIQLCQEVLEFYIEVAGFEQKSESSHGRQQHWLIPLGTGKRRELAARSPLIVATLQAICSLGDTSFEKNLSHFFPLISSLVRCEHGSKDVQVALSDMLSLSVGPILLQSCG

SEQ ID NO: 199297 - protein, 69 aa, Glycine max
  Coding DNA Sequence Number=SeqID_82519
MELCASSSQRSPQPLKDEGSKGSGVVEEGDKSACHRFFYPYKIEDKYGNLQQSTHPAQSRPPGKGDVID

SEQ ID NO: 199298 - protein, 95 aa, Glycine max
  Coding DNA Sequence Number=SeqID_82520
  Homolog annotation: Hit_ID=Q9SKD8; Match level="QueryCoverage=58%, HitCoverage=15%, E-value=7e-11, Identity=57%"; Hit description =Expressed protein
MEVLHGGIYLNKFGVKVYYFIKGSDIILFSKLTVVETSEELQSSTQASHEPKSEQPNNHTTDAPVTDTGSASATSNDSKKVSRQDIEFVRIYILC

SEQ ID NO: 199299 - protein, 430 aa, Glycine max
  Coding DNA Sequence Number=SeqID_82521
  Gene Ontology: Mol. function=nucleic acid binding; Cellular component= intracellular; Biological process=multicellular organismal development
  Homolog annotation: Hit_ID=Q8H2U4; Match level="QueryCoverage=77%, HitCoverage=74%, E-value=6e-86, Identity=49%"; Hit description =Pentatricopeptide (PPR)repeat-containing protein-like
  Pfam annotation: Domain name=PPR; Domain location=188-222; Score =18.9; E_value=0.018; Accession=PF01535.11; Description=PPR repeat
  Pfam annotation: Domain name=PPR; Domain location=223-257; Score =26.3; E_value=0.00011; Accession=PF01535.11; Description=PPR repeat
  Pfam annotation: Domain name=PPR; Domain location=258-292; Score =31.0; E_value=4.2e-06; Accession=PF01535.11; Description=PPR repeat
  Pfam annotation: Domain name=PPR; Domain location=293-327; Score =24.4; E_value=0.00039; Accession=PF01535.11; Description=PPR repeat
  Pfam annotation: Domain name=PPR; Domain location=328-362; Score =25.5; E_value=0.00019; Accession=PF01535.11; Description=PPR repeat
  Pfam annotation: Domain name=PPR; Domain location=363-397; Score=1.9; E_value=4.4; Accession=PF01535.11; Description=PPR repeat
  Pfam module annotation: Pfam domain module=PPR::PPR::PPR::PPR::PPR::PP R; Domain location=188-222::223-257::258-292::293-327::328-362::363 -397
MMGTYCNNLLCNFYHPNYSITNDVTKFCRVLTRGNSLCQNPVYFGLRKHRFDSVLVSVGLEEVVKEEGKEDNDRRYRWIEVGKNVPKEQQQAISKLPFRMADRCKALMRQIICYSAEKGSMSDLLRSWVKLMKPTRADWLSVLKELKIREHPVYLEGNAVFSSNHLNLLVCRVAKHALMEESFEVNIRDYTKIIHYYGEHNLLEDAEKFLTLMKQRGFIYDQVILTTMVHMYSKAGNHDRAKEYFEEIKLLGKPLDKRSYGSMIMAYIRAGMPEEGENLLQEMEAQEILAGSEVYKALLRAYSMIGNAEGAQRVFDAIQLAGITPDDKICSLVVNAYVMAGQSQKALIAFENMRRAGIKPSDKCIASVLVAYEKESKINTALEFLIDLERDGIMVEEEASAVLAKWFRKLGVVEEVELVLRDFVTSNQIS

SEQ ID NO: 199300 - protein, 73 aa, Glycine max
  Coding DNA Sequence Number=SeqID_82522
MEGSLEHTMLRLADPGEEERESAQSMLPQHSAVGMTSCLSVTSRSCRALSQGTYLYVKNVAKKDRMGDEWEVG

SEQ ID NO: 199301 - protein, 148 aa, Glycine max
  Coding DNA Sequence Number=SeqID_82523
  Gene Ontology: Mol. function=nucleic acid binding; Cellular component= intracellular; Biological process=regulation of transcription
  Homolog annotation: Hit_ID=Q9SVY1; Match level="QueryCoverage=85%, HitCoverage=32%, E-value=1e-60, Identity=77%"; Hit description=Zinc finger-like protein
  Pfam annotation: Domain name=zf-C2H2; Domain location=71-93; Score =20.4; E_value=0.0065; Accession=PF00096.16; Description=Zinc finger, C2H2 type
  Pfam annotation: Domain name=zf-C2H2; Domain location=97-122; Score =3.8; E_value=4.1; Accession=PF00096.16; Description=Zinc finger, C2H2 type
  Pfam module annotation: Pfam domain module=zf-C2H2::zf-C2H2; Domain location=71-93::97-122
MQMHMWGHGSQYRKGSNSLRGSKAGSLMLRLPCYCCEEGCKNNINYPRSKPLKDFRTLKTHYKRKHGEKPFECRKCHKPFAVRGDWRTHEKNCGKLWFCVCGSDFKHKRSLKDHVRAFGNGHASHNLSEERGDEGGDDDSEVAVFTFK

SEQ ID NO: 199302 - protein, 120 aa, Glycine max
  Coding DNA Sequence Number=SeqID_82524
TKTYENDDLKVTVVTSEINPEDGSYPSERKEAAVIPPSVVSDKRQGVPISNKKSFKKVAKQRSRPRPSRFGRVSSSWLPNWFLMSMTGVSSSGLFLTFHFGDSRVMEETPNFSPFLLVNR

SEQ ID NO: 199303 - protein, 255 aa, Glycine max
  Coding DNA Sequence Number=SeqID_82525
FFGGAGATGIVRPPWTPTAADPTNQGPAGGGLALPPEPKVGPSGARVSTKESCVDPSGNNPETGDSDKCGLYIEENPSRLVTLGRLYEGSTAVYNIPLLHGQVKVGVEEVKDAKAPVLVSTDEAAAKPPERLDPKVDDLLYLMTLTIPQLFLKSLQVMWDATVFGRSGQSQFESESYIKSWMQSSKHDVYLGAYQNGGHWQIVVILPKENLVVWFCSLHNRPDNYLKGIIKSAFKGLDDTPQPKSKAGAWWIVVK

SEQ ID NO: 199304 - protein, 136 aa, Glycine max
  Coding DNA Sequence Number=SeqID_82526
  Gene Ontology: Mol. function=diacylglycerol kinase activity; Cellular component=membrane fraction; Biological process=protein kinase C activation
  Homolog annotation: Hit_ID=Q4SN93; Match level="QueryCoverage=91%, HitCoverage=14%, E-value=7e-22, Identity=38%"; Hit description =Chromosome 8 SCAF14543, whole genome shotgun sequence
  Pfam annotation: Domain name=DAGK_cat; Domain location=4-136; Score =86.0; E_value=1.2e-22; Accession=PF00781.14; Description =Diacylglycerol kinase catalytic domain
RPKRLFVFVNPFGGTKSAVIVFRDQVKPLLEDAQVQLTVQETKHQLHAKQVVQSLDFSKYDGIVCVSGDGILVEFVPSTIVIVVVNGLLQRQDWDTAIKMPLGVVPAGTGNGMAKSLLDSVGDPCTVPNAVLAIIR

SEQ ID NO: 199305 - protein, 184 aa, Glycine max
  Coding DNA Sequence Number=SeqID_82527
  Gene Ontology: Mol. function=diacylglycerol kinase activity; Biological process=protein kinase C activation
  Homolog annotation: Hit_ID=Q00YM9; Match level="QueryCoverage=49%, HitCoverage=68%, E-value=6e-10, Identity=36%"; Hit description=[IT] KOG1116 Sphingosine kinase
ALTRILHLRHYIGCLYFVPAPGFEAYGDPTSYPGSSNNKGSNSELIDEEPLKLQRLGYQGPEIDLENQSWRVLNGPFISVWLHNVAWGAENTKAAPDAKFSDGYLDLIITKNCPKLPLLSLMSDLNNGGHVKVLVLEPGPRLGDQEKEGIIDADGEVLARGKGSYQCEQKALMAYDKLQITVDQ

SEQ ID NO: 199306 - protein, 281 aa, Glycine max
  Coding DNA Sequence Number=SeqID_82528
  Gene Ontology: Mol. function=protein transporter activity; Cellular component=integral to membrane; Biological process=intracellular protein transport
  Homolog annotation: Hit_ID=Q69X85; Match level="QueryCoverage=90%, HitCoverage=91%, E-value=8e-94, Identity=63%"; Hit description =Putative syntaxin-related protein Nt-syr1
  Pfam annotation: Domain name=SNARE; Domain location=185-247; Score =90.6; E_value=4.7e-24; Accession=PF05739.9; Description=SNARE domain
  Pfam annotation: Domain name=Syntaxin; Domain location=32-134; Score =82.2; E_value=1.6e-21; Accession=PF00804.15; Description=Syntaxin
  Pfam module annotation: Pfam domain module=SNARE::Syntaxin; Domain location=185-247::32-134
MNDLFSNSFKKYSNLKQQAHLDDVEAGKETVNLDKFFEDVENVKEEMRTVEKLHRKLQEANEESKVVHNAKTMKELRARMDKDVEQVLKRVKVIKGKLEALERSNAANRNIPGCGPGSSADRTRTSVMEYKETVERRYFTITGEKPDKETIENLIWSGESESFLQRAIQEQGKGQIMDTISEIQERHDAVKEIEKNLIELHQVFLDMAALVESQGQQLNNIESHVAHASSFVRRGTDQLQDAREYQKSSRKWTCYAIILGLVLLLVLLFPILINLLPHLLR

SEQ ID NO: 199307 - protein, 83 aa, Glycine max
  Coding DNA Sequence Number=SeqID_82529
  Subcellular localization annotation: CTP_CleavageSite=29; ConfidenceScore=5.07e-01
MVLLKTTTQCWSRMPAIFKSPPAGVAHPRVALLREKMETTEFASPTTIPTLTCPRFGIGRPENLLGKLLPPFIMPLALAPAIP

SEQ ID NO: 199308 - protein, 582 aa, Glycine max
  Coding DNA Sequence Number=SeqID_82530
  Gene Ontology: Mol. function=oxidoreductase activity; Cellular component=mitochondrion; Biological process=electron transport
  Homolog annotation: Hit_ID=Q8H5X6; Match level="QueryCoverage=88%, HitCoverage=86%, E-value=0.0, Identity=71%"; Hit description =Putative NADH dehydrogenase
  Pfam annotation: Domain name=Pyr_redox; Domain location=282-382; Score=40.1; E_value=7.6e-09; Accession=PF00070.17; Description =Pyridine nucleotide-disulphide oxidor
  Pfam annotation: Domain name=Pyr_redox_2; Domain location=114-426; Score=85.5; E_value=1.6e-22; Accession=PF07992.4; Description =Pyridine nucleotide-disulphide oxidor
  Pfam module annotation: Pfam domain module=Pyr_redox::Pyr_redox_2; Domain location=282-382::114-426
MALARIARANLRRSGGALGSSAHEKDMFNVGGYTSRSNIPSHKFFESDRKFSYVPRIKEQNYINFSMRGISGTPYDHFPSASTQTVIEESEYEFESDRQRYAGLQPTKPGEKPRVVVIGTGWAACRFLKGIDTRIYDVVCISPRNHMVFTPLLASTCVGTLEFRTVAEPVSRIQDSLARDPNSYFFLASCTGIDTGKHEIYCEAVNNGGLPQEPYQFKVAYDKLVIASGSEPLTFGIKGVKENAFFLREVNHAQEIRKRLLLNLMLSENPGISEEDKKRLLHCVVIGGGPTGVEFSGELSDFIMRDVQERYTHVKDYIHVTLIEANEILSSFDVSLRQYATKHLTKSGVRLMRGVVKEVHPKKIILSDGTEVPYGLLVWSTGVGASEFVKTLDLPKSQGGRIGVDDWLRVPSVEDVFALGDCAGFLEHTGRPVLPALAQLTSIYVYSRTWNDIKPLSECPFGSCSGGLLKRVAERQGKFLVELFDEIGNQNGGKAYSAKGMPLGEPFVYKHLGSMASVGGYKALVDLRQSKDSKGLSLAGFVSWMIWRSAYLTRVLSWRNRFYVAVNWATTLVFGRDNSRIG

SEQ ID NO: 199309 - protein, 298 aa, Glycine max
  Coding DNA Sequence Number=SeqID_82531
  Gene Ontology: Mol. function=endonuclease activity; Biological process=DNA catabolic process
  Homolog annotation: Hit_ID=Q9ZR87; Match level="QueryCoverage=92%, HitCoverage=84%, E-value=1e-113, Identity=66%"; Hit description =Bifunctional nuclease
  Pfam annotation: Domain name=S1-P1_nuclease; Domain location=23-289; Score=564.8; E_value=8.3e-167; Accession=PF02265.7; Description=S1P1 Nuclease
MGYERVRVLFLLFLIPLPTVLGWGKEGHYATCKIAQEYLSEDALFAVKQLLPDSAQGDLAAVCSWADEVGHTHRYHWSSALHYVDTPDFKCNYEYCRDCHDSYRHEHRCVSGAIYNYTMQLKSADAGISSEFNYNLTEALMFLSHFVGDIHQPLHVGFTGDLGGNTITVHWYRRKANLHYVWDDLIIQSALKTFYDSDLSIMIQAIQRNITDNWLNDVSTWEHCAHNYTACPNRYASESISLACKFAYRNATPGSTLKDEYFLSRLPVVEKRLAQGGVRLAAILNRIFTSSKTRIAQA

SEQ ID NO: 199310 - protein, 77 aa, Glycine max
  Coding DNA Sequence Number=SeqID_82532
  Homolog annotation: Hit_ID=Q43457; Match level="QueryCoverage=39%, HitCoverage=10%, E-value=1e-07, Identity=83%"; Hit description=Heat shock transcription factor 34
MQGFRKIVPDIWEFANEHFKRGQKKLLFEIMRQGSCGSENMIKLLKILALLGSGDKQASGHMYTVLGDIMRGNRRRG

SEQ ID NO: 199311 - protein, 205 aa, Glycine max
  Coding DNA Sequence Number=SeqID_82533
  Homolog annotation: Hit_ID=Q1SDE1; Match level="QueryCoverage=30%, HitCoverage=15%, E-value=2e-23, Identity=85%"; Hit description=Heat shock protein Hsp70
MGKNRGNKQTYIGIELSNKAGEVVVLEIFWKQILCKIHMLPHHKSVPTFNMGAGYCDVVVTATSGGVSQIKALARSTIGGEDLLQNMMHHLLPNSENLFKNHGVKEIKQMGTVNGFAPKYKNLTEAQKQPGPLGPSRLFLQKAVASGGSNLARLGELGGKLLPYFPINRGRSEEEKGSALLVLRNHLKLVKKIVSVKKIQAEALP

SEQ ID NO: 199312 - protein, 81 aa, Glycine max
  Coding DNA Sequence Number=SeqID_82534
MRLKHGHMVLGQGFTHEEKRGCWFKEIRTNVEKGKKREPNKLEALQEDQGEADSATEQDQAEKKVKKWKRLARDKREKGSQ

SEQ ID NO: 199313 - protein, 52 aa, Glycine max
  Coding DNA Sequence Number=SeqID_82535
MWVRWKKLNNGGKEREGVAVTWHPLRCCIRLTQNRSKVIESSICGALRCVNP

SEQ ID NO: 199314 - protein, 298 aa, Glycine max
  Coding DNA Sequence Number=SeqID_82536
  Gene Ontology: Mol. function=transferase activity; Cellular component= integral to membrane; Biological process=biosynthetic process
  Homolog annotation: Hit_ID=Q2QN13; Match level="QueryCoverage=88%, HitCoverage=92%, E-value=7e-67, Identity=65%"; Hit description =Glycosyl transferase, group 1 family protein, expressed
  Pfam annotation: Domain name=Glycos_transf_1; Domain location=90-272; Score=84.7; E_value=2.8e-22; Accession=PF00534.10; Description =Glycosyl transferases group 1
MIITALITAILAGLCIGPINGRRRRKRAVAFFHPYTNDGGGGERVLWCAVRGIQEESPDLDCYVYTGDHDATPQSLMARALDRFGVALLSPPKVLPLERSAEIPVLISVAQFRPEKAHTLQLEAFSAAIKRLDPSLPKPKFQIVGSCRNKSDEDRLQMLKEKAIELNVNEHMEFHKNVTYRDLVGLLGGAVAGIHSMTDEHFGISVVEYMAAGAIPIAHNSAGPKMDIVLDEEGQQTGFLACSVEEYADAMVRIVSMPEMERLKMAAAARRRAGRFSEQRFYDDFKAAVHPILCHISR

SEQ ID NO: 199315 - protein, 372 aa, Glycine max
  Coding DNA Sequence Number=SeqID_82537
  Gene Ontology: Mol. function=metal ion binding; Biological process =protein amino acid phosphorylation
  Homolog annotation: Hit_ID=Q1PFR9; Match level="QueryCoverage=77%, HitCoverage=99%, E-value=2e-51, Identity=40%"; Hit description=Zinc finger family protein
  Pfam annotation: Domain name=zf-C3HC4; Domain location=315-356; Score= 34.1; E_value=4.9e-07; Accession=PF00097.15; Description=Zinc finger, C3HC4 type (RING finger)
MGILEVLFPFFVFPVIYAVATSNDCQFSVCGNNSVLIRFPFQLDGDRNPYCGYPGFNLTCTNNSKTVLKLPYSGAFYVRSINYLTQKIQVYDPDDCLPKRLLTLNVSGSPFIPTFTRDYTFLSCPFQNAGSQFIPIDCLSNSTNFVSAVPTLNLTNPLPESCNVITRVSVPVSGPEQQYEENHRDELSEDLRLTWDRPDCRYCESGQQLCGFDPDNNGQLFCFPGYQTVTSRRGAQVFRIITFCIAGPAAVIAIVMACCVCYKDRLTNRSALAATISPVPQIATTGLDESTIESYEKMVVGESRRVPGPNNNGCCWICLSEYNSKETIRLIPECKHCFHADCIDEWLRINTTCPVCRNSPSPSPLHVTSIDP

SEQ ID NO: 199316 - protein, 657 aa, Glycine max
  Coding DNA Sequence Number=SeqID_82538
  Gene Ontology: Mol. function=voltage-gated potassium channel activity; Cellular component=integral to membrane; Biological process=potassium ion transport
  Homolog annotation: Hit_ID=Q9LM04; Match level="QueryCoverage=96%, HitCoverage=92%, E-value=0.0, Identity=59%"; Hit description=Cyclic nucleotide-gated calmodulin-binding ion channel
  Pfam annotation: Domain name=Ion_trans; Domain location=100-369; Score=66.1; E_value=1.1e-16; Accession=PF00520.21; Description=Ion transport protein
  Pfam annotation: Domain name=cNMP_binding; Domain location=470-570; Score=19.5; E_value=0.0045; Accession=PF00027.19; Description=Cyclic nucleotide-binding domain
  Pfam module annotation: Pfam domain module=Ion_trans::cNMP_binding; Domain location=100-369::470-570
  Subcellular localization annotation: CTP_CleavageSite=28; ConfidenceScore=5.21e-01
DWKSLSSSSIEHNDSSNGGFLKRKVQPSLSSVSDGSITNLSCRNHVLDPQGATLQKWNKIFVITSVMAISVDPLFFYIPMIDDKKQCLALDGTLKITASVLRTFFDLFYILHIIFQFRTGFIAPSSRVFGRGELVNDPWAIVMRYLSSYFIIDILSIIPLPQLVILAMIPFPKCSVPYVGKDLLKYTIIAQYVPRILRIYPLFKEVTSTSGILTETAWAGAAYNLFLYMLASHVVGAFWYLFSVESRLRCWRRRLKNTTFLHESYLSCGSGNSTVQSLLKSSCPLTDPQQIQHLETFNFGIFIEALKARVVESNTDFPHKFFYCFWWGLRSVSSVGQGLETSTYAGEIIFAIFIAVFGLILFASLIGNMQKYLQSTTVRVEEMRIKRRDAELWMSHRMLPDFLKERIRRYEQYKWQENRGVEEETLIRNLPKDLRRDIKRHLCIDLLKKVPMFENMDNQLLDALCDKLKPVLYTEKSYIVREGDPVDEMLFIMRGKLATATTNGGRTGFFNSFEIKAGDFCGEELLTWALDPNSSSNLPISTRTVETISEVEAFALMPDDLKFYSLQWKTWGACFIQAAWRRYKKKKAERLLREAEERIQALENEEGSSPSFAATIYASRFASSGLRHLRSGKRTRVPQPQRSLMPQKPDDFTAQKN

SEQ ID NO: 199317 - protein, 97 aa, Glycine max
  Coding DNA Sequence Number=SeqID_82539
MFENSGKVDEEIIGAVVEDKIDPNVVWEQGVKGAAQSGNPPKVDSKVEVLHKKPSEHNTYSDIEASYKCPEESYNVKQEDIPFWVICWQGPHFGSCS

SEQ ID NO: 199318 - protein, 82 aa, Glycine max
  Coding DNA Sequence Number=SeqID_82540
MGDVCGAVVLAAGWGGGVLTMKKDNFVLYLLLWRNNAHWYGGGGGDSGWSLGQKKRRRPLSLAEQLHGDTRNFFYNKEKGVV

SEQ ID NO: 199319 - protein, 269 aa, Glycine max
  Coding DNA Sequence Number=SeqID_82541
  Gene Ontology: Mol. function=protein kinase activity; Cellular component=integral to membrane; Biological process=protein amino acid phosphorylation
  Homolog annotation: Hit_ID=Q2LJM0; Match level="QueryCoverage=79%, HitCoverage=36%, E-value=6e-34, Identity=41%"; Hit description =Putative receptor kinase
MDTFLKIENQLTTLVACVWEKSNRLCNTTIRLQNNALSGHVPDLSASLLNLTVQNVTNNELRSHVPDSMLTVLFGNHALSSSSFPQTSSVTVPNNSRKKGLRVGVIVAIVVVACVAVLVAMSFAMAHCCTRGSTSGSVVGSETAKRKNGNSIRSEKMVYGNGGNLDRDSDGTNTEMERSKLVFFDRRNQFELEDLLRALTEMLEKGSLGTVYRVVLDDGCTVAVKRLKDANLCERNEFEQYVDGCIVDVVRKMPPLHGLKNAIQGVLRR

SEQ ID NO: 199320 - protein, 109 aa, Glycine max
  Coding DNA Sequence Number=SeqID_82542
MHVNKGSTSYVEHLAVSTDKIALGVCHYCCWRHQCLLSKYRQEEWRHESYVEHLARAAGGIAFSLLLLAASQGESLFLLAASLESLMQLAASNKKQTPTAISFKRNPDA

SEQ ID NO: 199321 - protein, 76 aa, Glycine max
  Coding DNA Sequence Number=SeqID_82543
MQSSKCDVYLGAYLNGALKGLDDAPQTKSKAPARWIVVKFNRQKGSIECDYYVMHWMSTIILESFRNNWEVYFNDA

SEQ ID NO: 199322 - protein, 318 aa, Glycine max
  Coding DNA Sequence Number=SeqID_82544
  Gene Ontology: Mol. function=microtubule binding; Cellular component =phragmoplast; Biological process=positive regulation of microtubule polymerization
  Homolog annotation: Hit_ID=Q5N7P7; Match level="QueryCoverage=59%, HitCoverage=56%, E-value=3e-21, Identity=56%"; Hit description =Microtubule-associated protein-like
GCNAAGNRTKCLDLYRKEVDVAKLCRAQIQQEIADYVAEIAGVCAAMGEQPLHFDPKACGSLKKARETVVSQLEEMRKLKTDRKKHFSEVLYQLKNISSELYGSMVANAYSDETNLSLKRLEELQKQLLQLQNEKTKEEALSRKEILEKVEKWLVACQEESWLEEYNRDDNRYNAGRGAHLTLKRAEKARALLSKIPGKDNSKASGHSVKTASSSENGIEIQSSFTRKPLSPVSPAVLSKANISNLGHDSLMPYIAGDEENMTPKNMALPVPTTPLTLVPMLTANTPDSVYSGATAASKTSQSFEYSFEEGLSKTYAQ

SEQ ID NO: 199323 - protein, 463 aa, Glycine max
  Coding DNA Sequence Number=SeqID_82545
  Gene Ontology: Mol. function=catalytic activity; Cellular component =integral to membrane; Biological process=Mo-molybdopterin cofactor biosynthetic process
  Homolog annotation: Hit_ID=Q9ZPI4; Match level="QueryCoverage=88%, HitCoverage=100%, E-value=1e-157, Identity=67%"; Hit description =Molybdopterin synthase sulphurylase
  Pfam annotation: Domain name=MoeZ_MoeB; Domain location=225-311; Score=160.9; E_value=3.2e-45; Accession=PF05237.3; Description =MoeZMoeB domain
  Pfam annotation: Domain name=Rhodanese; Domain location=349-455; Score=40.6; E_value=5.3e-09; Accession=PF00581.10; Description =Rhodanese-like domain
  Pfam annotation: Domain name=ThiF; Domain location=82-222; Score =203.9; E_value=3.6e-58; Accession=PF00899.11; Description=ThiF family
  Pfam module annotation: Pfam domain module=MoeZ_MoeB::Rhodanese::ThiF; Domain location=225-311::349-455::82-222
MSASEILRELDSLKDEKTKIEHKISALEAQLREINLQNDAAPPNASSSSSYPTNGLTQDMIHRYSRHLVLPSFGVQGQANLLKSSILVVGAGGLGAPALLYFAASGVGNMTSVYMLGVIDHDVVELNNMHRQVIHTEAYVGKPKVKSAAAACGSINSTIQVVEHEEALQTSNALEILSKYDIIVDATDNAPTRYLISDCCVVLGKPLVSGAALGLEGQLTVYNYNGGPCYRCLFPTPPPRTACQSCAEGGVLGVVPGIIGCLQALEAIKIAASVGEPLSGRMLLLDALSGRIRIVKIRGRSMQCEACGENATFTQQQFREFDYEKFTQTPLRVPPLKLNLLPRESRISSKEYSEVIIKKGPHVLVDVRPAHHFKIASLPKSLNIPLSTLEARLPEVSSALKKEEEESGAVSGSSAQLYVVCRRGNDSQRAVQYLHKMGFTSAKDIVGGLESWAHNVDHQFPTY

SEQ ID NO: 199324 - protein, 78 aa, Glycine max
  Coding DNA Sequence Number=SeqID_82546
  Subcellular localization annotation: CTP_CleavageSite=15; ConfidenceScore=5.48e-01
MVGGQFYTLLHATSRSSLVKSSSSRPFFNNTIKVFIFLHKAVVESGNLHLRNGLKLENYGQASSHLMEERALSMAKEL

SEQ ID NO: 199325 - protein, 89 aa, Glycine max
  Coding DNA Sequence Number=SeqID_82547
MWCRMKNKFGKCLLLSMKNCFTSNPQDQESVARFMEMRVTPLMSDILVVDFTKEEIKVALVQMHPTKTPRRKTTGKQGLMALKLDMSKA

SEQ ID NO: 199326 - protein, 209 aa, Glycine max
  Coding DNA Sequence Number=SeqID_82548
  Gene Ontology: Biological process=regulation of GTPase activity
  Homolog annotation: Hit_ID=Q8L8M0; Match level="QueryCoverage=76%, HitCoverage=36%, E-value=6e-11, Identity=32%"; Hit description=ARF GAP-like zinc finger-containing protein ZIGA3
MGNEKSNKHWEEKIPPNFDRSKLGIEKFIRDKYVEKRWASKEELQSTSRTGEIIYNFDESPNGGARSGILKNNRRLSLEESILANHVAQILPPITRSRGGFTFIDTQKKNSPPLKRPSSSVDFDKSTGKSNGTGDIFNLLCIYDDNQNFSTMPPSSWATFDCIPYRIMKFQASKDEMCQRFKFIACSTNPWCRSHKIIVTDDAVKWHEH

SEQ ID NO: 199327 - protein, 801 aa, Glycine max
  Coding DNA Sequence Number=SeqID_82549
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=95%, HitCoverage=97%, E-value=0.0, Identity=49%"; Hit description =Probable Na/H antiporter [imported]-Arabidopsis thaliana
  Pfam annotation: Domain name=Na_H_Exchanger; Domain location=34-413; Score=130.2; E_value=5.9e-36; Accession=PF00999.11; Description =Sodiumhydrogen exchanger family
  Pfam annotation: Domain name=Usp; Domain location=606-751; Score =10.1; E_value=0.091; Accession=PF00582.16; Description=Universal stress protein family
  Pfam module annotation: Pfam domain module=Na_H_Exchanger::Usp; Domain location=34-413::606-751
MANTIPACYEVSVLNPSRIWQTDNVLKSELPILAFQIVFTVALSRLFFFIYKPLHQPRLISQISVGFLLTPPLLGRYTAIFEFIFPVNGVLNVEVLSHIGLIYYAFLSGLEVNLDTILQVKKKPASIAAAGIIFPMVMAPGLYALHRKFYDNKAANQLEESTSFPVVAHTLSELKLLYTGLGKAALTAAMISETYGWILFTLLVPFSINGKIAVYSVLSTILFIVVCIFVLRPIFLRLIDRKTDKEELDDKQSLFVLMGVLACSYITDILGTHGIVGAFVYGLILPHGRFAEFIMSISDDFACGFLAPLFFSGNGMRLMLTSIFYQAHWPLTLLIVLLLCVPKILSTLFATFFFGMRTRDGLALGLLLNTKGAMALIMLNIAWDRAIVSIPTYAVITSAVLLMTVVVSPIINAIYKPRKRFEQNKLKTIQKLRLDAELRIQACVHNTRQATGMISIIESFNATRLSPIHVFALYLTELTGRAVALLAAHMEKPSSQPGVQNLTKSEAELQSIANAFDAFGEAHDAVRLETLNVVSAYATIHEDIHNSANEKRTSLILLPFHKQLSSEGALEVTSVVYKDINQNVMQHAPCSVGIFVDRDFGSIPKMNLRILMPFVGGPDDREALAIAWRMAGHPGIHLSVVRIILFDEATEVDTSIEAEAQGILSTVVDSEKQKELDDEYISSFRLTAVNNDDSITFSEIDAHADEDIPAILNELEKNGCDLYIVGQGNCRNSRVFSNLLKWCDCPELGVIGDILASNDFGSRSSLLVVQQYGYGGMVFGKNLNQVTTNNVGFESLVVKTE

SEQ ID NO: 199328 - protein, 107 aa, Glycine max
  Coding DNA Sequence Number=SeqID_82550
MANANDAIKPGARGKKKEEIPSTQVIKKVEENGSNCRNLIRIEEHKYIKEAMEMSVTSPIHAWLEYKRQSNLKASSNNYHKSITLNLIKSVKTEPAYGLMKPWRAWH

SEQ ID NO: 199329 - protein, 93 aa, Glycine max
  Coding DNA Sequence Number=SeqID_82551
  Homolog annotation: Hit_ID=Q10A88; Match level="QueryCoverage=99%, HitCoverage=19%, E-value=6e-10, Identity=52%"; Hit description =Rhodanese-like domain containing protein, expressed
MAYVNWLRKDNRFSNILVQISPSEKGHTFPILKLRYKSSLVQFEGGMSHLSFLDPSMRAMAYHLQNGEIDWKQSIKLILLEKITQTEITFYWM

SEQ ID NO: 199330 - protein, 56 aa, Glycine max
  Coding DNA Sequence Number=SeqID_82552
  Homolog annotation: Hit_ID=Q10A88; Match level="QueryCoverage=52%, HitCoverage=7%, E-value=7e-09, Identity=83%"; Hit description =Rhodanese-like domain containing protein, expressed
VTQGGDWVFCHSGVAGYEWDIGHFHGAQRPSVDCFRNTSFGLSQEEVGPLSDVSGT

SEQ ID NO: 199331 - protein, 72 aa, Glycine max
  Coding DNA Sequence Number=SeqID_82553
  Homolog annotation: Hit_ID=Q10A88; Match level="QueryCoverage=94%, HitCoverage=17%, E-value=5e-14, Identity=54%"; Hit description =Rhodanese-like domain containing protein, expressed
MPCDRQQGFQNLYTLKGGVSHYLKNEVPAEWVGNLFVFDSRLSLPPSIYYTGATTQAESNPVSGDDNFAKCY

SEQ ID NO: 199332 - protein, 44 aa, Glycine max
  Coding DNA Sequence Number=SeqID_82554
MKDLCNFLAGVLGMKRTQEAGECKAHLVIWQTASLFFRKLRGHS

SEQ ID NO: 199333 - protein, 712 aa, Glycine max
  Coding DNA Sequence Number=SeqID_82555
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=91%, HitCoverage=94%, E-value=0.0, Identity=70%"; Hit description =Homeodomain protein HOX3
  Pfam annotation: Domain name=Homeobox; Domain location=25-81; Score =83.4; E_value=7.1e-22; Accession=PF00046.19; Description=Homeobox domain
  Pfam annotation: Domain name=START; Domain location=225-422; Score =99.9; E_value=7.6e-27; Accession=PF01852.10; Description=START domain
  Pfam module annotation: Pfam domain module=Homeobox::START; Domain location=25-81::225-422
MEYGSGGGGSQSPGEQDGSDSQERRKRYHRHTANQIQRLESMFKECPHPDEKQRLQLSRELGLAPRQIKFWFQNRRTQMKAQHERADNCALRADNDKIRCENIAIREALKNVICPSCGAPPLNDDCYFDDQKLRLENAHLKEELDRVSSIAAKYIGRPISQLPPVQPIHISSLDLSMASYGNQGMVGPAPSSLNLDLLPAAGTSSSSMPYHPPCLSDMDKSLMSDIASNAMEEFLRLVQTNEPLWLKSNVDARDVLSCDAYERMFHKPNTRPKNPNVRIEASRDSGVVLMNTLALVDMFMDPNKWIQLFPTIVSVARTIQVISSGMMGSCSGSLQLGTWAVMDVSYDFPQDSHYAPQFRSHRCPSGCLIQDMPDGHSKITWVEHVEIEDKTLPHRLYRNLIYSGMAFGAERWLTTLQRMCERLTYLMATSNPTRDNLGGVISSPEGKRSMMKLAQRMVTNFCANISTSSGHRWTTLSGLNEIVVRVTVHKSSDPGQPNGVVLSAATTIWLPTPPHAVFNFFKDENKRPQWDVLSNGNAVQEVANIANGLHPGNSISVLRAFNNSTQNMLILQESCIDSYGSFVVYCPVDLPSINLAMSGEDPSYIPLLPNGFTILPDGQPDQEGDDGASTSSNNANRNIVRSGGSLVTIAFQILVSSLPSAKLNMESVTTVNNLIGSTESRTNHIWPLSSPHFQINQQSKKNVYGSGIDFCS

SEQ ID NO: 199334 - protein, 1036 aa, Glycine max
  Coding DNA Sequence Number=SeqID_82556
  Gene Ontology: Mol. function=protein kinase activity; Biological process=protein amino acid phosphorylation
  Homolog annotation: Hit_ID=Q9FMZ3; Match level="QueryCoverage=99%, HitCoverage=98%, E-value=4e-40, Identity=30%"; Hit description =Arabidopsis thaliana genomic DNA, chromosome 5, P1 clone:MJB21
MAKRSDFAQKLLDDLRLRKERMASSQTLSSNQSHHLPIDAYAYTKQTYRGSRNTKATEIVSTRTGEMLNSSSRSYRSVNNGQISNQMVPYGKAQSSRQTGDLSLALAFAFENGGKLRRNDSIMGFLHQIKRGTLEFSMSERQFASTSNYPMQINEISKGAQKLNQILRAGSNGLNMDSYSIQFAKELLQGAIDLEESLRMLVDQQNNSQFMITSQKKNRITLLEEDNDDNNDTGMEMQLAQPTLSFDKHTTENIQQFGKTIFMQRPITLTSSKEGRNSNNENKNVKKQVSQKRSTKTSSDIKNVNAISEGKNQMASNPEKGRIPNVIAKLMGLDILPDKVEKESKQAMLVKREGTSPKHTAKGSIKKTELKSKETDNLMPMKNQKVIEAFKVPSTQGEEMIFGANKNLLVEKTSSEVAVRNGIKTLKGFDKPSIKIDKPTKSSPQKNLTRESQKDVQEIGRKQNNPNNNNREQKGTVKGRTNDPIPNNMLSQLEQVRERSQVKSLTQEDKEINGNIVQPEKRHTNTLAMNNEKKPWNNVGVQKSYVLSKNGPHEEKHRREQQLQLREEHMLMMRPQGRSEMTSMNSPKSPHQLINPQKKQLSTNQVTLFKKNSGEKNVASMKSEGFLTNHYDPVRDEASNATNENVKEIIHRKSGQISSPRDQEFERAKRSGIKTLMDEKHINKLASKKIKNTRKQKVDMSGKIDQMLTGRNGAKLITEQGKQQIPTPDKFQVLNEAEHERVSMLRETDVHIINSNEPVSVAVTEPLDMRHQPHKEAELPPTLSSSVGGELQSQQELVAVVPNDLHCQDVQSLQDQAAPMAADEGFVTGEVELHKTNGLDEKRLCVNNSNLNISEKSIRQPLTESENCLKLILVMSQLFVNTAEALFKLNIPFNVLQGGDRENQDEGSKLTLDCGYEVMKRKGILQELKVHCYSRISMGSMNIISLDDLIRQLNKDMEKLKLYGRKKSCQADDVEDYLSKMLEHDIYDRHPDMNCMWDLGWNDETVAFIEKYDVIRDTEKHILSLLLDEITVDFCM

SEQ ID NO: 199335 - protein, 188 aa, Glycine max
  Coding DNA Sequence Number=SeqID_82557
  Gene Ontology: Mol. function=pyridoxal phosphate binding; Biological process=metabolic process
  Homolog annotation: Hit_ID=Q6ZHE5; Match level="QueryCoverage=73%, HitCoverage=35%, E-value=5e-56, Identity=71%"; Hit description =Putative 1-aminocyclopropane-1-carboxylate deaminase
MAVDLIFLAKRVFVVKLWGHNCWSVTRIVIEYIESKGISSIKTTHITHVFVHAFSVCDDPDYFHNFTQGLLDGLKAGVSSRDIVHIQNAKGLGYAMNTSEELNFVKEVATATGVVHDPVYRGKAAYAMVKDMSENPKKWEGRKILFIHTGGLLGLYDKVDQLASFVGNWQRMDVNESVPKHDGIGKMF

SEQ ID NO: 199336 - protein, 111 aa, Glycine max
  Coding DNA Sequence Number=SeqID_82558
MSLIVVAHTIMVQMGVVNGNVFKGEDDLGWVIGRRLKGEVVFVVLEVILTGKKKKGVINGNKYGVKSDGKVDKVEEEGGTREVGRGGSRGRRSRIGRAQCMGRTKHLTHRM

SEQ ID NO: 199337 - protein, 378 aa, Glycine max
  Coding DNA Sequence Number=SeqID_82559
  Gene Ontology: Mol. function=protein serine/threonine kinase activity; Cellular component=cytoplasm; Biological process=protein amino acid phosphorylation
  Homolog annotation: Hit_ID=Q9FX38; Match level="QueryCoverage=81%, HitCoverage=33%, E-value=8e-31, Identity=45%"; Hit description =Protein kinase, putative
MWVWVENGKDLRWCYVNLNRERTEREGGEGGRAAVHNNGTLFREESEWSGLCHLNSFSFRLRLGFTMSMADTNTNSVDVILDFLRRNRFTRAEAALLSEISNRPDLNAFLQKPQGQGQELIVKEIECGTKWKTTSEDLYSWKFNPTNGPVKATVSKCQTVDVIAANTNSKSGSGEENADKKSTWPASSSKASVVQSKEPRELDRQLKFNSSSLEVNFTDNPCPRKDENVNSSSDSSKDCSVKTVFPFSKGDVSTSFDGATYSYKIEEKKKVEISDTRTSIEEQVGELGRPIYLVKTPGSSEQKMIGSLSFPLPPENLKEEIPRLPPVKLKSDDKPLVVNWEEKFERDGPTSKLPGADSTLLVGSYLDVPIGQEINPSG

SEQ ID NO: 199338 - protein, 289 aa, Glycine max
  Coding DNA Sequence Number=SeqID_82560
  Homolog annotation: Hit_ID=UPI000045BB33; Match level="QueryCoverage =67%, HitCoverage=67%, E-value=4e-16, Identity=33%"; Hit description =COG4735: Uncharacterized protein conserved in bacteria
  Subcellular localization annotation: CTP_CleavageSite=53; ConfidenceScore=5.28e-01
MTATGVAVSLGLGTFSNCYCYPVPVKELLFSTTRIRNRSRKKRFGFGQKRFCVGAANANHEFDPELRSVLELATDSELYEIETILFGPSYLSPLLKSIPLAFTNTNTNDDLDRSMIGVDLGLRQQFIAALESRFFFLAADARSTLRGWRPSYRNVLLQIRKKLNIPCSTQLSTHDLELEIFLHLLHCNSTEEESSQGQATLQHGLSQWKVQSKVGAQDIPSILLKGGGVFTLSKIYQLLARKLSGKVLVEAANYQVKKELVKKVYIGTGESSGSLSISQEQLQHSFCAV

SEQ ID NO: 199339 - protein, 886 aa, Glycine max
  Coding DNA Sequence Number=SeqID_82561
  Gene Ontology: Mol. function=protein serine/threonine kinase activity; Cellular component=cytoplasm; Biological process=protein amino acid phosphorylation
  Homolog annotation: Hit_ID=Q9FX38; Match level="QueryCoverage=98%, HitCoverage=66%, E-value=0.0, Identity=65%"; Hit description=Protein kinase, putative
  Pfam annotation: Domain name=Pkinase; Domain location=460-885; Score =195.0; E_value=1.8e-55; Accession=PF00069.15; Description=Protein kinase domain
  Pfam annotation: Domain name=Pkinase_Tyr; Domain location=460-698; Score=-76.4; E_value=8.7e-08; Accession=PF07714.7; Description =Protein tyrosine kinase
  Pfam module annotation: Pfam domain module=Pkinase::Pkinase_Tyr; Domain location=460-885::460-698
MRKATGGCWLSVSQGIAEDTSDLVSGFATVGDELSESIDYPNEYWDSDEYDDDEDVGYMRQPIEDEAWFLAHEIDYPSDNEKGTGHGSVPDPQERGPAKDEDDDQSFAEEDSYFSGERYLQENNVEPVTATDDPIGLTHTEYGRTNDNDLMAQYDGQLMDEEELNLMCAEPVWRGFVPQTNELIMLGDGRVLNDNVRSRLEDISMDDDQHGSVRSIGVGINSDAADIGSEVRESLVGGSSEGDLEYFRDRDAGLGGSRHSHHDFDKKSTNKSNKNKNYEKSESNKYVIGCDKDAPLQMKTHGDGNFSFPLSLKDGQMIQASTNKSLWSNNGNTDEADDCLHAFVGTDDMLALWRRKSSDSSPVKSYENNADIVRSTNSSPTTVSNYGYSEREHVKVEEDEKTGIAREDDLGASLEDEEVAAVQEQDLNEIVVIFCYAVKTGFEEDKNFHVVLNSVIAGRYHVTEYLGSAAFSKAIQAHDLHTGMDVCVKIIKNNKDFFDQSLDEIKLLKYVNKHDPADKYHILRLYDYFYYREHLLIVCELLKANLYEFHKFNRESGGEVYFTMPRLQSITIQCLEALQFLHSLGLIHCDLKPENILVKSYSRCEVKVIDLGSSCFETDHLCSYVQSRSYRAPEVILGLPYDKKIDIWSLGCILAELCTGNVLFQNDSPATLLARVIGIIGPIDQNMLAKGRDTYKYFTKNHMLYERNQQAGDAPPPPLPFRTVEGVGDRRGVQGSLPGLHPRRQQPPIPPLQAINSVHTDKPPLSGRQLLIKREYGQNGVGHAEADAGEDYRDSILHEREANKVPLYLFYFKTPKLESFPKWRYNPSHTLQHSQETNRLEYLIPKKTSLRHRLPMGDQGFIDFVAHLLEVNPKKRPSASEALKHP

SEQ ID NO: 199340 - protein, 115 aa, Glycine max
  Coding DNA Sequence Number=SeqID_82562
MRAPGSCYMDHHDTTTNEWSFCAFLNLQAFSHTTEIKSPSGKGETNVGHGGGLAHASLARGDDGNPRGGARELELAVPLEEGPKERGMRQEEECEVGGGGGAGKKFKKGPTKLVL

SEQ ID NO: 199341 - protein, 62 aa, Glycine max
  Coding DNA Sequence Number=SeqID_82563
MADGGRLKFCHINMPLLWGTFLADLVIQMLGTDYARILRTIYALAQIRVIRTYRLSSEVTDE

SEQ ID NO: 199342 - protein, 194 aa, Glycine max
  Coding DNA Sequence Number=SeqID_82564
MAYCFHNSHLVKMKAEELPEELFTMKQKSLQSWSCLGANLRVKMDKYQYTMSGSKHRCLEQKWKCKEILHFVQSSQPTAVLDLRHRIEANGTNSTSNAAIFVGVDYSPCVLWNMIWNRTTTLIMGIMEQEQQWKSKKWAMSFYQPDHAQPCPNIWVHNSYETLQICQLRPFKPINQAKVYGQTNCHFHMISVSL

SEQ ID NO: 199343 - protein, 68 aa, Glycine max
  Coding DNA Sequence Number=SeqID_82565
  Gene Ontology: Mol. function=nucleic acid binding; Biological process= DNA integration
MTGDTSKFTHISPKKSGHVTYGDNNKGRILGVGKIGTNSSTSIENVQLVEGLKHSLLSVIQLCDKGYL

SEQ ID NO: 199344 - protein, 188 aa, Glycine max
  Coding DNA Sequence Number=SeqID_82566
  Pfam annotation: Domain name=DUF296; Domain location=2-99; Score =63.1; E_value=9e-16; Accession=PF03479.5; Description=Domain of unknown function (DUF296)
MVEINGLRLAGNDRNKYLGVELCLRWYLMEICNIGRFEILSLSGSFMPTDNQGSRSRSGGMSVSLSSPDGRVVGGGVAGLLVAAGPVQVVVGSFLPNNQQDQKPKKPKSDYAPANVTPSITVSSAPPPTNGEKEDVIGGHLLHNNSGTTLNSNLTPPSAFRRENWVNMHSLTDSMKSATDINISLPDS

SEQ ID NO: 199345 - protein, 145 aa, Glycine max
  Coding DNA Sequence Number=SeqID_82567
  Homolog annotation: Hit_ID=Q2HU33; Match level="QueryCoverage=28%, HitCoverage=3%, E-value=8e-13, Identity=87%"; Hit description =Kinesin, motor region
  Subcellular localization annotation: CTP_CleavageSite=66; ConfidenceScore=5.56e-01
MTVPLDSAYGTTKIKVVGQNSVLSTQVLSGPREVQVSLTRSNSSLTRSLRPLSEDETRLHTPVVISCNEDRREVLAVQNIANKQIDRTFAFDKVLSSFRYLKREERDGVGGEERTQIRQRKGFRRFPQRAQGWRLPVCPFSFLRS

SEQ ID NO: 199346 - protein, 173 aa, Glycine max
  Coding DNA Sequence Number=SeqID_82568
  Gene Ontology: Mol. function=ribonuclease H activity
  Homolog annotation: Hit_ID=Q1RTB0; Match level="QueryCoverage=43%, HitCoverage=35%, E-value=9e-10, Identity=41%"; Hit description =Ribonuclease H
VRGTIDRYKKACAASTNAESVSEANTQDEVNAIEVQQTELEENRMLQDYPDKLIWIHSDSWNLSLKKLRFDNAMVTLQSAKCLILASVQLIGNLSKGTMRSFIADLSILKAFNVTVHPLKAFSILLVDWIPPPCSWVKCNTMMLLKATLIPRPVVGLESSLAGKRLVAGHPSI

SEQ ID NO: 199347 - protein, 207 aa, Glycine max
  Coding DNA Sequence Number=SeqID_82569
  Gene Ontology: Mol. function=molecular_function; Cellular component =cellular_component; Biological process=biological_process
  Homolog annotation: Hit_ID=Q84M69; Match level="QueryCoverage=90%, HitCoverage=42%, E-value=3e-80, Identity=76%"; Hit description =Putative WD repeat protein
  Pfam annotation: Domain name=WD40; Domain location=29-67; Score=6.3; E_value=6.7; Accession=PF00400.22; Description=WD domain, G-beta repeat
  Pfam annotation: Domain name=WD40; Domain location=79-117; Score =36.2; E_value=1.2e-07; Accession=PF00400.22; Description=WD domain, G-beta repeat
  Pfam module annotation: Pfam domain module=WD40::WD40; Domain location=29-67::79-117
MLDDGFLQPVLNLISNSGTDIILWHGKTGKSVGHVDTNQLKNNMATISPNGRFIAAAAFTADVKIWEIVYAKDGSVKEVLNVMQLKGHKSAVTWLCFMPNSEQIITASKDGSMRLWNINVRYHLDEDPKTLKVFLIPLHDSSGTTLHYDRLSVSPDGKILAATHGSTLQWLCVETGKVLDTAEKAHDSDISCISWAPKPIPMGKLLL

SEQ ID NO: 199348 - protein, 63 aa, Glycine max
  Coding DNA Sequence Number=SeqID_82570
  Homolog annotation: Hit_ID=Q533R9; Match level="QueryCoverage=84%, HitCoverage=23%, E-value=9e-07, Identity=55%"; Hit description=MADS box protein AGL1
  Pfam annotation: Domain name=K-box; Domain location=2-62; Score=18.1; E_value=1.3e-05; Accession=PF01486.8; Description=K-box region
FYQQEASKFKRQIRDIQNLNRHILGEALSSLSLKELKNLESRLEKGLSRVRSRKVLYYQHEAS

SEQ ID NO: 199349 - protein, 234 aa, Glycine max
  Coding DNA Sequence Number=SeqID_82571
  Homolog annotation: Hit_ID=Q84M69; Match level="QueryCoverage=65%, HitCoverage=35%, E-value=8e-50, Identity=62%"; Hit description =Putative WD repeat protein
  Pfam annotation: Domain name=WD40; Domain location=71-109; Score =41.9; E_value=2.2e-09; Accession=PF00400.22; Description=WD domain, G-beta repeat
MDPALPIVALSLLLGAIIAFLFFSTYYRKRQSEIQSIADPNPKPLSSKAPPKKPLSKPHSSDKDQNKRHHPLDLNTLKGHGDAVTGICFSPDGRNLATACADGVVRVFKLDDASSKSFKFLRINLPAGGHPTAVAFSDDASSIVVASYTLSGCSLYMYGEEKPKTSEDKPQTKLPLPEIKWEHHKVHDKKSIITMFGASATYGTADGSTIVASCSEGIFTTSLPIRIYAEIVLS

SEQ ID NO: 199350 - protein, 174 aa, Glycine max
  Coding DNA Sequence Number=SeqID_82572
  Gene Ontology: Mol. function=DNA binding
  Homolog annotation: Hit_ID=Q1S0F5; Match level="QueryCoverage=94%, HitCoverage=31%, E-value=2e-15, Identity=35%"; Hit description=IMP dehydrogenase/GMP reductase
MVEEFEEILGCPLRGRKPYLFSDGLVDLAAIDAFLAYHDRKESPVVAILADLYDTFDRRCEKSSTRIVCCTPALSVWLASHLFRQEVRHPCPLESHRSCIEKRGANWDQLLASKEGASVNGFPRWKEGITGVLISCGGFPNVPLMGTRGCISYSLVLAIRQLGYPMRGAPLEAL

SEQ ID NO: 199351 - protein, 367 aa, Glycine max
  Coding DNA Sequence Number=SeqID_82573
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=O48766; Match level="QueryCoverage=80%, HitCoverage=66%, E-value=1e-123, Identity=63%"; Hit description =Endoglucanase 11 precursor
  Pfam annotation: Domain name=Glyco_hydro_9; Domain location=1-302; Score=254.1; E_value=2.9e-73; Accession=PF00759.9; Description =Glycosyl hydrolase family 9
  Pfam annotation: Domain name=HMG-CoA_red; Domain location=223-366; Score=-244.1; E_value=1.1e-07; Accession=PF00368.9; Description =Hydroxymethylglutaryl-coenzyme A reductase
  Pfam module annotation: Pfam domain module=Glyco_hydro_9::HMG-CoA _red; Domain location=1-302::223-366
VGDGDTDHYCWQRPEDMTTSRRAYKVDANNPGSDVAGETAAALAAASILFRRTNPHYSQLLLHHAQQLFEFGDKYKGKYDESVGVAKGYYASVSGYMDELLWAAAYDFGGTTWAMTEFSWDVKYAGLQAIASMFLMEEKKHKKHEVILKQYRSKAEHYLCACLNLNSVTNVERTPGGLLYVRQWNNMQYVATASFLLTVYSDHLLATDQKLHCQKGEVGPHEMLAFAKSQVDYILGSNPMAMSYLGYDNWYGRVEPNPNVLIGALVGGPDIKDQFKDERRNYVQTEACTYNTAALVGGRGKSVVCEAIIKEEVVQKVLKTNVSALVELNMLKNLAGSASNIVSAIFITINDGRHLHISVTMPYIEVI

SEQ ID NO: 199352 - protein, 159 aa, Glycine max
  Coding DNA Sequence Number=SeqID_82574
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=O48766; Match level="QueryCoverage=71%, HitCoverage=21%, E-value=1e-46, Identity=74%"; Hit description =Endoglucanase 11 precursor
  Pfam annotation: Domain name=Glyco_hydro_9; Domain location=36-159; Score=-214.7; E_value=0.00033; Accession=PF00759.9; Description =Glycosyl hydrolase family 9
MKKGNVQKNNIRCSTLCIASLSLITIFIIPFCESFNYGQALSQSLLYFESQRSGRLPYNQRVTWRHHSALTDGLEQGVDLVGGYYDAGDNVKFGLPMAFTITLLSWGAIEYGEQIAAAGEYAHALEAIKWGTDYFIKAHTQPNVLWLEVLISIPVNILF

SEQ ID NO: 199353 - protein, 51 aa, Glycine max
  Coding DNA Sequence Number=SeqID_82575
MGEEIEIKIKFLIFRALIWPWRIPHDRVDMHHKTLMQLLELALTGEAEQRW

SEQ ID NO: 199354 - protein, 111 aa, Glycine max
  Coding DNA Sequence Number=SeqID_82576
MEFSSIRFGDISYLQEKQRRNKEKSFAREETFPDLRESEVRASKAHIMAEDQQQRVTFEDYSSSTVPQSFTSIARPEDQAHNITYPHSLIQLIQGNLFHGLPNDRGRTRIK

SEQ ID NO: 199355 - protein, 401 aa, Glycine max
  Coding DNA Sequence Number=SeqID_82577
  Gene Ontology: Mol. function=nucleic acid binding; Cellular component= intracellular; Biological process=regulation of transcription
  Homolog annotation: Hit_ID=Q9C9X7; Match level="QueryCoverage=86%, HitCoverage=86%, E-value=4e-97, Identity=52%"; Hit description =Putative C2H2-type zinc finger protein; 11906-10073
  Pfam annotation: Domain name=zf-C2H2; Domain location=135-157; Score =22.1; E_value=0.002; Accession=PF00096.16; Description=Zinc finger, C2H2 type
  Pfam annotation: Domain name=zf-C2H2; Domain location=162-183; Score =14.5; E_value=0.28; Accession=PF00096.16; Description=Zinc finger, C2H2 type
  Pfam annotation: Domain name=zf-C2H2; Domain location=57-79; Score =27.3; E_value=5.3e-05; Accession=PF00096.16; Description=Zinc finger, C2H2 type
  Pfam module annotation: Pfam domain module=zf-C2H2::zf-C2H2::zf-C2H2; Domain location=135-157::162-183::57-79
MIDMLVIHNSLPPTSEAENGTAATATNKRKRRPAGTPDPDAEVVSLSPKTLLESDRYVCEICNQGFQRDQNLQMHRRRHKVPWKLLKRETTAVVKKRVFVCPEPSCLHHDPCHALGDLVGIKKHFRRKHNNHKQWVCERCSKGYAVQSDYKAHLKTCGTRGHSCDCGRVFSRVESFIEHQDACNVGRLGPETQSQAQAVQAAACLSRTASSETNFSTGSPWPQSGTIIIPNPTVTVVEPSSYTIVTAETNNKVHPNLELQLSNTTPTASSQEERVHQEQLRIAKAKKALAEEARKQAKRQIELAELEFTNAKRIRQEALAELDKAYAFKDHAIKHINSIMLQITCRACKHHFHSPTDDQIFSYITQARQLVPCYLNADYNMMSRFCWISLLVESGEVLDKH

SEQ ID NO: 199356 - protein, 194 aa, Glycine max
  Coding DNA Sequence Number=SeqID_82578
  Gene Ontology: Mol. function=voltage-gated potassium channel activity; Cellular component=integral to membrane; Biological process=potassium ion transport
  Homolog annotation: Hit_ID=Q9FY05; Match level="QueryCoverage=80%, HitCoverage=23%, E-value=1e-34, Identity=45%"; Hit description =Outward rectifying potassium channel
  Pfam annotation: Domain name=Ank; Domain location=101-133; Score =18.9; E_value=0.018; Accession=PF00023.20; Description=Ankyrin repeat
  Pfam annotation: Domain name=Ank; Domain location=134-180; Score =30.7; E_value=5.2e-06; Accession=PF00023.20; Description=Ankyrin repeat
  Pfam module annotation: Pfam domain module=Ank::Ank; Domain location =101-133::134-180
MALDFVEGGGCLMYRTMGIPREIRKEDDDAEENTITLHTYSSFGQVSFFCNMPQTSTVDLMNFARWSYIVLKNLLEVKDLSLQRKLLVSEFNLTIGNMETELATRMNCAAHDGHLDLVKRLIGFGADPNKTDYDGRTPLHISSIKNKFGSTPLLEAIKNGHGEVASILVDAGANIFTIDDFRVGPRIIPSFILI

SEQ ID NO: 199357 - protein, 312 aa, Glycine max
  Coding DNA Sequence Number=SeqID_82579
  Gene Ontology: Mol. function=calcium-dependent phospholipid binding; Cellular component=phagocytic vesicle; Biological process=fruiting body development (sensu Dictyosteliida)
  Homolog annotation: Hit_ID=Q9ZR53; Match level="QueryCoverage=80%, HitCoverage=91%, E-value=1e-114, Identity=55%"; Hit description =Annexin-like protein
  Pfam annotation: Domain name=Annexin; Domain location=15-80; Score =84.4; E_value=3.5e-22; Accession=PF00191.10; Description=Annexin
  Pfam annotation: Domain name=Annexin; Domain location=169-235; Score =92.7; E_value=1.1e-24; Accession=PF00191.10; Description=Annexin
  Pfam annotation: Domain name=Annexin; Domain location=87-151; Score =47.6; E_value=4.2e-11; Accession=PF00191.10; Description=Annexin
  Pfam module annotation: Pfam domain module=Annexin::Annexin::Annexin; Domain location=15-80::169-235::87-151
MATLNVPPLPPSPRDDAIQLYAAFKGFGCDTSVVINILAHRDATQRAYIQQEYKAMYSGDLLKRLSSELSGKLETALLLWMHDPAGRDAIILRQSLTLPKNLEAATQLICSRTPSQLHYLRQIYHSKFGVYLEHDIETNTSGDHKKILLAYVTTPRHEGPEVNREMAEKDAKVLYKAGEKRLGTDEKTFVQIFSERSAAHLAAITSYYHSMYGHSLKKAVKKETSGNFALALLTIVQCAENPAKYFAKVFFPWIEFCVISSRNTIILGWRCLHSMITPHLVRNKDDGVRTQEPLKGKNHCRECSVDEKADIY

SEQ ID NO: 199358 - protein, 149 aa, Glycine max
  Coding DNA Sequence Number=SeqID_82580
  Gene Ontology: Mol. function=acid phosphatase activity
  Homolog annotation: Hit_ID=Q9LL79; Match level="QueryCoverage=99%, HitCoverage=98%, E-value=1e-17, Identity=65%"; Hit description =Putative purple acid phosphatase
MGGLGIWMGLISLCFVSVSARSGLLQRLEHPVKADGSLSLVVIGDRGRKGTYNQSQVATQVFILYLVGTCVPVLVYQIQFLTSGGGSKAWKGDMDKDKTDGIKFYYDGQGFMSAELEETNVKVVYYDILGKVLHVVNLPKGLGTSVSAI

SEQ ID NO: 199359 - protein, 282 aa, Glycine max
  Coding DNA Sequence Number=SeqID_82581
MYLPYHTFMAESTHSKTNLDWIEEAIAKLASNKLHVTTKLNELIKRIMVLKTNQQQSSSPSSSSTNPPHVTPSSHLPHMKLEVPCLDGTDPSGWIFKINQFFVYHVTPEPKCLTIASFYMEGPTLAWFQWMMRNGQLTSWSGLLQALEVRFAPFQYEDPTSHHHTTHFSHFHNIHVLKDQNTMSSSQSILINTQELCNIYTKTQSYMQCGILSMKNHVGRLGVHDKTNHTLASQATLTRMLQPYGINIGLKEHSNRVTPKAYTPKSPSGCLPPDLGLTQKTF

SEQ ID NO: 199360 - protein, 430 aa, Glycine max
  Coding DNA Sequence Number=SeqID_82582
  Gene Ontology: Mol. function=acid phosphatase activity; Cellular component=integral to membrane; Biological process=iron ion transport
  Homolog annotation: Hit_ID=Q707M7; Match level="QueryCoverage=71%, HitCoverage=93%, E-value=1e-149, Identity=82%"; Hit description =Putative acid phosphatase
  Pfam annotation: Domain name=Metallophos; Domain location=83-294; Score=74.7; E_value=2.9e-19; Accession=PF00149.18; Description =Calcineurin-like phosphoesterase
MTVRWTQEVRIANHTRYCKCKGIVYYYLIMNPESGDGERFPVRAMSMSFLFTFTIIISFGLCILYASAELQRLSHSSKHDGALSFLVLGDWGRRGAYNQSQVSFQMGKVGEKLDIDFVVSTGDNFYDNGLTSDHDNAFQESFTQIYTAKSLQKQWYSVLGNHDYRGDAEAQLSPVLREIDSRWLCLRSFIVDSELVEIFFVDTTPFVEEYFTEPQEHKYDWRGIGPQKPYITNLLKDLELALRESTAKWKIVVGHHAIRSVGHHGDTQELINQLLPILQANNIDFYMNGHDHCLEHISDTESPIQFLTSGAGSKAWRGDIKGMNRRDVNFFYDGQGFMSVKLTQTDATIEFYDNVMPHLEDNGFVRMAKSMEAYVSDIQYINTWKTSQGQKGDMVQTAIPDVNLRRLRTENSSGDGTKGNSQPLNLLLLA

SEQ ID NO: 199361 - protein, 450 aa, Glycine max
  Coding DNA Sequence Number=SeqID_82583
  Gene Ontology: Biological process=response to UV-B
  Homolog annotation: Hit_ID=Q10DW0; Match level="QueryCoverage=86%, HitCoverage=88%, E-value=1e-109, Identity=55%"; Hit description =Expressed protein
  Pfam annotation: Domain name=DUF760; Domain location=10-404; Score =656.2; E_value=2.5e-194; Accession=PF05542.2; Description=Protein of unknown function (DUF760)
  Subcellular localization annotation: CTP_CleavageSite=22; ConfidenceScore=5.52e-01
MDVAVTAFRSPLIILRRPVNESASARFGSTFGFSRKQRFSSVCIPKHKHKQGRRRGFVVRASASSSPESDDAKIAPLQFESSIGQFLSQILKDHPHLVPAAVDQQLQQLQTDRDAHQQNEQPSASTTDLVLYRRIAEVKANERRKALEEILYALVVQKFMDANISLIPSVTPDLSGKVDLWPNEDGKLELLHSHEAYEMIQNHLALILGNRAGDLTSIAEISKFRVGQVYAASVMYGYFLRRVDQRFQLEKTMKVLPNATEKENSAHQTTMDNARPSIEEDTSQVMSHPEVSTWPGGDVRPGGFGYGVKATRLRNYVMSFDGDTLQRYATIRSKEAVSIIEKHTEALFGRPEIVVTPEGAVSKDENIKISFGGLKKLVLEAVTFGSFLWDVESYVDSRSHQVGGNLVHSVVLLSSVCSHTSQGIVYSVLVLTDGVNLNVTSVLKVQILFH

SEQ ID NO: 199362 - protein, 75 aa, Glycine max
  Coding DNA Sequence Number=SeqID_82584
METDDDDDMTTITQRKRRKKLHCGESITECTREMRGRGSNRTIDTLSAEFINFRIIQVMLLAGSVTLMSTTSICK

SEQ ID NO: 199363 - protein, 58 aa, Glycine max
  Coding DNA Sequence Number=SeqID_82585
MLEMTETEDTKNKMMAFIDPTWLHYIAVSKLKQQSHCDLHAVGRECRADVDTLTESDV

SEQ ID NO: 199364 - protein, 774 aa, Glycine max
  Coding DNA Sequence Number=SeqID_82586
  Gene Ontology: Mol. function=potassium ion transporter activity; Cellular component=membrane; Biological process=potassium ion transport
  Homolog annotation: Hit_ID=Q19A13; Match level="QueryCoverage=97%, HitCoverage=97%, E-value=0.0, Identity=45%"; Hit description =Putative high-affinity potassium transporter 1
  Pfam annotation: Domain name=K_trans; Domain location=23-774; Score =879.3; E_value=1.8e-261; Accession=PF02705.7; Description=K+ potassium transporter
MDSHLDAIFDEDHKKKTWKQTTLLSFQIVGIVYGQLSTAPLYVFGTMQKGDLASEEVVYELFSFIFWTLTIISLVKYASIVLKADDEGEGGIVALYSLLCRNAKVGLLPCDKSANEVVLYEERSGSKLKADSRARRAIEKHKICHYLILFLALFGSCMTIGDAVLTPALSVYSASTGVQRSLTDILTDIFAWSPDTQQNVSNGLRRYVPVPSACVILVGLFMLQHCGTRKIGIMFAPIITAWLLFVAGVGTYNVFHWDVKIIYKISPVYIYKFITHIDIHRWRLLGSVILCVAGSEAMFADLGHFSKKSIKITFICLIYPLLLLCYAGQAAYISKNLHAPDFNHLSQSMPPVGSQATITACFSIINQCLALNCFPRVKVIHTSKTIHGQIYIPDVNWLLMIFSLTVTIGFRDIVKIGNATGLAIICGMLVTTSLMSLIIALYWEKNLMVSACFLVCFGFLEAAYLSACLLEFHKGAWYLVVLLAVSMTVMLSWHYGTMKKYEFDLQNKVSTEWLIDISPGLGISRVPGIGFIYTDIVAGIPAFFSHFITNLPAFHQVLILVSFKSIAVPYVPESERYLIGRIGPKDYKIYRCIVRSGYCDHIRDTGHFEEQIIRSIGEFISIEQNDIESMVSPDERMIIIGNSNSRLDGNALVPLDEVDSSSCMVNNESQISPVDHDALESRNKRKKVRFMLPENSPKMQVSVRKELLELIDARESGSAYFLGQSHLVVRDGTNFLKRFLIMVYRFSEKNCRESPVALKIPHAALVEVGVICTI

SEQ ID NO: 199365 - protein, 794 aa, Glycine max
  Coding DNA Sequence Number=SeqID_82587
  Gene Ontology: Mol. function=nucleoside-triphosphatase activity; Cellular component=integral to membrane; Biological process=transport
  Homolog annotation: Hit_ID=Q1T0S3; Match level="QueryCoverage=94%, HitCoverage=96%, E-value=1e-152, Identity=42%"; Hit description=AAA ATPase
  Pfam annotation: Domain name=ABC2_membrane; Domain location=503-711; Score=133.1; E_value=7.7e-37; Accession=PF01061.14; Description=ABC -2 type transporter
  Pfam annotation: Domain name=ABC_tran; Domain location=80-270; Score =147.2; E_value=4.3e-41; Accession=PF00005.17; Description=ABC transporter
  Pfam module annotation: Pfam domain module=ABC2_membrane::ABC_tran; Domain location=503-711::80-270
MARPERTAGRNKSLETLMDSDKPGIGRNVNQLKIQKSIPGYGLEFSNLSYSIIKKQKKDGVWINKESYLLHDISGQAIKGEVMAIMGPSGAGKSTFLDALAGRIAKGSLEGSVRIDGKPVTTSYMKMVSSYVMQDDQLFPMLTVFETFMFAAEVRLPPSISRSEKKKRVYELLDQLGLQSATHTYIGDEGRRGVSGGERRRVSIGIDIIHKPSLLFLDEPTSGLDSTSAYSVVEKVKDIARGGSIVLMTIHQPSFRIQMLLDQITVLARGRLIYMGKADEVQAHMSRFGRPVPDGENSIEYLLDVISEYDQATVGLDPLVQFQRDGLKPHPAAMTPVPRTPYKRNTPASKHMISLRSQGFTAGTQQPDSADDEDDDDAEDFDNSLERKSAPTPRNMTSGVHQRLASQFYQDFSAKDFSVWLYHGVVGTPRRQPSWTPARTPGWTPGKTPMSGPTSAVSNQYSAAPFVVGQSMDYSATSYEGFEIEEVLDEPNFGSKYANPWLREVAVLSWRTALNVIRTPELFLSREIVLAVMALILSSIFGNLSHPFFEDINRLLNFYIFAVCLVFFSSNDAVPSFIMERFIFIRETSHNAYRASSYVISSLIVYLPFFAVQGFTFAVITKKMLHLRSSLLYFWLILYASLITTNAYVMLVSALVPSYITGYAVVIATTALFFLTCGFFLKRTQIPFYWMWLHYISAIKYPFEALLTNEFNNLNCYTGNLAELSHGPLGDLKLSKHHNSSLPANCLLGKDILSSMDITMDNIWYDILILLAWDVLYRFFFYLVLRFYSKNERK

SEQ ID NO: 199366 - protein, 946 aa, Glycine max
  Coding DNA Sequence Number=SeqID_82588
  Gene Ontology: Mol. function=protein kinase activity; Cellular component=integral to membrane; Biological process=protein amino acid phosphorylation
  Homolog annotation: Hit_ID=Q8LD58; Match level="QueryCoverage=61%, HitCoverage=91%, E-value=0.0, Identity=59%"; Hit description =Receptor kinase, putative
  Pfam annotation: Domain name=LRRNT_2; Domain location=69-106; Score =33.0; E_value=1.1e-06; Accession=PF08263.3; Description=Leucine rich repeat N-terminal domain
  Pfam annotation: Domain name=LRR_1; Domain location=109-132; Score =7.0; E_value=14; Accession=PF00560.23; Description=Leucine Rich Repeat
  Pfam annotation: Domain name=LRR_1; Domain location=134-156; Score =11.3; E_value=2.2; Accession=PF00560.23; Description=Leucine Rich Repeat
  Pfam annotation: Domain name=LRR_1; Domain location=158-180; Score =13.7; E_value=0.66; Accession=PF00560.23; Description=Leucine Rich Repeat
  Pfam annotation: Domain name=LRR_1; Domain location=182-204; Score =11.2; E_value=2.3; Accession=PF00560.23; Description=Leucine Rich Repeat
  Pfam annotation: Domain name=LRR_1; Domain location=206-227; Score =16.4; E_value=0.1; Accession=PF00560.23; Description=Leucine Rich Repeat
  Pfam annotation: Domain name=LRR_1; Domain location=228-250; Score =6.5; E_value=18; Accession=PF00560.23; Description=Leucine Rich Repeat
  Pfam annotation: Domain name=Pkinase; Domain location=404-669; Score =88.1; E_value=2.8e-23; Accession=PF00069.15; Description=Protein kinase domain
  Pfam annotation: Domain name=Pkinase_Tyr; Domain location=403-674; Score=55.3; E_value=7.3e-16; Accession=PF07714.7; Description =Protein tyrosine kinase
  Pfam annotation: Domain name=TPR_1; Domain location=824-857; Score =32.2; E_value=1.8e-06; Accession=PF00515.18; Description =Tetratricopeptide repeat
  Pfam annotation: Domain name=TPR_1; Domain location=858-891; Score =2.2; E_value=2.9; Accession=PF00515.18; Description=Tetratricopeptide repeat
  Pfam annotation: Domain name=TPR_2; Domain location=824-857; Score =26.7; E_value=8.2e-05; Accession=PF07719.7; Description =Tetratricopeptide repeat
  Pfam annotation: Domain name=TPR_2; Domain location=858-891; Score =11.1; E_value=1.7; Accession=PF07719.7; Description=Tetratricopeptide repeat
  Pfam module annotation: Pfam domain module=LRRNT_2::LRR_1::LRR_1::LRR_ 1::LRR_1::LRR_1::LRR_1::Pkinase::Pkinase_Tyr::TPR_1::TPR_1::TPR _2::TPR_2; Domain location=69-106::109-132::134-156::158-180::182 -204::206-227::...
  Pfam module annotation: Domain location=228-250::404-669::403 -674::824-857::858-891::824-857::858-891
MGIEVNYVKFMKGMRLIRAKGKEKKKLSDDFSVSEQSPPSPSEFAMLPQKHTLVATLAVVLAVAQAVDLASERAALLALRSAVGGRTLFWNATRESPCNWAGVQCEHDHVVELHLPGVALSGEIPVGIFGNLTQLRTLSLRFNALRGSLPSDLASCVNLRNLYIQRNLLSGQIPPFLFDFADLVRLNLGFNNFSGPFPTAFNSLTRLKTLFLENNQLSGPIPDLDKLTLDQFNVSDNLLNGSVPLKLQAFPPDSFLGNSLCGRPLSLCPGDVADPLSVDNNAKDSNTNNKSKLSGGAIAGIVVGSVVFLLLLVFLFIFLCRNKSAKNTSAVDIATVKHPETESKVLADKGVSDVENGAGHANGNSAVAAVAVGNGGSKAAEGNAKKLVFFGNAARAFDLEDLLRASAEVLGKGTFGTAYKAVLEAGPVVAVKRLKDVTISEKEFREKIEAVGAMDHESLVPLRAYYFSRDEKLLVYDYMSMGSLSALLHGNKGAGRTPLNWEVRSGIALGAARGIEYLHSRGPNVSHGNIKSSNILLTKSYDARVSDFGLAHLVSPSSTPNRVAGYRAPEVTDPRKVSQKVDVYSFGVLLLELLTGKAPTHALLNEEGVDLPRWVQSVVREEWTSEVFDLELLRYQNVEEEMVQLLQLAVDCAAQYPDMRPSMSEVWADRNPKLQFDLERPSERAREHGGGKIERAEAIHRDMQVQSLTSPQSISFILQDLSSQEPGDFDDKSDPPLSAQNDIVESDIELDNADVVEPDNDPPQKMGDPSAEITEEQRDAAQLAKSKAVDAIWPIDFSLMIFPGNLDEALAQLTEAILLNPQSAILYATRASIYMKLKKPNAAIRDADTALKINPDSAKGYKIRGMSRAMLGLWEEAASDLHVASKLDYDEEISMALKKVEPNALKIEEHRRKYERLRKQKQQKRAPIKTEAPIKKEQETEAQVSI

SEQ ID NO: 199367 - protein, 374 aa, Glycine max
  Coding DNA Sequence Number=SeqID_82589
  Gene Ontology: Mol. function=protein binding
  Homolog annotation: Hit_ID=UPI0000163432; Match level="QueryCoverage =98%, HitCoverage=47%, E-value=1e-17, Identity=32%"; Hit description =protein binding
MTENVNISPLITIHDISGSQSSSACPTSPPHFQEDLLHRRQHLVEEILQLSADSFSVASSDSNTSCSEVDCSEFESSVPKVDNFPCKYYMNGSVDGHLSQNLLKEKFYNPRQGILHARENGNSLSSPTCDPTSKQHSIDFAAGADNAESAFCASQDTGLLEKRKIRKKAKKRIISILEENLDGDASDHTQEQISQGQISPNLKQELDIDDSTEFSGRNYSTQENDDLIVTYFNTSIADSEASEESWLSRSLFVIGGNVLICIEDLKQLYSLSSNASASPYFRIDSCCSIADIAEMVIEVGGSCCVTLGLTCPRAELHPSTQMNLQTVNHENTAPGSLKLKLQWFSKDHLVKFVSLLKTIHEKETGSPLVVRCIS

SEQ ID NO: 199368 - protein, 396 aa, Glycine max
  Coding DNA Sequence Number=SeqID_82590
  Gene Ontology: Mol. function=protein binding
  Homolog annotation: Hit_ID=Q9LVH8; Match level="QueryCoverage=79%, HitCoverage=28%, E-value=4e-88, Identity=54%"; Hit description =Genomic DNA, chromosome 3, P1 clone: MEB5
  Pfam annotation: Domain name=LRR_1; Domain location=10-30; Score=7.9; E_value=9.7; Accession=PF00560.23; Description=Leucine Rich Repeat
  Pfam annotation: Domain name=LRR_1; Domain location=123-145; Score =2.5; E_value=99; Accession=PF00560.23; Description=Leucine Rich Repeat
  Pfam annotation: Domain name=LRR_1; Domain location=32-52; Score =13.1; E_value=0.99; Accession=PF00560.23; Description=Leucine Rich Repeat
  Pfam annotation: Domain name=LRR_1; Domain location=76-96; Score=4.7; E_value=38; Accession=PF00560.23; Description=Leucine Rich Repeat
  Pfam annotation: Domain name=LRR_1; Domain location=98-118; Score =6.6; E_value=17; Accession=PF00560.23; Description=Leucine Rich Repeat
  Pfam module annotation: Pfam domain module=LRR_1::LRR_1::LRR_1::LRR _1::LRR_1; Domain location=10-30::123-145::32-52::76-96::98-118
MDESLQLLPAVETLDLSRNKFAKVDNLHKCTKLKHLDLGFNHLRTFAPFTQMFWFETLKGPFVKLLRRKPTQVSCLIVKLVLRNNALTTLRGIENLKSLEGLDVSYNIISNFSELEFVAGLPYLQSLWLEGNPLCCARWYRAQVFSFFSYPERLKLDEKEINTSDFWKRQIIIASMHKQPASFGIYVPAKDEAVIEGGNIRRKKVSRLVSIKNEETTSICSDEDSASCANDIQNRQDPDLSDNEAEIVDLINRVEHMKKERSIHWLREFKDWMDTASDKSVETRKEGGASLHHQKENYIRKKTNQEQSGDISRYASDSVLASGDDSSMNILESDSSFVDMSASYHRQQHFDYRGLLGNVSGASHFDSRGVDMERLKSSLEGISSSLSQPRSSHSDT

SEQ ID NO: 199369 - protein, 101 aa, Glycine max
  Coding DNA Sequence Number=SeqID_82591
  Gene Ontology: Mol. function=acyltransferase activity; Cellular component=integral to membrane
  Homolog annotation: Hit_ID=Q8VWP9; Match level="QueryCoverage=77%, HitCoverage=14%, E-value=3e-32, Identity=83%"; Hit description =Fiddlehead-like protein
  Subcellular localization annotation: CTP_CleavageSite=84; ConfidenceScore=5.64e-01
MAYTCSPYPFFSWCLVLRLGASAKRTYGRSFGKTRVTTLLRFLLPLGSSFSPCPSTSCRGHVPFTSLILHVINPMTNSRYYSLPFMKKNAFAFSLNTPTSS

SEQ ID NO: 199370 - protein, 168 aa, Glycine max
  Coding DNA Sequence Number=SeqID_82592
  Homolog annotation: Hit_ID=Q2R358; Match level="QueryCoverage=89%, HitCoverage=61%, E-value=1e-09, Identity=29%"; Hit description =Expressed protein
MGNAASCTPSLISNNGVLKILLSDGRLEAYKKPMRAAELMLEYPGQFVCDSCYLKVGHRIHGLLADDQLERRKFYFLLPMELLYSVLTHEEMSSLNYKASRATKHATFNNLGKIFPVFSELCMFPSELKRLEEADNQLQLVREPEPPVQRYSKQRSWRPALETVDETL

SEQ ID NO: 199371 - protein, 113 aa, Glycine max
  Coding DNA Sequence Number=SeqID_82593
  Gene Ontology: Mol. function=protein binding
  Homolog annotation: Hit_ID=UPI0000163432; Match level="QueryCoverage =90%, HitCoverage=10%, E-value=2e-27, Identity=64%"; Hit description =protein binding
MESATIAGFAQAGAVRGEPGGSSDRRSLGVEAKSGGSPLRAIQTGGAARARKPSRRRSGGLPPSLRVGPRRPPRPGAAPADPAPPHIAESRFGAASSHQGSHALVVLAVCALE

SEQ ID NO: 199372 - protein, 288 aa, Glycine max
  Coding DNA Sequence Number=SeqID_82594
  Gene Ontology: Mol. function=binding
  Homolog annotation: Hit_ID=Q4R1J3; Match level="QueryCoverage=61%, HitCoverage=26%, E-value=1e-72, Identity=76%"; Hit description=SEL-1
MNFNGINSRSLLPGQSDPQSETENNWAGPNFTKKDELSKVTWQIPSGAENVASEVEDYNCNNTPSIAFPILFAIPIVVIRTTQHNTMAGPNPIPKWLFLSLTLILSLSVSVGARHFVLVLSQEDYKDDPPADPDSAAEWDEFGDGDSHKSEDDLDPGSWRPIFEPPAGDPQPLPESDAAYHSAVHKLMSGDPDLIQDGAAEIGALAETGHPASQSVLGFLWGMGLLRERSKGKAFLYHHFAAEGGNMQSKMALAYSYTRQDMFDKGVNLYGELAEVAVNSFLISKESP

SEQ ID NO: 199373 - protein, 70 aa, Glycine max
  Coding DNA Sequence Number=SeqID_82595
MRNEFDFGEGDTSVSRSEEEMDELVGEDGGGTNSVAGSTILGSFKRRNTKEKKKDQHGVTYNLVYYVIRS

SEQ ID NO: 199374 - protein, 127 aa, Glycine max
  Coding DNA Sequence Number=SeqID_82596
  Gene Ontology: Mol. function=catalytic activity; Biological process =cellular metabolic process
  Homolog annotation: Hit_ID=O48602; Match level="QueryCoverage=94%, HitCoverage=37%, E-value=7e-47, Identity=75%"; Hit description=2' -hydroxydihydrodaidzein reductase
FKGGSKTVYEYVLQVPCKKEEIGVIRYHMVHVDDVARAHIFLLEHPNPKGRYNCSPFIVPIEEMGEILSAKYPEYQIPTVDELKGIKGVKQPHLTSKKLEDAGFEFKYSLEDMFQDAIECCKEKGYL

SEQ ID NO: 199375 - protein, 181 aa, Glycine max
  Coding DNA Sequence Number=SeqID_82597
MIVTALGALNTSSASRPSRDGHFLRERRVQLRDDEYTDFQKGDSSPAVGITGHPHGQWIPFDADAIGQLLGYPLVLEEGQECEYGQRRNRSDGFDEEAIAHLLCIPGQDFARTTAGRRVRIMRTNMTTLTQIWMTLLLSNIQPSDHNSDLPLPKCQLVYAILTQMSIHVAQLIADVIYLFA

SEQ ID NO: 199376 - protein, 78 aa, Glycine max
  Coding DNA Sequence Number=SeqID_82598
MKSGGGGGGGMGAVPSYGVPAKRRWRGLVIAVLGLVILSMLVPLVFLLGLHNGFHSSELEFHLSNLRRIKCHHDALPK

SEQ ID NO: 199377 - protein, 386 aa, Glycine max
  Coding DNA Sequence Number=SeqID_82599
  Gene Ontology: Mol. function=zinc ion binding; Cellular component =integral to membrane; Biological process=metabolic process
  Homolog annotation: Hit_ID=Q10BU5; Match level="QueryCoverage=83%, HitCoverage=99%, E-value=3e-65, Identity=62%"; Hit description=DHHC zinc finger domain containing protein, expressed
  Pfam annotation: Domain name=zf-DHHC; Domain location=196-259; Score =119.0; E_value=1.4e-32; Accession=PF01529.11; Description=DHHC zinc finger domain
MYRSGAGMAWNVFRFCTALRGLGSIMILMVLGVVGVTYYAVVLTNFGPALFVGGLDTLISFVVLILFHCLGRSCEEKRDLVQEQKCNLCLLGLPLSLKHCGAKRLNMYPESWRGTGLYGGLEYIILVMILESLNFLSKYDNNSFVPLSELVMLLWCYFAVVFTDPGTVPPNWKPAVDEERGEVDPLNGVELSNLQSDTSNQRFRYCRKCSQPKPPRCHHCSVCGRCVLKMDHHCVWVVNCVGASNYKYFLLFLFYTLLETTIVTISLLPHFKTFFTDEEIPGTPGTLATTFLTFVLNLAFSLSVLGFLVLHMSLVASNTTTIEAYEKKTASKWHYDLGRRKNFEQVFGMDKGYWFIPAYSEEDIRRMPVLQGLEYPTTPDFNAQEF

SEQ ID NO: 199378 - protein, 422 aa, Glycine max
  Coding DNA Sequence Number=SeqID_82600
  Gene Ontology: Mol. function=transferase activity, transferring hexosyl groups; Cellular component=integral to membrane; Biological process=carbohydrate biosynthetic process
  Homolog annotation: Hit_ID=Q9ZVI7; Match level="QueryCoverage=88%, HitCoverage=60%, E-value=1e-118, Identity=55%"; Hit description =Expressed protein
  Pfam annotation: Domain name=Glyco_transf_8; Domain location=57-353; Score=126.6; E_value=7.1e-35; Accession=PF01501.10; Description =Glycosyl transferase family 8
MEKTITRVKSIPVVCDNVDKKLRQIFDLTEDEANFHMKQSAFLYKLNVQTMPKSHHCLSLKLTVEYFKSSHNDEKADEEKFIDSSLHHYVIFSNNVLAASVVINSTVFHAKESSNLVFHVLTDGENYYAIKLWFLRNHYKEAAVQVLNVELDSQKENPLLLSLPEEFRISFRDNPSRNRIRTEYLSIFSDSHYLLPHLFSNLNKVVVLDDDVVIQQDLSALWNIDLGHKVNGAVQFCSVKLGKLKSYLGEKGFSQNSCAWMSGLNIIDLVRWRELGLTQTYRKLIKEFTMQEGSVEGIAWRASLLTFENEIYPLNESWVVSGMGHDYTIGTQPIKTASVLHYNGKMKPWLDLGIPQYKSYWKKFLNKEDHLLSECNGSALKQEDACALGAQFSTLVFEGVLWKNQWWTGGDEFNTPVIKINQ

SEQ ID NO: 199379 - protein, 188 aa, Glycine max
  Coding DNA Sequence Number=SeqID_82601
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=6e-25, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
PIALRGLHVLALRGLHVLTFRGLHVLDFRGLHVLALKGLDVLALRRLHVLALRGLHILAFRGLHVLDFRGLHVITLRGLHALAFRGLHVLGFRGLHVLAFRGLHALTVSGLHILAFRGLHVLTVKGLHTPAFRGLHVLAFRRLHVLAFRGLVALVVRGLHVLAFRGHHILAFRGLQVLDFVRLLSTPL

SEQ ID NO: 199380 - protein, 63 aa, Glycine max
  Coding DNA Sequence Number=SeqID_82602
MYIESRVKDRTLDRTPKPGFSTEELKLKLTTIRSPMLKSFCSLRRNPRINWENGKKKKKARLG

SEQ ID NO: 199381 - protein, 346 aa, Glycine max
  Coding DNA Sequence Number=SeqID_82603
  Gene Ontology: Mol. function=transcription factor activity; Cellular component=nucleus; Biological process=regulation of transcription
  Homolog annotation: Hit_ID=Q9AVK4; Match level="QueryCoverage=99%, HitCoverage=42%, E-value=1e-176, Identity=89%"; Hit description =SCARECROW
  Pfam annotation: Domain name=GRAS; Domain location=1-245; Score =334.8; E_value=1.4e-97; Accession=PF03514.5; Description=GRAS family transcription factor
MLLEISQLSTPFGTSAQRVAAYFSEAISARLVSSCLGIYATLPHTHQSHKVASAFQVFNGISPFVKFSHFTANQAIQEAFEREERVHIIDLDIMQGLQWPGLFHILASRPGGAPYVRLTGLGTSMEALEATGKRLSDFANKLGLPFEFFPVAEKVGNLDPERLNVCKTEAVAVHWLQHSLYDVTGSDTNTLWLLQRLAPKVVTVVEQDLSNTGSFLGRFVEAIHYYSALFDSLGSSYGEESEERHVVEQQLLSREIRNVLAVGGPSRTGEPKFHNWREKLQQCGFRGISLAGNAATQASLLLGMFPSEGYTLVEDNGILKLGWKDLCLLTASAWRPPFHSAITHHN

SEQ ID NO: 199382 - protein, 68 aa, Glycine max
  Coding DNA Sequence Number=SeqID_82604
MGDEKVGRGGAWPKLQADNVVKIGTVVYRIPNIDTPLSNTILYAFCLLDGCKMRVLCWGGMYGTSHGG

SEQ ID NO: 199383 - protein, 284 aa, Glycine max
  Coding DNA Sequence Number=SeqID_82605
  Homolog annotation: Hit_ID=Q9AVK4; Match level="QueryCoverage=100%, HitCoverage=35%, E-value=3e-41, Identity=38%"; Hit description =SCARECROW
  Subcellular localization annotation: CTP_CleavageSite=32; ConfidenceScore=5.15e-01
MAACALFSAGGNITEDGNVNGSGSASSTPLTSASNSSSMSNEEKKHNLHGGGIMPQPHCERKMVRKRMASEMEVNVHATPPHNSSSTTSDYPRFPRRSSTNMNMLEKGSTSTTTATTTTLAEDNVAIPNYPTVTVTTNYSTMLLPSSTTTTINSSGVAPNYITHHQHHHFQGLVESQDHQQNPVPAVCGFSGLPLFPSQSQRNRDSNNTPTTNNIRNSGGNIVDVVASSSSSSSMDDTSAAAATSGWIDGILKDLIHSSNSVSIPQLISNVREIIYPCNPNLAM

SEQ ID NO: 199384 - protein, 50 aa, Glycine max
  Coding DNA Sequence Number=SeqID_82606
QYGRSILHLPRQTYRQTLISTSSLPKDRIPQQGTPRFPNNPLLHTRSVLM

SEQ ID NO: 199385 - protein, 128 aa, Glycine max
  Coding DNA Sequence Number=SeqID_82607
ERSWDLERLNLLLSPQVVEDIRNFKPPIGSMDHDFVQWRRTVDGSFSTKSAFESLIDQSIQTFRSVCDQKFFLNVRVSDVRSACGGEVRDFQGHFIMGYACSLDPCDVNKVENMAIFHGLKQAYEHGL

SEQ ID NO: 199386 - protein, 109 aa, Glycine max
  Coding DNA Sequence Number=SeqID_82608
MPHQCMRECETSFAAGSSINLPEINVPANPLLRCTSLRLLIVFYLSANDIFEVGSSDSPSMSSIEDALKTWDAEFRTALQSALKIVKNHETCLALPCYYARASFEVGVQ

SEQ ID NO: 199387 - protein, 190 aa, Glycine max
  Coding DNA Sequence Number=SeqID_82609
MAGVMRRRSAFEKGKNHGNDGKKKIKNKSARREAKARGDATWHGWSGRVNASPVVGCGLVAFAVFIDCVLLNGGAMAAIAEWRGGLFANCHRKFVKGGPLWRRHRPHLCVYMAEIWPSAIRHPPLITLRRKLPLGLDQSSGKEQSNGKEENSLTSESSRNASAKRVLKTEVATGQISSKKKGNDGVSYLL

SEQ ID NO: 199388 - protein, 170 aa, Glycine max
  Coding DNA Sequence Number=SeqID_82610
  Gene Ontology: Mol. function=nucleotidyltransferase activity; Cellular component=cellular_component; Biological process =biosynthetic process
  Homolog annotation: Hit_ID=Q2RB65; Match level="QueryCoverage=98%, HitCoverage=43%, E-value=2e-54, Identity=65%"; Hit description =Phosphoethanolamine cytidylyltransferase, putative, expressed
  Pfam annotation: Domain name=CTP_transf_2; Domain location=1-138; Score=-21.5; E_value=0.09; Accession=PF01467.16; Description =Cytidylyltransferase
MILRLARDLGDFLLVGIHTDQTVRFCCPCPFCHHTGTYWQLGICATRGSHRPIMNLHERSLSVLACRYVDEVIIGAPWEISKDMLTTFNISLVVHGTIAESNDFQKEECNPYAVPISMGIFKVLESPLDITTTTIIRRIVSNHEAYQNRNKKKGESEKRYYEGKSHVSEE

SEQ ID NO: 199389 - protein, 110 aa, Glycine max
  Coding DNA Sequence Number=SeqID_82611
MTVSCSNSYKTITKILSSRLRTIMQKLVNPCQSSFIPNRNSNGNIIIAQEVIHSMKNKKLRWKWMDGDQEEGYYWVQVIRDEYKCGQDPMPIIDDLRKGTNFWKGIRSCK

SEQ ID NO: 199390 - protein, 853 aa, Glycine max
  Coding DNA Sequence Number=SeqID_82612
  Gene Ontology: Mol. function=protein serine/threonine kinase activity; Cellular component=membrane; Biological process=protein amino acid phosphorylation
  Homolog annotation: Hit_ID=Q1T2M2; Match level="QueryCoverage=92%, HitCoverage=91%, E-value=1e-122, Identity=40%"; Hit description =Protein kinase
  Pfam annotation: Domain name=DUF26; Domain location=195-249; Score =92.2; E_value=1.6e-24; Accession=PF01657.8; Description=Domain of unknown function DUF26
  Pfam annotation: Domain name=DUF26; Domain location=323-377; Score =62.7; E_value=1.2e-15; Accession=PF01657.8; Description=Domain of unknown function DUF26
  Pfam annotation: Domain name=DUF26; Domain location=436-491; Score =38.2; E_value=2.8e-08; Accession=PF01657.8; Description=Domain of unknown function DUF26
  Pfam annotation: Domain name=DUF26; Domain location=81-137; Score =60.6; E_value=5.1e-15; Accession=PF01657.8; Description=Domain of unknown function DUF26
  Pfam annotation: Domain name=Pkinase; Domain location=577-800; Score =74.1; E_value=4.3e-19; Accession=PF00069.15; Description=Protein kinase domain
  Pfam annotation: Domain name=Pkinase_Tyr; Domain location=577-800; Score=20.8; E_value=9.6e-14; Accession=PF07714.7; Description =Protein tyrosine kinase
  Pfam module annotation: Pfam domain module=DUF26::DUF26::DUF26::DUF26: :Pkinase::Pkinase_Tyr; Domain location=195-249::323-377::436-491::81 -137::577-800::577-800
MHSNSFKLIFLFTLIILFNFPTTKAQESHDYLNQLCTDSQTPANSTYEKNLRTLLSSLSSKATAKTFFYDTVVGRNSFDTVYGMFMCRGDVPSQLCGQCVENATHIKYSEPDCSRSIWDVIWYEECMVRYSNVSFFSKVATHPFGYESSLANISSNPASFMSLLYNTMNQTAHEAAISGNMYSTKQANYSNSETLYCLAQCTQDLSPQNCTACLTQAIEYLPDCCEGKQGGRVVFPSCNIRFELYPFFRNVTDEALPEGIVPETKYSHTDSEYSEDPGYISHNCSTDQIINDTAFESNLKTLFSDLTSNATSGNRNRKKAGTLQGFFTCRVDLSRTLCGECVQNATEKIFSTCGLAAEGVIWYNHCWLRYSNRSFAMETSPSYVDLNVTDTDNRVQYSSHALTLISNKLAAMADGTGQILDKYQNGTLILNNKQRVYILAQCALDLTSDDCGACLSDMIGSAIPWTRLGSLGGRVLYPTCILRFELFQFYDLIPTTAITHPLLLAPASGKGRSRTIILILTSAIIVLGVLFTFCYYSIRRKARNNKTILRENFGHESSSIESLQFNLPTIVAATNNFSYENKIGKGGFGEVYKGILSDGRPIAVKRLSRTSKQDTKLEKVLTWSERYKIIEGIARGILYLHEYSRLKIIHRDLKPSNVLLDKNMNPKISDFGLAKIVELDQQEGSTNRIIGTYGFMAPEYAMFGQFSEKSDVYSFGVMVLEIISGKKNISSYEPRRVVDDGLLKFFWRHWRDETPFNTLDAKLKESYSEIEVIKCIQIGLLCVQEDPNARPTMMSIVSYLNNHSIELPTPHEPTFFLYNRMDPIAYESNSGQSSNSFISSSINEMSISTFYPR

SEQ ID NO: 199391 - protein, 915 aa, Glycine max
  Coding DNA Sequence Number=SeqID_82613
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=97%, HitCoverage=96%, E-value=1e-156, Identity=42%"; Hit description =Protein kinase
  Pfam annotation: Domain name=DUF26; Domain location=190-244; Score =75.5; E_value=1.7e-19; Accession=PF01657.8; Description=Domain of unknown function DUF26
  Pfam annotation: Domain name=DUF26; Domain location=325-380; Score =71.4; E_value=2.8e-18; Accession=PF01657.8; Description=Domain of unknown function DUF26
  Pfam annotation: Domain name=DUF26; Domain location=440-494; Score =65.8; E_value=1.4e-16; Accession=PF01657.8; Description=Domain of unknown function DUF26
  Pfam annotation: Domain name=DUF26; Domain location=72-128; Score =59.6; E_value=1e-14; Accession=PF01657.8; Description=Domain of unknown function DUF26
  Pfam annotation: Domain name=Pkinase; Domain location=587-859; Score =166.3; E_value=7.7e-47; Accession=PF00069.15; Description=Protein kinase domain
  Pfam annotation: Domain name=Pkinase_Tyr; Domain location=587-859; Score=124.9; E_value=2.2e-34; Accession=PF07714.7; Description =Protein tyrosine kinase
  Pfam module annotation: Pfam domain module=DUF26::DUF26::DUF26::DUF26: :Pkinase::Pkinase_Tyr; Domain location=190-244::325-380::440-494::72 -128::587-859::587-859
  Subcellular localization annotation: CTP_CleavageSite=51; ConfidenceScore=5.46e-01
MASSNSFNLLFLYIFFNFTTTKAQVSPIIMYPFCQDTTTNTTYQANLKTLLSSLVSNAIFNRFYNDTIQNTVFGLFMCRGDVSHILCQQCVQNATNKLSSYPQCSVSKQAVTYYDECMVRYSNASFFSTLTTEPSVREFNKANISSNETIFTSLLSDTMNQTIHAATNPMTWGSNYYAARHANVSDIQTLYCVAQCTMDLSRQDCATCLANATTTLLLLYEEKQGGRVLYPSCNVRFELYPFYQETKNSLDSNGLGGLVPETRYEYPLSDPKYSGYISHNCSSNLAILQNDDVSFKPYTNLTTLFSYLISNATDGAEFQMQVGNLYGLFMCRGDVDNRAVCGECVRNASERVVSECRFANEGVIWFEYCLVRFSDRDFFSVVERNPRFQKLNVTNHDERDDENSFTSTVSNKLAWMESQTGGSGSRYRNATVALNQIQTLYIVAQCTRDLSSDDCEVCLSDVVSAIPWRRLGSVGGRVLYPSCFLRFEQFQFLNHWMAPSLSPSPLPPSPPSTPQRPEIRSSSRTTVSIVVPVIIISVILFSFGCYFIRTKAKNYKTILKENFGAESTNVEPLQFDLVIIKAATNNFSDENKIGKGGFGEVYKGILTDGRHIAVKRLSKTSRQGAQEFRNEVLLIAKLQHRNLVEFIGFCLDEEEKILIYEYVSNKSLDYFLFGTQLQKVFNWSERYTIIGGIARGILYLHEYSRLKVIHRDLKPSNILLDENMNPKISDFGLARIVEIDQQEGSTNRIIGTYGYMSPEYAMFGQFSEKSDVYSFGVMILEIITGRKNVGSYESYGVVDGLLSFVWRQWTDQTPLNILDPKLRGDYSKIEVIKCIQIGLLCVQENPDARPSMLAIASYLSNHSIELPPPLEPAIFILNSKMNPQIVTHESSSSQSAKNSTPLSINEMTISDFYPR

SEQ ID NO: 199392 - protein, 218 aa, Glycine max
  Coding DNA Sequence Number=SeqID_82614
  Gene Ontology: Mol. function=protein serine/threonine kinase activity; Cellular component=mitochondrion; Biological process =protein amino acid phosphorylation
  Homolog annotation: Hit_ID=Q1SDW8; Match level="QueryCoverage=71%, HitCoverage=36%, E-value=4e-60, Identity=69%"; Hit description =Protein kinase
  Pfam annotation: Domain name=Pkinase_Tyr; Domain location=1-137; Score=-174.5; E_value=0.091; Accession=PF07714.7; Description =Protein tyrosine kinase
MNPKISDFGLAKIVELDQQEGSTNRIIGTYGFMAPEYAMFGQFSEKSDVYSFGVMVLEIISGKKNISSYEPRRVVDDGLLKFFWRHWRDETPFNTLDEKLKESYSEIEVIKCIQIGLLCVQEDPNARPTMMSIVSYLNNHSIELPTPHEPTFFLYNRMDPIAYESNSGQSSNSFISSSINEILAIAENKGGWSALSNHSLEYLVIRNDELVFVIPACV

SEQ ID NO: 199393 - protein, 462 aa, Glycine max
  Coding DNA Sequence Number=SeqID_82615
  Gene Ontology: Mol. function=protein serine/threonine kinase activity; Cellular component=membrane; Biological process=protein amino acid phosphorylation
  Homolog annotation: Hit_ID=Q9LFD4; Match level="QueryCoverage=83%, HitCoverage=93%, E-value=1e-179, Identity=81%"; Hit description =Protein kinase-like protein
  Pfam annotation: Domain name=Pkinase; Domain location=117-394; Score =168.6; E_value=1.6e-47; Accession=PF00069.15; Description=Protein kinase domain
  Pfam annotation: Domain name=Pkinase_Tyr; Domain location=110-394; Score=128.3; E_value=2.1e-35; Accession=PF07714.7; Description =Protein tyrosine kinase
  Pfam module annotation: Pfam domain module=Pkinase::Pkinase_Tyr; Domain location=117-394::110-394
  Subcellular localization annotation: CTP_CleavageSite=54; ConfidenceScore=5.47e-01
MKICSSEKIASSTPQPPSPPSPPPPPPPPPPQQQLLRRLVQQLHHATSLGASARSQNAGSEKKHGHGHGHRHNLSECASDLSESCSTPHGNNSNNTLLYTHVIAFTLYELETITKSFRGDYILGEGGFGTVYKGYIDENVRVGLKSLPVAVKVLNKEGLQGHREWLTEVNFLGQLRHPNLVKLIGYCCEDDHRLLVYEFMFRGSLENHLFRKATVPLSWATRMMIALGAAKGLAFLHNAERPVIYRDFKTSNILLDSDYTAKLSDFGLAKAGPQGDETHVSTRVMGTYGYAAPEYVMTGHLTARSDVYSFGVVLLELLTGRKSVDKTRPGKEQSLVDWARPKLNDKRKLLQIIDPRLENQYSVRAAQKACSLAYYCLSQNPKARPLMSDVVETLEPLQSSSVGPGEVSLSGSNSGSAGPFAMNKISDYRMRHKFSNNVGPGATCRSPNPNCSPGGPATLRVR

SEQ ID NO: 199394 - protein, 119 aa, Glycine max
  Coding DNA Sequence Number=SeqID_82616
  Gene Ontology: Mol. function=methyltransferase activity; Biological process=metabolic process
  Homolog annotation: Hit_ID=Q1SNV1; Match level="QueryCoverage=80%, HitCoverage=24%, E-value=4e-34, Identity=60%"; Hit description=SAM (And some other nucleotide) binding motif
MPNEAVTERKRDDAFYKRKGTRSFYMWLKPGGKILITDYCKSAGSPSLEFDEYIKKGGYYPHDIKAYRQMLEDAGFDDVIAEDRTDREDYNEIVERWKAKQTRGASREQMWGLFIAKKN

SEQ ID NO: 199395 - protein, 365 aa, Glycine max
  Coding DNA Sequence Number=SeqID_82617
  Gene Ontology: Mol. function=DNA binding; Cellular component=nuclear chromosome, telomeric region; Biological process=telomere maintenance
  Homolog annotation: Hit_ID=Q1SS97; Match level="QueryCoverage=98%, HitCoverage=80%, E-value=2e-89, Identity=50%"; Hit description =Nucleic acid-binding, OB-fold, subgroup
MAVNIFEENVERLPRVAAVGDVIVLCCVEVKSFKGEVNATFDKRFSSFGLYKGKDGDDLDPYHVSSYFHHIREDESLIVKLRKWLMNFQPHEDSCNFPMLREIKEETSVNLACKILHFCEAAKDEWIIFAWDGTNTPPNVICSKLEEEINSPLPLQLEPLPLSREVLCTLPVVGSILRMTFDADLVKNHLHLLNVDKWVKFMNMRLKVVDGLWLGVFTPQSKLQYTPNEDGLIVERQRLSEEWLFPKPSFITEEVNQDHAIPVTLMTVLTHSEVVTAKFKCVVRVVAATPCQAENLLSSTGEYRMRLTLEDSTARIHAFVTAKDGEVLFDGYPDIDELTRKLNILLGVNEVKDAPRNPPWVHRIG

SEQ ID NO: 199396 - protein, 109 aa, Glycine max
  Coding DNA Sequence Number=SeqID_82618
LLTLKRIDLIYGWLGINFPLKRFQKGDKLVESNGSSPTILRDKVHNAEADSDPKEVLVLLDGLMSVINSWGQPRAFKIFWTLVYKEILDFSLFRQTTFVTNLLPALNKF

SEQ ID NO: 199397 - protein, 381 aa, Glycine max
  Coding DNA Sequence Number=SeqID_82619
  Gene Ontology: Mol. function=nucleic acid binding
  Homolog annotation: Hit_ID=Q32P12; Match level="QueryCoverage=34%, HitCoverage=21%, E-value=3e-10, Identity=32%"; Hit description=CDNA sequence BC030867
MDLEPWEALDVDDTNLSAFLRPCNSNSDSSSLIPGPAGAVQAVMRNRRHHDPLSTQEFLKRVERQSDRDFNTNPWLCALQFVHLQGGDDDVAHGTPLSSIQNNAETERVPLIVALVKSSTPNGFGDITVNLKDPTATLTATVHRKVFSHPDLRKEILTVGSVLILQKVAVFSPNRNTRYLNITLHNIVKVFPKDSGPPSQQLTYPACPVIRTTPSMERHERLLTPGSTFSLPLERTEGIMSNLRFDSSFRQVADSDRQRSEVLASTSFRSDNGNDQNRETVSEGENLSLSLDNAGPVKVNCGGELESEVEDQPNPPKLDEGGDILARIAQGNSSATNSIPTSHGEKTGMENHFERQTQMVNKKCSFPHWTEEQLDELLAFD

SEQ ID NO: 199398 - protein, 221 aa, Glycine max
  Coding DNA Sequence Number=SeqID_82620
  Gene Ontology: Mol. function=transporter activity; Cellular component= integral to membrane; Biological process=auxin mediated signaling pathway
  Homolog annotation: Hit_ID=Q257B0; Match level="QueryCoverage=76%, HitCoverage=27%, E-value=4e-89, Identity=94%"; Hit description=Auxin efflux carrier
MDGDNGTGSVWELLRDQQSGASVLEHEEHQGVPDDALEDHNLDHQTPRELAVHAFEQGDSHHKRVWEGGDGEQRYGPLQAPSLAHVRPDAQDNQHDHLLERVGGDEPEVHFVGVVGGYEVEREQRDRKQSNEPVDARALVRGEDFPPFHGAVGEYHGHVQWHHCGHHMMSGGWWYLMLGWLGWGIAAYLVHEISLMVNRGGNRSGRSTGAYDLTYIKTGLN

SEQ ID NO: 199399 - protein, 568 aa, Glycine max
  Coding DNA Sequence Number=SeqID_82621
  Gene Ontology: Mol. function=transporter activity; Cellular component= integral to membrane; Biological process=auxin mediated signaling pathway
  Homolog annotation: Hit_ID=Q257B0; Match level="QueryCoverage=99%, HitCoverage=94%, E-value=0.0, Identity=83%"; Hit description=Auxin efflux carrier
  Pfam annotation: Domain name=Mem_trans; Domain location=1-568; Score =778.9; E_value=3e-231; Accession=PF03547.8; Description=Membrane transport protein
MVPLYVAMILAYGSVKWWKIFSPDQCSGINRFVALFAVPLLSFHFIASNNPYEMNFRFIAADTLQKMIVLVVLGIWANVSKRGCLEWTITLFSISTLPNTLVMGIPLLKGMYGEFSGSLMVQIVVLQCIIWYTLMLFMFEYRGARLLISEQFPDTAGTIVSIHVDSDVMSLDGRQHPLETDAQIKEDGKLHVTVRKSNASRSDIFSRRSQGFSSTTPRPSNLTNAEIYSLQSSRNPTPRGSSFNHTDFYSMMAAGRNSNFGANDVYGLSASRGPTPRPSNYDEDASNNNNGKPRYHYPAAGTGTGTGTGTGTGTGHYPAPNPGMFSPTASKNVAKKPDDPNKDLHMFVWSSSASPVSDVFGGGHEYDHKELKLTVSPGKVEGNINRDTQEEYQPEKDEFSFGNRGIEDEHEGEKVGNGNPKTMPPASVMTRLILIMVWRKLIRNPNTYSSLIGLTWSLISFRWNVKMPAIIAKSISILSDAGLGMAMFSLGLFMALQPRIIACGNSTAAFSMAVRFLTGPAVMAAASIAVGLKGVLLHVAIVQAALPQGIVPFVFAKEYNVHPDILST

SEQ ID NO: 199400 - protein, 541 aa, Glycine max
  Coding DNA Sequence Number=SeqID_82622
  Gene Ontology: Mol. function=calcium ion binding; Cellular component =mitochondrion; Biological process=metabolic process
  Homolog annotation: Hit_ID=Q1SSB5; Match level="QueryCoverage=89%, HitCoverage=95%, E-value=0.0, Identity=64%"; Hit description =Tetratricopeptide-like helical
  Pfam annotation: Domain name=PPR; Domain location=179-213; Score =36.2; E_value=1.1e-07; Accession=PF01535.11; Description=PPR repeat
  Pfam annotation: Domain name=PPR; Domain location=214-248; Score=6.9; E_value=1.1; Accession=PF01535.11; Description=PPR repeat
  Pfam annotation: Domain name=PPR; Domain location=346-380; Score =11.6; E_value=0.31; Accession=PF01535.11; Description=PPR repeat
  Pfam annotation: Domain name=PPR; Domain location=414-448; Score =27.9; E_value=3.6e-05; Accession=PF01535.11; Description=PPR repeat
  Pfam annotation: Domain name=PPR; Domain location=449-483; Score=9.1; E_value=0.63; Accession=PF01535.11; Description=PPR repeat
  Pfam module annotation: Pfam domain module=PPR::PPR::PPR::PPR::PPR; Domain location=179-213::214-248::346-380::414-448::449-483
IYKLDGFLRNLVPSPSTRAISNMKKGEKLKLKDEHREYMRNVIGKIYKTLKYSSWESAEQELNNMSLRWDSYTVNQVLKSHPPMEKAWLFFNWASSLRGFKHDHYTYTTMLDIFGEAGRVSSIKLDSVTYTSMMHWLSSSGNVEIRLCKCGTKSNPRLLKEATRVYKEMISSGVAPNCHTYTVLMDYLIASGKCKEALEIFEKMQEAGAQPDKAACNILIQRCSKVGGTEFMTHILQYMKENRLVLRYPVFVEALEALKFLDASNSITVAADCPTNIDNELLFVLLKNRNVVAIDHLLTGMMDKKIYLEHKVVSTIIEVNCSHCRPKGALLAFKYSVTMGISIERTGYLSLIGLLIRSNMFSKLVEIVEEMTRAGYSLGTYLASLLIIRLGCAKKHTLAMKIFNLLPDNHKCTATFTALISVYFSVRRVTKALEIYKIMCTKGFCPVLGTYDVLIAGFETNGKYAEAEHYRKAKKSKSLHANSGSQEIEGMLNSCYWIVEMPTSLTVMCHLSVLYVQILVDNANATNGHDFVLLVKDGQEE

SEQ ID NO: 199401 - protein, 476 aa, Glycine max
  Coding DNA Sequence Number=SeqID_82623
  Gene Ontology: Mol. function=structural molecule activity; Cellular component=protein complex; Biological process=microtubule-based movement
  Homolog annotation: Hit_ID=Q1SSB3; Match level="QueryCoverage=87%, HitCoverage=94%, E-value=0.0, Identity=92%"; Hit description=Cell division protein FtsZ; Peptidase S26A, signal peptidase I
  Pfam annotation: Domain name=Tubulin; Domain location=76-275; Score =376.9; E_value=3e-110; Accession=PF00091.15; Description=TubulinFtsZ family, GTPase domain
  Pfam annotation: Domain name=Tubulin_C; Domain location=277-414; Score=265.3; E_value=1.2e-76; Accession=PF03953.7; Description =TubulinFtsZ family, C-terminal domain
  Pfam module annotation: Pfam domain module=Tubulin::Tubulin_C; Domain location=76-275::277-414
MTNRLLIHSKQASAAVTVEKRVNFAPHPSQNMREILHIQGGQCGNQIGTKFWEVVCDEHGIDTTGQYVGNSELQLERVNVYYNEGSNGRYVPRAVLMDLEPGTMDAARTGPYGQIFRPDNFVFGQSGAGNNFAKGHYTEGAELIDSVLDVVRKEVENCDCLQGFQVCHSLGGGTGSGMGTLLISKIREEYPDRMMLTFSVFPSPKVSDTVVEPYNATLSVHQLVENADECMVLDNEALYDICFRTLKLATPSFGDLNHLISATMSGVTCCLRFPGQLNSDLRKLAVNLIPFPRLHFFMVGFAPLTSRGSQNYRALSVPELTQQMWDAKNMMCAADPRHGRYLTASAVFRGKMSTKEVDEQMLSVQNKNSSYFVEWIPNNVKSSVCDIPPRGLSMASTFVGNSTSIQEMFRRVSEQFTAMFRRKAFLHWYTGEGMDEMEFTEAESNMNDLVAEYQQYQDAAADEDGDSEEEDEGAES

SEQ ID NO: 199402 - protein, 314 aa, Glycine max
  Coding DNA Sequence Number=SeqID_82624
  Gene Ontology: Mol. function=transporter activity; Cellular component= mitochondrial inner membrane; Biological process=transport
  Homolog annotation: Hit_ID=Q1SSB0; Match level="QueryCoverage=98%, HitCoverage=97%, E-value=1e-124, Identity=70%"; Hit description =Adenine nucleotide translocator 1
  Pfam annotation: Domain name=Mito_carr; Domain location=113-209; Score=80.7; E_value=4.4e-21; Accession=PF00153.17; Description =Mitochondrial carrier protein
  Pfam annotation: Domain name=Mito_carr; Domain location=213-303; Score=88.6; E_value=1.8e-23; Accession=PF00153.17; Description =Mitochondrial carrier protein
  Pfam annotation: Domain name=Mito_carr; Domain location=8-105; Score =89.2; E_value=1.3e-23; Accession=PF00153.17; Description =Mitochondrial carrier protein
  Pfam module annotation: Pfam domain module=Mito_carr::Mito_carr::Mito_ carr; Domain location=113-209::213-303::8-105
MVKSTYEKFSKDFVMGGVAAIISKSAAAPIERVKLLLPNQGEMIKRGQLKKPYLGVSDGFKRVFMEEGLIAFWRGHQANIIRYFPTQAFNFAFKGYFKSIFGYSKERDGYIKWFAGNVASGSAAGATTSLLLYHLDYARTRLGTDAIECRVTSQRQFKGLIDVYRKTLSSDGIAGLYRGFGISIWGITLYRGMYFGIYDTMKPIVLVGPFEGKFLASFLLGWSITTFSGVCAYPFDTLRRRMMLTSGHPNKYCTAIHAFQEIVRQEGFRALFRGVTANMLLGMAGAGVLAGYDQLNRISSRHSHYNETNQRVLK

SEQ ID NO: 199403 - protein, 328 aa, Glycine max
  Coding DNA Sequence Number=SeqID_82625
  Pfam annotation: Domain name=ARID; Domain location=20-131; Score= -5.7; E_value=0.00055; Accession=PF01388.11; Description=ARIDBRIGHT DNA binding domain
METKEEIMLPSPSKGLANNGEQCSPGDDSGSFYMKLAVLLESSGLSLIFNVRETLLDLYLFYLEVTRREGYHQVDREKKWGEVVFALKLEGNSVKLCAQAEKFYAHLLYQFEQLYFYRRPAKQAGSNSTKELKTFQQLQYMMFQSENVMLKLLEGLFFSLVTSSSFFKGPLQKKRKSTASLPHTMDIKDGHKKTTEMSKDYSCNMTAVVFRGAYTMLWIPTKQVLGMWFYRHPHMSKKPRNTEALEGQKILRLAIDAWRNMSTIEKKPYEEESKKNKEAMIGNKKEEKWHSLSGDNLVTSQPETDDSKLVKKATEKSPTDPSFIFIYN

SEQ ID NO: 199404 - protein, 234 aa, Glycine max
  Coding DNA Sequence Number=SeqID_82626
  Gene Ontology: Mol. function=voltage-gated potassium channel activity; Cellular component=integral to membrane; Biological process=potassium ion transport
  Homolog annotation: Hit_ID=Q9LEQ3; Match level="QueryCoverage=99%, HitCoverage=35%, E-value=4e-86, Identity=64%"; Hit description =Putative cyclic nucleotide-gated ion channel 18
  Pfam annotation: Domain name=cNMP_binding; Domain location=15-115; Score=36.9; E_value=6.8e-08; Accession=PF00027.19; Description =Cyclic nucleotide-binding domain
MDDQLLDAICERLASSLSTEGTYLFREGDPVDEMLFIIRGQLESSTTNGGRSGFFNSISLRPGDFCGEELLTWALMPNSNLNLPSSTRTVKALTEVEAFALQAEDLKSVASQFKRLHSKKLQHAFRYYSHQWRTWASCFIQAAWRRHQKRKATRELSLKEGLYYLALSEAERDGSGNYEIEESSGSVKKVQNLGPTVFASKFAANTKKGNHKLQDPVPQLFKPDEPDFSLDHEQ

SEQ ID NO: 199405 - protein, 92 aa, Glycine max
  Coding DNA Sequence Number=SeqID_82627
MQQKETERMHLNSLEKVGFITLGYDPHLSKILRAKTRTCHSRGVKHHQELFKGNFHFPSWLLSYLFGTLLVPTASSPQLQKLKSKQARDPSL

SEQ ID NO: 199406 - protein, 88 aa, Glycine max
  Coding DNA Sequence Number=SeqID_82628
  Gene Ontology: Mol. function=voltage-gated potassium channel activity; Cellular component=integral to membrane; Biological process=potassium ion transport
  Homolog annotation: Hit_ID=Q2QXB8; Match level="QueryCoverage=92%, HitCoverage=13%, E-value=6e-34, Identity=82%"; Hit description =Cyclic nucleotide-gated ion channel 14, putative, expressed
MQTYLSSMSVRLEEWRIRKRDTEEWMRHRQLPQDLQERVRRFAQYKWLATRGVNEEAILLSLPLDLRREIQHHLCLSLVRRVCLSPLA

SEQ ID NO: 199407 - protein, 85 aa, Glycine max
  Coding DNA Sequence Number=SeqID_82629
MEAWGCWKRELSLEDPNESSGDEDMTKSKGKDPLEGLGGPMTRARGRKAKEALQQVLSILFEYKPKFQGEKSKVVSCIMAQMEED

SEQ ID NO: 199408 - protein, 172 aa, Glycine max
  Coding DNA Sequence Number=SeqID_82630
  Gene Ontology: Mol. function=protein binding; Cellular component =apoplast; Biological process=response to biotic stimulus
  Homolog annotation: Hit_ID=Q1SSC0; Match level="QueryCoverage=78%, HitCoverage=83%, E-value=3e-45, Identity=48%"; Hit description =Thaumatin, pathogenesis-related
MGAEGDQIVSFGASSDAGGVIIGIGVGLGACGLEDLGIDGGLAGLWASIGARAAANGAHGVEVAHAPGVAAFSGSLEGGDGDGVNSARVAGGLPPMPLQNRDPPQSPGVGPVWGELEASAGQNGLSCAGLDPGPHWKITEDDAETLSTVSVRKKMVVRKGLRLSSIEPIMAM

SEQ ID NO: 199409 - protein, 108 aa, Glycine max
  Coding DNA Sequence Number=SeqID_82631
MFSRGHRCSSKLFLLIADDDNLSSSDTFIADWGTELAENEALAQVLILIDGVSPTRMLGFGFGPQHSAHYTLTADLVLGVQWLKSLDPVVTDYMDLTMNLRISYSFSN

SEQ ID NO: 199410 - protein, 64 aa, Glycine max
  Coding DNA Sequence Number=SeqID_82632
MKRRTRGFIGKKEVPASRETHSSDRRVVVKKETHRVVAPGRPPLPPPVPPPLSPSHIMSRVSFS

SEQ ID NO: 199411 - protein, 78 aa, Glycine max
  Coding DNA Sequence Number=SeqID_82633
  Gene Ontology: Mol. function=nucleotide binding; Cellular component =membrane; Biological process=small GTPase mediated signal transduction
  Homolog annotation: Hit_ID=Q40196; Match level="QueryCoverage=92%, HitCoverage=33%, E-value=6e-34, Identity=95%"; Hit description=RAB11F
  Pfam annotation: Domain name=Ras; Domain location=14-78; Score=-36.0; E_value=1.4e-06; Accession=PF00071.12; Description=Ras family
MADAFDEECDYLFKAVLIGDSGVGKSNLLSRFAKDEFRLDSKPTIGVEFAYRNIKVGDKLIKAQIWDTAGQERFISSE

SEQ ID NO: 199412 - protein, 210 aa, Glycine max
  Coding DNA Sequence Number=SeqID_82634
  Gene Ontology: Mol. function=nucleotide binding; Cellular component =membrane; Biological process=small GTPase mediated signal transduction
  Homolog annotation: Hit_ID=Q6ZXT1; Match level="QueryCoverage=68%, HitCoverage=65%, E-value=3e-61, Identity=81%"; Hit description=Small GTPase
  Pfam annotation: Domain name=Miro; Domain location=21-120; Score=0.2; E_value=0.0052; Accession=PF08477.3; Description=Miro-like protein
  Pfam annotation: Domain name=Ras; Domain location=49-168; Score=97.0; E_value=5.7e-26; Accession=PF00071.12; Description=Ras family
  Pfam module annotation: Pfam domain module=Miro::Ras; Domain location= 21-120::49-168
MQFNLNSVTIRRGGSRTWACSTCVRERNMKVIERKALQGDIDLPYLRVQSYQCLSKTSIFLRKLRFRAITSSYYRGALGAMLVYDISRRSSYENVSKWLLELREFGGEDMVVVLVGNKCDLDGQSREVDKEEGKGFAETEGLCFMETSALKNLNVEEVFLQMITRIYDMTSQKNLAAKMDEKPINLLNGKEIHIADEVTATKQSSTCCSR

SEQ ID NO: 199413 - protein, 447 aa, Glycine max
  Coding DNA Sequence Number=SeqID_82635
MVQIDQQAAESLRKNEDFRLEEPSIDAPFKSGSGVSLKDQLKKKPLESNEYRGKLRSDPNFDGLKATASAPKLSPKSGPTLTDDDWTELLSAPSPTQSIASASGGNHGNGLPAPRGLGRSSSRKQKGLSSGSLATDVKRNPRTGNSGLRSLQKSDSVKEVKLSRKASDDGKESTSSTSTGRNFAVESETDGKWGKGLEYADKDSSEKLVVEEKRNEENQHRFNYRDISPPELLQEDDKTLAAETLLAWGVDEDQEAKIVEDVDGNQSRSMIQGRHELNSISDDLKRGSPVASDGISDSDTDSGSTSDSESEHEREERRKRRERILAEKVAAKAINAIKERENIVAKLEGEKESLEKILEERAKQQAQEASQLQSTMMETMEAVELEKQKHNNTRMEVLARLAKLETVNADLARSLAAVQWSLEVESHEADKGHLSQDLIPVTDSDGV

SEQ ID NO: 199414 - protein, 283 aa, Glycine max
  Coding DNA Sequence Number=SeqID_82636
  Gene Ontology: Biological process=protein folding
  Pfam annotation: Domain name=CASP_C; Domain location=46-267; Score= -94.3; E_value=0.0093; Accession=PF08172.3; Description=CASP C terminal
MIDPLMFCRTQKANEESSSNWSFTKSIFRAWDFKRKLVSKSVELEREIHEAEHSLINNKVAQLQEKARKLEADIEMTRKEIEEPTEVEVELKRRLQQMTDHLIQKQAKVRVSYIHLVVIVCECSWITVLNSDWTCLSDQSVQQVESLSSEKASLVFRIEAVSRLLDENMSASGAANMNPASSSSDLESGLWELSNSKLKPMLKARIHSGKIQLGSLLQQLDYIFVTGALFLKRNSTAKLWALIYLVCLHFWVFYILLSHSSPSNEGRSGAQISLENINNTGGV

SEQ ID NO: 199415 - protein, 139 aa, Glycine max
  Coding DNA Sequence Number=SeqID_82637
MASLESRRIFSAIDTSWKMIAPRDHRLAVSDRLPDPNRVAASQSTLTSPILENVSHGQLQTRSSVPFDFAMTVTRAIDGHGEAMGLSVAKSGDDGGAVDRGGGRQWWCTEVSDMDRRKKERRKNSDGGQLVVCGGDDER

SEQ ID NO: 199416 - protein, 582 aa, Glycine max
  Coding DNA Sequence Number=SeqID_82638
  Gene Ontology: Mol. function=protein serine/threonine kinase activity; Cellular component=mitochondrion; Biological process =protein amino acid phosphorylation
  Homolog annotation: Hit_ID=Q1RSC2; Match level="QueryCoverage=91%, HitCoverage=97%, E-value=1e-146, Identity=49%"; Hit description =Pentatricopeptide repeat
  Pfam annotation: Domain name=PPR; Domain location=120-154; Score =22.5; E_value=0.0015; Accession=PF01535.11; Description=PPR repeat
  Pfam annotation: Domain name=PPR; Domain location=155-189; Score =36.6; E_value=8.6e-08; Accession=PF01535.11; Description=PPR repeat
  Pfam annotation: Domain name=PPR; Domain location=190-224; Score =42.8; E_value=1.1e-09; Accession=PF01535.11; Description=PPR repeat
  Pfam annotation: Domain name=PPR; Domain location=225-259; Score =32.5; E_value=1.5e-06; Accession=PF01535.11; Description=PPR repeat
  Pfam annotation: Domain name=PPR; Domain location=260-294; Score =42.3; E_value=1.6e-09; Accession=PF01535.11; Description=PPR repeat
  Pfam annotation: Domain name=PPR; Domain location=295-329; Score =39.6; E_value=1.1e-08; Accession=PF01535.11; Description=PPR repeat
  Pfam annotation: Domain name=PPR; Domain location=330-364; Score =52.5; E_value=1.4e-12; Accession=PF01535.11; Description=PPR repeat
  Pfam annotation: Domain name=PPR; Domain location=365-399; Score =42.1; E_value=1.9e-09; Accession=PF01535.11; Description=PPR repeat
  Pfam annotation: Domain name=PPR; Domain location=400-434; Score =43.4; E_value=7.6e-10; Accession=PF01535.11; Description=PPR repeat
  Pfam annotation: Domain name=PPR; Domain location=435-468; Score =19.0; E_value=0.017; Accession=PF01535.11; Description=PPR repeat
  Pfam annotation: Domain name=PPR; Domain location=469-503; Score =15.5; E_value=0.11; Accession=PF01535.11; Description=PPR repeat
  Pfam annotation: Domain name=PPR; Domain location=504-538; Score =39.8; E_value=9.3e-09; Accession=PF01535.11; Description=PPR repeat
  Pfam annotation: Domain name=PPR; Domain location=539-573; Score =19.3; E_value=0.014; Accession=PF01535.11; Description=PPR repeat
  Pfam annotation: Domain name=PPR; Domain location=85-119; Score=13.7; E_value=0.18; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=120 -154::155-189::190-224::225-259::260-294::295-329::330-364::365 -399::400-434::435-468::...
  Pfam module annotation: Domain location=469-503::504-538::539-573::85- 119
MGERRRRVAELKKKKKKSGIGIGERVREKMLNGSRYVLPRSIHILFFSQHVRFFGHLHPPKFHTVDDTLLSFNRMLRKHPPPPIFVFDKLLGAIVRMGHYPTAISLFSQLHSKGITPSIATLTILINCYCHQAHLSFAFSLLGTILKMGFQPNMVTFNTLINGFCINGMVSKAMAFRLDLMAKGYPLDEFSYGSLINGLCKNGQTRDALQLLQKMEEDLVRPNLITYSTVIDGLCKDRLIADALRLFSLVTSRGILVDVVAYNSLIHGCCSVGQWREATRLLTMMVRGNINPDDYTFNILVDALCKEGRIVEAQGVFAVMMKRGEKPDIVTYNALMEGFCLSNNVSEARELFNRMVKRGLEPDVLNYNVLINGYCKIDMVDEAMVLFKEIRCKNLVPNLATYNSLIDGLCKLGRMSCVQELVDEMCDRGQSPDIVTYNIFLDAFCKSKPYEKAISLFRQIVQGIWPDFYMYDVIVENFCKGEKLKIAEEALQHLLIHGCCPNVRTYTIMINALCKDCSFDEAMTLLSKMDDNDCPPDAVTFETIIGALQERNETDKAEKLRLEMIERGLVNDEARSDNLVPC

SEQ ID NO: 199417 - protein, 107 aa, Glycine max
  Coding DNA Sequence Number=SeqID_82639
  Gene Ontology: Mol. function=peptidyl-prolyl cis-trans isomerase activity; Cellular component=integral to membrane; Biological process=protein folding
  Homolog annotation: Hit_ID=UPI00003C0BFE; Match level="QueryCoverage =83%, HitCoverage=35%, E-value=2e-20, Identity=62%"; Hit description =PREDICTED: similar to CG6282-PA, isoform A isoform 2
MGCSLIILQWGEDRRFDEMRSNLGRLAIFWIFQAVWVWVVSLPVTLVNASDRNPFLQVQQINKSCISKDLQKIEGSGVMLDYGNILVILTILVKMYMEELQQQLGYA

SEQ ID NO: 199418 - protein, 43 aa, Glycine max
  Coding DNA Sequence Number=SeqID_82640
MVNWTQIPHFHTSHQNNTSMLLWNPLEGTAFNKMQHIKAKNVN

SEQ ID NO: 199419 - protein, 67 aa, Glycine max
  Coding DNA Sequence Number=SeqID_82641
MTNPGSKKCKSRFRSTLLFSSLPVLAFSLLDLSYPAFFLSYKPITLFLVLGDCEESVHSLVEFARYM

SEQ ID NO: 199420 - protein, 693 aa, Glycine max
  Coding DNA Sequence Number=SeqID_82642
  Gene Ontology: Mol. function=transferase activity; Cellular component= membrane; Biological process=protein metabolic process
  Homolog annotation: Hit_ID=Q9M3I0; Match level="QueryCoverage=84%, HitCoverage=100%, E-value=0.0, Identity=87%"; Hit description =Putative glucosyltransferase
  Pfam annotation: Domain name=Glycos_transf_2; Domain location=232 -407; Score=18.4; E_value=3.8e-05; Accession=PF00535.16; Description =Glycosyl transferase
MAPRLDFSNWWTKDTQKGTPVVVKMENPTFSVVEINGADAAFRPVEKSRGKNAKQVTWVLLLRAHRAVGCVTWLAAVLWALLGAIKKRLIHGQGVSVESESDKLEKGKLLFRVIRVFLVTSLAVLAFEVVAYLQGWHFGNPNLHIPRTSDLEGLLHLAYVAWLTFRAEYIAPPIQALSKFCVVLFLIQSADRMLLCLGCFWIKYRKVKPRIEGGPFESDDVEGSESYYPMVLVQIPMCNEREVYDQSISAVCGIDWPRDRLLIQVLDDSDDESIQWLIKAEVSKWSQKGINIIYRHRLVRTGYKAGNLNSAMSCDYVKDYEFVAIFDADFQPNPDFLTQTVPHFKDNPELGLVQARWSFVNKDENLLTRLQNINLCFHFEVEQQVNGIFLNFFGFNGTAGVWRIKALEESGGWLERTTVEDMDIAVRAHLNGWKFIFLNDVKVPCEVPESYEAYRKQQHRWHSGPMQLFRLCLPAIVRSKVSPWKKANLILLFFLLRKLILPFYSFTLFCIILPLTMFVPEAELPLWVICYVPVFMSLLNILPAPKSFPFIVPYLLFENTMSVTKFNAMVSGLFQLGSSYEWVVTKKAGRSSESDLLAAAEREAKSIEQKIHRGASDSDLIESHQLKEHKEAAPKKVKKSNKIYTKELTLAFLLLTASVRSLLSAQGVHFYFLLFQGVTFLLVGLDLIGEQMS

SEQ ID NO: 199421 - protein, 726 aa, Glycine max
  Coding DNA Sequence Number=SeqID_82643
  Gene Ontology: Mol. function=voltage-gated potassium channel activity; Cellular component=integral to membrane; Biological process=potassium ion transport
  Homolog annotation: Hit_ID=Q9SJA4; Match level="QueryCoverage=99%, HitCoverage=99%, E-value=0.0, Identity=70%"; Hit description =Putative cyclic nucleotide-gated ion channel 14
  Pfam annotation: Domain name=Ion_trans; Domain location=132-402; Score=76.4; E_value=9.3e-20; Accession=PF00520.21; Description=Ion transport protein
  Pfam annotation: Domain name=cNMP_binding; Domain location=503-603; Score=21.2; E_value=0.0031; Accession=PF00027.19; Description=Cyclic nucleotide-binding domain
  Pfam module annotation: Pfam domain module=Ion_trans::cNMP_binding; Domain location=132-402::503-603
MELKNEKLVRFANDEKHTLEPLWEKIDAHKHHEKAFHVYPEFKISNGEKNRMSIKIPSLEKLKVFPEKHEPWKKRILDPGSDVILEWNRAFLFACILALFVDPLFFYLPSVANDGKSLCMATDLNLGIVVTCFRTFADVFYLLNMAIKFRTAYVSPSSRVFGRGELVMDPRLIARRYLRSEFFLDLVATLPLPQIVIWFIMPAIRSSHADHTNNALVLIVLLQYVPRLYMIFPLSSQIIKTTGVVTKTAWAGAAYNLLLYMLASHVLGASWYLLSIERHATCWKSECRNESLPVKCALKYLDCSTLNHDDRMKWVNTTSVFGNCNPESSTSFNYGIFGNAVENNVVSSAFVEKYLYCLWWGLQNLSSYGQSLTTSTFVWETAFAILIAILGLVLFAHLIGNMQTYLQSITVRLEEWRLKRRDTEEWMSHRQLPQNLRERVRRFVQYKWLATRGVDEETILRGLPTDLRRDIQRHLCLDLVRRVPFFSQMDDQLLDAICERLVSSLSTQGTNIVREGDPVTEMLFIIRGRLESSTTNGGRTGFFNSITLRPGDFCGEELLAWALLPKSTLNLPSSTRTVKALVEVEAFALRAEDLKFVANQFRRLHSKKLQHTFRFYSHHWRTWAACFIQAAWRRFKKRMLTKSLSLRECQSFNHDEQVGDEMEHGEEEHSAVTSNTAQVKQNLGVTILASRFAANTRRGVQKIKDVELPKFQKPEEPDFSVEPDDG

SEQ ID NO: 199422 - protein, 341 aa, Glycine max
  Coding DNA Sequence Number=SeqID_82644
  Gene Ontology: Mol. function=translation initiation factor activity; Cellular component=eukaryotic translation initiation factor 3 complex; Biological process=translational initiation
  Homolog annotation: Hit_ID=Q9XHM1; Match level="QueryCoverage=69%, HitCoverage=25%, E-value=2e-66, Identity=58%"; Hit description =Eukaryotic translation initiation factor 3 subunit 8
  Pfam annotation: Domain name=PCI; Domain location=3-110; Score=84.9; E_value=2.4e-22; Accession=PF01399.17; Description=PCI domain
  Pfam annotation: Domain name=eIF-3c_C; Domain location=111-249; Score= 195.2; E_value=1.6e-55; Accession=PF05469.2; Description=Eukaryotic translation initiation fac
  Pfam module annotation: Pfam domain module=PCI::eIF-3c_C; Domain location=3-110::111-249
MSEIMYGCHKDLRKGDFQKAFDIIVSLDVWKFVRNRDTVLEMLKDKIKEEALRTYLFTFSSSYESLSLDQLTKFFDLSVSRTHSIVSRMMINEELHASWDQPTGCILFQDVEHSRLQALVFQLTEKLSVLAESNEKATEARVGGGGLDLPLRRRDGQDYAAAAAAGSGTASTGGRWQDLSPSQPRQGSGRAGYGGRPMTLGQAAGSGYSRGRGRGSYGGSGRTSQRGSALRGPQGDGPARMICLAHLREKLMSFAQTYIFKRAKTLFRFWLLFHCLQRLRPDAPTIVPNAAGSAPPPKSDPNLEFYDSLDIVGLWLSRWLERMTRSTMLGSEEVPKMRKKT

SEQ ID NO: 199423 - protein, 94 aa, Glycine max
  Coding DNA Sequence Number=SeqID_82645
  Gene Ontology: Mol. function=peptidyl-prolyl cis-trans isomerase activity; Cellular component=integral to membrane; Biological process=protein folding
  Homolog annotation: Hit_ID=UPI0000D57967; Match level="QueryCoverage =83%, HitCoverage=66%, E-value=5e-14, Identity=48%"; Hit description =PREDICTED: similar to CG6282-PA, isoform A, partial
MGTVIESHFLAFTALVTIAYQFLFFVVTALLKFDKVTDFAGSTNFIIIAALTLVIKASWYFRQIILTLFVGTWGLRLCLFLLFRYHDGTVVLGL

SEQ ID NO: 199424 - protein, 134 aa, Glycine max
  Coding DNA Sequence Number=SeqID_82646
  Gene Ontology: Mol. function=protein serine/threonine kinase activity; Cellular component=membrane; Biological process=protein amino acid phosphorylation
  Homolog annotation: Hit_ID=Q67UL6; Match level="QueryCoverage=89%, HitCoverage=10%, E-value=3e-41, Identity=70%"; Hit description =Putative CTR1-like kinase kinase kinase
  Pfam annotation: Domain name=Pkinase_Tyr; Domain location=1-106; Score=-162.8; E_value=0.018; Accession=PF07714.7; Description =Protein tyrosine kinase
MFQAEWMAPEVLRNELSDEKCDVFSYGVILWELSTLQQPWGGMNPMQVVGAVGFQHRRLDIPDNVDPAIADIIRQCWQTCMTQYATFLHYSDPKLRPTFTEIMAALKPLQKPITASQVHRLSVQSSRVAEDPAG

SEQ ID NO: 199425 - protein, 664 aa, Glycine max
  Coding DNA Sequence Number=SeqID_82647
  Gene Ontology: Mol. function=translation initiation factor activity; Cellular component=eukaryotic translation initiation factor 3 complex; Biological process=translational initiation
  Homolog annotation: Hit_ID=Q9XHM1; Match level="QueryCoverage=100%, HitCoverage=71%, E-value=0.0, Identity=74%"; Hit description =Eukaryotic translation initiation factor 3 subunit 8
  Pfam annotation: Domain name=eIF-3c_N; Domain location=39-650; Score =1296.6; E_value=0; Accession=PF05470.3; Description=Eukaryotic translation initiation fac
MASRFWTQGGSDSEEEESDYDEEVDTTVGEASGQAVTSRYLQDNASDSDDSDGQKRVVRSAKDKRFEEMASTVDQMKNAMKINDWVSLQESFDKINKQLEKVMRVTESERVPNLYIKALVMLEDFLAQALANKDAKKKMSSSNAKALNSMKQKLKKNNKQYEDLINKCRENPESEEEKEEEESDEEYDSDGEIIDPDQLQKPEAKSDSEASQYEDEKPDAGEGPWDQKLSKKDRLLDRQFMKNPSEITWDAVNKKFKEVVAARGRKGTGRFEQVEQLTFLTKVAKTPAQKLEILFSVVSAQFDVNPGLNGHMPINVWKKCVQNMLIILDILVQYPNIMVDDSVEPDENETQKGAEHNGTIRVWGNLVAFLERIDVEFFKSLQCIDPHTRDYVERLRDEPTFLVLAQNVQEYLERVGNFKAASKVALRRVELIYYKPQEVYDAMRKLTELTEDGDNGGEASEKEFEESRIPTAFVVTPEVVTRKPTFPENSRTLMDILVSMIYKYGDERTKARAMLCDIYHHALLDEFSIARDLLLMSHLQDSVQHMDISTQILFNRAMSQLGLCAFRVGLISEAHGCLSELYSGGRVKELLAQGVSQSRYHEKTPEQERLERRRQMPYHMHINLELLEAVHLVSAMLLEVPNMAANVHDAKRKVISKTFRRLLE

SEQ ID NO: 199426 - protein, 595 aa, Glycine max
  Coding DNA Sequence Number=SeqID_82648
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=97%, HitCoverage=53%, E-value=1e-144, Identity=50%"; Hit description=CTR1- like kinase kinase kinase
  Pfam annotation: Domain name=Pkinase; Domain location=440-594; Score =10.7; E_value=3.4e-09; Accession=PF00069.15; Description=Protein kinase domain
  Pfam annotation: Domain name=Pkinase_Tyr; Domain location=442-595; Score=12.8; E_value=2.9e-13; Accession=PF07714.7; Description =Protein tyrosine kinase
  Pfam module annotation: Pfam domain module=Pkinase::Pkinase_Tyr; Domain location=440-594::442-595
MYLEVVIDDDMNFREYIVDLMAAPGTLIPSDATGSHIECDDSSFVASPSSRELDSHVASFSSGVGSSSEEASDSGTLDKDNKSKYFGYARKESNVSGAATGKEELKRPSNESNNTPYEEKIILQESPIRSNYPYMHGRSPSWTEGISSPAVRRMKVKDVSQYMIDAAKENPNLAQKLHDILLESGVVAPPNLFSEIYHGQLSTPTEANFPTEQKDENKQGSVQQETKTDDNLVPARFLPPLPHHRVHRKVTPSSSSQLEHSKPVEGLGIGLPLDSGEAAGQHISSQVEATQVKYGKNMPVAAAAAAAAAVVASSMVVAVTKSNADSNLEIPVAAAATATAAAVVATTAAVSKQYEQGSWSGGDTEGAGCEPKCSGDGEHNALGENTEGERKSDRSVSNDSTKSDSALDDVAEYDIPWDEIAVGERIGLEKLNCNYVACIWHAGSYGEVYRGEWHGTEVAVKKLLYQDISGELLEEFKSEVQIMKRLRHPNVVLFMGAVTRPPNLSIVSEFLPRGSLYRLIHRPNNQLDERRRLQMALDAARGMNYLHNCTPVIVHRDLKSPNLLVDKNWVVKVCDFGLSRMKHSTFLSSRSTAGT

SEQ ID NO: 199427 - protein, 95 aa, Glycine max
  Coding DNA Sequence Number=SeqID_82649
MQSLHRGQVIIMQSFQSLGLPSIMSVDEFLAQVAWLGVQLSLSRGVAQEHTSPVPISPTPISEDTMPSAPAMEPEQPILQDVPAAPVLDLNEDQP

SEQ ID NO: 199428 - protein, 150 aa, Glycine max
  Coding DNA Sequence Number=SeqID_82650
MVLAIYAPCLANTACERPKTIVWLLLPALLLCKHSLPDLSRPWPARCSSWPARCSNQVATHIFDELKICSKFEFGQNLFESKREKSRLKGIPRFKEVFAKYKARTRKRASNHWAIRTGVYSSRSRGSQISGLSAISDKTSQNQFDFEQCG

SEQ ID NO: 199429 - protein, 82 aa, Glycine max
  Coding DNA Sequence Number=SeqID_82651
MGSEELKDQDEEGKARLRCTSLELEESLRRGKGEPRYNSGSGRGMYGFPQQVQKHLTRDLLENLKPQTEKPWILIGDFNQTL

SEQ ID NO: 199430 - protein, 181 aa, Glycine max
  Coding DNA Sequence Number=SeqID_82652
  Homolog annotation: Hit_ID=Q1SDI2; Match level="QueryCoverage=28%, HitCoverage=6%, E-value=3e-08, Identity=50%"; Hit description=RNA -directed DNA polymerase
  Subcellular localization annotation: CTP_CleavageSite=64; ConfidenceScore=5.06e-01
MEKASHIAYILGKYKRASGLKWWRLLTQPKSLMARTLKAKYFPSSCALTATRGHSPSFSWVSILSTTRGGRDHVEDYSTRSWKQSTIKNTFTEHQIFQSRTINKLNIRCFLEVDLEGECCPKVLKLGMYSLPKYPSVKKNLQKKINRGLSKEHKNLEEMANICSNDKVKSQASTRRDGQED

SEQ ID NO: 199431 - protein, 86 aa, Glycine max
  Coding DNA Sequence Number=SeqID_82653
MVWKEKGERNEHELVRSGRVGGEVGELRSGGVGDEEECVRLRVLFQIFGVLFWTLSARRVKHVGFHAPWMRMLSCHSITLSPNPFF

SEQ ID NO: 199432 - protein, 222 aa, Glycine max
  Coding DNA Sequence Number=SeqID_82654
  Gene Ontology: Mol. function=RNA-directed DNA polymerase activity; Biological process=RNA-dependent DNA replication
  Subcellular localization annotation: CTP_CleavageSite=26; ConfidenceScore=5.47e-01
IDIPPLSQVEVFSMPQASYFKGVTLPSNLVSTSLTSRLRNPFVSGIIDTSLPPTWKGVTLDKYYGTTDLDKHIGIYVAQVGLYIMDDFVLCKALLTSLKGVPPQTFTGADFKGMDPTQDDPMDGYKDVMVKYVVIHANTSYNILIVQPLINVIEAIVSTLHLAVKFLTDDGLIVTVHVDQKATQECYMSSLKLTHIKEVLRSQAINVVTWVEMDKAESLDLG

SEQ ID NO: 199433 - protein, 276 aa, Glycine max
  Coding DNA Sequence Number=SeqID_82655
  Gene Ontology: Mol. function=nucleic acid binding; Cellular component= nucleus; Biological process=DNA integration
  Homolog annotation: Hit_ID=Q1S1X7; Match level="QueryCoverage=79%, HitCoverage=18%, E-value=6e-40, Identity=40%"; Hit description =Integrase, catalytic region; Zinc finger, CCHC-type; Peptidase aspartic, catalytic
MHDEIVRTLIEVCHVLGLKKNLVFVGAMDSKGFSGLVESEVIQIRGKEKSMGPSRVPSLGGARYFLSIIDDYSRMTWNQIGKIRKCLRTNNGLEFYSTKPNEFCKGEDIARQRTVEVVSTCYLVNRSSSTAIDFRIPIEVWSNKPVEYSMLKVFECPTYYHVRESKLEPRAKKGVFMGYGDGVKGFRIWLPSGRKVIVSTNVIFDELSMFHSKSEEDSGKAKDATKLVKFESPTIKNLVIRRSLKHLMRLIRNFKCNLNIRIQHQLRSLIRQVRTI

SEQ ID NO: 199434 - protein, 324 aa, Glycine max
  Coding DNA Sequence Number=SeqID_82656
  Gene Ontology: Mol. function=ubiquitin thiolesterase activity; Cellular component=nucleus; Biological process=ubiquitin-dependent protein catabolic process
  Homolog annotation: Hit_ID=Q1SM56; Match level="QueryCoverage=99%, HitCoverage=28%, E-value=1e-129, Identity=71%"; Hit description =Peptidase C19, ubiquitin carboxyl-terminal hydrolase 2; Ubiquitin carboxyl-terminal ...
  Homolog annotation: Hit description=hydrolase, N-terminal region 1
  Pfam annotation: Domain name=UCH; Domain location=105-313; Score=2.4; E_value=1.2e-06; Accession=PF00443.19; Description=Ubiquitin carboxyl- terminal hydrolase
MTRPTTRSKNKRQRQGDDDGGGTSDIWRKIHITGAVTEDDMNQLYMIWKPVCSGCRVNTKDNPNCFCALVPPANGTRKSGLWQKMADFVESLGPDPNMDLRVSDSSPAGLTNLGATCYANSILQCLYMNKSFREGIFSVEPDVLQQQPVLDQLTQLFVHLHASKMAFIDSSPFVKTLELDNGIQQDSHEFLTLLLSLLERCLSHSKIAKARTIVQDLFRGRKCPKNNYLGNDVHVASMCSQCGRDSEASSKMEDFYGLELNIKGLKGLDESLDDYLAIEELHGDNQYFCESCKTRVDATRSIKLCTLPDVLNFQLKRYVFLPQV

SEQ ID NO: 199435 - protein, 766 aa, Glycine max
  Coding DNA Sequence Number=SeqID_82657
  Gene Ontology: Mol. function=ubiquitin thiolesterase activity; Cellular component=nucleus; Biological process=ubiquitin-dependent protein catabolic process
  Homolog annotation: Hit_ID=Q1SM56; Match level="QueryCoverage=99%, HitCoverage=71%, E-value=0.0, Identity=77%"; Hit description =Peptidase C19, ubiquitin carboxyl-terminal hydrolase 2; Ubiquitin carboxyl-terminal ...
  Homolog annotation: Hit description=hydrolase, N-terminal region 1
  Pfam annotation: Domain name=UCH; Domain location=1-131; Score=-72.1; E_value=0.047; Accession=PF00443.19; Description=Ubiquitin carboxyl -terminal hydrolase
MKKKVTSAFSFPAELDMRHRLSEPSQFELIYDLSAVLIHKGTAVNSGHYIAHIKDVNTGQWWEFDDENVTNLGCHPFGEGTSSTSKSVKTDVLHSNCSEAMLADSNGLDATHAQSLLVETFSSSDAYMLMYHLKHSKNVGEKGGIVYGANLEVEGNAVTAQDSACLPSHFCKEIQNFNASYLDSCEQYKHRKELELSHINERRQEVRSILAEAPTQPLEQPYFWICSDWLRQWADNIIPIALDNTSIQCSHGKVPVSKVTSMKRLSSKAWDKLLSKYGGGPTLSHEDCCWDCLIDGAQNVVSADTYRDQRESLKRLARDILDGNCEDGMYYVSRPWLQQWWKRKVVDAPSEADAGPTAAICCPHGQLMPEQAVGAKRLLVPEDFWLFLYKDAISVKPDDPLGCPTFPLDSRRCSQCSDELSEEACLEDSLRLVKQMQRQNHEKLFVGKSMPLSLHCKYFLVPSSWISKWRNYINLAVKNSDKPETLDGVIDSLMCEKHSRLIERPPELVFRRGAIIARESSVSGLTIISENDWKCFCEEWSGIETKGISARIENVNDSENALTGSCREMPICEDQLNTWDKVNNESGNGHIVIKTCPEVCESCVGEKESCELMQKLNYCNQDISVILVRGKEVPKSILEASKGFVEIDRRVSKRSRKTKNGSSISLKVSASTSIYQLKMMIWESFAVVKENQILQKGDRTIDVDNEYATLVDANIFAGDQIIVRDSEIHENRDIADELCDEEMETQHTEAGFRGTLLTSNVSSQVV

SEQ ID NO: 199436 - protein, 208 aa, Glycine max
  Coding DNA Sequence Number=SeqID_82658
  Homolog annotation: Hit_ID=Q2R9P0; Match level="QueryCoverage=44%, HitCoverage=4%, E-value=8e-16, Identity=51%"; Hit description =Armadillo/beta-catenin-like repeat family protein, expressed
MTSKVFDSGKSLFGKIFSALMKPLDMLGDDLVLKCNLEDPVVGFSNDLSQQMLPSIFIQLILWGSLKRFQLMGTPYCLTTQALLTPSQVIEPFPFWDSHPKLLSSLSQKCYFIFLHRNIFQHDITTKSSVVTLVQLAGIEILNFKQTATKALEKNFTNWTKAVTDAGGIFELAKLWEIFPSMKEMLDLVTSASVSACRALLKISQLKK

SEQ ID NO: 199437 - protein, 88 aa, Glycine max
  Coding DNA Sequence Number=SeqID_82659
MGCQWIYKKKFGSTNDKSSTTLDMELEQLDVKTTFLHGRLEEYIPMQQLEGFVVQGKKLYLENPTDMFMKPVPRSKFMHRLDLLNVDC

SEQ ID NO: 199438 - protein, 91 aa, Glycine max
  Coding DNA Sequence Number=SeqID_82660
MTTPTTISITVAITNITILIVIVTIIIVTNVITTIIVTNKVAIVVVTTASGGDDNNGHIGSNGGSHDDDHNDGGGNDDDDSDNYGDDLDTN

SEQ ID NO: 199439 - protein, 186 aa, Glycine max
  Coding DNA Sequence Number=SeqID_82661
  Gene Ontology: Mol. function=nucleic acid binding; Cellular component= mitochondrion; Biological process=DNA integration
  Homolog annotation: Hit_ID=Q1SRN1; Match level="QueryCoverage=75%, HitCoverage=13%, E-value=9e-28, Identity=66%"; Hit description =Integrase, catalytic region
MLQPYGISIGLKEHSNPVTPKAYTPKSPPGPFLPDSVVRALQYSTITCPELSYAVNKVCQFKSHPLEAHWTTIKRILRYLKGTLHHGLHLRSTLSTNSIPIKGLCDADWASDPEDHISTSVLHSRTKHMEIDVFFVRERVLAKQLLTRHIPTIDQWANALAKPLAPSRFMFLGDKLAEFHSGSHPP

SEQ ID NO: 199440 - protein, 80 aa, Glycine max
  Coding DNA Sequence Number=SeqID_82662
MAMAWQRRVINIKSLRKLVRASTSQLVESTPFDLDTLIFVEPNDDAQSEEDLDDDDGDGDDDESDDIHGDDPIRGLNMLL

SEQ ID NO: 199441 - protein, 444 aa, Glycine max
  Coding DNA Sequence Number=SeqID_82663
  Gene Ontology: Mol. function=methyltransferase activity; Biological process=cell division
  Homolog annotation: Hit_ID=Q6YXY1; Match level="QueryCoverage=87%, HitCoverage=83%, E-value=1e-103, Identity=55%"; Hit description =Putative methyltransferase
  Pfam annotation: Domain name=Methyltransf_5; Domain location=83-444; Score=281.4; E_value=1.7e-81; Accession=PF01795.10; Description=MraW methylase family
  Subcellular localization annotation: CTP_CleavageSite=48; ConfidenceScore=5.28e-01
MALLSRITTSSLLLSLSSKPICNAFLLSRSTATTCTKHQNKKKKENAKAALAKEKRRTRSDKQFNHDAIIERCNINDTDTDTKFSHVPVMLGEVLDVFSSTFLTSFVDCTLGAAGHSTAGLRNGMKQVIKGHQELKYFVGMDVDSVAHDIAQPRLDAVLNGGVKAITVLRNFRDVKSVLREFDELKLGVDGILMDLGISSMQVDDPVRGFSVLGDGPLDMRMDPQGRILEGKCGVITIDWKSMASLKAEDILNSWPDSEVGRILREYGEESNWRTLQKKIVNARLHGGLHSTSDLLDLIRRVAPPMRGGRQGWIKTATRVFQALRIAVNDELKTLEDSLYYCFDCLAPGGRLAVISFHSLEDRIVKQTFLNIIKGSKDVEERESLNSDLRKTSDEIKEKEAWIKQVIYGSNGTILTKRPITPSGEEEKLNRRSRSAKLRVIQKH

SEQ ID NO: 199442 - protein, 111 aa, Glycine max
  Coding DNA Sequence Number=SeqID_82664
MVETWLRRLPRRWTVTKLPRRWMVALLFMETSSMHLATSSRQQWLVAEEEEEPFPTMVTNGDAGEVSKNNTKMAEVRKKKETVLGRREENAGHYGLFTSIVECTYKNAGCT

SEQ ID NO: 199443 - protein, 58 aa, Glycine max
  Coding DNA Sequence Number=SeqID_82665
MTNKAKGKGKEVAGKGSAGKCKGAFDDDKTSGVQKRNKPCSNEPVSPVIFFGFVDVQT

SEQ ID NO: 199444 - protein, 127 aa, Glycine max
  Coding DNA Sequence Number=SeqID_82666
MQSQGLALPPKSEVGPSATHVSTKESCIDPLGNDPDTGDSEKYRLCIEENPPRLVALGKLYEVGVEKVRDADAPIPVPTEEVQLVGHAHNTFVAWPTHLVKRLSEQSPEWPVHNSVRSHFFLTAHNL

SEQ ID NO: 199445 - protein, 80 aa, Glycine max
  Coding DNA Sequence Number=SeqID_82667
MVFMQEFECGPTKNTVVGTRPRPEPSNTEERDREDLDFRLMHPFLKVTREAMARVIISPCKRVQVSETLQECPRGSICGT

SEQ ID NO: 199446 - protein, 139 aa, Glycine max
  Coding DNA Sequence Number=SeqID_82668
MAERVHGMYYTPQTFAEYPTQMYQYPFQGHHTDTSASQQPFGGFAETQAHFSWPTMTPSQQYHGPIPTPNAPLGTQWNVPGQIPNTGDLFGVDLRHAFSAEANEEEAGRHWGRRNPYRQARRWDRPCGTSSRHHGHQNE

SEQ ID NO: 199447 - protein, 75 aa, Glycine max
  Coding DNA Sequence Number=SeqID_82669
MPQPHGINMGLKEHSNRVSLPPRPRLRRICLGLTFLIQVQPLKQFYTQTLLMNYTIPTTSYSGFNSQHKYCHIKY

SEQ ID NO: 199448 - protein, 303 aa, Glycine max
  Coding DNA Sequence Number=SeqID_82670
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=84%, HitCoverage=16%, E-value=1e-29, Identity=49%"; Hit description=Chromo
MADNTRMKELTGDVKRILETMENRNKEYAARFETLETTLEMTLKDKTRDPGSISLAMNNHPFKVVPWYQMMTHENSFTTWIAFTRALETEFGPSPCECPRSQLFKLTQIGSVQSYYVQFTSLANRVQGITQEALLDCFVGGLKPNIRMDVIAQSPTSLLRTISLAKLYEEKYTPKLKPFSSSFSSKTQTSNTNSNLNTNQNSPQSLKSTSLPPLLPTPYIKPINVKKMTSTEMQLRRERGLSFTCDDKFSPSHRCPNKQHFVLQWEEEDDPAFQPDPPDEVETAGDPSLQDHHLSYNALKGSS

SEQ ID NO: 199449 - protein, 238 aa, Glycine max
  Coding DNA Sequence Number=SeqID_82671
  Homolog annotation: Hit_ID=Q27CU5; Match level="QueryCoverage=68%, HitCoverage=50%, E-value=2e-15, Identity=32%"; Hit description=GGDEF
MAGRVRALRASRGLPGRGASLARAATAQGADGAPAQCSDRQSWLRDAVIVSYIRSTAWMGFLRQWWTEPVPTGWLRGFLHARKLDRTVRNLIGGYALIFAAICIAVQFSDTGPRSMIGRVIVGLCAVGSLGWALRWVVGPWPSLRLRSTRGLGGHGAFHARRRLRELLPGEPAAGGPRRLVRADDHRAVVSPVRRGYRRRCDDRAGEGDQHAVGRGADPGGHSIRDCGGAMGRTCRAA

SEQ ID NO: 199450 - protein, 247 aa, Glycine max
  Coding DNA Sequence Number=SeqID_82672
  Gene Ontology: Mol. function=hydrolase activity, acting on ester bonds; Cellular component=nucleus; Biological process=biosynthetic process
  Homolog annotation: Hit_ID=Q3PL88; Match level="QueryCoverage=95%, HitCoverage=19%, E-value=6e-38, Identity=40%"; Hit description=Amino acid adenylation
  Pfam annotation: Domain name=AMP-binding; Domain location=1-204; Score=-63.4; E_value=6.5e-05; Accession=PF00501.18; Description=AMP -binding enzyme
MDPVKLYHFIERQQPSVIQATPTVWSTIVHHLPAAGQRPLTVLCGGEKMPAALLTQLRRIATRVLQVYGPTETTIWSTCADLTHEGASDCIGTPIQSTDVLVMDQAGNPMPSGAFGELWLGGAGVSPGYWRNPTLSDKVFLRRQAFGTERYMYRTGDIVRFNRQGQLEYLGRNDHQVKIRGHRIELSEIDLSLSSLDNIERSLSLIVGEGQQARIVSYLQLTPGEELNEKAVRTALKARLPNIMIPS

SEQ ID NO: 199451 - protein, 81 aa, Glycine max
  Coding DNA Sequence Number=SeqID_82673
MELHGAWSWRMEIELRSFGGEGSKKGVQEVKASLPFYVNSHTQPTTGASSCGTVMELGITPSLTSRMLMQILCNSSGQQQC

SEQ ID NO: 199452 - protein, 153 aa, Glycine max
  Coding DNA Sequence Number=SeqID_82674
MFELGFRQNYRKNPKERNDEVHDHPEEAATDDAVTDAEGFSGEPHDTSVLMDYQRLELKLSSHGRKVEKFGRPAPEIKGLVAATRLSPLIACSLDTSDQGLISAFMERRGNYYLRRCGIVVTYAHNRVFHSFQALHVDEVILLLVELLEVSSK

SEQ ID NO: 199453 - protein, 91 aa, Glycine max
  Coding DNA Sequence Number=SeqID_82675
MGQICVVPRKCSTDYMELFYIISHPFMSPAQPRDPPRLPPKVHDDTFVEPDVPQHPDYIDDLSVEEEDPFEDVSDAKETLEIEEDPFKNYS

SEQ ID NO: 199454 - protein, 382 aa, Glycine max
  Coding DNA Sequence Number=SeqID_82676
  Gene Ontology: Mol. function=nucleic acid binding
  Homolog annotation: Hit_ID=Q6H7U2; Match level="QueryCoverage=78%, HitCoverage=76%, E-value=8e-24, Identity=31%"; Hit description =Putative BRI1-KD interacting protein
MPLYFFVDTYTYQRDRCAHAALPNDYAPVVFPNVSHELKIAEYSPTMSLEKKSDRRHRRKQDTNGQSDISGNLKVSDRVQGQVKEGKLLSSGSRNNLEEQLKKVDSDISTLQNRKFQLEVYLDESVQEVDSLNSRIRELEAQLCKEDEECKRSQVRLQRFGDQLVSDISRIGANEEDLSIDIISNGENTGLHPIAKHNVEHNDASSHKKRLHIEHDALEELKQDRSKDGHLVETARTRKRSRWNLSDQLKEESLGTPDNGTEVTRSLDLEGKHKKGLKQPRIEAPSTSMAAHVVDEDVDIERYDGNDINETANTENDNGAAYKLCYLVAITCSMKATTRMLMWMVDEEATGARIGSGTLFNVGKSLDFQLLHSKVTEWGYAK

SEQ ID NO: 199455 - protein, 217 aa, Glycine max
  Coding DNA Sequence Number=SeqID_82677
  Gene Ontology: Mol. function=nucleic acid binding
MLEEIRCYAMRSMSGHKLKLAARSGPLCPMQQSKLDREKKLSNNWRPEWAGDDNGARFKVHCVGKKVDVDLDMHTCLPCMHACAAINWRRKRPEEFCNHWLTLGAYNATYQFFFIKPTHGAQYWTPTEYEKPQPPNKKSQRGRPKKMRRKDTDEELISRKKLKRQLRPPGVVAQPPGSQQPMPNVPFNMFGSSSRYRPPPIQPNYNILIRNPSTSQQ

SEQ ID NO: 199456 - protein, 357 aa, Glycine max
  Coding DNA Sequence Number=SeqID_82678
  Gene Ontology: Mol. function=oxidoreductase activity; Cellular component=vacuole; Biological process=response to oxidative stress
  Homolog annotation: Hit_ID=Q9ZNZ6; Match level="QueryCoverage=98%, HitCoverage=99%, E-value=1e-125, Identity=65%"; Hit description =Peroxidase precursor
  Pfam annotation: Domain name=peroxidase; Domain location=74-320; Score=436.1; E_value=4.7e-128; Accession=PF00141.13; Description =Peroxidase
MDSSSVQQDNACRLTCIYRLNSLAIKVSAKYAQMGSQSCFKALIICLIALIGSTQAQLQLGFYAKSCPKAEKIILKYVVEHIRNAPSLAAALIRMHFHDCFVNGCDGSVLVDSTPGNQAEKDSIPNLTLRGFGFIDAIKRLVEAECPGVVSCADILALTARDSIHATGGPYWNVPTGRRDGLISRAADPLRSLPAPFHNLTTQLTLFGNVGLDANDLVLLVGAHTIGVAHCSSIATRLYNFTGKGDIDPTLDSEYAKNIKTFKCKNINDNTIIEMDPGSRDTFDLGFYKQVVKRRGLFQSDAEFLTSPITRSIIDRQLQSTQGFFEEFAKSIEKMGRINVKLGTEGEIRKHCARVNN

SEQ ID NO: 199457 - protein, 413 aa, Glycine max
  Coding DNA Sequence Number=SeqID_82679
  Gene Ontology: Cellular component=integral to membrane
  Homolog annotation: Hit_ID=Q4SM68; Match level="QueryCoverage=57%, HitCoverage=77%, E-value=2e-22, Identity=31%"; Hit description =Chromosome 13 SCAF14555, whole genome shotgun sequence
  Pfam annotation: Domain name=TraB; Domain location=138-351; Score =129.4; E_value=1e-35; Accession=PF01963.8; Description=TraB family
  Subcellular localization annotation: CTP_CleavageSite=70; ConfidenceScore=5.78e-01
MTHLVTRTQLARVTQLSHRPKPLFFTPKPTLYRSQTLSLPQLSTLSSATFRRRTHPLLRPTMDPQPPEPSAPAASAEDFVHVTDLKMESLSESMVRIDEPSEADAAPSAPDSDRRPATLSPELSRNVLVLSCESAAEGGVCDVYLVGTAHVSEESSREVQAIVNFLKPQVVFLELCSSRVAVLTLQNLKVPTMGEMVTMLKKKHNMFEIASKLEVFPGSEFRVAYEEAIKYGGRVILGDRPVQITLRRTWSKMPLWHKTKLLYSLLFQAVFLPSSDDLNKMLKEMDDSDMLTLVIQEMSKEFPTLMETLVHERDQYMSSTLLKVASENSSVVAVVGKGHLQGIKKHWKQPVVVGEHLVTYFLSSIYLTGFQMKDLMTVPSPKPAVSATRIVTSIGVAVAGVAIISGIYLSCKK

SEQ ID NO: 199458 - protein, 219 aa, Glycine max
  Coding DNA Sequence Number=SeqID_82680
MSVLGNTLADLPVNDSAQPQECAKMPSQLQPEDVKRRISNLKVANKCTIEDGNVGLNYILEERRVDGLNRSLQTLIRPNRLCWESLSESGSKVDKKYNRSGSGNANITYGSAGCMIVLTNHKKLTRKVGLLREATLLAIWALERAAKEKRKEEEEASKLILSGRHMGMALPRGEKEVIDRMAIKEKKDKMGIEEVKRKHGKRECARIKWYDEGGGEEDV

SEQ ID NO: 199459 - protein, 255 aa, Glycine max
  Coding DNA Sequence Number=SeqID_82681
  Gene Ontology: Mol. function=RNA-directed DNA polymerase activity; Biological process=RNA-dependent DNA replication
MEQPTNDHNEDIHDAIPPSINILGRQLLHFKNPFVPSIMEATLPSNYKNLTIEKNDDTTDPNEHMDVYITQVSLYTTDDAILYQSASPPNVCGHRQHPAGEEGIISDQVWDDVYTSSADKIELQDPCYAHYTPLTATISHIMDQALAECSALKDKIEELIKLGHLKEFVHTPQSSREKKERPIDQPRQVINTIARGFIGDDPMVISVEITSIVKKILVDQGSSTNMLFWNTFKHMDIPESEILPNDDPLFSFAEE

SEQ ID NO: 199460 - protein, 324 aa, Glycine max
  Coding DNA Sequence Number=SeqID_82682
  Gene Ontology: Mol. function=RNA-directed DNA polymerase activity; Biological process=RNA-dependent DNA replication
  Pfam annotation: Domain name=rve; Domain location=169-302; Score= -1.4; E_value=0.0078; Accession=PF00665.16; Description=Integrase core domain
MKNVKSDIGNIAHLVKIEYQQEVDCLSFDLDKGHKHDTGAGGGGQYWSRAGLILEGPNDMAMAQLLHFGFKATFNDKLDKLVGWQPPLNLGSLKCSFSIQFPNSVSQEKNACTPHWPANYIGDGSPHLFSNVLTKKANYVFYELHKGVCDLHSGERTMATRVLRGMYILRTFPTTPRLRRLLLVAINYFMKWVEAEPLTNITVQVVQKFFWRNIITRFGIPNTLIIDNGIQFTDRKLNEFLRGHGKFKKRLDGAKRRWVEELVEILWAYRCTPQSTTQEIPFRLTYGIDAKFSIENPAQFEEWSIKVRITIREGHPEYLGTPGI

SEQ ID NO: 199461 - protein, 159 aa, Glycine max
  Coding DNA Sequence Number=SeqID_82683
MDQALTLTPKGLLLCRRVFSSDFLLNPLVCESERAATGGRVTCKRHSITQVGLTGSEVCEPAHLDCQLRNTPLNHAYALLIKESVGDDFEVRGYNNEVFEVLSTLAPGGQIFLVPLTYRQPRGLVTFVNSLASVPNLSQVVKYSEVRVSNPQGLCLYLD

SEQ ID NO: 199462 - protein, 171 aa, Glycine max
  Coding DNA Sequence Number=SeqID_82684
MEKVQYKSLGKFTSEGSVSKVFTKGICFTWKLSLPLAVKGDPPLRMTIHALTWMVLPFALAIKADLECLARSIGDIGCSLGRGEVRGSHACIRRESHQKHWRYRLQARAEAQKSGVQMHACFSPFPVARLVQSGFAIPSGETGVDISTCALKISISSGSSREERRKRVSSF

SEQ ID NO: 199463 - protein, 81 aa, Glycine max
  Coding DNA Sequence Number=SeqID_82685
MNAKRKEYMVGVLPKRRILMRHGESQGNQDMAASTYPLRSHPIDALRVQTVFLEEEAPRRERRVTSSRTKFWKLSGGREDE

SEQ ID NO: 199464 - protein, 225 aa, Glycine max
  Coding DNA Sequence Number=SeqID_82686
MAVVAETGTSLGATSRPKRLPMLKEKHSPPLIILLGYTWVDTEGMNTDFFYMYDCLLRDLHVRVPFDDFMMGVLCILNMAPTQLHSNEWSTMQAFHALCLYSLGSSKANPLKDRLRVLTNDAKGLEMCAINVEALVRSLNAEEIEEAIADTERIQHKAFDDVHNAHEATFNHCIWKVLHLCKVSDPSVFDINKDVYEGELVLIDDILEEDVAPSPERPSTLVEDP

SEQ ID NO: 199465 - protein, 125 aa, Glycine max
  Coding DNA Sequence Number=SeqID_82687
MSYNILLGCPSLKALGTVVSTLHLTMKFQSDTGIIITVHADQRTARECYMASLRLCLHTMEGASKVGHCMEARMKVEEVEELELDPKTNDDNQVKLVEKTSAFQLGPKEGWIIQLENQLPNNDNS

SEQ ID NO: 199466 - protein, 75 aa, Glycine max
  Coding DNA Sequence Number=SeqID_82688
  Gene Ontology: Mol. function=nucleic acid binding
  Homolog annotation: Hit_ID=Q1T2W1; Match level="QueryCoverage=76%, HitCoverage=7%, E-value=6e-16, Identity=62%"; Hit description =Integrase, catalytic region; Asp/Glu racemase
MHGRCKHIDVRFHFLRDLAKEGVVKLKHCSTQEQLADIMTKALKLDSFCKLREELSMCDVKDCKGGFVRIREAWA

SEQ ID NO: 199467 - protein, 125 aa, Glycine max
  Coding DNA Sequence Number=SeqID_82689
MTVSKLRNDAKTSWKIPLRLKGSSRCGISTKNNGGLWWLMVAVGDGESAWDVGNGFGRKKKKKNGVFPKLLGLQGTKRTNEQCSRKRKLRAHSKHLLKDPNGQILDKCSVKIQTKFREDPTVNEG

SEQ ID NO: 199468 - protein, 332 aa, Glycine max
  Coding DNA Sequence Number=SeqID_82690
MDRVVISIGISSFEDIHRGASDSESSSSEKVRSRIGLVGALPILAGGEVATMEMPGRLPTCDVAIVLGHCHPPLLSLAMNGDDFPFLRAALGSLPFFFMYKCLFEVLGLILPLTTFQCALLEHLNEAPSQCHLNSWTMLTDKIRWVSLNRVSKKLFEFDSNIFHHFKDCFFKVLVTDVVADGMPLIFNRDAKPHFPFYWPLVKQVRLVGGNMPSFTAALVGEEGQPTGEVGPIAIVTEVNPNALSSILAKRKWDDGAGSSGRKKSKAPMSLCALRQVAGLTPSAGHPSIVLDVPPTPSTIEAPVAAPVIIEVRVLAVLAGFVVASSSTVAAP

SEQ ID NO: 199469 - protein, 156 aa, Glycine max
  Coding DNA Sequence Number=SeqID_82691
MKGLPINDIRNTWQRMALVVVYRLTWVMYTIRCSSESVVSSYLSMVKFFQLEGRVASMMLGMKEFFNCNNCLPRPQVVVTYVPPEGERSRVEGWLLYCGGVHSSYGYTHKFLGSGYMLLGPIMGAKNVPVTNGLGTRPSTEGSSTVPRGRLLFVPS

SEQ ID NO: 199470 - protein, 307 aa, Glycine max
  Coding DNA Sequence Number=SeqID_82692
  Gene Ontology: Mol. function=RNA-directed DNA polymerase activity; Biological process=RNA-dependent DNA replication
MEATLPSNWKNLTIDKYDDTTDSDEHLIVYITQLPPNSMDLFDTLVARFGTKVAVNIQNLNSVVAMHHLIMMLQSIPFVNSLCKKPASNLDELQMRVTKYMPMNELDEYQNQVRAEAVSAKKDNDKPGSNRGHDEGRRDRPPQESHFTQYIPLTANKSHIMDQALVVNILTMLKKTNTPSKADYSKHYRYHCNCGHSTEKCSALKDKIQEFIQLGHLKKEKEERPFDQSRRVINNIVGGFTGGGATSSTQKRHLQQFQFVNMISWHQVPNMPPITFTIKDFKAIEPVQYNPMVVGVEIANCIIKKTL

SEQ ID NO: 199471 - protein, 200 aa, Glycine max
  Coding DNA Sequence Number=SeqID_82693
MGAEWREDTVQSTVQTLHVTMKRWKSSDYIVHDTMHVIVLVRNPAETLQIIMLATIPAETLCTPLSASLCSSGILPRHCARHCAHQDSYRDTMHVIVCVTMLVRNLAETLYLSLCPSGIMQTLRVSLYSSGILQGHCPSGILQKHYTSLSVSLCSIGILQRHCACHCPCQESYKDTMRVIVLVMNPAQTRCLSLCPSLLL

SEQ ID NO: 199472 - protein, 132 aa, Glycine max
  Coding DNA Sequence Number=SeqID_82694
MHRVWKDIWNSRHNMLYSADVADDATLHLSFHSNYMVRYRVRTRRWINKERVRVGYTADTAKRMHHIATPQHRQGNVVNEVRSGVGNVLQALNEMDRIVVPTQQAPPETHHFPQSSDNVDTGAGHKEGRGLH

SEQ ID NO: 199473 - protein, 168 aa, Glycine max
  Coding DNA Sequence Number=SeqID_82695
  Gene Ontology: Mol. function=RNA-directed DNA polymerase activity; Cellular component=extracellular region; Biological process=RNA -dependent DNA replication
MNVAPKCKDMVWRACCKIFPVKANLRRKINTMDPIFPCCGEKEENMEHLFLRCNDVRRVWFGSQLGVRINQPNMSSNLWLSKWLRKIDDVAAQQVFGLLWKRTLCFFRASSITRYLVDPTKQEKAGKINFDATMRQDTGVGMGIVCMNYCGQVLTSPQRCYLTIKVLK

SEQ ID NO: 199474 - protein, 118 aa, Glycine max
  Coding DNA Sequence Number=SeqID_82696
  Homolog annotation: Hit_ID=Q6CQE5; Match level="QueryCoverage=41%, HitCoverage=44%, E-value=6e-11, Identity=67%"; Hit description =Protein TAR1
MVDEPRSRPITCEPVSSGPIDDPLRARTAPNETSVWRSVLSGGPGPSPLEGAPERVRAPSCPDPVAPRGAVGESGCLGMQPQSGGKFRPRLNTGERPIANKYREGKMKRTLKRESKSA

SEQ ID NO: 199475 - protein, 110 aa, Glycine max
  Coding DNA Sequence Number=SeqID_82697
  Gene Ontology: Mol. function=hydrolase activity
  Homolog annotation: Hit_ID=Q4KA32; Match level="QueryCoverage=46%, HitCoverage=23%, E-value=6e-13, Identity=65%"; Hit description=HD domain protein
MALRRILFHRDGVVQQYRRTENAPVAAFQLADPAAVLPDPVQMRHVMRTVVRLEALASARVKTRSAPVGGNRSISIAAPDAGRMTEKRLLFTKVQPTIVITAVFAAKQAT

SEQ ID NO: 199476 - protein, 134 aa, Glycine max
  Coding DNA Sequence Number=SeqID_82698
  Gene Ontology: Mol. function=catalytic activity; Biological process =chromosome segregation
  Homolog annotation: Hit_ID=Q0M8P9; Match level="QueryCoverage=100%, HitCoverage=61%, E-value=2e-28, Identity=55%"; Hit description =Hypothetical protein precursor
MAAEQATLTLTRLEWAPADIAAVAHAIEAHSFSAGIPPQTLEAKILQDADRLDAIGLIGVARCFYIGGRMRSALYDAADPRAEHRQYDDKRFSLDHFETKLFKLQRRLPDRRRAAHGRAAHRTHAALCRRSAGR

SEQ ID NO: 199477 - protein, 52 aa, Glycine max
  Coding DNA Sequence Number=SeqID_82699
  Homolog annotation: Hit_ID=Q936B2; Match level="QueryCoverage=67%, HitCoverage=9%, E-value=1e-07, Identity=77%"; Hit description =Heptosyltransferase
MPFAVLIGAGMPRVSGDEQADGGGFQRHGEVERAGIARSPVPADWRSSPAVA

SEQ ID NO: 199478 - protein, 357 aa, Glycine max
  Coding DNA Sequence Number=SeqID_82700
  Gene Ontology: Mol. function=ligase activity
  Homolog annotation: Hit_ID=Q2NWG0; Match level="QueryCoverage=92%, HitCoverage=84%, E-value=7e-51, Identity=35%"; Hit description =Putative lipid A core surface polymer ligase
MHVPVDSAALSAAERRQPLSIIAAEQHKQKQARLPTPPCAPVRDGEPRAVSQQRQQQQEPHAAALQQRAKVQAVRGVVQLAGVIEKVKLLVKAVAEERRLFDQRQAVAPDADANKALLIQLAKARQQHFADRTVNDGENHSQRAGQQKPQPPSRPVSIRHRHHHRERQRDQRAAALRQHHECQQRRDKAQRRFLPGIAENHQAQQNGDGGVTGQIDHVARPRIAGGGFPQMINRRGVDQRQIQAQRRHAGQHRPLQLMTPLTVEQRHQPGEIEQDISAVGQGRRHVARRLAPQRAEGIIKQKYQRQPAAPARLTIVPQLPPQRRPGEHGGQPQQRRQMKQVIDAGLPAKDRAEKREG

SEQ ID NO: 199479 - protein, 194 aa, Glycine max
  Coding DNA Sequence Number=SeqID_82701
  Gene Ontology: Cellular component=integral to peroxisomal membrane; Biological process=peroxisome organization and biogenesis
  Homolog annotation: Hit_ID=Q9C733; Match level="QueryCoverage=82%, HitCoverage=19%, E-value=4e-38, Identity=50%"; Hit description =Lysine and histidine specific transporter, putative
GDVVDREDQKKFLDSVDFLSQHGMPALISDMEAATKEVLKGKQLSTFFNSTTLHETIMQILNTFMSMGTPNSWIKYMIPEDVRPYSTTSGSDDPVPFDVTEFEQLMIEARAVLSSAEFGSIVEISLKAVVDTLVELMRTKFSGGSVAEGMPLARVLPQVAQILPFKCSNSASVCSCRFYIMMRYARVVQWCPIF

SEQ ID NO: 199480 - protein, 326 aa, Glycine max
  Coding DNA Sequence Number=SeqID_82702
  Gene Ontology: Mol. function=molecular_function; Cellular component =membrane; Biological process=auxin mediated signaling pathway
  Homolog annotation: Hit_ID=Q9LRT0; Match level="QueryCoverage=96%, HitCoverage=99%, E-value=2e-64, Identity=44%"; Hit description =Nodulin MtN21-like protein
  Pfam annotation: Domain name=DUF6; Domain location=155-284; Score =6.3; E_value=0.029; Accession=PF00892.11; Description=Integral membrane protein DUF6
MAKRVLYKDLVPFGAMVATECLNVALNTLFKAATLRGMSYHVFVVYAYAVAAIVLIPAPFISQRSRVLPPLSFPLLRKIGLLGLIGWVCISDRGIHWHQFQFPHSLLGNKQLGARFYFFACHHFQDGKGDCKKYKLPSQDPSWAIGGLLLTAEYILVPLWYIVQVQIMKVYPNELIVIFFYNLCVSIMAAIVAIFTETNAGAWKIGVDTALASIVCSGIFGSFVNNVVHTWVLRIKGPVYVAMFKPLSIAIAVALGVMFLGDTLHLGSIVGATIISIGFYTVMWGKATEENVGEDVPGQQSPTTENVPLLQSCKTDTAEKKMHGSV

SEQ ID NO: 199481 - protein, 286 aa, Glycine max
  Coding DNA Sequence Number=SeqID_82703
  Gene Ontology: Mol. function=protein binding; Cellular component =nucleus; Biological process=RNA splicing
  Homolog annotation: Hit_ID=Q16U78; Match level="QueryCoverage=70%, HitCoverage=93%, E-value=3e-27, Identity=34%"; Hit description =Splicesome protein, putative
  Pfam annotation: Domain name=BCAS2; Domain location=12-244; Score =323.2; E_value=4.6e-94; Accession=PF05700.2; Description=Breast carcinoma amplified sequence 2 (BCAS2)
MADGSNGGVLMLEAPPSYGRPTGSNAEIIDALPYIDDDYADPRVKLEVDRLVEDEMRRSTKKPTDFLKDFPPLPNSNFQQNYPMIAREYERVRAGRPPVALDRSRYELEMPPANKRNDETAWKQALHRAQHLLQYQIMRMENLDLMLKYGPDTWKQHNQRLEVYLSRMQKLAQEQNEKIEKVNRERKYHQQNTAYELNALSMQWKELCQKNIDISAACASVENRINELKRGAAESTDLGFTNPVLVQPTIILISSNGFHFDYMFKSPTHNIHRLILNGTEAELIAS

SEQ ID NO: 199482 - protein, 132 aa, Glycine max
  Coding DNA Sequence Number=SeqID_82704
  Gene Ontology: Cellular component=integral to peroxisomal membrane; Biological process=peroxisome organization and biogenesis
  Homolog annotation: Hit_ID=Q69M23; Match level="QueryCoverage=93%, HitCoverage=33%, E-value=6e-23, Identity=43%"; Hit description =Peroxisomal biogenesis factor 3-like
  Pfam annotation: Domain name=Peroxin-3; Domain location=1-132; Score=- 165.1; E_value=0.05; Accession=PF04882.3; Description=Peroxin-3
MLSVRDFWRRHRRKVFVTVGVLGSGYLLYKLYGAHRHGVQELERELAVQRETEELMKAQMQAHFENIQRMSDVTLPHAMHELSCRITEELDLSHLLERLIQGKGQPNTLTQSEKLDLWSRLKILSMNLVLQE

SEQ ID NO: 199483 - protein, 95 aa, Glycine max
  Coding DNA Sequence Number=SeqID_82705
MELRRKIKEKRNILRICLRHLSIFPLDATSMKHGRCDSSTWEASLRSKKGSFLEKLGGGGDVHFFLGKEGRQVGLGPGGRKDDQNSSGLGRPKSR

SEQ ID NO: 199484 - protein, 416 aa, Glycine max
  Coding DNA Sequence Number=SeqID_82706
  Gene Ontology: Mol. function=actin binding; Cellular component =cytoskeleton; Biological process=sensory perception of sound
  Homolog annotation: Hit_ID=Q9LV35; Match level="QueryCoverage=83%, HitCoverage=57%, E-value=1e-157, Identity=75%"; Hit description=WD40- repeat protein
  Pfam annotation: Domain name=WD40; Domain location=138-176; Score =31.3; E_value=3.4e-06; Accession=PF00400.22; Description=WD domain, G-beta repeat
  Pfam annotation: Domain name=WD40; Domain location=183-221; Score =44.4; E_value=4e-10; Accession=PF00400.22; Description=WD domain, G -beta repeat
  Pfam annotation: Domain name=WD40; Domain location=274-313; Score =15.7; E_value=0.16; Accession=PF00400.22; Description=WD domain, G -beta repeat
  Pfam annotation: Domain name=WD40; Domain location=7-45; Score=24.2; E_value=0.00046; Accession=PF00400.22; Description=WD domain, G-beta repeat
  Pfam annotation: Domain name=WD40; Domain location=95-134; Score =20.1; E_value=0.0082; Accession=PF00400.22; Description=WD domain, G- beta repeat
  Pfam module annotation: Pfam domain module=WD40::WD40::WD40::WD40::WD4 0; Domain location=138-176::183-221::274-313::7-45::95-134
MMNLQNPLNVSVYGDHAYPATVARFSPNGEWVASADASGSVRIWGTRNDFVLKKEFRVLSARIDDLQWSPDGLRIVACGEGKGKSFVRAFMWDSGTNVGEFDGHSRRVLSCAYKPTRPFRVVTCGEDFLLNFYEGPPFRFKLSHRDHSNFVNCVRYSPDGSKFISVSSDKKGIIFDGNSAEKIGELSSEGGHTGSIYAVSWSPDGKLVLTVSADKSAKVWDITEDNNGKVKKTLTCPGTGGVEDMLVGCLWLNDYLVTVSLGGTISIFLASDLDKAPTAFSGHMKNVSSLTILRSNPRVLLSSSYDGLIVKWIQGIGYSEKLQRKENSQIKCLAAVEEEIVTSGFDNKYIGSKVSDRALGYGAGLENKVEQYLDQLLDLDPSTNKPKIWKVYSRRQQKGIGRISYADLANWLGSSS

SEQ ID NO: 199485 - protein, 277 aa, Glycine max
  Coding DNA Sequence Number=SeqID_82707
  Gene Ontology: Mol. function=GPI anchor binding; Cellular component =anchored to membrane
  Homolog annotation: Hit_ID=Q9SUC9; Match level="QueryCoverage=69%, HitCoverage=56%, E-value=9e-31, Identity=39%"; Hit description =Uncharacterized GPI-anchored protein At4g28100 precursor
GLGKDAAYHQLDRDYRLKCVKLTMILTLLPPPKSPFLNTLLLLCTTLLLPPCYLALPDPDADAVQPIIPNPSSSTGTIPAFPEQADAAGCPLSLSDEHYEGIKSACGSNKHAADDDDDLHRSRCCPVLAAWLYSAYSATALSGGMQHERASKGHTTSYDMPLLPDDSETCVSDLGKALKIRGIQLFQPNETCDLVYCYCGIRLHPLTCPESFSVTPSGTLVVNQSVKRLERDCFSSSTNVNKFPGLGGCSKCLHSLYSPFVLADSSSPPPTAPPLII

SEQ ID NO: 199486 - protein, 172 aa, Glycine max
  Coding DNA Sequence Number=SeqID_82708
  Subcellular localization annotation: CTP_CleavageSite=32; ConfidenceScore=5.23e-01
MVASLVLSRAPPLIALLGFFSPSGTGLGNPVMASDATRCTLEDLPETPPSSTQRLLNDPSSIVDYGGGSPTNHNYEVIEVCNGDLYLINRETVSYFGTPLLGDTYKVVEDCNSLETEVRIHRLGHNCWRIVVRWSGFPKLRNVHGAVYASVSPRKSLFLCLANEGVLDYIAE

SEQ ID NO: 199487 - protein, 70 aa, Glycine max
  Coding DNA Sequence Number=SeqID_82709
MPQPHGINMGLKEHSNRVSLPPRPRLRRIRLGLTFLIQTLFMSYIIPTTSLLYFNIFNKMRYSLTLQDPN

SEQ ID NO: 199488 - protein, 648 aa, Glycine max
  Coding DNA Sequence Number=SeqID_82710
  Gene Ontology: Mol. function=protein serine/threonine kinase activity; Cellular component=nucleus; Biological process=protein amino acid phosphorylation
  Homolog annotation: Hit_ID=Q9LV37; Match level="QueryCoverage=76%, HitCoverage=96%, E-value=0.0, Identity=74%"; Hit description=Mitogen- activated protein kinase 9
  Pfam annotation: Domain name=Kdo; Domain location=105-273; Score= -87.3; E_value=0.09; Accession=PF06293.4; Description=Lipopolysacchari de kinase (Kdo)
  Pfam annotation: Domain name=Pkinase; Domain location=109-404; Score =298.0; E_value=1.7e-86; Accession=PF00069.15; Description=Protein kinase domain
  Pfam annotation: Domain name=Pkinase_Tyr; Domain location=109-402; Score=29.2; E_value=2.9e-14; Accession=PF07714.7; Description =Protein tyrosine kinase
  Pfam module annotation: Pfam domain module=Kdo::Pkinase::Pkinase_Tyr; Domain location=105-273::109-404::109-402
MGGGGTLVEGIRRLFQRRASSSSSSDHHDHNNVNANNSLVLVRDLRAQLASIPNTLHPDSDSDFDFDFSTLKPIKVPSQIPFRPSSMDHHKKGAPETEFFTEYGEASQYQIQEVVGKGSYGVVGSAIDTHTGEKVAIKKINDVFEHVSDATRILREIKLLRLLRHPDIVEIKHIMLPPSRREFRDIYVVFELMESDLHQVIKANDDLTPEHHQFFLYQLLRGLKYIHTANVFHRDLKPKNILANADCKLKICDFGLARVSFNDAPSAIFWTDYVATRWYRAPELCGSFFSKYTPAIDIWSIGCIFAEMLTGKPLFPGKNVVHQLDLMTDLLGTPPPESIARACDMIRNEKAKRYLNSMRKKQPIPFSQKFPNADPLALRLLERLLAFDPKDRPSAEEALSDPYFTGLANMDREPSTQPISKLEFEFERRKLTKDDVRELIYREILEYHPQMLQEYLRGGDQTSFMYPSGVDRFKRQFAHLEEHYGKGERSTPPLQRQHASLPRQVERVCAPKDESKQNNDSEKPSGSNLQQSPPGSDETGAQNGTSKPNYSARSLLKSASISASKCVVLKQNKDPEVANSIFSSAWLFAERSYYMVKQEPITEVNDEAVDGVTGDNVSKTCSSPVVGGLRYNAFDSAKKLQVVQLWVY

SEQ ID NO: 199489 - protein, 1516 aa, Glycine max
  Coding DNA Sequence Number=SeqID_82711
  Gene Ontology: Mol. function=binding; Cellular component =intracellular; Biological process=metabolic process
  Homolog annotation: Hit_ID=Q6K2P5; Match level="QueryCoverage=95%, HitCoverage=95%, E-value=0.0, Identity=49%"; Hit description =Putative pentatricopeptide (PPR) repeat-containing protein
  Pfam annotation: Domain name=PPR; Domain location=1017-1050; Score =34.5; E_value=3.8e-07; Accession=PF01535.11; Description=PPR repeat
  Pfam annotation: Domain name=PPR; Domain location=106-140; Score =27.8; E_value=3.9e-05; Accession=PF01535.11; Description=PPR repeat
  Pfam annotation: Domain name=PPR; Domain location=1110-1144; Score =38.4; E_value=2.5e-08; Accession=PF01535.11; Description=PPR repeat
  Pfam annotation: Domain name=PPR; Domain location=1211-1245; Score =53.0; E_value=9.8e-13; Accession=PF01535.11; Description=PPR repeat
  Pfam annotation: Domain name=PPR; Domain location=1246-1280; Score =4.6; E_value=2.1; Accession=PF01535.11; Description=PPR repeat
  Pfam annotation: Domain name=PPR; Domain location=1282-1316; Score =19.3; E_value=0.014; Accession=PF01535.11; Description=PPR repeat
  Pfam annotation: Domain name=PPR; Domain location=1348-1382; Score =3.2; E_value=3.1; Accession=PF01535.11; Description=PPR repeat
  Pfam annotation: Domain name=PPR; Domain location=168-201; Score =34.3; E_value=4.3e-07; Accession=PF01535.11; Description=PPR repeat
  Pfam annotation: Domain name=PPR; Domain location=230-264; Score =17.0; E_value=0.067; Accession=PF01535.11; Description=PPR repeat
  Pfam annotation: Domain name=PPR; Domain location=292-325; Score =30.7; E_value=5e-06; Accession=PF01535.11; Description=PPR repeat
  Pfam annotation: Domain name=PPR; Domain location=385-419; Score =38.4; E_value=2.4e-08; Accession=PF01535.11; Description=PPR repeat
  Pfam annotation: Domain name=PPR; Domain location=486-520; Score =47.2; E_value=5.6e-11; Accession=PF01535.11; Description=PPR repeat
  Pfam annotation: Domain name=PPR; Domain location=595-629; Score=9.0; E_value=0.64; Accession=PF01535.11; Description=PPR repeat
  Pfam annotation: Domain name=PPR; Domain location=661-695; Score=6.2; E_value=1.4; Accession=PF01535.11; Description=PPR repeat
  Pfam annotation: Domain name=PPR; Domain location=831-865; Score =30.4; E_value=6.4e-06; Accession=PF01535.11; Description=PPR repeat
  Pfam annotation: Domain name=PPR; Domain location=893-926; Score =36.0; E_value=1.3e-07; Accession=PF01535.11; Description=PPR repeat
  Pfam annotation: Domain name=PPR; Domain location=955-989; Score =26.0; E_value=0.00013; Accession=PF01535.11; Description=PPR repeat
  Pfam annotation: Domain name=TPR_4; Domain location=1281-1306; Score =5.8; E_value=7.6; Accession=PF07721.5; Description=Tetratricopeptide repeat
  Pfam annotation: Domain name=TPR_4; Domain location=201-223; Score =6.6; E_value=6; Accession=PF07721.5; Description=Tetratricopeptide repeat
  Pfam annotation: Domain name=TPR_4; Domain location=260-285; Score =0.4; E_value=33; Accession=PF07721.5; Description=Tetratricopeptide repeat
  Pfam annotation: Domain name=TPR_4; Domain location=291-316; Score =9.3; E_value=2.9; Accession=PF07721.5; Description=Tetratricopeptide repeat
  Pfam annotation: Domain name=TPR_4; Domain location=926-948; Score =3.6; E_value=14; Accession=PF07721.5; Description=Tetratricopeptide repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::TPR_4::TPR _4::TPR_4::TPR_4::TPR_4; Domain location=1017-1050::106-140::1110 -1144::1211-1245:...
  Pfam module annotation: Domain location=:1246-1280::1282-1316::1348 -1382::168-201::230-264::292-325::385-419::486-520::595-629::661 -695::831-865::893-926::955-989::1281-1306::201-223::260-285::291 -316::926-948
VTVSISGISCYDPTIKHATYKLESNARHGRRWLLVVVGVKTMRGKFNLRQLHSSIFHVQRPTNYPKPHFEDPHTVKCTKAISTHMRNGHCDLALCVFDAMPLRNSVSYNAMISGYLRNAKFSLARDLFDKMPHKDLFSWNLMLTGYARNRRLRDARMLFDSMPEKDVVSWNAMLSGYVRSGHVDEARDVFDRMPHKNSISWNGLLAAYVRSGRLEEARRLFESKSDWELISCNCLMGGYVKRNMLGDARQLFDQIPVRDLISWNTMISGYAQDGDLSQARRLFEESPVRDVFTWTAMVYAYVQDGMLDEARRVFDEMPQKREMSYNVMIAGYAQYKRMDMGRELFEEMPFPNIGSWNIMISGYCQNGDLAQARNLFDMMPQRDSVSWAAIIAGYAQNGLYEEAMNMLVEMKRDGESLNRSTFCCALSACADIAALELGKQVHGQVVRTGYEKGCLVGNALVGMYCKCGCIDEAYDVFQGVQHKDIVSWNTMLAGYARHGFGRQALTVFESMITAGVKPDEITMVVLALIRVIQCFPSILAIFFSKVIPIFQLGFLSAGASEVGVLSACSHTGLTDRGTEYFHSMNKDYGITPNSKHYACMIDLLGRAGCLEEAQNLIRNMPFEPDAATWGALLGASRIHGNMELGEQAAEMVFKMEPHNSGMYVLLSNLYAASGRWVDVSKMRLKMRQIGVQKTPGYSWVEVQNKIHTFTVGDCFHPEKGRIYAFLEELDLKMKHEGYVSSTKLVLHDVEEEEKKHMLKYHSEKLAVAFGILTMPSGILIAITTSVRVFVLVGITDPDIVTWNKAISSHMRNGHCDSALRVFNSMPRRSSVSYNAMISGYLRNAKFSLARDLFDKMPERDLFSWNVMLTGYVRNRRLGEAHKLFDLMPKKDVVSWNAMLSGYAQNGFVDEAREVFNKMPHRNSISWNGLLAAYVHNGRLKEARRLFESQSNWELISWNCLMGGYVKRNMLGDARQLFDRMPVRDVISWNTMISGYAQVGDLSQAKRLFNESPIRDVFTWTAMVSGYVQNGMVDEARKYFDEMPVKNEISYNAMLAGYVQYKKMVIAGELFEAMPCRNISSWNTMITGYGQNGGIAQARKLFDMMPQRDCVSWAAIISGYAQNGHYEEALNMFVEMKRDGESSNRSTFSCALSTCADIAALELGKQVHGQVVKAGFETGCFVGNALLGMYFKCGSTDEANDVFEGIEEKDVVSWNTMIAGYARHGFGRQALVLFESMKKAGVKPDEITMVGVLSACSHSGLIDRGTEYFYSMDRDYNVKPTSKHYTCMIDLLGRAGRLEEAENLMRNMPFDPGAASWGALLGASRIHGNTELGEKAAEMVFKMEPQNSGMYVLLSNLYAASGRWVDVGKMRSKMREAGVQKVTGYSWVEVQNKIHTFSVGDCFHPEKDRIYAFLEELDLKMRREGYVSSTKLVLHDVEEEEKEHMLKYHSEKLAVAFGILTIPAGRPIRVMKNLRVCQDCHNAIKHISKIVGRLIILRDSHRFHHFSEGICSCGDYW

SEQ ID NO: 199490 - protein, 119 aa, Glycine max
  Coding DNA Sequence Number=SeqID_82712
  Subcellular localization annotation: CTP_CleavageSite=64; ConfidenceScore=5.09e-01
MAIKNPSHSSTSDSENIPSPSPSTHKHKGKGKAIEGVAISSPKKKSSMKVKKSGQKRRRPQYEVAALFKDRKLLEKFDIRWRWMRVFDVHEPNHPRLVRAFFAAIVVDSSNFTVKTTLK

SEQ ID NO: 199491 - protein, 121 aa, Glycine max
  Coding DNA Sequence Number=SeqID_82713
  Gene Ontology: Mol. function=nucleic acid binding; Cellular component= mitochondrion; Biological process=DNA integration
  Homolog annotation: Hit_ID=Q1S9I4; Match level="QueryCoverage=93%, HitCoverage=11%, E-value=1e-24, Identity=50%"; Hit description =Integrase, catalytic region; Zinc finger, CCHC-type
MIKGVGKIEIASGVNTRTSLNKEKGMMALFSTIEPKSLIKALSKYSWVISMEKELSHFIKNKVWSLVPPPKSLSVIGSKWVFKNRLNKYGEVVKKRQDCWLKDTIKRKGLTMKKPLHQYQD

SEQ ID NO: 199492 - protein, 92 aa, Glycine max
  Coding DNA Sequence Number=SeqID_82714
  Gene Ontology: Mol. function=DNA binding; Biological process=DNA integration
MSMMGKLKFFQGLQIIQKDDDIFIDQEKYTEDLLKRFRMDEARPMATRMRPSTTFHKDEKGYCDADFVGDKIERKRTCGACQFLGKLLCNGL

SEQ ID NO: 199493 - protein, 578 aa, Glycine max
  Coding DNA Sequence Number=SeqID_82715
  Homolog annotation: Hit_ID=Q6ZXT1; Match level="QueryCoverage=34%, HitCoverage=91%, E-value=4e-95, Identity=86%"; Hit description=Small GTPase
  Pfam annotation: Domain name=Arf; Domain location=8-173; Score=-68.4; E_value=0.00017; Accession=PF00025.11; Description=ADP-ribosylation factor family
  Pfam annotation: Domain name=MMR_HSR1; Domain location=13-128; Score=- 1.3; E_value=0.0013; Accession=PF01926.13; Description=GTPase of unknown function
  Pfam annotation: Domain name=Miro; Domain location=14-128; Score =64.0; E_value=4.8e-16; Accession=PF08477.3; Description=Miro-like protein
  Pfam annotation: Domain name=Ras; Domain location=14-175; Score =297.8; E_value=2e-86; Accession=PF00071.12; Description=Ras family
  Pfam module annotation: Pfam domain module=Arf::MMR_HSR1::Miro::Ras; Domain location=8-173::13-128::14-128::14-175
MADAFDEECDYLFKAVLIGDSGVGKSNMLSRFAKDEFRLDSKPTIGVEFAYRNIRVGDKLIKAQIWDTAGQERFRAITSSYYRGALGAMLVYDISMRSSYENVSKWLLELREFGGEDMVVVLVGNKCDLDESREVEKEEGKGFAETEGLCFMETSALKNLNVEEVFLQMITRIYDMTSQKNLAAKMEEQPINLLNGKEIHIADEGKIMGPKLKQCDSLNIDWPNKTRFHHPHQAAESLRKNEGFRSEEPSIDAPAKSGSGVSLKDQLKKKPLESNEYRGKLRSDLNFNGLKATASAPKLSPKSGPTLTDDDWTELLSAPTPTQSVASASGGNHGNGLPAPRGLSRNSSRKQKGLSSGLLAMDVKRNPRNGNSGPRPLQKSDSVKEVKLSGKACDDGKESTSLTSTGRNSVVESKIDGKWGKGLEYADKDSSAKLVVEEKGNEENQHRFNYRDISPPELLQEDGKTLAAETLPAWGVDEDQEAKIVEDVDGNQLRSVVLGRHELNSISDDLKRGSPVASDGSSDSDTDSGSTSDSESEHEREERRKRRERILAEKAAAKAINAIKERENIVAKLEGEKE

SEQ ID NO: 199494 - protein, 307 aa, Glycine max
  Coding DNA Sequence Number=SeqID_82716
  Gene Ontology: Mol. function=protein homodimerization activity; Cellular component=integral to membrane; Biological process=protein folding
  Homolog annotation: Hit_ID=Q9QYE6; Match level="QueryCoverage=91%, HitCoverage=35%, E-value=3e-14, Identity=24%"; Hit description =Golgin subfamily A member 5
  Pfam annotation: Domain name=CASP_C; Domain location=105-291; Score= -81.2; E_value=0.0013; Accession=PF08172.3; Description=CASP C terminal
MEAVELEKQKHNNTRMEVLARLAKLETANADLARSLAAVQWNLEVEVKQVAELRQQITSKELFHEELRRRMTNPRQTGASQNQFSKLGTLRGRSLLASKGVELEREILEAEHSLINDKVAQLQEKARKLEADIEMTRKEIEEPTEVEVELKRRLQQMTDHLIQKQAKVESLSSEKASLVFRIEAVSRLLDENMSASGAANMNPASSSSDLESGLWELSNSKLKPMLKARIHSGKRQLGSLLQQLDYIFVTGALFLKRNSTAKLWALIYLVCLHFWVFYILLSHSSPSNEGRSGAQISLENINNTGGV

SEQ ID NO: 199495 - protein, 54 aa, Glycine max
  Coding DNA Sequence Number=SeqID_82717
MEAEKKNHFQRYLPPAIAINLSSAITVLAFQTLTRSNSMSSIHHKAQQNVGIIF

SEQ ID NO: 199496 - protein, 165 aa, Glycine max
  Coding DNA Sequence Number=SeqID_82718
  Homolog annotation: Hit_ID=Q0LYU2; Match level="QueryCoverage=43%, HitCoverage=30%, E-value=6e-32, Identity=87%"; Hit description =Glutathione S-transferase-like
RDLAVRVQRQEFRRPGFVVTDVDQVRLIGQADLFQHDGHFDAVRRRQGIELQPFRMLSRPAFDDRELGGIEHGNSSGWRGGLSVPLEYCSKTTPPPGYTLQLAAVEPADDPAAVDKGGQQCGAQRAAEVRAAFAPVQAAAGEAAAGGGGGAIDAQPRQRGLTGVA

SEQ ID NO: 199497 - protein, 205 aa, Glycine max
  Coding DNA Sequence Number=SeqID_82719
  Gene Ontology: Mol. function=peptidyl-prolyl cis-trans isomerase activity; Cellular component=integral to membrane; Biological process=protein folding
  Homolog annotation: Hit_ID=UPI0000588B74; Match level="QueryCoverage =90%, HitCoverage=57%, E-value=3e-44, Identity=46%"; Hit description =PREDICTED: similar to conserved hypothetical protein
  Pfam annotation: Domain name=DUF1295; Domain location=24-205; Score =211.1; E_value=2.5e-60; Accession=PF06966.3; Description=Protein of unknown function (DUF1295)
MGTIIDSHFLAFTALVTIAYQFLFFVVTALLKFDKVTDFAGSTNFIIIAALTLVIKGSWYFRQIILTLFVGIWGIRLGLFLLFRILQWGEDRRFDEMRSNLGRLAIFWIFQAVWVWAVSLPVTVVNASDRNPFLQVVDIVGWILWAVGFIVEGTADQQKLHFKRSSENRGKWCNVGLWKYSRHPNYFGEDVYGGACKFSWIYEYG

SEQ ID NO: 199498 - protein, 903 aa, Glycine max
  Coding DNA Sequence Number=SeqID_82720
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=99%, HitCoverage=81%, E-value=0.0, Identity=51%"; Hit description=CTR1 -like kinase kinase kinase
  Pfam annotation: Domain name=Pkinase; Domain location=629-875; Score =227.7; E_value=2.6e-65; Accession=PF00069.15; Description=Protein kinase domain
  Pfam annotation: Domain name=Pkinase_Tyr; Domain location=631-875; Score=243.3; E_value=5.2e-70; Accession=PF07714.7; Description =Protein tyrosine kinase
  Pfam module annotation: Pfam domain module=Pkinase::Pkinase_Tyr; Domain location=629-875::631-875
MPSLVDLQGTPTSDDVTWEAVLVNRAADSSLLKLEQEAMEMAVNSRKDFEVLVDSDLVHKLAIIVADYMGGSVEDPESMSRAWRSLSYSLKATLGSMVLPLGSLTIGLARHRALLFKVLFPTFFFLVYILMRTVWLIMTLLLGSPTSPTSVLGMSAYISVRQLHLVSMVLADSLGIPCRLVKGLQYMGSNDVAMNFVKIDGREYIVDLMAAPGTLIPSDATGSHIEFDDSSFVASPSSRELDSSHVASFSSGVGSSSEEASDSGTLDKDNKSKYFGYAGKESDVSGPTTGKEELKKPSNESKNTPYEEKIIVRDSPSRPNYPYMHGRSPSWTEGISSPAVRRMKVKDVSQYMIDAAKENPNLAQKLHDVLLESGVVAPPNLFSEIYHGQLSTLTEANFPTEQKDENKQGSVQRETKTDDNLVPARFLPPLPHYRVQRKATPSTSSHLEHSKPVDGLGTGLPLDSGEAAGQHISSQVEATQVKYGKNMPVAAAAAAAAAVVASSMVVAVTKSNADSNLEIPVAAAATATAAAVVATTAAVSKQYEQGSRSDGDAEGAGCESKGSGDGEHNALGENSEGERKSDRSVSNDSTKSDSALDDVAEYDIPWEEIAVGERIGLEKLNCNCVAGIWHAGSYGEVYRGEWHGTEVAVKKFLYQDISGELLEEFKSEVQIMKRLRHPNVVLFMGAVTRPPNLSIVSEFLPRGSLYRLIHRPNNQLDERRRLRMALDAARGMNYLHNCTPVIVHRDLKSPNLLVDKNWVVKVCDFGLSRMKHSTFLSSRSTAGTAEWMAPEVLRNELSDEKCDVFSYGVILWELSTLQQPWGGMNPMQVVGAVGFQHRRLDIPDNVDPAIADIIRQCWQTDPKLRPTFAEIMAALKPLQKPITVSQVHRPIAQSSRIAEDPAG

SEQ ID NO: 199499 - protein, 936 aa, Glycine max
  Coding DNA Sequence Number=SeqID_82721
  Gene Ontology: Mol. function=translation initiation factor activity; Cellular component=eukaryotic translation initiation factor 3 complex; Biological process=translational initiation
  Homolog annotation: Hit_ID=Q9XHM1; Match level="QueryCoverage=99%, HitCoverage=100%, E-value=0.0, Identity=71%"; Hit description =Eukaryotic translation initiation factor 3 subunit 8
  Pfam annotation: Domain name=PCI; Domain location=667-797; Score =133.2; E_value=7.3e-37; Accession=PF01399.17; Description=PCI domain
  Pfam annotation: Domain name=eIF-3c_C; Domain location=798-936; Score= 216.5; E_value=6e-62; Accession=PF05469.2; Description=Eukaryotic translation initiation fac
  Pfam annotation: Domain name=eIF-3c_N; Domain location=39-660; Score =1261.7; E_value=0; Accession=PF05470.3; Description=Eukaryotic translation initiation fac
  Pfam module annotation: Pfam domain module=PCI::eIF-3c_C::eIF-3c_N; Domain location=667-797::798-936::39-660
MASRFWTQGGSDSEEEESDYDEEVDTTVGESGSQAVTSRYLQDNASDSDDSDGQKRIVRSAKDKRFEEMASTVDQMKNAMKINDWVSLQESFDKINKQLEKVMRVTESEKVPNLYIKALVMLEDFLAQALANKDAKKKMSSSNAKALNSMKQKLKKNNKQYEDLINKCRENPESEEEKEEESEEEYDSDGEIIDPDQLQKPEAKSDSEASQYEDEKPDAGEGPWDQKLSKKDRLLDRQFMKNPSEITWDAVNKKFKEVVAARGRKGTGRFEQVEQLTFLTKVAKTPAQKLEILFSVVSAQFDVNPGLNGHVPINVWKKCVQNMLIILDILVQYPNIVADDLVEPDENETQKGPEHNGTIRVWGNLVAFLERIDVEFFKSLQCIDPHTRDYVERLRDEPTFLVLAQNVQEYLERVGNFKAASKVALRRVELIYYKPQEVYDAMRKLTELTEDGDNGGEASEKEFEESRIPTAFVVTPEVVARKPTFPENSRTLMDVLVSMIYKYGDERTKARAMLCDIYHHALLDEFSTARDLLLMSHLQDSVQHMDISTQILFNRAMSQLGLCAFRVGLISEAHGCLSELYSGGRVKELLAQGVSQSRYHEKTPEQMYTNSIINTKEERLERRRQMPYHMHINLELLEAVHLVSAMLLEVPNMAANVHDAKRKVISKTFRRLLEVSEKQTFTGPPENVRDHVMAATRVLNKGDFQKAFDIIVSLDVWKFVRNRDTVLEMLKDKIKEEALRTYLFTFSSSYESLSLDQLTKFFDLSVCRTHSIVSRMMINEELHASWDQPTGCILFQDVEHSRLQALAFQLTEKLSVLAESNEKAAEARVGGGGLDLPLRRRDGQDYAAAAAAGSGTASSGGRWQDLSLSQPRQGSGRAGYGGRPMALGQAAGSGYSRGRGRGSYGGSGRTAQRGSALRGPQGDGSTRMVSLKGVRA

SEQ ID NO: 199500 - protein, 77 aa, Glycine max
  Coding DNA Sequence Number=SeqID_82722
MAMAPNPWDPSRTRPDFDKKNSNGLGSWLGSGFPRQPKSGEREKNEESGTGQDKQNPTPTCPVVMPNFCPRKEQTAK

SEQ ID NO: 199501 - protein, 360 aa, Glycine max
  Coding DNA Sequence Number=SeqID_82723
RVMSEIEEVQEKMKADMEAMKEQMTSMMEVMMSMRRMMEVNLVTVVAASTATELDPSHPPGFNQVNHLASDMVGQGGKALGSTGGPHFVQVQSTHSFPPYGLPPNYTPFNVAHIPDENVDNSAPIPIESQHPQFGHAQVSQLMGETHEAPRDHNLVDFGPHYRPQPQPLHFAVGRVSPAMVCRQRIKLNVLMMPKDYMNHMLLKDLFKTKIFCFLHYLIVRRQLDWAHLVRYRMHKALRLNAPLPYPQLVTLFLRHFEIPLDSESYIPIKRSFLIGAAAIASFGYRKERNLPDEDNSTFLRRLMDKFDGLQTFVGDKFDAMELQVDMRFDAMESRITRVEEDVSFIRTCFDPPPPPPSSS

SEQ ID NO: 199502 - protein, 110 aa, Glycine max
  Coding DNA Sequence Number=SeqID_82724
  Homolog annotation: Hit_ID=Q0GPJ3; Match level="QueryCoverage=32%, HitCoverage=17%, E-value=2e-15, Identity=97%"; Hit description=BZIP transcription factor bZIP86
  Pfam annotation: Domain name=MFMR; Domain location=44-110; Score= -65.8; E_value=0.019; Accession=PF07777.2; Description=G-box binding protein MFMR
MCFNELIFAGSQICEYEKAASISSSHDPPIVLAKVDANEEKNRSSEMDKTPKEKESKTPPPPPTSQEQSSTTSSGTINPEWPGFQAYSPIAPHGFLASSPQAHPYMWGVQ

SEQ ID NO: 199503 - protein, 191 aa, Glycine max
  Coding DNA Sequence Number=SeqID_82725
  Gene Ontology: Mol. function=3'-5' exonuclease activity; Cellular component=intracellular
  Homolog annotation: Hit_ID=Q8GWN3; Match level="QueryCoverage=58%, HitCoverage=28%, E-value=1e-16, Identity=33%"; Hit description =Putative nucleolar protein
MVRYAREDTHYLLYIYDLMRIELFSMLNEPESVDAPLVEVYKCSYKVARRWFHCSTTSHCFAKQMPVTANNLRLLVNSRHPYVEHNLDSLVDIIRHSIQNTSAFEEIAQLLKTGHDVATIAQQLTRHPAQEHNRHPIRIGSQVMEGNFHKVLGSNIIHHWRRHGVVSHQLFDWQHVLVHFSTPVVQSCRYY

SEQ ID NO: 199504 - protein, 302 aa, Glycine max
  Coding DNA Sequence Number=SeqID_82726
  Gene Ontology: Mol. function=DNA binding; Cellular component =nucleosome; Biological process=chromosome organization and biogenesis (sensu Eukaryota)
  Homolog annotation: Hit_ID=Q93YH8; Match level="QueryCoverage=97%, HitCoverage=80%, E-value=8e-73, Identity=51%"; Hit description=HMG I/Y like protein
  Pfam annotation: Domain name=AT_hook; Domain location=113-125; Score =5.1; E_value=3.1; Accession=PF02178.9; Description=AT hook motif
  Pfam annotation: Domain name=AT_hook; Domain location=148-160; Score =5.3; E_value=2.8; Accession=PF02178.9; Description=AT hook motif
  Pfam annotation: Domain name=AT_hook; Domain location=191-203; Score =17.8; E_value=0.019; Accession=PF02178.9; Description=AT hook motif
  Pfam annotation: Domain name=AT_hook; Domain location=218-230; Score =9.3; E_value=0.56; Accession=PF02178.9; Description=AT hook motif
  Pfam annotation: Domain name=Linker_histone; Domain location=8-77; Score=50.2; E_value=7e-12; Accession=PF00538.9; Description=linker histone H1 and H5 family
  Pfam module annotation: Pfam domain module=AT_hook::AT_hook::AT _hook::AT_hook::Linker_histone; Domain location=113-125::148-160::191- 203::218-230::8-77
MAISFSPKNPPYDEMIYTAIGALKERDGSSKRAIGKYIEQVYKDLPPTHPALLTHHLNRLKSSALLVLVKKSYKLPWISSSACAPAPKDPWSSSQAQAPPRPGRPKKIGVSPPGPRGRPPGTGRSKLPKRPGRPPKPKSVSAISSGLKRRPGRPPKAQSNVNVIPFAAPVAPGLPTVQPILPTASVPNGSPRPRGRPKKSFTAAGAPALSAVAGAARGRGRGRPRGVFPVVRPGRPQKLAVGRSKNPGSTAAAITAHKAANEDLRKKLEHFQSKVKESLGTLKPYFNHESPVTAIAAIQELE

SEQ ID NO: 199505 - protein, 33 aa, Glycine max
  Coding DNA Sequence Number=SeqID_82727
MTSGGVRWCDIGGMRWLWRFDDQGLLGRCKSAW

SEQ ID NO: 199506 - protein, 647 aa, Glycine max
  Coding DNA Sequence Number=SeqID_82728
  Gene Ontology: Mol. function=binding; Cellular component=nucleus; Biological process=metabolic process
  Homolog annotation: Hit_ID=Q9LHZ4; Match level="QueryCoverage=98%, HitCoverage=80%, E-value=1e-116, Identity=31%"; Hit description =Pentatricopeptide (PPR) repeat-containing protein-like
  Pfam annotation: Domain name=PPR; Domain location=130-164; Score =20.6; E_value=0.0055; Accession=PF01535.11; Description=PPR repeat
  Pfam annotation: Domain name=PPR; Domain location=232-266; Score =31.7; E_value=2.6e-06; Accession=PF01535.11; Description=PPR repeat
  Pfam annotation: Domain name=PPR; Domain location=267-301; Score=8.7; E_value=0.69; Accession=PF01535.11; Description=PPR repeat
  Pfam annotation: Domain name=PPR; Domain location=27-61; Score=15.9; E_value=0.097; Accession=PF01535.11; Description=PPR repeat
  Pfam annotation: Domain name=PPR; Domain location=333-367; Score =28.4; E_value=2.6e-05; Accession=PF01535.11; Description=PPR repeat
  Pfam annotation: Domain name=PPR; Domain location=434-468; Score =28.1; E_value=3e-05; Accession=PF01535.11; Description=PPR repeat
  Pfam annotation: Domain name=PPR; Domain location=470-504; Score =19.2; E_value=0.015; Accession=PF01535.11; Description=PPR repeat
  Pfam annotation: Domain name=PPR; Domain location=506-539; Score =11.3; E_value=0.35; Accession=PF01535.11; Description=PPR repeat
  Pfam annotation: Domain name=PPR; Domain location=572-606; Score=1.3; E_value=5.2; Accession=PF01535.11; Description=PPR repeat
  Pfam module annotation: Pfam domain module=PPR::PPR::PPR::PPR::PPR::PP R::PPR::PPR::PPR; Domain location=130-164::232-266::267-301::27 -61::333-367::434-468::470-504::506-539::572-606
LNVLYARYASLCHAHKLFEETPCKTVYLWNALLRSYFLEGKWVETLSLFHQMNADAVTEERPDNYTVSIALKSCSGLQKLELGKMIHGFLKKKIDSDMFVGSALIELYSKCGQMNDAVKVFTEYPKPDVVLWTSIITGYEQNGSPELALAFFSRMVVLEQVSPDPVTLVSAASACAQLSDFNLGRSVHGFVKRRGFDTKLCLANSILNLYGKTGSIRIAANLFREMPYKDIISWSSMVACYADNGAETNALNLFNEMIDKRIELNRVTVISALRACASSSNLEEGKQIHKLAVNYGFELDITVSTALMDMYLKCFSPENAIELFNRMPKKDVVSWAVLFSGYAEIGMAHKSLGVFCNMLSNGTRPDAIALVKILAASSELGIVQQALCLHAFVTKSGFDNNEFIGASLIELYAKCSSIDNANKVFKGLRHTDVVTWSSIIAAYGFHGQGEEALKLFYQMSNHSDVKPNDVTFVSILSACSHAGLIEEGIKMFHVMVNEYQLMPNIEHYGIMVDLLGRMGELDKALDMINNMPMQAGPHVWGALLGACRIHQNIKIGELAALNLFLLDPNHAGYYTLLSNIYCVDKNWHDAAKLRTLIKENRLKKIVGQSMVEIKNEVHSFIASDRFHGESDQIYEMLRKLDARMREE

SEQ ID NO: 199507 - protein, 52 aa, Glycine max
  Coding DNA Sequence Number=SeqID_82729
MDLRVELRRGKGRGQIADEGARDLLNLKNNPYQNVNMFAFFPYTSIVKACKY

SEQ ID NO: 199508 - protein, 175 aa, Glycine max
  Coding DNA Sequence Number=SeqID_82730
  Gene Ontology: Mol. function=protein binding; Cellular component =apoplast; Biological process=response to biotic stimulus
  Homolog annotation: Hit_ID=Q1SSC0; Match level="QueryCoverage=83%, HitCoverage=69%, E-value=3e-73, Identity=72%"; Hit description =Thaumatin, pathogenesis-related
MGAEGEEIVSFGASSNAGGVIIGIGVGLGACGLEDLGIDGGLAGLWASIGAGAAAHGAHGVQVAHAARVAAFSGSLEWGDGDGQVVAVHQAHVVEVLLVAQGQLRQGRRWASPDAVAEEGPAAVTGGAAPAPADVEGAAVAAPEAPGPEGGTVKRKKMVVRMGLRVGIVVFNNAS

SEQ ID NO: 199509 - protein, 170 aa, Glycine max
  Coding DNA Sequence Number=SeqID_82731
  Gene Ontology: Mol. function=ribonuclease H activity; Cellular component=mitochondrion; Biological process=DNA integration
MTVSYKDWHEMLPFSLHGYQTSLRTSTGATPYSLVYGMEVVLPFEVEVPSQKILAESGLEESEWAQTRYDQLNLIEGKRLTAMSHGRLYQQRIKNVFDKKVRPCKFNEGDLVLKKISHTVKDNRGKWAPNYEGPFVVKRAFSGGALVLTNMDGEELPSPVNSDVVKRYYA

SEQ ID NO: 199510 - protein, 300 aa, Glycine max
  Coding DNA Sequence Number=SeqID_82732
  Gene Ontology: Mol. function=transporter activity; Cellular component= mitochondrial inner membrane; Biological process=transport
  Homolog annotation: Hit_ID=Q1SSB0; Match level="QueryCoverage=99%, HitCoverage=94%, E-value=1e-120, Identity=70%"; Hit description =Adenine nucleotide translocator 1
  Pfam annotation: Domain name=Mito_carr; Domain location=1-91; Score =82.3; E_value=1.5e-21; Accession=PF00153.17; Description =Mitochondrial carrier protein
  Pfam annotation: Domain name=Mito_carr; Domain location=199-289; Score=90.3; E_value=6.1e-24; Accession=PF00153.17; Description =Mitochondrial carrier protein
  Pfam annotation: Domain name=Mito_carr; Domain location=99-195; Score= 81.8; E_value=2.1e-21; Accession=PF00153.17; Description =Mitochondrial carrier protein
  Pfam module annotation: Pfam domain module=Mito_carr::Mito_carr::Mito_ carr; Domain location=1-91::199-289::99-195
MGGVAAIISRSAAAPIERVKLLLQNQGEMIKRGQLKKPYLGVSDGFKRVFMEEGLIAFWRGHQANLIRYFPTQAFNFAFKGYFKSIFGYSKERDGYIKWFAGNVASGSAAGATTSLLLYHLDYARTRLGTDAIECRVTGQRQFKGLIDVYRKTLSSDGIAGLYRGFGISIWGITLYRGMYFGIYDTMKPIVLVGPFEGKFLASFFLGWSITTFSAVCAYPFDTLRRRMMLTSGHPNKYCTAIHAFQEIVRQEGFRALFRGFTANMLLGMAGAGVLAGYDQLNRISSRHSHYNETNQRVLK

SEQ ID NO: 199511 - protein, 162 aa, Glycine max
  Coding DNA Sequence Number=SeqID_82733
MTARRNWTALIRACIHPPRNSHRAIEREEKGRKVIERERKRRGERNKEECSHITWPPCPWGTTTITNRRRRLYTRRNRRSVSRNPKFLAGAPIWRPIRYFRSLHSSRTLGMILLFPRSGFEWFPTCWSSDRSRFASEAPASLEFRPIYRFSVLAGENIRRRR

SEQ ID NO: 199512 - protein, 445 aa, Glycine max
  Coding DNA Sequence Number=SeqID_82734
  Gene Ontology: Mol. function=structural molecule activity; Cellular component=protein complex; Biological process=microtubule-based movement
  Homolog annotation: Hit_ID=Q1SSB3; Match level="QueryCoverage=95%, HitCoverage=95%, E-value=0.0, Identity=92%"; Hit description=Cell division protein FtsZ; Peptidase S26A, signal peptidase I
  Pfam annotation: Domain name=Tubulin; Domain location=45-244; Score =376.9; E_value=3e-110; Accession=PF00091.15; Description=TubulinFtsZ family, GTPase domain
  Pfam annotation: Domain name=Tubulin_C; Domain location=246-383; Score=265.3; E_value=1.2e-76; Accession=PF03953.7; Description =TubulinFtsZ family, C-terminal domain
  Pfam module annotation: Pfam domain module=Tubulin::Tubulin_C; Domain location=45-244::246-383
MREILHIQGGQCGNQIGTKFWEVVCDEHGIDPTGQYVGNSELQLERVNVYYNEGSNGRYVPRAVLMDLEPGTMDAARTGPYGQIFRPDNFVFGQSGAGNNFAKGHYTEGAELIDSVLDVVRKEVENCDCLQGFQVCHSLGGGTGSGMGTLLISKIREEYPDRMMLTFSVFPSPKVSDTVVEPYNATLSVHQLVENADECMVLDNEALYDICFRTLKLATPSFGDLNHLISATMSGVTCCLRFPGQLNSDLRKLAVNLIPFPRLHFFMVGFAPLTSRGSQNYRALSVPELTQQMWDAKNMMCAADPRHGRYLTASAVFRGKMSTKEVDEQMLSVQNKNSSYFVEWIPNNVKSSVCDIPPRGLSMASTFVGNSTSIQEMFRRVSEQFTAMFRRKAFLHWYTGEGMDEMEFTEAESNMNDLVAEYQQYQDSATDEDGDSEEEGEGAES

SEQ ID NO: 199513 - protein, 585 aa, Glycine max
  Coding DNA Sequence Number=SeqID_82735
  Gene Ontology: Mol. function=binding; Cellular component =mitochondrion; Biological process=metabolic process
  Homolog annotation: Hit_ID=Q1SSB5; Match level="QueryCoverage=97%, HitCoverage=100%, E-value=0.0, Identity=71%"; Hit description =Tetratricopeptide-like helical
  Pfam annotation: Domain name=PPR; Domain location=131-165; Score =39.1; E_value=1.5e-08; Accession=PF01535.11; Description=PPR repeat
  Pfam annotation: Domain name=PPR; Domain location=166-200; Score =47.8; E_value=3.5e-11; Accession=PF01535.11; Description=PPR repeat
  Pfam annotation: Domain name=PPR; Domain location=201-235; Score =27.5; E_value=4.8e-05; Accession=PF01535.11; Description=PPR repeat
  Pfam annotation: Domain name=PPR; Domain location=236-270; Score =35.5; E_value=1.9e-07; Accession=PF01535.11; Description=PPR repeat
  Pfam annotation: Domain name=PPR; Domain location=271-305; Score=5.9; E_value=1.5; Accession=PF01535.11; Description=PPR repeat
  Pfam annotation: Domain name=PPR; Domain location=425-459; Score=7.8; E_value=0.89; Accession=PF01535.11; Description=PPR repeat
  Pfam annotation: Domain name=PPR; Domain location=493-527; Score =32.8; E_value=1.2e-06; Accession=PF01535.11; Description=PPR repeat
  Pfam annotation: Domain name=PPR; Domain location=528-562; Score =14.2; E_value=0.16; Accession=PF01535.11; Description=PPR repeat
  Pfam module annotation: Pfam domain module=PPR::PPR::PPR::PPR::PPR::PP R::PPR::PPR; Domain location=131-165::166-200::201-235::236-270::271 -305::425-459::493-527::528-562
MVNGVAVAVAPKLLVMCRIRIYKFHGFIRILVPSPSTRAMHSLNQSKPMKKAEKLKLKDEPREYMRNVIGKIYNMLKYSSWESAEQDLNNLSMKWDSYTVNQVLKSHPPMEKAWLFFNWVSSLRGFKHDHYTYTTMLDIFGEAGRVSSMKHLFQQMQEKGIKLDSVTYTSMMHWLSSSGNFDEAMQMWDQMKSKGFHPTVVSYTAYIKILFHNQRVKEATRAYKEMISSRVAPNCHTYTVLMDYLIGSGQYKEALEIFEKMQEAGAQPDKAACNILIERCSKVGGTEFMTHILQYMKENRLVLRYPVFVKALEALKIAGESDTLLRQVNPQFYMDCIIRKKASNTITVAADCPTNIDKELLFVLLKNRNVVAIDHLLTGMMDKKISLDHKVVSTIIEVNCSHCRPEGALLAFKYSVTMGISIERTGYLSLIGLLIRSNMFSKLAEIVEKMTRAGHSLGIYLASLLIFRLGCARKHTLAMKIFNLLPDNHKCSATYTALISVYFSVRRVNEALEIYKIMCSKGFCPVLGTYDVLIAGLERNGKYAEAEHYRKAKKRKSLRANSGSQESVCIEGKICNLLFSVDVVL

SEQ ID NO: 199514 - protein, 587 aa, Glycine max
  Coding DNA Sequence Number=SeqID_82736
  Gene Ontology: Mol. function=amidase activity; Cellular component =chloroplast; Biological process=translation
  Homolog annotation: Hit_ID=Q1SSA9; Match level="QueryCoverage=96%, HitCoverage=95%, E-value=0.0, Identity=78%"; Hit description=Amidase
  Pfam annotation: Domain name=Amidase; Domain location=7-438; Score =101.0; E_value=3.7e-27; Accession=PF01425.11; Description=Amidase
  Pfam annotation: Domain name=TPR_1; Domain location=471-504; Score =22.1; E_value=0.0019; Accession=PF00515.18; Description =Tetratricopeptide repeat
  Pfam annotation: Domain name=TPR_1; Domain location=505-538; Score =35.6; E_value=1.8e-07; Accession=PF00515.18; Description =Tetratricopeptide repeat
  Pfam annotation: Domain name=TPR_1; Domain location=539-572; Score =34.3; E_value=4.4e-07; Accession=PF00515.18; Description =Tetratricopeptide repeat
  Pfam annotation: Domain name=TPR_2; Domain location=471-504; Score =23.8; E_value=0.00062; Accession=PF07719.7; Description =Tetratricopeptide repeat
  Pfam annotation: Domain name=TPR_2; Domain location=505-538; Score =27.4; E_value=5e-05; Accession=PF07719.7; Description=Tetratricopepti de repeat
  Pfam annotation: Domain name=TPR_2; Domain location=539-572; Score =33.5; E_value=7.4e-07; Accession=PF07719.7; Description =Tetratricopeptide repeat
  Pfam module annotation: Pfam domain module=Amidase::TPR_1::TPR_1::TPR_ 1::TPR_2::TPR_2::TPR_2; Domain location=7-438::471-504::505-538::539 -572::471-504::505-538::539-572
MAKNLLVLLGLGLAGIVLITRKLNKSVREDFGAFIHKLQLLPPPQPSPPKAPHPLTSLTFALSDLFHIHGHVPSFGHPDWARTHEPSSSTAPAVSALVEGGATCVATTVLDDLALGIGGENKHFGTPTNPAVPARVPGGSSSGAAVAVAANFVDFALGIDTTGGVRVPAGFCGILGFRPSHGAVSHMGIIPISTSLDTVGWFAKDPNILRRVGHILLQAPFVMQRSPRQIVIADDCFQHINVPLDRSSQVVVKATEKLFGRQVLKHINLGDYLSSRVPSLKGCSGQKPNGEVKASSLKLLAHIMQFLQRHEFRLKHDDWMNTVKPDLHPGVSAQLHEKFEVSDAEIENSKSVRSEMRAAVNSLLKDEGILVIPTVADPPPKLGGKEILSEDYQSRAFSLLSIASISGCCQVSIPLGFYDKYPVSVSLIARHGGDRFLLDTLQTVYTTLQEQADIASKSKSSGNVVSKEQSAEIAKEKGNQAYKDKQWQKAIGFYTEAIKLCGDNATYYSNRAQAYLELESYLQAVEDCTKAISLDKKNVKAYFRRGTARQMLGYYKEAIDDFKHALVLEPTNKRAASAAERLRKLFQ

SEQ ID NO: 199515 - protein, 130 aa, Glycine max
  Coding DNA Sequence Number=SeqID_82737
MQVRNIIRTSNLLRFSCPLRHQITAPFHHDPDSRVLSISLNSRELTLSLFLNKNRAREREEKRRKVIEREREEERETKKKSVSHITWPPCPWGTTTTTTNRRRRLYIRRNRRSLSRNPKFLAGAPIWRQI

SEQ ID NO: 199516 - protein, 454 aa, Glycine max
  Coding DNA Sequence Number=SeqID_82738
  Gene Ontology: Mol. function=DNA binding; Cellular component=nuclear chromosome, telomeric region; Biological process=telomere maintenance
  Homolog annotation: Hit_ID=Q1SS97; Match level="QueryCoverage=97%, HitCoverage=98%, E-value=2e-92, Identity=42%"; Hit description =Nucleic acid-binding, OB-fold, subgroup
  Pfam annotation: Domain name=Telo_bind; Domain location=45-151; Score= 39.4; E_value=1.3e-08; Accession=PF02765.8; Description=Telomere -binding protein alpha subunit, ce
MSSRKRTGMREGYEFMPIRDVGRSVGQKAKLIGVILDFGFPKKSKGTDFCCCLRIIDETHHQISMAINMFEENVERLPRLAAVGDVVVLCCVEVKSFKGEVNVTFNKRFSSFGLYKGKDGDDLDPYHVSSYFHHVREDESLIVKLRKWLMNFQPHEDSSNFPMLREIKEETSVNLACKILHFCETAKDEWIIFSWDGTNTPSNVICSKLEEEINCPLPLQLEPLPLSREVLCTLPVAGSILRIMFDKVVVKNHLHLLNVDKWVKFMNIHLKVVDGLWLGVFSPQSRLRYTPNEDSLIVERCLMSSYFLSLYLLQKKLIKIMRLLLLLMTVLTHSKVVTAKFKCVVRVVAAMPYLAKNLLSSIGKYRMQLTLEDSTARVHAFVTGKDGETLFDGYPSIDELTRKLNRLLGVTGIKDAPRDPPWVSVCLKSYYVSKTDVWGSRNFKIFGIKIVGDT

SEQ ID NO: 199517 - protein, 454 aa, Glycine max
  Coding DNA Sequence Number=SeqID_82739
  Gene Ontology: Mol. function=methyltransferase activity; Biological process=metabolic process
  Homolog annotation: Hit_ID=Q1SNV1; Match level="QueryCoverage=99%, HitCoverage=97%, E-value=0.0, Identity=73%"; Hit description=SAM (And some other nucleotide) binding motif
  Pfam annotation: Domain name=CMAS; Domain location=211-452; Score= -113.5; E_value=1.3e-07; Accession=PF02353.10; Description =Cyclopropane-fatty-acyl-phospholipid synthase
  Pfam annotation: Domain name=CheR; Domain location=230-360; Score= -97.5; E_value=0.047; Accession=PF01739.9; Description=CheR methyltransferase, SAM binding domain
  Pfam annotation: Domain name=Methyltransf_11; Domain location=250 -346; Score=94.4; E_value=3.4e-25; Accession=PF08241.2; Description =Methyltransferase domain
  Pfam annotation: Domain name=Methyltransf_11; Domain location=53-119; Score=11.3; E_value=0.0042; Accession=PF08241.2; Description =Methyltransferase domain
  Pfam annotation: Domain name=Methyltransf_12; Domain location=250 -344; Score=60.3; E_value=6.3e-15; Accession=PF08242.2; Description =Methyltransferase domain
  Pfam annotation: Domain name=Pox_MCEL; Domain location=191-454; Score= -188.0; E_value=0.027; Accession=PF03291.7; Description=mRNA capping enzyme
  Pfam annotation: Domain name=Ubie_methyltran; Domain location=227 -397; Score=-96.8; E_value=2.9e-05; Accession=PF01209.9; Description =ubiECOQ5 methyltransferase family
  Pfam module annotation: Pfam domain module=CMAS::CheR::Methyltransf _11::Methyltransf_11::Methyltransf_12::Pox_MCEL::Ubie_methyltran; Domain location=211-452::230-360::250-346::53-119::250-344::191 -454::227-397
MDERHIQKSYWLQHSADLSVEAMMLDSKAAHLDKEERPEVLSLLPPFEGKSVIELGAGIGRFTGELALKAGQLLAVDFIDTAIKKACSTYAFVSPLMLQVEKLAERMVRWLKDGGYIFFRESCFHQSGDSKRKYNPTHYREPRFYTKVFKECHMSDNTGNSFELSLVGCKCIGAYVRNKKNQNQICWIWQKVRSQDDRGFQRFLDRVEYSHKSILRYERMYGPGFVSTGGLETTKEFVAKLGLKPGQKVLDVGCGVGGGDFYMAENFDVEVIGIDLSINMISLAIERAIGLNYAVEFDCADCYRKTYPENTFDVIYTRDTMLHVKDKPTLFRSFYKWLKPGGKILITDYCKSAGSPSLEFAEYIKKGGYYLHDIKAYRQMLEDAGFDDVIAEDRTDQFVNTLQQELNALENKKDDFIGDFSEEDYNEIVERWKAKQTRGASREQMWGLFIAKKN

SEQ ID NO: 199518 - protein, 276 aa, Glycine max
  Coding DNA Sequence Number=SeqID_82740
MQDIDTWSYFKGVDLLKELGYDFSNYRLWWKHRDANFEQGLKEFANDNDALQLCNYALINEDHEVALERGSENDGEGEDFESDEEAFSASEDSKDGDEDMDLDNESLHHLSSVDNTTPWGSILHLISQIWMMLEMILMLTICLRSWTVGMNQMGMTTSGLKKFRAHEMCKDFEFKIVMQLSSLTQFKEAMMKHSVLNSKEVTFIKNDKKKARNAKSKWVAMQILDKLKSNSSMIVNDVVNYTRSRFTARITSSTTYKARKIALAIVEGDAVKQYAI

SEQ ID NO: 199519 - protein, 848 aa, Glycine max
  Coding DNA Sequence Number=SeqID_82741
  Gene Ontology: Biological process=vesicle docking during exocytosis
  Homolog annotation: Hit_ID=Q2RA23; Match level="QueryCoverage=99%, HitCoverage=99%, E-value=0.0, Identity=50%"; Hit description =Expressed protein
MATVDVIKSCIDSIRQISEHIQDAIVYLDAGSTESFQFIAAYPILLELGARAICSLENMCPLDLVVDWNSNSDPGRKLVVITSSLLSDAHRYILRCLSAHQVVRHCIIFTSISETAHSAFPDSPLGPDAYHEYESLLVQDYEELVKKSWTKPGQAKHNFEDGGRSEFPSSGEDVLNLEASSSGRDFYEHNQLDCIEDAVQKLVVSVHHFPMILCPISPRVFVLPSEGLVAEAYLSAEHEDSISPGLPPLSTGLLSDADDVPPGATLTAHFLYHLAAKMDLKMEIFSLGDISKTVGKILTDMSSLYDVGRRKRSAGLLLIDRTLDLLTPCCHGDSLVDRMFSSLPRRNRTFSHGSGSQLKLSSSYLHRAPLDVQIPLAKILDEEDWQIDNFRLLETVEAFLCGWNSGNSDSQIEGLINLSQKIHDKPSQSDVEILTGSFVSSENFRGMPLLEAILDRKTKDGALLVKKWLQETLRRENVTVNVKSRPGLVTKPELQAMIKALSRSQSSLLRNKGIIQLASATLFALEESNYAKWDAFSSAEKILGVSSGETSQSLAIQIGDLINKTAFLGSHVNEGKREISKGLLSLQDALLLMIIGYILAGENFPTSGSDGPFSWQEEHLLKEAVVDALLENPSVANLKFLHGLREDLETNVSKSKSEETAEEPSKLDIDDFDDDQWGKWGDEDGDNKNEKVYGDVQLKLELRDRVDNFFKFLHKLSDLKRKNIPLRDGSLTTEANFDEDRKGLLYKLLTRVLGKYDVPGLEYHSSTVGRLFKSGFGRFGLGQAKPSLADQNVILVFVIGGINGLEVREAHKALGESGRPDIELLVGGTTLLTSNDMLDLLLGDSSYI

SEQ ID NO: 199520 - protein, 36 aa, Glycine max
  Coding DNA Sequence Number=SeqID_82742
MSFQRRWTNEDHGEIDVVEQMVAKPVVEHNKKINKL

SEQ ID NO: 199521 - protein, 134 aa, Glycine max
  Coding DNA Sequence Number=SeqID_82743
MASRKRKATTVVSQAGYDRSRFISQEAWDCYSDNVLARNVLLERNFKLYINEFDDFRRELIRRNWHKQLTRLTEGSINVAIVKEFYANLYVPEDKFPKQVRVRGNLIKFDVDSLNTFLETPVVVEQGESLPSYS

SEQ ID NO: 199522 - protein, 358 aa, Glycine max
  Coding DNA Sequence Number=SeqID_82744
  Gene Ontology: Mol. function=zinc ion binding; Cellular component =integral to membrane; Biological process=ubiquitin cycle
  Homolog annotation: Hit_ID=Q1SGA9; Match level="QueryCoverage=89%, HitCoverage=88%, E-value=1e-70, Identity=48%"; Hit description=Zinc finger, RING-type; RINGv
  Pfam annotation: Domain name=PHD; Domain location=158-203; Score=0.7; E_value=0.049; Accession=PF00628.19; Description=PHD-finger
  Pfam annotation: Domain name=zf-C3HC4; Domain location=159-200; Score= 36.5; E_value=9.3e-08; Accession=PF00097.15; Description=Zinc finger, C3HC4 type (RING finger)
  Pfam module annotation: Pfam domain module=PHD::zf-C3HC4; Domain location=158-203::159-200
MGLNYRNLFPGTPSNCLQDCSYDDKSSCCDPSNLLPPTPPIYSDNDLSQSPSKHIKAEYLIISFSIVATAFIALFCYAIYVKFFSPRNTSIIRRRRTTTTTTLSQPQTEQYFLDEEEHGPVVDHPIWYIRTTGLQQAVITAITVCNYKKDEGLIEGTECSVCLSEFQEDESLRLLPKCNHAFHLPCIDTWLRSHTNCPMCRAPIVTDPTRVPSSMDPTAFETSSFVEEIFENSAENTQNSSDDLLRGEEEERVQEDEACEENLASELVVTVQQPRRSVSLDSSSAAKISLALATVVSGESHGDHSKRVGGNGNLATKGGSSSCSSTSSVKRSLSFNAKHLLSWYSRSQRKPNAPLRSF

SEQ ID NO: 199523 - protein, 476 aa, Glycine max
  Coding DNA Sequence Number=SeqID_82745
MTAKAHNEICRLSPQKLILIKHNRGNFTIVILITCVTFLIALHTQFFLQTPPPPSSWETSIFNTTHNELNSTVHKLRSSVTFLPLKDLRHARAPLEGHTWFMSSMYDTHEDGEVQYQQFPSESSHGKLLCLKGRDTHDGSWNSYALAWPEALPYNTTFMRGLTFVSYNHYNYENLWHGLCAMVPFVAWHKMNNSSQLPSRWVLYHWGELRFKMGLWVDTLMEATFNGPPIIEKFDGVNEDGPVCFEEAVVMRHNEGGMSRERRMEVYDLMRCKARMFCNVSLKGSDVEINDRGSPMIGMTLFFRTGPRSFKNDTIVAEIFHKECAKIEGCRFMVAHSNNLTFCEQVKLMSVTDILISPHGAQLTNMFLMQRNSSVMEFFPKGWLKLAGVGQYVYHWIASWSGMKHQGSWRDPSGDECPYSDDDRRCMSIYKNGRIGHNETLFSEWARNVLAEVKTRKIQETSIKRRASSSFGGTCS

SEQ ID NO: 199524 - protein, 415 aa, Glycine max
  Coding DNA Sequence Number=SeqID_82746
  Gene Ontology: Mol. function=transcription regulator activity; Cellular component=nucleus; Biological process=unidimensional cell growth
  Homolog annotation: Hit_ID=Q9FMF4; Match level="QueryCoverage=57%, HitCoverage=61%, E-value=2e-16, Identity=34%"; Hit description =Arabidopsis thaliana genomic DNA, chromosome 5, P1 clone:MSJ1
MVCQAASQTRFRALKHEYGIDGKATIIVRVIACFQPLHFCQKSSKFPKISYKSTITSTSHLFCWMVKADGSLPRPHHVAWQSPSSNYFSMLPKPSLLGLPTYLNSGTSILPAVSTFHGLAAPSIPSLKTKLTNEVQGFLQYHYADTSLKETHVGGALQNANPSSLQKRLLIFDRSDNKTRLFYGPVPLVQSPTVTATKFAQSYGVKGEGQASNVGQKHLASYSLLEESVKDHAVIEESENHEDTEEINAFLYSDDESSEDDDDDTCDEVTSTDHSPLATNKTYVIQEQFKDTKEEVASSDWPNKRLKLFDGDYNRSSTPVDRYSLVRPNETCDCVSDAESKNSSGWAYSVDKTKVDNSVAHHIKFKKDKIRESLKVLENLIPGAKGKEPLLVIDGTIEYLKILMSQTGALGVKYH

SEQ ID NO: 199525 - protein, 672 aa, Glycine max
  Coding DNA Sequence Number=SeqID_82747
  Gene Ontology: Mol. function=signal transducer activity; Cellular component=membrane; Biological process=response to light stimulus
  Homolog annotation: Hit_ID=Q1SGA7; Match level="QueryCoverage=99%, HitCoverage=100%, E-value=0.0, Identity=84%"; Hit description =BTB/POZ; NPH3
  Pfam annotation: Domain name=BTB; Domain location=38-144; Score= -13.4; E_value=0.066; Accession=PF00651.21; Description=BTBPOZ domain
  Pfam annotation: Domain name=NPH3; Domain location=227-515; Score =480.2; E_value=2.5e-141; Accession=PF03000.5; Description=NPH3 family
  Pfam module annotation: Pfam domain module=BTB::NPH3; Domain location= 38-144::227-515
MWESESESGAGREYGSGLLTSTKHSLKTEGFQQRGNCWYVSTDIPSDLLVQIGDANFHLHKYPLLSRSGKLNRIIYDSRNPDLNKIVMDDLPGGPEAFELASKFCYGIAIDLTAGNISGLRCAAEYLEMTEDLEEGNLIFKTEAFLSYVVLSSWRDSIVVLKSCEKLSPWAENLQIVRRCSESIAWKACANPKGIRWSYTGRVPKVASPKWNDMKDSSPSRNQQVPPDWWFEDVSILRIDHFVRVITAIKVKGMRFEMIGAGIMHYAIKWLPGLMNKDTSIPGEEGSNSSTSNSISSSGGSWKGGLHMIVAGPRDDTSTLQAKDQRMIIESLISIIPPQKDSVSCSFLLRLLRMANMLKVAPALITELEKRVGMQFEQATLADLLIPCYNKNETTYDVDLVQRLLEHFLVQEQNESSSPSRPPFPDKHVSSNINAKTRVARLVDSYLTEVSRDRNLSLTKFQVLSEALPESARTSDDGLYRAIDSYLKAHPTLTEHERKRLCRVMDCQKLSIDACMHAAQNERLPLRVVVQVLFSEQVKISNALANNGSLKEGAESHYQPMIPNRKTLLEGTPQSFQEGWTAAKKDINTLKFELETVKTKYLELQNDMENLQKHFDKLLKQKHSSAWSSGWKKLSKLTKMTNVENHDISPQIPTSEEQNRKTTTRRWRNSIS

SEQ ID NO: 199526 - protein, 75 aa, Glycine max
  Coding DNA Sequence Number=SeqID_82748
MAGRNDHAIVDALQALAQAVGNPNRGEAGGAVELIRQVCEVLIFSFSLSQSAGLAIHLLSAPLLQLSARKNLEEG

SEQ ID NO: 199527 - protein, 322 aa, Glycine max
  Coding DNA Sequence Number=SeqID_82749
MGKLHLHGGTGRVGSNYDTVVVIKIHNIRVLHIDSRSLLLAMVLVALPFLGFILKGSVVSGFDATATESGSIISDEVLNLILRDLGEEGLLRKEHKVLIMDSPPPRVMDFEVSYDFVFTCSFDAAAFADSVLKVNGIVAFPLRIDPTSNAGMKATDVALRKIGLVNDLVDSSPKRKLCQLATRVKRNALKGLEDALLEPPRDDFAKPNKIKYLLSCWVILLKVTREESSLVWACMRKIELRLNGLSRTTPKRVQCFRFIVSRLHQNHMDVSAWLTNHVKEEEFVVMKAEAGRRNKSGRTYWECLALYGRLRDEGVAVHQWWN

SEQ ID NO: 199528 - protein, 110 aa, Glycine max
  Coding DNA Sequence Number=SeqID_82750
LFDLQTANLYTDNHSGISARQRDSKVNMTDLVSAEDDINLHLSTILSAAIEEGFSTYRQQKVYMNNHSGISARQRDSKVSMTDLVSAEDDVNLRVPTGLSIAIDEGRRRR

SEQ ID NO: 199529 - protein, 1261 aa, Glycine max
  Coding DNA Sequence Number=SeqID_82751
  Gene Ontology: Mol. function=hydrolase activity; Cellular component =cytosol; Biological process=electron transport
  Homolog annotation: Hit_ID=Q1SGA5; Match level="QueryCoverage=99%, HitCoverage=99%, E-value=0.0, Identity=88%"; Hit description =Hydantoinase/oxoprolinase; Hydantoinase B/oxoprolinase; Hydantoinaseoxoprolinase, N-terminal
  Pfam annotation: Domain name=Hydant_A_N; Domain location=10-220; Score=324.6; E_value=1.7e-94; Accession=PF05378.3; Description =Hydantoinaseoxoprolinase N-terminal region
  Pfam annotation: Domain name=Hydantoinase_A; Domain location=239-539; Score=447.7; E_value=1.5e-131; Accession=PF01968.8; Description =Hydantoinaseoxoprolinase
  Pfam annotation: Domain name=Hydantoinase_B; Domain location=739 -1261; Score=816.2; E_value=1.8e-242; Accession=PF02538.5; Description=Hydantoinase Boxoprolinase
  Pfam module annotation: Pfam domain module=Hydant_A_N::Hydantoinase _A::Hydantoinase_B; Domain location=10-220::239-539::739-1261
MGSVTEGKLRFCIDRGGTFTDVYAEIPGQTDGQVLKLLSVDPLNYDDAPVEGIRRILEEFTGEKIPRNSKIPTEKIEWIRMGTTVATNALLERKGERIAVCVTRGFRDLLQIGNQARPSIFDLTVLKPSNLYEEVVEVEERVQLVQSEEEEEKQGGSSSVVKGISGELVRIVKPLNEEALKPVLKNLLDKGISCLAVVLMHSYTYPQHEQQVKKLALSLGFRHVSISSALSPMVRAVPRGLTAGVDAYLTPVIKEYLSGFISKFDEGIGKLNVLFMQSDGGLAPESTFSGHKAILSGPAGGVVGYSQTLFGLETDKPLIGFDMGGTSTDVSRYAGSYEQVLETQIAGAIIQAPQLDINTVAAGGGSKLKFQFGTFQAGPESVGAHPGPVCYRKGGELAITDANLVLGYVIPDYFPSIFGPNEDQPLDFKSTRGEFEKLARQINTHRRNQDPSSKDMTVEEIALGFVDVANETMCRPIRQLTEMKGHETKNHSLACFGGAGPQHACAIARSLGMKEVLIHRFCGILSAYGMGLANVVEEAQEPYSAVYGVESIVEVSQREAVLLRQVKQKLQIQGFKEENISTETYLNLRYEGTDTAIMVKRQVAEDGNLCDYATEFVRLFQQEYGFKLQNRNIVICDVRVRGIGVTNILRPQAIEPAPGSPIVEGYYKVYFGNGWQETPLYKLEKLGYGHMMSGPAIIMNGNSTVIVEPNCRAIITKYGNIKIEIESPLTSVKISDKVADVVQLSIFNHRFMGIAEQMGRTLQRTSISTNIKERLDFSCALFDPSGGLVANAPHVPVHLGAMSSTVQWQLNYWGDNLNEGDVLVTNHPSAGGSHLPDITVITPVFFNGKLVFFVANRGHHAEIGGTTPGSMPPFSKSILEEGAAIKAFKLVEKGIFQEEGIIKLLQFPSSDGRGNKIAGTRRIQDNLSDLRAQVAANQRGISLVLELIEQYGLETVQAYMNYVQVNAEAAVREMLKSVGHRISSKSNELVTIEEEDYMDDGSIIHLKLSIDSNKGEAVFDFAGTSSEVYGNWNAPKAVTAAAVIYCVRCLVNVDIPLNQGCLAPVKILIPEGSFLSPSDTAAVVGGNVLTSQRITDVIFTAFQACACSQGCMNNFTFGDDTFGYYETIGGGSGAGPTWDGTSGVQCHMTNTRMTDPEIFEQRYPVILHKFGLRENSGGDGFHKGGDGLLREIEFRRPVIVSILSERRVHAPRGLKGGKDGARGANYLVKKDKRKIYLGGKNTVEVLPGEILQILTPGGGGW

SEQ ID NO: 199530 - protein, 103 aa, Glycine max
  Coding DNA Sequence Number=SeqID_82752
MTKEMWDFIQGLGKVFEEKELNIKILKSLNRTWQPKVTTIFESKDLTSITYVELLKKLRKYEMDMIRMAEEEAKEKKSRDLALKPSIPSSDASEEENAEGFKS

SEQ ID NO: 199531 - protein, 841 aa, Glycine max
  Coding DNA Sequence Number=SeqID_82753
  Gene Ontology: Mol. function=protein binding
  Homolog annotation: Hit_ID=Q9LVH8; Match level="QueryCoverage=98%, HitCoverage=71%, E-value=1e-166, Identity=49%"; Hit description =Genomic DNA, chromosome 3, P1 clone: MEB5
  Pfam annotation: Domain name=LRR_1; Domain location=112-134; Score =7.7; E_value=10; Accession=PF00560.23; Description=Leucine Rich Repeat
  Pfam annotation: Domain name=LRR_1; Domain location=169-190; Score =0.6; E_value=2.2e+02; Accession=PF00560.23; Description=Leucine Rich Repeat
  Pfam annotation: Domain name=LRR_1; Domain location=192-212; Score =7.9; E_value=9.7; Accession=PF00560.23; Description=Leucine Rich Repeat
  Pfam annotation: Domain name=LRR_1; Domain location=214-234; Score =10.9; E_value=2.7; Accession=PF00560.23; Description=Leucine Rich Repeat
  Pfam annotation: Domain name=LRR_1; Domain location=258-278; Score =9.5; E_value=4.7; Accession=PF00560.23; Description=Leucine Rich Repeat
  Pfam annotation: Domain name=LRR_1; Domain location=280-300; Score =6.6; E_value=17; Accession=PF00560.23; Description=Leucine Rich Repeat
  Pfam annotation: Domain name=LRR_1; Domain location=305-327; Score =2.5; E_value=99; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=112-134::169-190::192 -212::214-234::258-278::280-300::305-327
MEIVTGDRYLEKLVQFVENQAGPLIEGALVLKLNPAGLHYVQSRLEALHELESLLAGAPVDYLRAYVSDLGDHRALEQLRRILRLLTSLKIVSVLPHPIRDPTPLSFLPFGRLKVLELRGCDLSTSAAKGLLELRHTLEKIICHNSTDALRHVFASRITEVKNSPQWNRLSFVSCACNGLVLMDESLQLLPAVETLDLSRNKFAKVDNLHKCTKLKHLDLGFNHLRTFAPFTQYLAPVDPVMSNLVTILVETRMVSCHIVKLVLRNNALTTLHGIENLKSLEGLDVSYNIISNFSELEFVAGLPYLQSLWLEGNPLCCARWYRAQVFSFFAYPERLKLDEKEINTSDFWKRQIIIASMHKRPASFGIYVPAKDEAVIEGGNIRRRKVSRLVSIKNEETTSICSDEDFVSCANDIQNREDPDLSDNEAEMVDLINRVEHMKKERSIHWLREFKDWMDIASDKSVETRKEGSTSLHHQKENYIRKKTNQEQSGDISRYASDSVLASGDDSSMNILESDSSFVDMSASYHRQQHFDYRGLLGNASGASHFDSGGVDMERLKSSLEGISSSLSQNRSSHSDTVTTQGTQRMTENVNFSPLSTIHDISGSQSSSACPTSPPHFQEDLLHRRQHLVEEILQLSADSFSVVSFDSNTSCSDVDCSEFELSVPKVDNFPCKYYMNGSVDGHLSQNQLKEKFYNPRQGILHARENGNSLSSSTCDPTSKQHSIDFAAGADNAESAFCANQDTGLLENRKIRKKAKRIISILEENLDVDASDHTQEQTSQGQISPNLKQVLDIDDSTEFSGHHYSTQENDDLIVTYFNTSIADSEASEDYYSTSVQNVLMF

SEQ ID NO: 199532 - protein, 120 aa, Glycine max
  Coding DNA Sequence Number=SeqID_82754
  Gene Ontology: Cellular component=chloroplast thylakoid membrane
MKHLMLILFSMLQKTPFGYTRKDVLLIGLGVTLLGIGLKSGLEFVGVDSLQAGNVVQLVLVLGLTVGWISTYIFRVSNKEMTYAQQLRDYESKVMEKRLESLTEAELQALLEEVEEEKSR

SEQ ID NO: 199533 - protein, 211 aa, Glycine max
  Coding DNA Sequence Number=SeqID_82755
  Gene Ontology: Mol. function=protein binding
  Homolog annotation: Hit_ID=UPI0000163432; Match level="QueryCoverage =91%, HitCoverage=18%, E-value=5e-30, Identity=42%"; Hit description =protein binding
LLNPSLIYHPGTLLSVLSCHKIEEVCEVLVGMGLQAHCGNLNGSLEQVQVELFDNQICGGSNVSIYQYAMVLLFCKNGSEESWLSRSLFVIGGNVLLCIEDLKQLYSLSSDASVSPYFRIDSCCSIADITEMVIEVGGSCCVTLGLTCPLAELHPSTQMNLQTVNHENTVPRSRKLKLQWFSKDYLVKFVSLLKAIHEKETGSPLVVRCIS

SEQ ID NO: 199534 - protein, 178 aa, Glycine max
  Coding DNA Sequence Number=SeqID_82756
  Gene Ontology: Mol. function=nucleoside-triphosphatase activity; Cellular component=integral to membrane; Biological process=vacuolar transport
  Homolog annotation: Hit_ID=Q6ES53; Match level="QueryCoverage=98%, HitCoverage=23%, E-value=3e-59, Identity=67%"; Hit description =Putative white pigment protein
  Pfam annotation: Domain name=ABC_tran; Domain location=79-176; Score=- 32.8; E_value=0.00014; Accession=PF00005.17; Description=ABC transporter
MARPERTGRNKSLETLIDSDKPGMGRNVNQLKTQKSIPGYGLEFSNLSYSIIKKQKNDGVWINKETYLLHDISGQAIKGEIMAIMGPSGAGKSTFLDALAGRIAKGSLEGSVRIDGKPVTTSYMKMVSSYVMQDDQLFPMLTVFETFMFAAEVRLPPSISRSEKKKRVYELLDQLGLQ

SEQ ID NO: 199535 - protein, 449 aa, Glycine max
  Coding DNA Sequence Number=SeqID_82757
  Gene Ontology: Mol. function=transporter activity; Cellular component= integral to membrane; Biological process=transport
  Homolog annotation: Hit_ID=Q6Z1Z0; Match level="QueryCoverage=91%, HitCoverage=90%, E-value=1e-140, Identity=62%"; Hit description =Putative sulfate transporter-like
  Pfam annotation: Domain name=MFS_1; Domain location=31-422; Score= -48.4; E_value=0.052; Accession=PF07690.6; Description=Major Facilitator Superfamily
  Pfam annotation: Domain name=Sulfate_transp; Domain location=117-427; Score=-126.1; E_value=0.0033; Accession=PF00916.10; Description =Sulfate transporter family
  Pfam annotation: Domain name=Xan_ur_permease; Domain location=40-417; Score=-164.9; E_value=0.057; Accession=PF00860.11; Description =Permease family
  Pfam module annotation: Pfam domain module=MFS_1::Sulfate_transp::Xan_ ur_permease; Domain location=31-422::117-427::40-417
  Subcellular localization annotation: CTP_CleavageSite=13; ConfidenceScore=5.02e-01
MAPPNPPPTSEASSSAVQKVKSNLVFRSTWAELNGAMGDLGTYIPIVLSLTLASDLNLGTTLIFTGMYNIITGAIYGVPMPVQPMKSIAAVALADPTFSIPEIMASGILTGATMLVLGVTGLMQLAYKLIPLCVVRGIQLAQGLSFALTAVKYVRKVQDLPRSKSMDQRHSLGFDGLILAIACVCFIVIVNGAGEDPNHDHDHDHDEEPSHQIQARISNKVRKIRRVIFALPSAFLVFVLGVLLAFIRRPRVVHEIKFGPSSIEVVKMSRHAWKQGFIKGTIPQLPLSILNSVIAVCKLSSDLFPGLMNLVGGWFGAMPCCHGAGGLAGQYKFGGRSGGCVALLGAAKLILGFVLGSSLAHFFNQFPVGILGVLLLFAGVELAMASRDMNTKEDSFVMLLCTAVSLVGSSAALGFLCGMIVFVLLKLRDWINGKPINAIWKHEGPDEQV

SEQ ID NO: 199536 - protein, 212 aa, Glycine max
  Coding DNA Sequence Number=SeqID_82758
  Gene Ontology: Mol. function=nucleoside-triphosphatase activity; Cellular component=integral to membrane; Biological process=transport
  Homolog annotation: Hit_ID=Q6ES53; Match level="QueryCoverage=78%, HitCoverage=21%, E-value=4e-70, Identity=80%"; Hit description =Putative white pigment protein
  Pfam annotation: Domain name=ABC2_membrane; Domain location=54-212; Score=-6.7; E_value=0.0038; Accession=PF01061.14; Description=ABC-2 type transporter
MSGPRSAVSNQYSAAPAVVGQSMDYSATSYEGFEIEEVLDELNFGSKYANPWLREVAVLSWRTALNVIRTPELFLSREIVLTVMALILSNIFRNLSHPLFKDINRLLNFYIFAVCLVFFSSNDAVPSFIMERFIFIRETSHNAYRASSYVISSLIVYLPFFAVQGFTFAVITKKMLHLRSSLLYFWLILYASLITTNAYVMLVSALVPSYIT

SEQ ID NO: 199537 - protein, 388 aa, Glycine max
  Coding DNA Sequence Number=SeqID_82759
  Gene Ontology: Mol. function=zinc ion binding
  Homolog annotation: Hit_ID=Q69L44; Match level="QueryCoverage=95%, HitCoverage=90%, E-value=7e-47, Identity=31%"; Hit description=SWIM zinc finger family protein-like
MEGILNLPVQDPLCPEFSAAHINWVKLEGGRQCGDNIALIPFARVDDFVKGESSNPECPASFRLESRRKRPVGSIAKPRVDGYLEYTLYWCSYGPKDYRESDSGVGEASHDERGRELCMHAPRISDELRQKVMSMLYVGISLDKIIQHHAEDMQKQGGPQNRDDFLTRNDVRNMERTVRNSSNELHENDECSVKIWVQQHQKHVFYFQDNSSSEPFVLGIQTDWQLQQMLRFGNNSFISFHSSFGLKKLKENYASFWPRVDWLIHTLTTEFHSLYWLDQYSLETGYFENLRDNSFSSNVWYHALHIPDVDVILDEQNLHLAKVARPSLSTQGYKQALLTLLHNPPDDPLVLDLTILHVTHLQQDIKALEDFSNNGLLQPIAPDLSSQT

SEQ ID NO: 199538 - protein, 422 aa, Glycine max
  Coding DNA Sequence Number=SeqID_82760
  Homolog annotation: Hit_ID=Q75GB5; Match level="QueryCoverage=37%, HitCoverage=49%, E-value=7e-21, Identity=38%"; Hit description =Putative senescence-associated protein
  Pfam annotation: Domain name=DUF581; Domain location=335-393; Score =76.0; E_value=1.2e-19; Accession=PF04570.5; Description=Protein of unknown function (DUF581)
MLRKRNRSVQKDQHLMCEVNSEHYSQSHHALGRNNIKGHSIFNVPCLFVGLGPKGLLDSDSVRSPTSPLDDARVLSNLGKNPVRKPRSSHHERSWDCCKVGLGIVESLEDCSSSRFSGKILQSPESKRVSLSPQMMMIKAPNCQIHRDSSLEGSKSLPKDFCKAPPYYAHQNGSVVIHKGECESESTVLFEIGESGLELEPFGRTRSCSLDSCSPLKALSGVTTFYSNSDTDNNFAVKDVSSPPRFIGGSQNSNNNFTPTKLNSTTLSISPSNDIIKSLSASEIELSEDYTCVISHGPNPKTTHIFGDCILETHSNAFKTHFKNEEKEHGVKPLGSNKLGSPKPYPSSDFLSFCHHCNKKLEEGKDIYIYGGEKAFCSLTCRAMEIMIDEELEKSNTNPPCESSPKPKLGELLFETGILTAT

SEQ ID NO: 199539 - protein, 195 aa, Glycine max
  Coding DNA Sequence Number=SeqID_82761
  Gene Ontology: Mol. function=binding; Cellular component=thylakoid; Biological process=cell redox homeostasis
  Homolog annotation: Hit_ID=Q93X83; Match level="QueryCoverage=51%, HitCoverage=41%, E-value=8e-28, Identity=48%"; Hit description=Hsp70 interacting protein/thioredoxin chimera
MNLCISGYYYSHHMLEPGTDFDDNNSDPPLSAQDDIIESDIELDNADVVEPDNDPPQKMGNPSAEVTEEQRYRKLFQINPDSAKGYKIRGMSRAMLGLREEAASDLHVASKLDFDEEISIALKKVEPNANKIEEHRRKCERLRKRKEQKRSPIKTETPIKKESKKLKPRKALQAAMKPGIPKMAKYQDHTWLYLI

SEQ ID NO: 199540 - protein, 57 aa, Glycine max
  Coding DNA Sequence Number=SeqID_82762
MYTELIGILIVDDSREWKYWRSFSTAKYMLVYWLNVEKDLAINDFIGKPNFRGFEDK

SEQ ID NO: 199541 - protein, 508 aa, Glycine max
  Coding DNA Sequence Number=SeqID_82763
  Gene Ontology: Mol. function=protein transporter activity; Cellular component=membrane; Biological process=intracellular protein transport
  Homolog annotation: Hit_ID=Q9LGF8; Match level="QueryCoverage=93%, HitCoverage=89%, E-value=1e-84, Identity=61%"; Hit description =Putative syntaxin of plants 31
  Pfam annotation: Domain name=SNARE; Domain location=252-314; Score =68.9; E_value=1.6e-17; Accession=PF05739.9; Description=SNARE domain
  Pfam annotation: Domain name=Syntaxin; Domain location=339-445; Score= 94.5; E_value=3.2e-25; Accession=PF00804.15; Description=Syntaxin
  Pfam annotation: Domain name=Syntaxin; Domain location=52-158; Score =95.4; E_value=1.7e-25; Accession=PF00804.15; Description=Syntaxin
  Pfam module annotation: Pfam domain module=SNARE::Syntaxin::Syntaxin; Domain location=252-314::339-445::52-158
  Subcellular localization annotation: CTP_CleavageSite=59; ConfidenceScore=5.39e-01
MHAKSAQSSFRDRTQEFHSITERLKKSGSGPNGPSSSTSSTRSEEQRSAIANQSEFNRRASKIGYGIHQTSQKLAKLAKLAKRTSVFDDPTMEIQELTGVIKQDITALNSAVVDLQFLCNSRNESGNVSADTTSHSSTVVDDLKTRLMSTTKEFKDVLTMRTENMKVHENRRQLFSSSASKDSANPFIRQRPLAARAAASTSNAPALPWANGSPSSSQAFPKKQVDGESQPLLQQQQQQQEVVPLQDSYMQSRAEALQNVESTIHELSNIFNQLATLVSQQGEIAIRIDENMDDTLANVEGAQGALLNIAERLKKTGPAPNGQSSSSSRSEEQRSAIANQSEFNRRASKIGFGIHQTSQKLAKLAKLAKRTSVFDDPTMEIQELTGVIKQDITALNSAVVDLQLLSNSRNESGNASTDTTSHSTTVVDDLKTRLMSATKEFKDVLTMRTENLKVHENRRQLFSATASKDSANPFVRQRPLATRSAASTSNAPAAPWATGSSSSQLFPK

SEQ ID NO: 199542 - protein, 908 aa, Glycine max
  Coding DNA Sequence Number=SeqID_82764
  Homolog annotation: Hit_ID=Q016Y8; Match level="QueryCoverage=24%, HitCoverage=11%, E-value=5e-31, Identity=35%"; Hit description =Homology to unknown gene
  Subcellular localization annotation: CTP_CleavageSite=33; ConfidenceScore=5.26e-01
MDTLFFGIKLRASLQGNNTIKRVFPRSKRCNVSAKHVRYPLRHAFRFCGQNVNLLKKHHVSASWSRLKCFREKEPPFSLSVSYFTPLWKEGVLLMRASVFTAVISGLCLLVWFGRNKAWGFVETNILPSVCSVISEYVQRDVCFGKVLRISPLSVTLESCSFGPNEEEFSCGEAPTVKVRFRPLASLWRGKFVFDAVLSHPCVLVVQKKDFSWLGILPSQGGIQRRLSTKEGLDHRTRVRRVAREEAAAKYVRERDDAAREAAEMGYFVSEKNCGPSKGDDDLKEIATHSVGGTNSKSFFCMKEVEQHGHRCVGTGVDYDMKHADLEESFRVKFPEKGLKFWKRVIKGHRKHKFKPKAKRSDISASGIALRKRILERGAFAANAYFRSQSHGKFEQPLSSSGCFHARDHDRQLVKSDDKNDVSVASGDDNRNGDHRNGTQFRDLGVWSPSANENINGHSNDLNFCSDLHSQTRESKHENLQSSEDVAEHANANISTEKKEELGLHVAHSPIDVSATRGQRDLVSVKPSSLLAAYFHVPFETLIMKFGLNSFFRNIEGLKSFFLSGPIEKLKSEMDGVDVLQSEDLTKILPVTLDSVQFRGATVMLLTYGDREVRVLENVNGHVKFHNHYDHINVKLSGNCKTWRSDDICEGDSWLSVDVFVDTVEQKWHANLKIDHFFVPLFERILDIPITWSKGRASGEVHLCMSKGETFPNHHGQLNVTGLNFQLSDAPSCFSNISGSLCFRGQSIFLHNACGWFGSIPLEASGDFGIHPEEGEFHLMCQVPSVEVNALMRTFNMRSLSFPLAGSITALFNCQGPLDTPIFVGTGMVSRTFSSLHVDTPTTVASEALAKSKEAGALAAFDRVPFSHVSANFTFNTDSCIADLYEIRASLVDGGEIRGAGTVWICSE

SEQ ID NO: 199543 - protein, 829 aa, Glycine max
  Coding DNA Sequence Number=SeqID_82765
  Homolog annotation: Hit_ID=Q016Y8; Match level="QueryCoverage=91%, HitCoverage=33%, E-value=5e-75, Identity=27%"; Hit description =Homology to unknown gene
MGRWRMKLDIPRAEVAEMLPLARLLSRSMDPAVLSRSKLRREHHAPSNDVLDDLSLPGLLELKGRWHGSLNASGGGNGDTLAEFDFHGEDWEWGEYKTQRVLAVGTYSNDDGLNLEKFFIQKENATIHADGTLLGPKSNLHFAVLNFPVSLIPTVVQIIDSTSSNVAHSLRQLLAPIRGILHMEGDLRGSLAKPECDAQIRLLDGAIGGIVLERAEVVTSLTSTSHFLFNAKFEPLIQNGHVLVQGAIPVTFFQSNMLQQDVELDKSRTTWVPEWVKKKSMGTTDDARDKKVSRRRNEEGWNTQLAESLKGLNWQILDVREVRVDVDIKDGGMMLVTALTPYANWLHGSADIMLEARGTVDQPVLNGYASFRRASISSPVFRNSLTNFGGIVHMKSNRLSIPSLESRIGRKGKLLVKGNLPLRTKEPALNDKIEFKCEVLEVNSQVQITGSILQPNISGNIKLSQGEVYLPHDKGGAASNGFPSYPSAVPRGGIDKSYASRYISQYFGSESASLMAKNSQSSGSVNESIQVEKDMEEVQIKPNIGIRLSDLKLVLGPELKIVYPFILNFSVSGELELNGLAHPKCIKPRGTLAFENGEVDLVATQVRLKREHLNVARFEPDNGLDPMLDLTLVGSERQYRIHHRASNWQEFVEQDTLSPIEGLGSTGPVWLGLEQVLELMKLLKSPVEAKQVARRLDSQLAESILENNGHVAFEKVVTATLEKLMPRIEGKGEFGLAKWKLVYAPQIPSLVCSGATVDPFTLLAANLSFGTDVEVQLGKHIQARIVRQMKESQMAMEWTLTYELTSRLHLCLKNGSSKCILFEYSASQD

SEQ ID NO: 199544 - protein, 235 aa, Glycine max
  Coding DNA Sequence Number=SeqID_82766
AENDETAIDANFSGSLAFEKIMLRYIPSYHHLMPLKFGVLSENTKLSGSLLRPRFDIKWTASKAEGSFSDARGDIIISDDFVTVNSASAAFDLYMKVQTSYSDNFSLKREEFYAPRAIPFTVSGVEFDLHMRGFEFFSLVTPYTLDFPRPLILKATGRIKFQGKILKPSTTVIEQNFDKNKQHVQMLEKGSADSLVGEVSISGLKLNQLMLAPQMSGSLSVSPESIKVMDKLFPS

SEQ ID NO: 199545 - protein, 138 aa, Glycine max
  Coding DNA Sequence Number=SeqID_82767
MKGKRFSLNPYVPLSKWNAEKDSKNHDDEAHPQPQHLLQSKAKNMPQSLQNVSEWEVQQADLELGYLKSAFLDSAKQSLSDAYSANNSDLDNSIDLLHHFDDETLNIGNVPESVPAADSASPNPNNTASKAGASSNLA

SEQ ID NO: 199546 - protein, 214 aa, Glycine max
  Coding DNA Sequence Number=SeqID_82768
  Gene Ontology: Mol. function=calcium ion binding; Cellular component =oxygen evolving complex; Biological process=photosynthesis
  Homolog annotation: Hit_ID=P82715; Match level="QueryCoverage=67%, HitCoverage=48%, E-value=5e-40, Identity=56%"; Hit description =Thylakoid lumenal 35.8 kDa protein, chloroplast precursor
  Subcellular localization annotation: CTP_CleavageSite=48; ConfidenceScore=5.43e-01
MVFPSSSLSLFFPIPTLLPNNLIFRNNTRAILNQHKCPFSEERPRFSCCALKPTSQNRIFRRDLMLLGLTSLSPTMPLSVTLAEEEPKMASFLDEINAYSYMYPVELPSDNFTFKWIESRKPERYSSAAPLSPDARLRIVSERLDFIDNVIISVTIGPPNSSYIKSKDKSKWTAKDVADSVLADRSSLIISTWKVETRSGNMATNVGWWLNFKL

SEQ ID NO: 199547 - protein, 179 aa, Glycine max
  Coding DNA Sequence Number=SeqID_82769
  Gene Ontology: Mol. function=metal ion binding
  Homolog annotation: Hit_ID=Q84PB2; Match level="QueryCoverage=61%, HitCoverage=49%, E-value=2e-24, Identity=50%"; Hit description =Putative ATP synthetase alpha chain
  Subcellular localization annotation: CTP_CleavageSite=41; ConfidenceScore=5.53e-01
MARPTHHVIDITGSSGPSTSSSSTPHDRLANDVDFGALNSRTSRRRGDTTRSSRQHRSPLNSGLWICVELVITVSQIVASVVVLSLSKHEHPRAPLFAWIVGFASGCVATLPLLYWRYYHNCLVRELESSSQASLRSNDPSGTLLSDSTTNGGEDVPASSRSNQESWLMNARDESSSAE

SEQ ID NO: 199548 - protein, 329 aa, Glycine max
  Coding DNA Sequence Number=SeqID_82770
  Gene Ontology: Mol. function=heat shock protein binding; Cellular component=nucleus; Biological process=protein folding
  Homolog annotation: Hit_ID=Q84SD3; Match level="QueryCoverage=99%, HitCoverage=98%, E-value=1e-108, Identity=59%"; Hit description =Putative heat shock protein 40
  Pfam annotation: Domain name=DnaJ; Domain location=4-70; Score=124.7; E_value=2.6e-34; Accession=PF00226.21; Description=DnaJ domain
  Pfam annotation: Domain name=DnaJ_C; Domain location=205-327; Score =67.9; E_value=3.2e-17; Accession=PF01556.9; Description=DnaJ C terminal region
  Pfam module annotation: Pfam domain module=DnaJ::DnaJ_C; Domain location=4-70::205-327
MGLDYYNVLNVNRNATEDDLKKAYRKLAMKWHPDKNPTNKKEAEANFKEISEAYEARNVLSDPQKRVVYDQDGEEGLKDRPPPGNESASSGFNPRNAEDIFAEFFGSSPFGFGSSGPGRSKRFPSDGGGFSATDNNFRTYSTGRANMPKKPLPVETKLACSLAELYSGSTRKMKISRSVVDVNGQAIPETEILTIEVKPGWKKGTKITFPDKGNQQPNQLAADLVFVIDEKPHDLFDRDGNDLIVSKRVSLAEAIGGTTINLTTLDGRSLSIPVSDIVSPGYEMIVANEGMPITKEPGHRGDLRIKFDVKFPTRLTHEQRAGLKRALGS

SEQ ID NO: 199549 - protein, 247 aa, Glycine max
  Coding DNA Sequence Number=SeqID_82771
  Gene Ontology: Mol. function=prephenate dehydratase activity; Cellular component=cytoplasm; Biological process=L-phenylalanine biosynthetic process
  Homolog annotation: Hit_ID=Q1RXT6; Match level="QueryCoverage=49%, HitCoverage=31%, E-value=2e-49, Identity=76%"; Hit description =Prephenate dehydratase with ACT region
  Pfam annotation: Domain name=PDT; Domain location=98-231; Score=68.3; E_value=2.5e-17; Accession=PF00800.9; Description=Prephenate dehydratase
MALEVSPDGGRWCFTMETCPCLYQEMSCAILKPGLQTNFCSSVILWLSRIIPSGVVPTKLLNWAFGDFFILTLVARLDLPEPLMGKEFPSSDGSKLRVAYKGLPGAYTEDAALKAYPKCETVPCEDFETSFKAVESWLVDKAVLPIESSVGGSIHPNYDLLLGHKLHIVGEVQLLINHCLLGLPGVRKEDLKAVISHPQELLLSKFLHMSKFLAVLTLAFYDVDDLSPSEFSFCKCHKEDIGLRKSF

SEQ ID NO: 199550 - protein, 160 aa, Glycine max
  Coding DNA Sequence Number=SeqID_82772
  Homolog annotation: Hit_ID=Q9FYF7; Match level="QueryCoverage=63%, HitCoverage=43%, E-value=5e-19, Identity=43%"; Hit description =REF/SRPP-like protein At1g67360
  Pfam annotation: Domain name=REF; Domain location=16-160; Score= -59.6; E_value=1.9e-06; Accession=PF05755.3; Description=Rubber elongation factor protein (REF)
MFGNQLIKKLKKQLLTPQLGDNHRRSAASAGNETHHVVELLGKQIPRAAHKFDEHAPSLVKQVATQVTCLVQKVTHKAEKVVSEAQSGGARAAANYVATESKQIVLSGSVKLWTGLNQYPSFHSVAEMAVPLAAEEFNELMTSKLKWRLLVPELFLVQIF

SEQ ID NO: 199551 - protein, 92 aa, Glycine max
  Coding DNA Sequence Number=SeqID_82773
  Subcellular localization annotation: CTP_CleavageSite=44; ConfidenceScore=5.29e-01
MDCPAFLSMVTTSQCLKNDGNLYSGQSVTGGKGGYCTPGMLPISGNVGAKSFLFAPWTSPMLMESDKTMKKETKKRKRREAIFFSDVVGAKK

SEQ ID NO: 199552 - protein, 68 aa, Glycine max
  Coding DNA Sequence Number=SeqID_82774
MGLHSPGEIQGVVVVEGGGERKGMVGMVGIMGFEGMLGMLGILGIGILGKEKGGSGRFGKTGKGGTFP

SEQ ID NO: 199553 - protein, 169 aa, Glycine max
  Coding DNA Sequence Number=SeqID_82775
  Gene Ontology: Mol. function=protein serine/threonine kinase activity; Cellular component=nucleus; Biological process=response to high light intensity
  Homolog annotation: Hit_ID=P02519; Match level="QueryCoverage=90%, HitCoverage=100%, E-value=3e-83, Identity=100%"; Hit description =17.3 kDa class I heat shock protein
  Pfam annotation: Domain name=CS; Domain location=46-138; Score=-5.7; E_value=0.082; Accession=PF04969.6; Description=CS domain
  Pfam annotation: Domain name=HSP20; Domain location=49-152; Score =168.9; E_value=1.3e-47; Accession=PF00011.11; Description=Hsp20alpha crystallin family
  Pfam module annotation: Pfam domain module=CS::HSP20; Domain location= 46-138::49-152
MSLIPSFFGGRRSSVFDPFSLDVWDPFKDFPFPSSLSAENSAFVSTRVDWKETPEAHVFKADIPGLKKEEVKLEIQDGRVLQISGERNVEKEDKNDTWHRVERSSGKLVRRFRLPENAKVDQVKASMENGVLTVTVPKEEIKKPDVKAIDISGFMLAKRPNVWALEISG

SEQ ID NO: 199554 - protein, 127 aa, Glycine max
  Coding DNA Sequence Number=SeqID_82776
  Homolog annotation: Hit_ID=Q9SU58; Match level="QueryCoverage=60%, HitCoverage=8%, E-value=7e-12, Identity=48%"; Hit description=ATPase 4, plasma membrane-type
  Pfam annotation: Domain name=Cation_ATPase_N; Domain location=61-127; Score=-14.3; E_value=0.1; Accession=PF00690.16; Description=Cation transporterATPase, N-terminus
MQHVFQHPLIETATGTPENMKISNDRLSYFIDGVLFEFKYSYTETPKKKKATRVVLKEAVDLENMPLEEEVFQTLKSDSNGLTTKVSKKLGIFGHNKFQEKKENKFLIFRGSRKLQKSWSLLCKCWR

SEQ ID NO: 199555 - protein, 426 aa, Glycine max
  Coding DNA Sequence Number=SeqID_82777
  Gene Ontology: Biological process=response to UV-B
  Homolog annotation: Hit_ID=Q10DW0; Match level="QueryCoverage=81%, HitCoverage=78%, E-value=1e-116, Identity=62%"; Hit description =Expressed protein
  Pfam annotation: Domain name=DUF760; Domain location=17-399; Score =643.1; E_value=2.3e-190; Accession=PF05542.2; Description=Protein of unknown function (DUF760)
  Subcellular localization annotation: CTP_CleavageSite=56; ConfidenceScore=5.75e-01
MDVAVTAVRSPLIVLGSPVNGSASARLGSTFGFSRKLCLNSVFIPKQVRRRGFVVRAASSSPEWDDAKIAPLQLESPIGQFLSQILKDHPHLVPAAVDQQLHQLQTDRDAHLQNQQQPSSPTDLVLYRRIAEVKANERRKALEEILYALVVQKFMDANISLIPSVTPDLSGKVDLWPNEDGKLEQLHSDEAYEMIQNHLSLILGNKAGDLTSVAEISKFRVGQVYAASVMYGYFLKRVDQRFQLEKTMKVLPNATEEENGVHRNTMDNARPSIEQDTSQVMSHPEVSAWPGGDVSPGGFGYGIKATRLRNYVMSFDGDTLQRYAAIRSKEAVSIIEKHTEALFGRPEIVVTPEGAVSKDENIKISFGGLKKLVLEAVTFGSFLWDVESYVDSRDHRWEPCAFSCPFDFCLLPYITRYSSYFIVCWY

SEQ ID NO: 199556 - protein, 470 aa, Glycine max
  Coding DNA Sequence Number=SeqID_82778
  Gene Ontology: Mol. function=transcription factor activity; Cellular component=nucleus; Biological process=regulation of transcription, DNA-dependent
  Homolog annotation: Hit_ID=Q1SIZ0; Match level="QueryCoverage=99%, HitCoverage=56%, E-value=0.0, Identity=54%"; Hit description=Zinc finger, NF-X1-type; Single-stranded nucleic acid binding R3H; Zinc finger, RING-type; Zinc finger, PHD-type
  Pfam annotation: Domain name=zf-NF-X1; Domain location=128-152; Score= 16.5; E_value=0.095; Accession=PF01422.8; Description=NF-X1 type zinc finger
  Pfam annotation: Domain name=zf-NF-X1; Domain location=157-178; Score= 6.0; E_value=1.5; Accession=PF01422.8; Description=NF-X1 type zinc finger
  Pfam module annotation: Pfam domain module=zf-NF-X1::zf-NF-X1; Domain location=128-152::157-178
MPCRGLFSLSGSSFPEVSMWLYFPHCGVLQDKNGKSEIYFLIQIIFLMRIGIHTCVNYHVNPCATVLPCSVPQPCSHPASHSCLFRDCPPCSVPVAKECIGGHVVLRNIPCGSKDIRCNKLCVKTRQCGLHACGRTCHLPPCDNLSVVTCGAPRRDCRHTCIAPCHPSTPSPDTRCEFPVTITCSCGRITENVPCDAGANYNADVVHEASIIQKLPVLLQPVAANGKKAPLRQRKLMCNDDCAKLERKRVLADAYEITAPNLDSLHFGENSIASELLADMLRSDSKWVLSVEERCKFLVLGKSRGNDAHGPKVQVFCPMLKDKGDAVRVIAERWKLVVNAAGREPKHFIVVHVTPKSRAPARVLGVKGTTTVNVPLPLAFDPLVDMDPRVVVSFLDLPRDADISALVLRFGGKCELVWLNDKNALAVFNDPARAATAMRRFDHGTVYKGAVMVVVPPNVGASVASSATNA

SEQ ID NO: 199557 - protein, 352 aa, Glycine max
  Coding DNA Sequence Number=SeqID_82779
  Gene Ontology: Mol. function=voltage-gated potassium channel activity; Cellular component=integral to membrane; Biological process=potassium ion transport
  Homolog annotation: Hit_ID=Q9FY05; Match level="QueryCoverage=98%, HitCoverage=40%, E-value=1e-106, Identity=58%"; Hit description =Outward rectifying potassium channel
  Pfam annotation: Domain name=Ank; Domain location=129-161; Score =22.3; E_value=0.0017; Accession=PF00023.20; Description=Ankyrin repeat
  Pfam annotation: Domain name=Ank; Domain location=193-225; Score =33.8; E_value=5.9e-07; Accession=PF00023.20; Description=Ankyrin repeat
  Pfam annotation: Domain name=Ank; Domain location=226-258; Score=9.7; E_value=1.2; Accession=PF00023.20; Description=Ankyrin repeat
  Pfam annotation: Domain name=Ank; Domain location=63-95; Score=11.4; E_value=0.72; Accession=PF00023.20; Description=Ankyrin repeat
  Pfam annotation: Domain name=Ank; Domain location=96-128; Score=38.5; E_value=2.3e-08; Accession=PF00023.20; Description=Ankyrin repeat
  Pfam module annotation: Pfam domain module=Ank::Ank::Ank::Ank::Ank; Domain location=129-161::193-225::226-258::63-95::96-128
MVEAHEFCKVLRLDKKSFTEILKIYFLDGRIVLNNLLEVKDLSLQRKLLESDFNLTIGNMETELAIRMNFAAHDGHLDLVKRLIGFGADPNKTDYDGRTPLHISASKGYVDISSYLVEQGVNINCADKFGTTPLLEAIKNGHEEVASILVNAGAIFTIDDVGNFLCMTVAKKELDLLKRVLGCGVNPNAKNYDQRTPLHIAASEGLFTMAEVLLEAGASVLSKDRWGNTPLHEAHTGGDRNMIKMLEVAKASQLVELSNNIHETQATPTDEIPKKRCIVFPFHPWDDQKADRKEGVVLTVPQSIEELIKEATKHLEIPNASCILSEQCGKIVYVGTINNDEKLFLVSEAQNE

SEQ ID NO: 199558 - protein, 252 aa, Glycine max
  Coding DNA Sequence Number=SeqID_82780
  Gene Ontology: Mol. function=voltage-gated potassium channel activity; Cellular component=integral to membrane; Biological process=potassium ion transport
  Homolog annotation: Hit_ID=Q9FY05; Match level="QueryCoverage=100%, HitCoverage=32%, E-value=3e-89, Identity=62%"; Hit description =Outward rectifying potassium channel
MIFNVVTYLLVQIVLIDVVNNMRHLISESLGLRSLDNQGSDVAEKVSAENHVKGDINHDKYHFPDIDGMDVSVAKSSHGNNSEVEGGDVTLPKINMSEVRISIVTHLQATDPASGSVGAIKFNDKEFEDTGEQVTDTGVLLEGVEELGDSESTAEPYQEKIADELVVGGEFVKVVPGETGEKIGEEARLEVSKGDLVGVQDQGEGVGLDLVIANQEPEEDVKEEKQLPRHVQQENLLGQASEEPKLHGSQEG

SEQ ID NO: 199559 - protein, 159 aa, Glycine max
  Coding DNA Sequence Number=SeqID_82781
  Gene Ontology: Mol. function=kinase activity; Cellular component =nucleus; Biological process=regulation of progression through cell cycle
  Homolog annotation: Hit_ID=Q39878; Match level="QueryCoverage=95%, HitCoverage=31%, E-value=3e-63, Identity=83%"; Hit description =Mitotic cyclin a2-type
  Pfam annotation: Domain name=Cyclin_C; Domain location=16-141; Score =164.1; E_value=3.5e-46; Accession=PF02984.9; Description=Cyclin, C -terminal domain
MEREVLDLVHFQLSVPTIKTFLRRFIQAAQSSYKAPCVELEFLANYLAELALVECNFFQFLPSLVAASAVFLAKWTLNESEHPWNPTLEHYTKYKASELKTVVLALQDLQLNTKGSSLNAVPEKYKQQKQCVITARDNCKAKLPKDLTFEWENCHKCSG

SEQ ID NO: 199560 - protein, 418 aa, Glycine max
  Coding DNA Sequence Number=SeqID_82782
  Gene Ontology: Mol. function=acid phosphatase activity; Cellular component=lysosome; Biological process=iron ion transport
  Homolog annotation: Hit_ID=Q707M7; Match level="QueryCoverage=77%, HitCoverage=97%, E-value=1e-159, Identity=83%"; Hit description =Putative acid phosphatase
  Pfam annotation: Domain name=Metallophos; Domain location=42-253; Score=70.5; E_value=5.5e-18; Accession=PF00149.18; Description =Calcineurin-like phosphoesterase
MTDISKSLLFTFTIIISFGLCILYASAELQRFAHSSKHDGALSFLVLGDWGRRGAYNQSLVAFQMGKVGEKLDIDFVVSTGDNFYDNGLTSDHDNAFQESFTKIYTAKSLQNQWYSVLGNHDYRGDAEAQLSPVLREIDSRWLCLRSFIVDSELVEIFFVDTTPFVDEYFTEPPEHKYDWRGIGPQKSYISNLLKDLELALRGSTAKWRIVVGHHAIRSVGHHGDTQELINRLLPILQANNVHFYMNGHDHCLEHISDTESPIQFLTSGAGSKAWRGDIEGMNRRGVNFFYDGQGFMSVKLTQTDATIEFYDVFGNVLHRLTSSKQLHSSIYPTFLTVLNPHGFVHKNVMPWICKDGQMEVYISDNQYPLSLDPVVQARSAQVSRYAHKKVLIDQSIGETYKKKRETFVSLATKKTKK

SEQ ID NO: 199561 - protein, 171 aa, Glycine max
  Coding DNA Sequence Number=SeqID_82783
  Gene Ontology: Cellular component=nucleus; Biological process =regulation of progression through cell cycle
  Homolog annotation: Hit_ID=Q39878; Match level="QueryCoverage=99%, HitCoverage=36%, E-value=7e-66, Identity=76%"; Hit description =Mitotic cyclin a2-type
MDKVNRVCAKDEERPLRITRARARALRGITPYSRPSLKNEQKNVLRAHPKRAASSENKTSVVVPAVVQQKGRAVLSDVSNMCAKPHDKCTKSSKFQAKGVYTKKTTKLAALGVSTEVSSTQENVRAKLAEELSTIRMVESKDTIREGVTADTALSMQNSLKSDELQSSPNK

SEQ ID NO: 199562 - protein, 326 aa, Glycine max
  Coding DNA Sequence Number=SeqID_82784
  Gene Ontology: Mol. function=hydrolase activity; Cellular component =mitochondrial outer membrane; Biological process=aromatic compound metabolic process
  Homolog annotation: Hit_ID=O49147; Match level="QueryCoverage=88%, HitCoverage=94%, E-value=9e-97, Identity=61%"; Hit description =Lysophospholipase homolog
  Pfam annotation: Domain name=Abhydrolase_1; Domain location=103-320; Score=-2.8; E_value=0.013; Accession=PF00561.10; Description =alphabeta hydrolase fold
MKRSWDKDKKGNGGFHVDSAPSLPLPQRDYHALRLQDQEMEPLSLTTFSFQPLLVTPFLPTLGFLALLSLPSGDLFFLFMDLTSTVADILILQITSMLMASGFTGWIGLVSHGGSDGLHGYVHSLDDAVSDMKIFLEKVLNENPGLPCFCFGHSTGAAITLKALLDPKVESRIAGAVLTSPAVGVSPSHPILLVLAPIASFLLPTYQCSSAYKKGSPVSRDPEALIAKYSDPLVYTGPLRVRTGYEILKITSYLQQNLRKLRVPFFVLHGTADSVTDPVASQKLYVEASSTDKTMKLYDGFLHDLLFEPERDAITQDIIQWLNSRV

SEQ ID NO: 199563 - protein, 358 aa, Glycine max
  Coding DNA Sequence Number=SeqID_82785
  Gene Ontology: Mol. function=acid phosphatase activity; Cellular component=integral to membrane; Biological process=iron ion transport
  Homolog annotation: Hit_ID=Q9LL79; Match level="QueryCoverage=99%, HitCoverage=98%, E-value=1e-143, Identity=73%"; Hit description =Putative purple acid phosphatase
  Pfam annotation: Domain name=Metallophos; Domain location=37-277; Score=71.5; E_value=2.6e-18; Accession=PF00149.18; Description =Calcineurin-like phosphoesterase
MAGLGIWMGFVSLCLLSVSVSGLLQRLEHPVKADGSLSLMVIGDWGRKGTYNQSQVATQMGRVAAKLNIDFVISTGDNFYDDGLTGIDDPAFEISFSKIYTAKSLQKQWYSGESRHTNHGCNKLTLLGNHDYRGDVEAQLNPILQKIDPRWICQRSFIVDTGKVTSRNLNRGFILNKIAEFFFIDSTPFVDKYFLKPKDHKYDWRGVLPREKYLSKLLKDLEIALKDSTAKWKIVVGHHPVRSIGHHGDTKELIRQLLPILEENNVDMYINGHDHCLEHISSRSSQIQFLTSGGGSKAWKGDMDKDKKDGIKFYYDGQGFMSVELEETNAKVVYFDIYGKVLHVVNLPKGLGTSVSAI

SEQ ID NO: 199564 - protein, 67 aa, Glycine max
  Coding DNA Sequence Number=SeqID_82786
MLVLVLRAGHICHGPDSDARDVKVVIMNRVCLCLNALRALRGTTESATVINPSPSGTEKHAAFYSHL

SEQ ID NO: 199565 - protein, 73 aa, Glycine max
  Coding DNA Sequence Number=SeqID_82787
MAYKIDPWEKPMYITHPWAAIIEAGKQISLWSLTKTTNMSIIMDQAARTLYMTSPSLFSPPSEKLCYYVYQLG

SEQ ID NO: 199566 - protein, 134 aa, Glycine max
  Coding DNA Sequence Number=SeqID_82788
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9M4A9; Match level="QueryCoverage=76%, HitCoverage=22%, E-value=9e-25, Identity=51%"; Hit description=Beta -1,3 glucanase precursor
MEQTPLVASILNATLLVVAILALIQGAHGIGIGVNYGTVANNLPPPAMVAKFLSKSTTIKKVRLFDANPEILRAFGNTGIEVTITVPNDQIPDITNLTYAQQWVKTNVQPFIPATKLIRILVGNEVLSTANKLL

SEQ ID NO: 199567 - protein, 69 aa, Glycine max
  Coding DNA Sequence Number=SeqID_82789
  Homolog annotation: Hit_ID=Q6Z4S6; Match level="QueryCoverage=47%, HitCoverage=7%, E-value=7e-11, Identity=87%"; Hit description =Tetratricopeptide repeat-containing protein-like
MDQLPPEPCTKEHTHICSMCAHTQEQVHHNAPLCFDSNYISEHCVYRKMKVRNIKLATISKFTMHAFDG

SEQ ID NO: 199568 - protein, 241 aa, Glycine max
  Coding DNA Sequence Number=SeqID_82790
  Homolog annotation: Hit_ID=P29185; Match level="QueryCoverage=38%, HitCoverage=19%, E-value=2e-16, Identity=47%"; Hit description =Chaperonin CPN60-1, mitochondrial precursor
MAEKEMTPSWMTITKMESGLQFPPQFATASPTAILRPHLRSSEFIPATTDLQPSVNIARVRTIAHVVPAKQLKCSLCHVFTPSSVTLGAPKLCSITTLPSIKRINSTSTNFRSDHDFEGFDRRNGFDWYRESDRSLIHRSESFCGGGGSQRDQFLKGFQSERERSRRDGSVSSWRRGLKDLDDRERVVRSPKGLRDARSPSWSKDSVSESEQSKKRSSSSPRPSKDGNSIKSKSKSSRVLR

SEQ ID NO: 199569 - protein, 142 aa, Glycine max
  Coding DNA Sequence Number=SeqID_82791
MAYCFQNSHLVKMTVEELPKKLVTMKQKSMQAWPCLGANLRVKMDKYQYTMSSSRHRWKYPSRSCLGTNIRVPLKGKETLHFEQSSQPTAVLDLSHHIEANGTNSTLNAAIFVGLDYSPCVLWNKTRNRTTAPIMGIMEQGQ

SEQ ID NO: 199570 - protein, 372 aa, Glycine max
  Coding DNA Sequence Number=SeqID_82792
  Homolog annotation: Hit_ID=Q05045; Match level="QueryCoverage=30%, HitCoverage=18%, E-value=8e-34, Identity=69%"; Hit description =Chaperonin CPN60-1, mitochondrial precursor
MEQSFGAPKVTEDGVNTAESIEFKDKVKKVSFRLVVHVANAPNDVAQYQIAGFCGTTCAIVLTRAIFTEGCKSVVAGMNSLDLRCGLSMAVGDAVANLKSKARMISTSEEIAQGEMKMIMLMSMAIFLNLKKGTTQALGSAILEQVSSDPKIEEEILEAEEKLQFPDNEPAQEEADPLADVSKKEDGSQHGSNKDAPLRYAIVYGCSDATIVLGVPTDTLYGFACDAWCDEGEGALRWSVAANEMDEHEWMYEIMSERADMDYENAEACRANEPHVDCSDAFNTSQVFESREDVLRWARSVAHENGFVVVILRSDTNTGGRGRTTFVLIGCERSGVYRCRKKEFIRRDTGTRKCGCPFKLRCKPVVGGEGWM

SEQ ID NO: 199571 - protein, 92 aa, Glycine max
  Coding DNA Sequence Number=SeqID_82793
MGIYAKSALKGFIEMVRNRRGGSVLGLALGSELRVVRLEREIGEFVKKGRSGEEKFGVRLKKLEQQCEGSGIPEKFTYKVLIVLVLVTACVG

SEQ ID NO: 199572 - protein, 1033 aa, Glycine max
  Coding DNA Sequence Number=SeqID_82794
  Gene Ontology: Mol. function=protein kinase activity; Biological process=protein amino acid phosphorylation
  Homolog annotation: Hit_ID=Q9FMZ3; Match level="QueryCoverage=99%, HitCoverage=98%, E-value=5e-41, Identity=29%"; Hit description =Arabidopsis thaliana genomic DNA, chromosome 5, P1 clone:MJB21
MAKRSDFAQKLLDDLRLRKERMASSQTQRSNQSHHLPIDAYAYTKQTYRGSRHTKATEIVSSKTGEMLNSSSRSYRSVNNGQVSNQMVTYGKGQSSRQMGDMSLALAFAFENGGKLRRNDSIMGFLHQIKRGTLEFSMSERQLASTSNYPMQISEISKGAQKLNQILRACSNGLNMDSYSIQFAKELLQGAIDLEESLRMLVDLQNNSQFMITSQKKNRITLFVVVNDDDNDTGMEMQLAQPTFSFNKHTAENIQQFGKAIFMQRPITLTSSKEGRNSNNENKNVKRQVSQKRSTKSSSDIKNVNAISEGKNQTASNPEKGRIPNVIAKLMGLDILPDKVEKESKRAMLQKREGTSPKHAAKGSTKKTELKSKETDNLMPMKNQKVIEAFKVPATQGKEMIFGANKKLLVEKTSSEVAVRNGIIALKGFDKPSIKADKPTKSSPQKNLTRESQKDVQEIGRKQNHPNNNNREQKGTRKGRANDPIPNNQPEQVCERSQVNSLTQEDKEIDGNTVQCEKRHTNTHVMNNEKKPWNNVGVQKSYVLSKNGPHEEKHRREQKLQLKEEHMLMMRPQGGSEMASKNSPKSPHQLINPQKKQLSMNQVTLFKKSSGEKNVASMKSEGLLTNHHDLVRDEASNATNENVKESIHRKSGQISSPRDQEFELAKRNGIKTLMDEKHVNKLASKKIKNTRKQKVGMPGKIDQVLTGRNGAKLITKQGKQQIPTPDKFEVLNEAERERVSMLRETDAHIINSNEPVSVAVTEPLDMRHQPCKEAELPPTLSSSVGGELQSQQELVAIVPNDLYCQDVQSLQDEAVPVAADEGSVTGEVALHKTNGLDEERLCVNNSNLNISEKSIQQPLTESENCLKWILVMSQLFVNTAEALFKLNIPFNVLQGGGRENQDEGSKLILDCGYEVMKRKGIRQELKVHSYSRISMGSMNIISLDDLVRQLNEDMEKLKLYGRKKSCQADDVEDYQSKMLEHDVYDRDPDMNCMWDLGWNDETVAFIEKYDVIRDTEKHILSVLLDEITVDFCM

SEQ ID NO: 199573 - protein, 777 aa, Glycine max
  Coding DNA Sequence Number=SeqID_82795
  Gene Ontology: Mol. function=protein serine/threonine kinase activity; Cellular component=cytoplasm; Biological process=protein amino acid phosphorylation
  Homolog annotation: Hit_ID=Q9FX38; Match level="QueryCoverage=78%, HitCoverage=50%, E-value=1e-150, Identity=49%"; Hit description =Protein kinase, putative
MADSVDVILDFLRRNRFTRAEAALLTEINNLPDLNANPQGLELIVKEIECGNGNAHLQATSAPSILFSNTSEEDFLYSRNFNPSTVPVKPSVSQTNEAVDVIAANTNSKSWSVEENAVSMWPASSSKTSVVQSKQPMELDRQLKFNTPSLKVNFTDYPWSRTDDNMNSSSDSAKDCSVKTIFPFSKGDMSSSFGAVTYSDKKEEKKKVEISDTRTSSIKEQVGELGRPIYLVKTPGSSEQKIIGSLSFPLLPENQKEEFPSLPPVKLKSDDKPLVVNWEEKFERDGPTSKLPGADSTLLIGSYLDVPIGQEINPSGMRRATGGSWLSVSQGIAEDTSDLVSGFATVGDGLSESIDYPNEYWDSDEYDDDEDVGYMRQPIEDEAWFLAHEIDYPSDNEKGTGHGSVPDPQERGPAKDEDDDQSFAEEDSYFSGERYLQENNVVPVTTTDDPIGVTLTEYGRTNDNDLMAQYDGQLMDEEELNLMCAEPVWRGFVPQTNELIMLGDGRVLNDNLRSRLEDINMDDDQHGSVRSIGVGINSDAADIGSEVRESLVGGSSEGDLEYFHDRDAGLGGSRHSHHDLDKKSTNKSNKNKNNEKSESNKYVIGCDKDAPLQMKTHGDGNFSFPLSLKDGQMIQASTNKSLWSNNGNADDADDCLSAIVETDDMLALWRRKSSDSSPVKSSRDENNANFVRSTNSSPTTVSNYGYSEREHVKVEEDEKTGIAREDDLGASLEDEEVAAVQEQVRQIKAQEEEFETFNLKIVHRKNRHVFNVFVCVC

SEQ ID NO: 199574 - protein, 169 aa, Glycine max
  Coding DNA Sequence Number=SeqID_82796
MSDHSSRVAVIVWELINEYRNMKSSMLGAWGSGLPRVGLGYGGGGVHCLGRRKSSDTPDAWSWVGGDFSVRAVYELLLSRCESSGDPSGLGRRPMRSALLRRVVVLDDVGCVFCEHDWEDVDHLFPGMVLCAGENDLARFVILSGMLLVGAFGSIGIASSFRRNKQMYS

SEQ ID NO: 199575 - protein, 713 aa, Glycine max
  Coding DNA Sequence Number=SeqID_82797
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=99%, HitCoverage=98%, E-value=0.0, Identity=76%"; Hit description =Homeodomain protein HOX3
  Pfam annotation: Domain name=Homeobox; Domain location=21-77; Score =83.4; E_value=7.1e-22; Accession=PF00046.19; Description=Homeobox domain
  Pfam annotation: Domain name=START; Domain location=223-448; Score =196.5; E_value=6.2e-56; Accession=PF01852.10; Description=START domain
  Pfam module annotation: Pfam domain module=Homeobox::START; Domain location=21-77::223-448
MEYGGSQSPGEQDGSDSQERRKRYHRHTANQIQRLESMFKECPHPDEKQRLQLSRELGLAPRQIKFWFQNRRTQMKAQHERADNCALRADNDKIRCENIAIREALKNVICPSCGGPPLNDDSYFNDHKLRLENAHLKEELDRVSSIAAKYIGRPISQLPPVQPIHISSLDLSMASFGNQGMVGPAPAPSLNLDLLPAGTSSSMPNLPYQPPCLSDMDKSLMSDIASNAMEEFLRLVQTNEPLWLKSNVDRRDVLSSDAYDRMFSKPNTRSKNPNVRIEASRDSGVVLLNSLALVDMFMDPNKWIQLFPTIVSVARTIQVISSGVMGSCSGSLQLMYQELQVLSPLVSTREFYFLRYCQQIEQGTWAVMDVSYDFPQDSHFAPQFRSHRCPSGCLIQDMPDGHSKITWIEHVEIEDKTLPHRLYRNLIYSGMAFGAERWLTTLQRMCERFTYLMATSNPTRDNLGGVISSPEGKRSMMKLAQRMVTDFCASISTSSGHRWTTLSGLNEIVVRVTVHKSSDPGQPNGVVLSAATTIWLPTPPHTVFNFFKDENKRPQWDVLSNGNAVQEVANIANGLHPGNCISVLRAFNNSQNMLILQESCIDSYGSLVVYCPVDLPSINTAVSGEDPSYIPLLPNGFTILPDGQPDQEGDGASTSSNTNRNIARSGGSLVTIAFQILVSSLPSAKVNMESVTTVNNLIGSTVQQIKSSLSCPT

SEQ ID NO: 199576 - protein, 66 aa, Glycine max
  Coding DNA Sequence Number=SeqID_82798
  Subcellular localization annotation: CTP_CleavageSite=40; ConfidenceScore=5.16e-01
MCSLRTPQARPASRLSLPALSAPSSLSQNSLTLAYWQKLREESKNREKGEARAIEMKPPRESRLEE

SEQ ID NO: 199577 - protein, 554 aa, Glycine max
  Coding DNA Sequence Number=SeqID_82799
  Homolog annotation: Hit_ID=Q10A88; Match level="QueryCoverage=27%, HitCoverage=32%, E-value=1e-36, Identity=55%"; Hit description =Rhodanese-like domain containing protein, expressed
  Subcellular localization annotation: CTP_CleavageSite=93; ConfidenceScore=5.65e-01
MRWCSQVFSVSGSGAHAHALALAPIVTASFSNTSLVLQFQKPLFKFSNSSSLALTHRKLLPSALPLTQPSSSREDFDFVVVNFYHFVFIQDPQAEVDKHRSFLQLEGLDINGRLYLNEQGINAQYSGPSKDAMTYVNWLRKDNRFSDILVQISPSEKGHTFPTLKLRYKPSLVQFEGGMSHLSLLDPSMRAIPLSPSEWRDRLESINKTDLTAKDNSNRNYILLDVRNALTNRLPWPPSIQHSVAVRIDGDIHRVHIVEENWSAEMSCVRHPWSSWGSSEEIISDNGDTGTPRSWMSDISPRPVAGKHDGDCIIRQSVSLPSGCSVDDDPMGKDCVSRAHCPSHVSRRTGGAKVKETEPVEGYLKVAEKRKELPAHQWVASENCLEDVTADPTYGQKVDNIYGHNGPHKLEVKHSRDLNVKCIGPESNVGLTSHTTPQDHDCEYDNYNEQQAEAASALQVYSRKRWCKKEAHDSGKTALSEEITSSDGQQQLTPPTRDEGTANLLEEATAQWELTKELGMTCGTAQKTIIEQISAMEIKDKKEAESLGNRSDHQ

SEQ ID NO: 199578 - protein, 301 aa, Glycine max
  Coding DNA Sequence Number=SeqID_82800
MRSKDNICRGTKRKSVEKGGRIVFIIATGVAVSLGLGTLSNCYPVPVKELLLFSTTRTRIHNRSRKKLFGIGQKTFCVEAANANYEFDPDLRSVIELATDSELYEIEAILFGPSYSSPLLKSIPLALFRNTNENGGLDRSMIGVDLRLRQQFIAALESRFFFLAADARSTLRGWRPSYRNILLQIRTKLNIPCSTQLEQESGNYPALFDVVRTSSQGQATLQHELSQWKVQSKVGAQDIPSIVLKGGGVFTLSKIYQLLARKLSGKALVEAANCQGGQLAMINLESTAALLAAKQECILLV

SEQ ID NO: 199579 - protein, 397 aa, Glycine max
  Coding DNA Sequence Number=SeqID_82801
  Gene Ontology: Mol. function=protein serine/threonine kinase activity; Cellular component=cytoplasm; Biological process=protein amino acid phosphorylation
  Homolog annotation: Hit_ID=Q9LSH3; Match level="QueryCoverage=91%, HitCoverage=26%, E-value=1e-177, Identity=84%"; Hit description=Ser -Thr protein kinase-like protein
  Pfam annotation: Domain name=Pkinase; Domain location=55-388; Score =199.1; E_value=1e-56; Accession=PF00069.15; Description=Protein kinase domain
  Pfam annotation: Domain name=Pkinase_Tyr; Domain location=55-388; Score=-85.6; E_value=3.2e-07; Accession=PF07714.7; Description =Protein tyrosine kinase
  Pfam module annotation: Pfam domain module=Pkinase::Pkinase_Tyr; Domain location=55-388::55-388
MDPKSILRLMRTLGPFLASLAQSSWSLLSNALGRTGFEEDKNFHVVLNSVIAGRYHVTEYLGSAAFSKAIQAHDLHTGMDVCVKIIKNNKDFFDQSLDEIKLLKYVNKHDPADKYHILRLYDYFYYRSMGVLPPKGRGDGNLVEISFKLWSSNFAVYLEHLLIVCELLKANLYEFHKFNRESGGEVYFTMPRLQSITIQCLEALQFLHSLGLIHCDLKPENILVKSYSRCEVKVIDLGSSCFETDHLCSYVQSRSYRAPEVILGLPYDKKIDIWSLGCILAELCTGNVLFQNDSPATLLARVIGIIDPIDQSMLAKGRDTYKYFTKNHMLYERNQETNRLEYLVPKKTSLRHRLPMGDQGFIDFVAHLLEVNPKKRPSASEALKHPWLSYPYEPISS

SEQ ID NO: 199580 - protein, 40 aa, Glycine max
  Coding DNA Sequence Number=SeqID_82802
MPDLPFQVGDLAESRCFEKVVIVVHGLDARISRSLKGFGV

SEQ ID NO: 199581 - protein, 63 aa, Glycine max
  Coding DNA Sequence Number=SeqID_82803
  Gene Ontology: Mol. function=nucleotide binding; Cellular component =cortical microtubule, transverse to long axis; Biological process =translation
  Homolog annotation: Hit_ID=Q9FEV9; Match level="QueryCoverage=92%, HitCoverage=10%, E-value=2e-17, Identity=62%"; Hit description =Microtubule-associated protein MAP65-1a
MKLSRKEVTDRIDKWFAACEEENWLDKYNQDDNRYSAGQCTHINLKRAEHARITIGKIPSLLS

SEQ ID NO: 199582 - protein, 251 aa, Glycine max
  Coding DNA Sequence Number=SeqID_82804
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=54%, HitCoverage=18%, E-value=1e-73, Identity=97%"; Hit description =Photosystem I P700 chlorophyll a apoprotein A1
MQSDVWGSISDQGIVNHITGGNFAQSSITINGWLRDFLWAQASQVIQSYGSSLSAYGLFFLGAHFVWAFSLMFLFSGRGYWQELIESIVWAHNKLKVAPATQPRALSIVQGRAVGVTHYLLGGIATTWAFFLARIIADPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQ

SEQ ID NO: 199583 - protein, 91 aa, Glycine max
  Coding DNA Sequence Number=SeqID_82805
MTHQDFQVYAIIVNHSYNAKMNEFDILVSLILSQTHLCLFNFHRNVSVSHWFVCSKRPALLSVNFQDRQSEIARPARWWGCRKTTSKVQNK

SEQ ID NO: 199584 - protein, 184 aa, Glycine max
  Coding DNA Sequence Number=SeqID_82806
  Gene Ontology: Mol. function=transferase activity, transferring glycosyl groups; Cellular component=periplasmic space; Biological process=carbohydrate biosynthetic process
  Homolog annotation: Hit_ID=UPI00005F764B; Match level="QueryCoverage =82%, HitCoverage=32%, E-value=1e-62, Identity=68%"; Hit description =COG3131: Periplasmic glucans biosynthesis protein
MERLQCLSVIRRLRVERLRPLGGQRQRRKIILGGLSRLIHWQTHRQAPAFGHWVIADVVFYHFTVVADADVRGDQSIGVQPFQHRADEVDQEGHAAVWLANQVGLLHVTGRTHGAGHIGDVLRMQFVFIAVERIRRPERADVVVGFIRRRDLHQLNLAFAPVALRFNPGARAQIVTIVQIFIFP

SEQ ID NO: 199585 - protein, 518 aa, Glycine max
  Coding DNA Sequence Number=SeqID_82807
  Homolog annotation: Hit_ID=Q10B16; Match level="QueryCoverage=15%, HitCoverage=14%, E-value=5e-28, Identity=69%"; Hit description =Expressed protein
  Pfam annotation: Domain name=X8; Domain location=406-487; Score =145.6; E_value=1.3e-40; Accession=PF07983.3; Description=X8 domain
  Subcellular localization annotation: CTP_CleavageSite=46; ConfidenceScore=5.10e-01
MAKEASLCLLFLLSSLTISCSGSVEGFSYRERGHTSTSARTISFLQQSNVPPSQIRIFVTDHRILSTLSYSKVPTDVYLNKSQVENFITSKPSELKAHLLNILQNSNIKSIIASCGSEGLAQNEMPLFLHALISISSVLRELHLGREVKVSVAFPLSFLEKLNASHENNIRRILSVIKEMKSFVMVEDYIDGEFSIGDHFVHAIIKRATLAASILPCKDVPIVLAIKSTVIFPSMELAQFSERVSKYLESKTHIRKRIAALYIEVHRTEDFASKKLKRRSLDDTTNPTNTVFPTNPASSTPIITPPDTPTIITVPATNPVTISPSNPAAMPVTVPSTTPVPIPPTNPANSPVPVSNPATTTPVATPPPVTIPVTSYPPPSGNVPVVNPQPQPPPANTNAPAIQGQSWCVAKQGAPEASLQSALDYACGMGGADCSQIQQGGNCYSPVTLQSHASVAFNSYYQKNPAPTSCDFGGTATLVNTNPRSISKSLITTYFDISYGINTYARIVALKDNFLQFI

SEQ ID NO: 199586 - protein, 122 aa, Glycine max
  Coding DNA Sequence Number=SeqID_82808
THDTIRIVNPTKGLKLTEREAEVVFTTGGLSEAKPGIIPDAGLLEFNTEGPVPEDEDVGGAVGIDGAGVNGLGGGSVVGLDCVGGVGGDDDFGVVVVVDDDDGKMHEPVPIHNSEQPVKNGH

SEQ ID NO: 199587 - protein, 93 aa, Glycine max
  Coding DNA Sequence Number=SeqID_82809
MDPSNGNLDVLIGERGFFICTSGGQDGYGVGVRVTSLSNELEPWEDAFASFDQQLLLALPWDYQRALIPCFTQIPQVLSLGGLLRDLPLTSPD

SEQ ID NO: 199588 - protein, 72 aa, Glycine max
  Coding DNA Sequence Number=SeqID_82810
MSKKTVGLKVKEVMENIIADPEWGWWWEIWGWWNIRVSRWWQKCLRNGCLWWRVKAKCLLLGGGWKNGWNTY

SEQ ID NO: 199589 - protein, 192 aa, Glycine max
  Coding DNA Sequence Number=SeqID_82811
MVNTIKIEKFIGKNSFRLWCIKMQSLLKERGIWAPPSSQSSKIDKSMLELQEEKEGIPMKEHLDEINYILMELRALLTGKDSITLEEVIVEEKKDKGTKTSKDYPKDIHNFYKELGCIFELQSGPSMVIFNHGYAAEDKGEGELHHQESVLDKKLREEASMEEKNERERGHEIEGDKRGREETKEEEKWNFE

SEQ ID NO: 199590 - protein, 278 aa, Glycine max
  Coding DNA Sequence Number=SeqID_82812
  Gene Ontology: Mol. function=methyltransferase activity; Cellular component=cytoplasm; Biological process=metabolic process
  Homolog annotation: Hit_ID=Q1RXR5; Match level="QueryCoverage=81%, HitCoverage=28%, E-value=1e-26, Identity=69%"; Hit description=SAM (And some other nucleotide) binding motif
MQQPEKQINAPAGMPLPERRRRRRSSGICATSGVRVQPQEEQQQVATRGTVLTDSDQFYFNWYAHIDVHEEMIKDRVRTDAYKNAIMRHKDFIRDKVVLDVGCGTGILAIFCAQAGARRTIRVVEANNLLNIITVLHGRVEPACDPGAIKVMGQHLPLPNWAGWCSIAASRAITFICIGIPSPLRKALVVSFVHSENLGLLRSYIEYRYGQNRAYKGLGQSSPHLLAFGDVEIGEKVDVIISEWMGYMLLCESMLGSVITARDRWLKPGGLVLPSKAT

SEQ ID NO: 199591 - protein, 61 aa, Glycine max
  Coding DNA Sequence Number=SeqID_82813
  Subcellular localization annotation: CTP_CleavageSite=2; ConfidenceScore=5.01e-01
MVAMAPPFNSNVYPLKPAKPKKQPPRPSLSTPFGFNEDDENDIEREIALQASKNKRLKEVC

SEQ ID NO: 199592 - protein, 504 aa, Glycine max
  Coding DNA Sequence Number=SeqID_82814
  Gene Ontology: Mol. function=malate transporter activity; Biological process=response to aluminum ion
  Homolog annotation: Hit_ID=Q9LS22; Match level="QueryCoverage=96%, HitCoverage=91%, E-value=1e-123, Identity=51%"; Hit description =Arabidopsis thaliana genomic DNA, chromosome 5, BAC clone:F10E10
  Pfam annotation: Domain name=UPF0005; Domain location=4-469; Score =368.5; E_value=1.1e-107; Accession=PF01027.11; Description =Uncharacterised protein family UPF0005
MEGWQRGSKKGGSFYESWYGFGKNAMWAVMTVVVVMEFTVGATLCKGLNRGLGTLLAGSLAFLIKYFADAPGRIFQAVYIGVSVFMIGALTTYVRFIPSIKKNYDYGVLIFLLTFNLITVSSYRVNDVWDFAKDRISTIAIGCGLCLLMSILVFPNWSGEELHNNTISRLEGLANSIQVCITGYFYDSAKQATEGDSSENPIYEGYKAVLDSKVKDETLASQASWEPRFSRYCHRTPWHQYTRVGAALRQFSYTVVALHGCLQSEIQNTVRNIITFEKPLRNSVTFMMQAGSCISKLAITPKSISTLYKDSCIRLGEEVSKVLRELANSIRNKRQFSPQTLSRNLKDALQDLHSALKSQPQLVLGSRNGRTQTPKTAVQAVPHPHPDQKLEEDTKFSFSSVRNGSRGSGCQSVEHSRELTRKVLRPQMSMSAIISLEFSEALPFAAFTSLLVEMVAKLDYVMDEVDELGIIAHFEEFQGDEIVVTCEKPNINKPQNDLPSYGAE

SEQ ID NO: 199593 - protein, 519 aa, Glycine max
  Coding DNA Sequence Number=SeqID_82815
  Gene Ontology: Mol. function=malate transporter activity; Biological process=response to aluminum ion
  Homolog annotation: Hit_ID=Q9LS22; Match level="QueryCoverage=90%, HitCoverage=92%, E-value=1e-148, Identity=56%"; Hit description =Arabidopsis thaliana genomic DNA, chromosome 5, BAC clone:F10E10
  Pfam annotation: Domain name=UPF0005; Domain location=36-481; Score =530.5; E_value=1.8e-156; Accession=PF01027.11; Description =Uncharacterised protein family UPF0005
MAETNTSIKSSRQLRCVYSFADKVKSFPGLARRATWKVGKEDPRRVVHALKVGMALTLVSLLYLMEPLFKGIGKNAMWAVMTVVVVMEFTVGATLSKGLNRGLGTLLAGSLAFLIEYVADAPGRIFRAVFIGVAVFMLGAMTTYVRFIPYIKKNYDYGVLIFLLTFNLITVSSYRIDNVWNIAKDRMSTIAIGCGLCLVMSILVFPNWSGEDLHNNTITKLEGLANSIQVCVMEYFYDSAKQATEDDSSEDPIYEGYKAVLDSKANDETLALQASWEPRCSRYCHRIPWHQYARVGAALRQFSYTVVALHGCLQSEIQTPKSIRAVYKDSCIRLGEEVSKVLRELANSIRNKRQFSPQTLSNNLNEALQDLDNALKSQPQLVLGSRNGRTPNTPVQKLEEDTASARTPLSSVKNDYFSPRGCKSKEHSLEQPKKVLRPQLSKSAIISLEFSEALPFAAFTSLLLEMVAKLDRVMDEVEELGRMAHFREFKDDDDDEIVVTCEKPKMIIAQNGMPSYGAE

SEQ ID NO: 199594 - protein, 70 aa, Glycine max
  Coding DNA Sequence Number=SeqID_82816
MVRDRFGEATAVKDDECAVSTVLLWCVASMRSMNLDSLEKSRKRVEFGFQVVVVEGLGLPFSEEGSTWMK

SEQ ID NO: 199595 - protein, 385 aa, Glycine max
  Coding DNA Sequence Number=SeqID_82817
  Gene Ontology: Mol. function=malate transporter activity; Biological process=response to aluminum ion
  Homolog annotation: Hit_ID=Q9LS22; Match level="QueryCoverage=94%, HitCoverage=72%, E-value=1e-103, Identity=51%"; Hit description =Arabidopsis thaliana genomic DNA, chromosome 5, BAC clone:F10E10
  Pfam annotation: Domain name=UPF0005; Domain location=1-351; Score =260.7; E_value=2.9e-75; Accession=PF01027.11; Description =Uncharacterised protein family UPF0005
MLLLSHYFWLAGATTTYVRFIPHIKKNYDYGVMIFLLTFNLITVSSYRVDNVWEIAKDRIATIAIGGGLCLVMSLLVFPNWSGEDLHNSTISKLEGLANSIEACVVRYFHDSENQETQDDSTEDLIYKGYKAVLDSRAKDETLALQASWEPRWSRYWHRIPWWQYTKVGTTLRQFSYTVVALHGCLLSEIQTPGSIRALYKDSCIKLAEEVSKALRELANSIRNKRQFSLQLLSDNLNEALQNLHNDLKSQPQLFLGSKKFGGTTHPEEDTRVSFSSVRSDCSSMFEYKSKEHSGEMSMEGHKKVLKPLMSKIAMTSLEFSEALPFAAFTSMLVEMVAKLDHIIDAVEELAKLSRFREFRDGDEIVVTCERPKVANNDLPSHALD

SEQ ID NO: 199596 - protein, 190 aa, Glycine max
  Coding DNA Sequence Number=SeqID_82818
MTETSMRAGNIDVYGFLEPQSIQRSGQSQFESENYIKNWMQNSKRDVYLGAYLNGAHWQMVVILPKENVVIWFCSLHNKPDNYLKGIINRSVLFFNIFALALVSALKGLDDTQQSKSKTPARWIVVKCNRQKGSTECGYYVMHWMSTIILENFKNNWEMYFIDARPLEPERLKALRIQWAKYYLKVKNET

SEQ ID NO: 199597 - protein, 75 aa, Glycine max
  Coding DNA Sequence Number=SeqID_82819
MSKLREIQFALEKDVSHIGPWNGGFNPFSFSQTFGNPNRATKGRALESTRNIKIDNKELLSDYIEIWDELFTIGD

SEQ ID NO: 199598 - protein, 92 aa, Glycine max
  Coding DNA Sequence Number=SeqID_82820
MVKREKFDHIEERLRVIEGGVNYAFADIAELCLVPDEVIPSKFKVPNFDKYKGTTCPKNHMKINCRKMGAYAKNEKLLMHFFQESLTGAAVT

SEQ ID NO: 199599 - protein, 83 aa, Glycine max
  Coding DNA Sequence Number=SeqID_82821
MQGSGNNQEDWIEIKENTGNSQASLCYSLQAPRLCFLSWEMKDWCTMYPYVAITPNYHQHDFVKMRLSHEVLKVIVELSSSVG

SEQ ID NO: 199600 - protein, 223 aa, Glycine max
  Coding DNA Sequence Number=SeqID_82822
  Homolog annotation: Hit_ID=Q9FNN0; Match level="QueryCoverage=45%, HitCoverage=25%, E-value=2e-33, Identity=65%"; Hit description =Arabidopsis thaliana genomic DNA, chromosome 5, P1 clone:MAH20
  Pfam annotation: Domain name=efhand; Domain location=141-169; Score =18.3; E_value=0.027; Accession=PF00036.22; Description=EF hand
  Pfam annotation: Domain name=efhand; Domain location=91-119; Score =6.1; E_value=3.1; Accession=PF00036.22; Description=EF hand
  Pfam module annotation: Pfam domain module=efhand::efhand; Domain location=141-169::91-119
MGAKLHLGQKLAGLDHVWDKNQDLFPTFSVLMLCQHCKLEKGAKQDSNSKDHKSKKRTGWHKSKKPVSGRHDCSDKFARLKRVTDGGDPGKKVVVGRERDTDRDGKVNFKEFFHGLFDLVRNYDEESHNDTHNSDNSMDAPARVLFAQLDKDGDGYLSDVELQPIIGKLHPSEHYYAKQQADYIISQPQRSFKRPVTQYPIPHSILARFSVPLSSPSIPPFPL

SEQ ID NO: 199601 - protein, 145 aa, Glycine max
  Coding DNA Sequence Number=SeqID_82823
  Homolog annotation: Hit_ID=Q9LS22; Match level="QueryCoverage=79%, HitCoverage=20%, E-value=5e-17, Identity=43%"; Hit description =Arabidopsis thaliana genomic DNA, chromosome 5, BAC clone:F10E10
  Pfam annotation: Domain name=UPF0005; Domain location=43-145; Score= -48.2; E_value=0.0023; Accession=PF01027.11; Description =Uncharacterised protein family UPF0005
MAETNYFASNRSSMITRHWIWKYMSSVGEKVKRYSGLAWRTAVKVGKEDPRRVIHSLKVGLALILVSLLYLIKPLFKGIGQNAMSAVLTVVVVMEFTVGATLGKGLNRGLGTLLAGSLAFLVEYIADIVGRVFQAVFIGAAVFIL

SEQ ID NO: 199602 - protein, 223 aa, Glycine max
  Coding DNA Sequence Number=SeqID_82824
  Homolog annotation: Hit_ID=Q9FMW6; Match level="QueryCoverage=34%, HitCoverage=26%, E-value=3e-10, Identity=55%"; Hit description =Similarity to ABA-repsonsive protein
MVLNTVLVTALCHGKRRHNQMLDSACGGWLAEVIGVAWNPGQCGSWLAEVPHGIKKEFGSPMDCMELWTQDLFPYIYYFPGILFLKIYKLILENLTGERSMKVFSQKGHMLRIHYKVATPLKKIKFVNQSKNVQKPTQKYIEIVTENLLISGLWKWFISVELKHLVASTMWTKGFEYKSSSLKVSVHGLAYVRASWSMKGDYGGRKVQRKDKLKGTKLLVAQL

SEQ ID NO: 199603 - protein, 245 aa, Glycine max
  Coding DNA Sequence Number=SeqID_82825
  Gene Ontology: Mol. function=calcium ion binding
  Homolog annotation: Hit_ID=Q9FNN0; Match level="QueryCoverage=98%, HitCoverage=63%, E-value=1e-64, Identity=50%"; Hit description =Arabidopsis thaliana genomic DNA, chromosome 5, P1 clone:MAH20
MKLGIFAVSRVQKARRQQTNKNKENRQQRVKGVINSPTQLSCNLVAIKNKERDLKRDVRACILNPTGRIVLGEGNEAIVVLIVKLHLPLRAMQDLALGLLEVPLNQLVLRNEPIGGVHVDLREQEYEPVGNIKLVLVIEVILGVHEVLPLGLGLVGRGRVRLQFGQGLVDYLLLPLLVFAVPLEFGDERVEGDGVVARGGEGEVGAQLEAAVAVAGVLIRGMGEEYEKRRCDEYVNENRRFGHRC

SEQ ID NO: 199604 - protein, 224 aa, Glycine max
  Coding DNA Sequence Number=SeqID_82826
  Gene Ontology: Mol. function=calcium ion binding
  Homolog annotation: Hit_ID=Q9FNN0; Match level="QueryCoverage=99%, HitCoverage=65%, E-value=2e-81, Identity=60%"; Hit description =Arabidopsis thaliana genomic DNA, chromosome 5, P1 clone:MAH20
MAKASIFIYILVAAALLIFLSHSPDKHSGHRHRRLKLRSNFTLAPSRHHAVAFDPLVAELERHREDKEWEKKIIHQALPELESDPAPAHESQPEWEDFMDAEDYLNDEDKFNVTNRLILLFPKIDVDPTDWFVTEHELIQWNLQQAQREVLHRTQREMELHDKNHDGFVSFSEYDPPNNESFGYDMGWWKEEHFNASDADGDAFCTLLTAKIPSFINGCARRKS

SEQ ID NO: 199605 - protein, 200 aa, Glycine max
  Coding DNA Sequence Number=SeqID_82827
  Gene Ontology: Mol. function=DNA binding; Cellular component =mitochondrion; Biological process=DNA integration
  Homolog annotation: Hit_ID=Q1SFD6; Match level="QueryCoverage=48%, HitCoverage=6%, E-value=4e-27, Identity=60%"; Hit description =Integrase, catalytic region
MSHSKRIGKSDLIEGLYVLASPSVLDSEANTNICNSVSIHASIFKHYPSVPHFKDVHPTVDDFVISLGTTAQSAEAQSNPILLPTTSSTVVFESMPPQQLLRSPSPKWRQAMTEEIKALKVNNTWSLVLLPTNKHCIDSRWVYKLKYKPDGTMDKYKARLVAKGYTQQAGIDFLDTFSPVAKLTSVRVLLAKATTRNWCL

SEQ ID NO: 199606 - protein, 185 aa, Glycine max
  Coding DNA Sequence Number=SeqID_82828
  Gene Ontology: Mol. function=ribonuclease H activity
  Homolog annotation: Hit_ID=Q9FMW4; Match level="QueryCoverage=78%, HitCoverage=78%, E-value=2e-33, Identity=47%"; Hit description =Similarity to ABA-responsive protein
  Pfam annotation: Domain name=GRAM; Domain location=76-154; Score =39.3; E_value=1.3e-08; Accession=PF02893.10; Description=GRAM domain
  Subcellular localization annotation: CTP_CleavageSite=70; ConfidenceScore=5.29e-01
MQTSLLHELVVGTPVISATFDQPQKSVNRYLPGPATQCQYSTTTSKQMRLRTNISETVKRKLSLGARILRVGGVEKVFKQFFNVEEGERLLKVSQSYLSTTSGPLAGFLFISTDKVAFCSERSMKVFTRKGHMLRIRYKVVIPLNKIKCVNQSQNVQKPTQKKLSNILSRHFLKLSWVEKSTVQT

SEQ ID NO: 199607 - protein, 280 aa, Glycine max
  Coding DNA Sequence Number=SeqID_82829
  Gene Ontology: Mol. function=nucleic acid binding; Cellular component= chromatin; Biological process=DNA integration
  Homolog annotation: Hit_ID=Q1S4N1; Match level="QueryCoverage=81%, HitCoverage=21%, E-value=6e-65, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=110-257; Score= -4.6; E_value=0.015; Accession=PF00665.16; Description=Integrase core domain
MAKAIATNLKLLQTTKIKTTTLKYIHLALTINKLITHKKGVGGSQIQNLLSVPQLLKKGYKVLFEDKNCMIKDSESREVFNIQMKGMSFALDFMNKEQAAMHKEVSSTVLWHKRLGHFHHGALMFMKKNNLAKNLLELEEELPTCAICQYGKQTILHFPQTMTWRATERLQLIHTDVEGPMRTPSLNGIADIFWKFKAWVETTERKNRTIMEMARCLLHEKELPKRFWAEAANIAVFMLNRLPTKALQKKTPFEAWYGYKPELLNLKIFGCLCFFLHSSG

SEQ ID NO: 199608 - protein, 165 aa, Glycine max
  Coding DNA Sequence Number=SeqID_82830
  Gene Ontology: Mol. function=nucleic acid binding; Cellular component= endoplasmic reticulum membrane; Biological process=DNA integration
  Homolog annotation: Hit_ID=Q1S6N9; Match level="QueryCoverage=99%, HitCoverage=13%, E-value=1e-59, Identity=59%"; Hit description =Integrase, catalytic region; Zinc finger, CCHC-type; Peptidase aspartic, catalytic
MYVVSLLSRYMHCASEIHFQAAKRILRYVKGTIDYGIRFSQVKSFNLLGYSDSDWAGCADDMRNTSGYCFTLSSGMFSWCSKKQEVIVQSTSKAEYIVVLAGVNQALWIKKLMIDLHTKPTKSTQIFVDNQVAISMANDPVFHGRTKHLKIKFFFLREVQKDGEV

SEQ ID NO: 199609 - protein, 131 aa, Glycine max
  Coding DNA Sequence Number=SeqID_82831
MERRTSLRQSCGRPPTSTRNYVFTVDVTDGIISKPTALVRPYAYHQLLPTEAVDFVDASRPCMTMQHSSGVGDIWTISMHNQYVDEPWNRFLTDNDLMGGDEVVFYYRPNEHVWEIIFRKKPIWDEHEDFT

SEQ ID NO: 199610 - protein, 317 aa, Glycine max
  Coding DNA Sequence Number=SeqID_82832
  Gene Ontology: Mol. function=metal ion binding; Biological process =ubiquitin cycle
  Homolog annotation: Hit_ID=Q9SPL2; Match level="QueryCoverage=87%, HitCoverage=89%, E-value=4e-45, Identity=40%"; Hit description=E3 ubiquitin-protein ligase CIP8
MSEAPPPPTADASPPPYWCYHCEKRVSVETLANLPDVVCGECKNGFVESMPTPSRSRSPSASSDDPYFGSQFLQVLRLIAQSARDDDASPPPPPSRSPENDFLRIELGGWDNDEENENDDDNGDEEFEEHEEAEDRSGNEDPHGGDDEDLRRRRRELLRLRIRDLATRTRSMRNRILDWAEILMGLEDNSIEFRLQLPESDRYVGNPEDYVDAAEYEALLQTLAESDGGGRRGAPPASKAALEALPTVKIASESEAVACAICKDLLGVGDAAKRLPCGHRFELPTDDKEYEEERVVIAASSNSNGASSSGGGGSAIV

SEQ ID NO: 199611 - protein, 117 aa, Glycine max
  Coding DNA Sequence Number=SeqID_82833
MKQQICKQYCRTAKVLEPTNTHARIHFKAGETKVKTQSTISRQNKMQKIKTEATNKQHIIHRENIIKQQMRHRVIIDPVWRSSKPCECDQQEPVMRKKMKWLRPEVGHTMHMERGKC

SEQ ID NO: 199612 - protein, 163 aa, Glycine max
  Coding DNA Sequence Number=SeqID_82834
  Gene Ontology: Mol. function=protein binding
  Homolog annotation: Hit_ID=Q09HM7; Match level="QueryCoverage=50%, HitCoverage=20%, E-value=6e-20, Identity=58%"; Hit description =Putative F-box and leucine-rich repeat protein
MDMQLARNSGVRVSSNSMEGDAVSGSRVCINDVLTDDSLRLIVGRVESRRKPRRSPHVRVEEWLIGLVRLLSSGDGTILSLAKYCANLETLLISGCWLVSDDAVKSLATACGSSLKVLGLDSYGNISDSTVSCILRQCRNLEALNIAGCTKLIDAGCSSSYKQ

SEQ ID NO: 199613 - protein, 154 aa, Glycine max
  Coding DNA Sequence Number=SeqID_82835
MDDTIAHIQELEDAKKIEMKVAQATIHEVVVDEVMEKFAHHKESQADVLKATLDDYHLPKEFNNTQLVVSIIQTPFVDARTTSPSYDKYFTKGPNGTIKANNLQPSDWTTSTNESSFHSPTPKHFGTYSTCFEPCYAIPSTITSTTTTTTTTTT

SEQ ID NO: 199614 - protein, 145 aa, Glycine max
  Coding DNA Sequence Number=SeqID_82836
  Gene Ontology: Mol. function=protein serine/threonine kinase activity; Cellular component=membrane; Biological process=protein amino acid phosphorylation
  Homolog annotation: Hit_ID=Q49N13; Match level="QueryCoverage=71%, HitCoverage=20%, E-value=8e-26, Identity=54%"; Hit description =Putative receptor-like protein kinase 3
MGADLKAELSGKTFVFGLKVWQIIGIAVGLFIVVILCVLPFCLTSRKKTRRARNRIPASHIPPVSKEITEVRVEQVPANGFVPREGILLTIHDKSSDKESDKVMLHLGVGKKKHGDSGSHHSDSFHYLDGGGSQSGEEISSGMVG

SEQ ID NO: 199615 - protein, 34 aa, Glycine max
  Coding DNA Sequence Number=SeqID_82837
METPAGNSKAEASVEGLYLGVGTSNLPVCLYGLR

SEQ ID NO: 199616 - protein, 69 aa, Glycine max
  Coding DNA Sequence Number=SeqID_82838
  Subcellular localization annotation: CTP_CleavageSite=18; ConfidenceScore=5.09e-01
FAAAHGRTGVNQNVFATRRMKHAGRGRRTMLSVTNSVESVSFCICIHCNHEHIHGGGGGGGVKEDESIN

SEQ ID NO: 199617 - protein, 539 aa, Glycine max
  Coding DNA Sequence Number=SeqID_82839
  Gene Ontology: Mol. function=catalytic activity; Cellular component =intracellular; Biological process=metabolic process
  Homolog annotation: Hit_ID=Q9LIC3; Match level="QueryCoverage=92%, HitCoverage=84%, E-value=0.0, Identity=60%"; Hit description =Selenium-binding protein-like
  Pfam annotation: Domain name=PPR; Domain location=140-174; Score=9.2; E_value=0.62; Accession=PF01535.11; Description=PPR repeat
  Pfam annotation: Domain name=PPR; Domain location=256-290; Score =26.6; E_value=8.7e-05; Accession=PF01535.11; Description=PPR repeat
  Pfam annotation: Domain name=PPR; Domain location=292-326; Score =14.5; E_value=0.14; Accession=PF01535.11; Description=PPR repeat
  Pfam annotation: Domain name=PPR; Domain location=329-363; Score=2.7; E_value=3.5; Accession=PF01535.11; Description=PPR repeat
  Pfam annotation: Domain name=PPR; Domain location=395-429; Score=4.3; E_value=2.3; Accession=PF01535.11; Description=PPR repeat
  Pfam annotation: Domain name=PPR; Domain location=70-104; Score=29.7; E_value=1e-05; Accession=PF01535.11; Description=PPR repeat
  Pfam module annotation: Pfam domain module=PPR::PPR::PPR::PPR::PPR::PP R; Domain location=140-174::256-290::292-326::329-363::395-429::70-104
MNLQDYNTVLNECVSKRAFKEGQRVHAHTIKTHYLPCVYLWTRLIVFYTKCDSLGDARHVLNEMPERNVVSWTAMISAYSQRGYASQALSILVQILRSGTESNEFTFATMPYFMYRFLGFCLREAIHSLIIKLNFKAHVYVGSSLLDMYAKDGKIHEARGIFECLPERDVVSCTAIISGYAQLDLDEELELFLRVLTALSGLAALDHGKQVHNHLLCSEVPSFVILQNSLIDMYSKCGNLTYARRIFDTMRERTVISWNAMLVGYSKHGERREVLELFNLMRDENKVKPDSVTVLAVLSGCSHGGQEDKGMDIFYDMTSGKISVQPDTKRYGCVVDLLGRAGRVEEAFEFIKKIPFEPSAAICGCLLGACSVHSNLGIGEFVGHRLLEFEPENAGNYVILSNLYASAGRWEDVTSLRNLMLKKAVTKEPGRSLIEVDQKRRSICKVQELLVRFKEAGYFPDLSCVLHDVDEEQKEKILLSHSEKLALSFGLIATPENLHALILVLSKGESDQCLFRLSATENEKVTPPPINEHVEPNQA

SEQ ID NO: 199618 - protein, 109 aa, Glycine max
  Coding DNA Sequence Number=SeqID_82840
  Subcellular localization annotation: CTP_CleavageSite=59; ConfidenceScore=5.54e-01
MLSPPKPKSSSLDSPLSGSNIKQSSTQKKSKEHFCPLSLSQQKNNSEKTKVCGPFFAFVSEHATSDLILDGEKSYTKISVLKSSVVTFLKAIRRGSMQRLKHETILQSI

SEQ ID NO: 199619 - protein, 95 aa, Glycine max
  Coding DNA Sequence Number=SeqID_82841
  Gene Ontology: Mol. function=RNA-directed DNA polymerase activity; Cellular component=mitochondrion; Biological process=RNA-dependent DNA replication
MDILGPLSKALRVVKYLLVVIDYFTKWIKARPLQENMANEVEKFTWKHLICLYDLPYVIITYKDTQFIAPIYEDYLTRLGIKYLVTSVEHPQTND

SEQ ID NO: 199620 - protein, 104 aa, Glycine max
  Coding DNA Sequence Number=SeqID_82842
MHACDTQTASGTGEFGVFEGTASANGDIGMQGEPSVKLASSKLQKSDCFFQVVGSLFSGRVALSEMAGQREVATAIGELRASCNSHWRVRTEEITISDGDLSFQ

SEQ ID NO: 199621 - protein, 113 aa, Glycine max
  Coding DNA Sequence Number=SeqID_82843
MCPEGHDKIVKTGEHEADMFQEVQTKNQGLADEATGGGPARFRGREGGTWPSRARNEALLWWRVAALLVTRLAGVGRAPRGAPNPGFAEKFDGGDGGGEWRQSERDCTRSNTC

SEQ ID NO: 199622 - protein, 89 aa, Glycine max
  Coding DNA Sequence Number=SeqID_82844
MDLAKSQVTNNLGTPTTVRGEAHEGAPPRTSLAKSIGTIRLIYQRLMESIRCGGNEFLQSLSRSIEWRINSIPSSMASWRHAYHPGGRC

SEQ ID NO: 199623 - protein, 55 aa, Glycine max
  Coding DNA Sequence Number=SeqID_82845
MRKEEWIYPVLLNGCTVAEWRGRFFANRHRQFVKGRLLTCVEVEAAAAGVNELRS

SEQ ID NO: 199624 - protein, 116 aa, Glycine max
  Coding DNA Sequence Number=SeqID_82846
  Gene Ontology: Mol. function=transferase activity, transferring phosphorus-containing groups; Cellular component=chloroplast; Biological process=phosphorylation
  Homolog annotation: Hit_ID=Q93YW0; Match level="QueryCoverage=82%, HitCoverage=14%, E-value=2e-35, Identity=75%"; Hit description =EXECUTER1 protein, chloroplast precursor
MSQLSRAVYLENYEDAARLKVAFAATANNDSVGRVMSYLNRAIKEERYGDAAFLRDKAGAGLVGWWSGISEGVNDPHGLIIRITPEHGRYVARSYSPRTKGDAPPLLHCTIEEWLV

SEQ ID NO: 199625 - protein, 271 aa, Glycine max
  Coding DNA Sequence Number=SeqID_82847
  Gene Ontology: Mol. function=catalytic activity; Biological process =metabolic process
  Homolog annotation: Hit_ID=Q8S8F9; Match level="QueryCoverage=94%, HitCoverage=95%, E-value=6e-82, Identity=55%"; Hit description =Expressed protein
  Pfam annotation: Domain name=Isochorismatase; Domain location=63-245; Score=-54.9; E_value=0.026; Accession=PF00857.11; Description =Isochorismatase family
MVSQTVELLKNEIPLEQESVVLAEDAVNGLVLVDIINGFCTVGAGNLVSKTDMRRLILQPTKLDPLDIASCVRAPRESNTQISGMISESARLARVFCEKNLPVMAFLDSHHPNKPEDPYPPHCIVGSDESNLVPALRWLENEPNVTIRRKDCFDGYLGSIQEDGSNVFVDWVKKNKITTLLVVGVCTDICVLDFVCSTMSAKNRGFLEPLENVVVYSRACATFNVPLEVARNTKGALAHPQEFMHHVGLYMAKERGAKIANEVLFGAAGKV

SEQ ID NO: 199626 - protein, 467 aa, Glycine max
  Coding DNA Sequence Number=SeqID_82848
  Gene Ontology: Cellular component=chloroplast
  Homolog annotation: Hit_ID=Q93YW0; Match level="QueryCoverage=98%, HitCoverage=62%, E-value=1e-106, Identity=49%"; Hit description =EXECUTER1 protein, chloroplast precursor
  Subcellular localization annotation: CTP_CleavageSite=40; ConfidenceScore=5.02e-01
MKGANLHLKAVYLKQRGAFHGPPTTSSKTLDAAGRLSSVESTEDKSELFVVSTEDPENGNDRNDGSDPAEGMPGFQNVLKDMIPGVKVKVFKVITPEKVDKDLSNVIEKIIEDEDGDEDEDEEMENDAESLELEEIKSETDQEGDDEIEINAGLGTFEREDQNEFAVKIAIGGLVQKLSGNLSSRDLLRVPAMLEMKGRGSFSFTVEKEVNQQVGLDKGKSSSDKSTKFQGRRRVDHVIFDLAKFIGRGKIPSKVLKEVGELINLTLSQAQSHHQLSGSTIFNRIEIPASFDPLNVQCKPSNIFSFSSGLYIGAHGLYSSEVIHLRRRFGQWQEDNGAKEPSNIEFYEYVEALKLTGDPYVPAGQLETTLGQNIQDENGTPVAFRAKIGKRYQLPHKGIIPEEFGVIARYKGEGRLAEPGFQNARWVDGELVILDGKHLKAGPVVGFVYWAPGYHFLVFFNRLRLQQ

SEQ ID NO: 199627 - protein, 51 aa, Glycine max
  Coding DNA Sequence Number=SeqID_82849
MMLLRRIIAACPQSKRMFSSSVTHGYESAIQELNKVKSLVCSARGNGIGIR

SEQ ID NO: 199628 - protein, 158 aa, Glycine max
  Coding DNA Sequence Number=SeqID_82850
  Gene Ontology: Mol. function=sequence-specific DNA binding; Cellular component=nucleus; Biological process=regulation of transcription, DNA-dependent
  Homolog annotation: Hit_ID=Q8GXL7; Match level="QueryCoverage=61%, HitCoverage=32%, E-value=2e-12, Identity=45%"; Hit description=GATA transcription factor 27
  Pfam annotation: Domain name=CCT; Domain location=133-158; Score =21.2; E_value=0.0016; Accession=PF06203.4; Description=CCT motif
  Pfam annotation: Domain name=Zim; Domain location=56-91; Score=40.3; E_value=6.5e-09; Accession=PF06200.4; Description=ZIM motif
  Pfam module annotation: Pfam domain module=CCT::Zim; Domain location =133-158::56-91
MDNSTLNNPGDNAEDPPPPPAPMQVFDSFQPFHYANGSDEGEEAVPAPVANASSAMRARASELTISFEGEVYVFPAVTPEKVQAVLLLLGAQEMPNSAPTSDFLLQQNYQDIREINDPSRSSKLSRRFASLVRFREKRKERCFEKKIRYSCRKEVAQR

SEQ ID NO: 199629 - protein, 134 aa, Glycine max
  Coding DNA Sequence Number=SeqID_82851
  Subcellular localization annotation: CTP_CleavageSite=16; ConfidenceScore=5.27e-01
MPRRSSGGRSARPAPRAAPRPAPVHHAPPPAPAQSGGGSMLGGIGSTIAQGMAFGTGSAVAHRAVDAVMGPRTIQHETVVTEAAAAAPAPTANTFGGDACSIHTKAFQDLRIYFVLGKMWEVKIIFFGRVTNQD

SEQ ID NO: 199630 - protein, 74 aa, Glycine max
  Coding DNA Sequence Number=SeqID_82852
MQKITSSCTLHAETLATRLTLHHNLPVQKGYKVSVTIRNTQQRGICSKDSTNDSECSNCNTECNLMLLGKREVE

SEQ ID NO: 199631 - protein, 197 aa, Glycine max
  Coding DNA Sequence Number=SeqID_82853
  Gene Ontology: Mol. function=sequence-specific DNA binding; Cellular component=nucleus; Biological process=regulation of transcription, DNA-dependent
  Homolog annotation: Hit_ID=Q8GXL7; Match level="QueryCoverage=38%, HitCoverage=29%, E-value=4e-21, Identity=59%"; Hit description=GATA transcription factor 27
  Pfam annotation: Domain name=GATA; Domain location=35-72; Score=56.8; E_value=7e-14; Accession=PF00320.17; Description=GATA zinc finger
MHRKNGQFASLKEDYKSPAENWDSSNGTPCPDSTCQHCGISEKSTPAMRRGPAGPRSLCNACGLMWANKGTLRDLSKAGRIAFEQNELDTSADIKPSTTEAKHSYAKQGKEGSPEETKPVQMDSRRSPEKTNEQFIIGTAESVTNNLSVRLENHALILHEQDTLEDLADASGTEFEIPAGFDDQVDIDDANMRTYWL

SEQ ID NO: 199632 - protein, 218 aa, Glycine max
  Coding DNA Sequence Number=SeqID_82854
  Homolog annotation: Hit_ID=Q5N9R6; Match level="QueryCoverage=89%, HitCoverage=35%, E-value=2e-21, Identity=42%"; Hit description =Transducin family protein / WD-40 repeat family protein-like
MYLLELEGNDRGSRGCVVARCLIAVCNSEGHVKIYRPPFCDYCAEWIEGRQYILIWAWKNYVVDITKRLYDYFQCTEFRGTRFASLDVSDKNSSDQTDSMYEENGKLLSADQYASRSAMLCSLVVSWSPLLRLASELYPVCDSVSLLAVGGKSGKISLWRFHPPECYTIEDREVPTTVKFVGLLQAHNSWVTTISWLLFAFDSSNPQILLASGSSDGR

SEQ ID NO: 199633 - protein, 778 aa, Glycine max
  Coding DNA Sequence Number=SeqID_82855
  Gene Ontology: Mol. function=motor activity; Cellular component =myosin complex; Biological process=actin filament-based movement
  Homolog annotation: Hit_ID=Q9SNF0; Match level="QueryCoverage=98%, HitCoverage=63%, E-value=0.0, Identity=68%"; Hit description=Myosin
  Pfam annotation: Domain name=Myosin_head; Domain location=172-777; Score=617.8; E_value=9.3e-183; Accession=PF00063.11; Description =Myosin head (motor domain)
MSQTSTVLPAFHSIKSLPPEFNPVLVEKHGDVKFRHTNPIGSNGLENGALVAEISKEVNCRAGGMDLFDEDSPYGGKGRSLKDRPSNADEDSVSVSLPLPSILTSSRESRWNDANPYGSKKKLQSWLQLPNGDWELVKIITTSGAESVISLPDGKVKEESLVPANPDILDGVDDLMQLSYLNEPSVLFNLQYRYNHNMIYTKAGPVLVAVNPFKKVPLYGNDYIEAYKCKSIESPHVYAITDTAIQEMIRDEVNQSIIIRCFNLSSYFSCNLCKYCLNAGFMFYSLKFKGWSSVQAPIGESGAGKTETAKIAMQYLATLGGGSGIENEILKTNPILEAFGNGKTLRNDNSSRFGKLIEIHFSETGKISGANIQTLVQCNEGERSYHIFYQLCAGAPSSLREKLNLTSAEDYKYLRQSNCYSITGVDDAEEFRIVKEALDVVHISKGDQENVFAMLAAVLWLGNISFTVVDNENHVQAVEDEGLFTVAKLIGCEIEDLKLTLSTRKMKVGNDIIVQKLTLSQAIDARDALAKSIYACLFDWLVEQINQSLAVGKRRTGRSISILDIYGFESFNRNSFEQFCINYANERLQQHFNRHLFKLEQEEYIQDGIDWAKVEFEDNQDCLNLFEKKPLGLLSLLDEESTFPNGTDLTFANKLKQHLNSNSCFKGEREKAFTVRHYAGEVTYDTSGFLEKNRDLLHLDSIQLLSSSKCHLPKLFASHMLTQSEKPVVGPLHKSGGADSQKLSVATKFKTSIQYVYNAINGNHAKYCIYSLKKDSLI

SEQ ID NO: 199634 - protein, 140 aa, Glycine max
  Coding DNA Sequence Number=SeqID_82856
  Homolog annotation: Hit_ID=Q2HTF4; Match level="QueryCoverage=24%, HitCoverage=43%, E-value=3e-10, Identity=88%"; Hit description=TonB box, N-terminal; Like-Sm ribonucleoprotein-related, core
MVVGTLCGFDQFMNLVVDNPVEVNGNEKNDIGMVLTAVFMAFLIDEDSNGAIDQEELKKCMFNGVLMANMYVYGFSTVFIHLCRFSHVVTKGAHNFQALAEVSSRVAQGKNSKNELNEVQNPHNIKYNGTIEDLKYTWRT

SEQ ID NO: 199635 - protein, 94 aa, Glycine max
  Coding DNA Sequence Number=SeqID_82857
MWNQDKNDLKAAKRRRLETKCGVESKTQKTKSKQDVKFVAVDRLRFENLLKRNRFKKEIRRKERIRIRRRDRGRDGKLNLKTNLLTMLLVLDKT

SEQ ID NO: 199636 - protein, 56 aa, Glycine max
  Coding DNA Sequence Number=SeqID_82858
MANVEESRATRQPPFEENEWDTYRNQQPFSYETRSILTSGPYFPFPTPDQRDFRLP

SEQ ID NO: 199637 - protein, 315 aa, Glycine max
  Coding DNA Sequence Number=SeqID_82859
  Gene Ontology: Mol. function=anthranilate synthase activity; Cellular component=chloroplast; Biological process=tryptophan biosynthetic process
  Homolog annotation: Hit_ID=Q41155; Match level="QueryCoverage=84%, HitCoverage=44%, E-value=1e-130, Identity=84%"; Hit description =Anthranilate synthase alpha subunit precursor
  Pfam annotation: Domain name=Anth_synt_I_N; Domain location=1-54; Score=-3.2; E_value=0.016; Accession=PF04715.3; Description =Anthranilate synthase component I, N terminal region
  Pfam annotation: Domain name=Chorismate_bind; Domain location=114 -313; Score=185.4; E_value=1.4e-52; Accession=PF00425.8; Description =chorismate binding enzyme
  Pfam module annotation: Pfam domain module=Anth_synt_I_N::Chorismate _bind; Domain location=1-54::114-313
GWVGYFSYDTMRYVEKKKLPFSNAPVDDRNLPDVHLGLYDSVIVFDHVEKKAYVIHWVRVDRYSSAEEAFEDGRNRLETLVSRVHDIITPRLPTGSIKLYTRLFGPKLEMSNMTNEEYKRAVLKAKEHIRAGDIFQIVLSQRFEQRTFADPFEIYRALRIVNPSPYMTYLQARGSILVASSPEILTRVKKRKITNRPLAGTVRRGKTPKEDIMLEKQLLNDEKQCAEHVMLVDLGRNDVGKVSKPGSVQVEKLMNIERYSHVMHISSTSILGYLLGLVLLSLVFIFPNYITTDTSLPNLKGHKAWVEFLGSSTFS

SEQ ID NO: 199638 - protein, 247 aa, Glycine max
  Coding DNA Sequence Number=SeqID_82860
  Homolog annotation: Hit_ID=Q5N9R6; Match level="QueryCoverage=41%, HitCoverage=11%, E-value=1e-15, Identity=41%"; Hit description =Transducin family protein / WD-40 repeat family protein-like
MVYPIVKIWLADNDKLLKSSKVDQTSFSLLKEVITVNAVPVSVLSVTTHVQYPSKMLLATGKVSGSFEIWLCDISSREFDKLGSYNAHDLVVTGLTWAFGGRFLYSCSQLQRHLSDFFTSVIMHNMSYTKLFNIMLGEQVQACQTLFVSPEGTTNGKGVRALVLISSLVIVAYCSVPTRDLYKVGSSNITGPKTGQFVVAHRRGKDAFCLSSWLPPGRRGQSVNKISVRIEKGMVLKLQGKLSMSQE

SEQ ID NO: 199639 - protein, 82 aa, Glycine max
  Coding DNA Sequence Number=SeqID_82861
MESSSCSVLCDGDGLRGRKNRLRAGQRWRWWWVAVLVFLPHFKRQRTKLCRGCDLTGAHANGHFGRDDPDFTGEVVKPLKWE

SEQ ID NO: 199640 - protein, 119 aa, Glycine max
  Coding DNA Sequence Number=SeqID_82862
  Subcellular localization annotation: CTP_CleavageSite=29; ConfidenceScore=5.09e-01
MSPPPLGPLNHSQTQLTLSGRLPFPALVSADLQQQNLSNSLEFGPLSRTEDMQELLKKNGQTPTLNLILGLNSGALSGMTLRLENMHNSSFFQILPRAQPRRVALSGWLAKPKDWLSEK

SEQ ID NO: 199641 - protein, 129 aa, Glycine max
  Coding DNA Sequence Number=SeqID_82863
  Gene Ontology: Mol. function=protein serine/threonine kinase activity; Cellular component=membrane; Biological process=protein amino acid phosphorylation
  Homolog annotation: Hit_ID=Q49N13; Match level="QueryCoverage=73%, HitCoverage=19%, E-value=1e-34, Identity=72%"; Hit description =Putative receptor-like protein kinase 3
MVDWLKTMVGNRRSEEVVDPNIEVKPSTRALKRVLLTALRCVDPDSEKRPKMGQVVRMLESEEYPLAREDRRHRRNRGVNSEIESHKDNSDTDGSDIQGSRSESGRISGVYKILGFAYPRWAWQRLSRG

SEQ ID NO: 199642 - protein, 286 aa, Glycine max
  Coding DNA Sequence Number=SeqID_82864
  Homolog annotation: Hit_ID=Q5N9R6; Match level="QueryCoverage=40%, HitCoverage=12%, E-value=2e-14, Identity=35%"; Hit description =Transducin family protein / WD-40 repeat family protein-like
VHCLDVEKLNRMYEGRILRAAIEYFWIGGLQVDVQLKSPFSCYIEGNSSYVEKELTYWGTNIIWSLNQYQCHDKPLVLWDIIAALSAFKDNNLKYAEHLLIEWISSSFLQLDMDLSPEKVLSFFSSSLSDIPSRLLHLLNIICRRVMLAELDADQITGIYKKFQKLEEVSPAMEKQITKWTKLLLNSERELRERLVGFSFSAFQTSMSNPETNFKSGCWYPVGLAQMEQWIALDQEHIHDQLKVIASEAKHEKRFAPLLPYGIVSVAIGQGLDWHQNHFLECLHFI

SEQ ID NO: 199643 - protein, 56 aa, Glycine max
  Coding DNA Sequence Number=SeqID_82865
MLENPNTFQLGLRIHVSWMLLGACFEGLRFICGGLMLSDPISSTFTLLDGLCCFQK

SEQ ID NO: 199644 - protein, 92 aa, Glycine max
  Coding DNA Sequence Number=SeqID_82866
MGELASHCHEKPYTRRKHKVAEEKDDSQVNSSTIEFLQFFSYCNGVYSPIDLVFPGQGLQMMWHFSSALELPCRLVYALGLVGLDLTNDSCI

SEQ ID NO: 199645 - protein, 193 aa, Glycine max
  Coding DNA Sequence Number=SeqID_82867
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=35%, HitCoverage=29%, E-value=9e-18, Identity=62%"; Hit description =Transcription factor, MADS-box
  Pfam annotation: Domain name=SRF-TF; Domain location=96-146; Score =64.0; E_value=4.9e-16; Accession=PF00319.9; Description=SRF-type transcription factor (DNA-binding and dimerisation domain)
MVDPWFSLPRTTLLPPCQDLKMEGFSSTSSMSRSEDEGPSFVWILDGRWGEGVGWVGGWRNTKGTSIIYNPLIQKNVSNLSDVTKKTNGRQKIKMKKISNKCNLQVMFLKCQTGVFKKTSELATLCGVDLAVIMFSPNNQVYSFSSPNVDFVIHTIQPKAHLPSLPKTSTRTLASWMRMSSTHTSTVCLTKLP

SEQ ID NO: 199646 - protein, 69 aa, Glycine max
  Coding DNA Sequence Number=SeqID_82868
MTPCSATMHSSSFFQILPHAQPISVALSRWLAKPKDWLSERPSAPVMEPEQPIQDVPAAPALDLNEDQP

SEQ ID NO: 199647 - protein, 54 aa, Glycine max
  Coding DNA Sequence Number=SeqID_82869
MKLTLPASIEASQASFHQYITWEDNDMDSSSDSENEIANLSLMAKDYETEEEMH

SEQ ID NO: 199648 - protein, 128 aa, Glycine max
  Coding DNA Sequence Number=SeqID_82870
MTEGCGEGFCLANLPGDAFSLWGNFFEAKKQMMADAKFAGLLVGGAGLWPRAKFRIGWPPPPPRDQFCCQDFANFGLRPGRIKATRAESQWIVAARPLCHLQYPVAYLSRLQRILPAARWEIALQGVS

SEQ ID NO: 199649 - protein, 211 aa, Glycine max
  Coding DNA Sequence Number=SeqID_82871
  Subcellular localization annotation: CTP_CleavageSite=27; ConfidenceScore=5.15e-01
MKLHHVKLSLSARRSHSAGLPSFPPVVLAMSGCLFKVLGLVLPLITFQCALLEHLNVSLSQLHPNSWAMMMMTGKTGWVSLNRILKKLFEFDSNVFRWFKDLFFKVLATNVEADTRSLASHSTEGQQGHLGAAVDLAGYTVTRAILSLPSQAIPSPPWMVGPAAGVGPIDKVAEVSPSMPSFVLAKRKHDDGAEVCSQPASVPDRTSSIKR

SEQ ID NO: 199650 - protein, 117 aa, Glycine max
  Coding DNA Sequence Number=SeqID_82872
  Gene Ontology: Mol. function=nucleotide binding
  Homolog annotation: Hit_ID=Q1S5H0; Match level="QueryCoverage=81%, HitCoverage=19%, E-value=8e-34, Identity=70%"; Hit description=Plant protein family, putative
AALEKEKNVSEVEDSGKQESLEALTSQISDMVAIAKIMKATLVLPTLDHDSFWTDSSDFKQIFDWKNFIEVLKDDVQILESLPPEFATIKPVLKAPAGYYAGEVLQLLKKHKVIKFI

SEQ ID NO: 199651 - protein, 85 aa, Glycine max
  Coding DNA Sequence Number=SeqID_82873
  Gene Ontology: Mol. function=molecular_function; Cellular component =membrane; Biological process=auxin mediated signaling pathway
  Homolog annotation: Hit_ID=Q69PB3; Match level="QueryCoverage=97%, HitCoverage=23%, E-value=5e-23, Identity=57%"; Hit description =Putative MtN21
MATLQSTLVTLLLEPDPHAWKINSLLEFGCTLYSGVIGSAVLLFIQAWCISLRGPLFCAMFNPLFTVIVTILAALLLHEEIYSGR

SEQ ID NO: 199652 - protein, 510 aa, Glycine max
  Coding DNA Sequence Number=SeqID_82874
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=99%, HitCoverage=40%, E-value=2e-42, Identity=34%"; Hit description =Receptor protein kinase-like protein
  Pfam annotation: Domain name=DUF26; Domain location=195-249; Score =96.5; E_value=8.1e-26; Accession=PF01657.8; Description=Domain of unknown function DUF26
  Pfam annotation: Domain name=DUF26; Domain location=325-379; Score =60.0; E_value=7.6e-15; Accession=PF01657.8; Description=Domain of unknown function DUF26
  Pfam annotation: Domain name=DUF26; Domain location=438-493; Score =40.4; E_value=6e-09; Accession=PF01657.8; Description=Domain of unknown function DUF26
  Pfam annotation: Domain name=DUF26; Domain location=81-137; Score =64.1; E_value=4.6e-16; Accession=PF01657.8; Description=Domain of unknown function DUF26
  Pfam module annotation: Pfam domain module=DUF26::DUF26::DUF26::DUF26; Domain location=195-249::325-379::438-493::81-137
MHSNSFKLIFLCTLVILFNFPTTKAQESHDYLNQMCSESEIPANSTYEKNLRTLFSSLSSKATAKTFFYDTVVGRNSFDTVYGMFMCRGDVPSQLCGQCVVNATHTRDSEPGCSRSIWDVIWYEECMVRYSNVPFYSKVATHPFCYKWSLANISSNPASFMSLLYNTMNQTAHEAAISGNMYSTKQANYSNSETLYCLAQCTQDLSPQNCTACLTQAIEYLPNCCEGKQGGRVLFPSCNIRYELYPFFRNVTDEALPEGIVPETKYSHTDSEYSEDPGYISHNCSTDQIINDTAFESNLKTLFSDLTSNATSGNRNSKRAGAGTLQGFFTCRVDLSRTLCGECVQNATEKIFSACGLAAEGVIWYNHCWLRYSNRSFAMETSPSYVDLNVTDTDNRVQYSSHALTLISNKLAAMADGTGQTLDKYQSGTLILNNKQRVYILAQCALDLSSEDCGACLSDMIGSAIPWTRLGSLGGRVLYPTCILRFELFQFYDLIPTTAITHPLLLAPAS

SEQ ID NO: 199653 - protein, 43 aa, Glycine max
  Coding DNA Sequence Number=SeqID_82875
MKKMKKSLISIKDALLRARPSIAISSPDSETSNDIRENPPNYM

SEQ ID NO: 199654 - protein, 88 aa, Glycine max
  Coding DNA Sequence Number=SeqID_82876
  Homolog annotation: Hit_ID=Q2QYQ2; Match level="QueryCoverage=68%, HitCoverage=11%, E-value=3e-12, Identity=68%"; Hit description =Expressed protein
MVLIDRARRTVRGSADDIGWLQRDPGMPPVEDGTERFLEILDNIKFFLPCQAWCSQVTKFGGLFVNSRLIMTNSTSNPSHAAGRTNVY

SEQ ID NO: 199655 - protein, 72 aa, Glycine max
  Coding DNA Sequence Number=SeqID_82877
GFNDTKIEFKLANVQKIWQRFLYRDSVLLEAERQKTAIGHVDDWAVEFLKLTEDDAFATLIQVLLFFLANYF

SEQ ID NO: 199656 - protein, 113 aa, Glycine max
  Coding DNA Sequence Number=SeqID_82878
  Gene Ontology: Mol. function=metal ion binding
MIYFFIAYLVYRNQKTFDLDGACVFDMDISNQILLIAQKRKAIGGMHLLTKMSLMFPFEMQDILLPSGTNGVKDLHISASHSSTLALFASLGKKLSVLSLDSGNLVVNYDLQV

SEQ ID NO: 199657 - protein, 123 aa, Glycine max
  Coding DNA Sequence Number=SeqID_82879
  Homolog annotation: Hit_ID=Q1SKH2; Match level="QueryCoverage=93%, HitCoverage=8%, E-value=2e-32, Identity=62%"; Hit description =Calcium-binding EF-hand
MNRLNNAISVGDINGKIKSMEHMIEHETLPLNKEKQLIHEIKQLKQNYEELSSNMKKQDQSQQSVDNKDDNIEEHFKHLQLLKKEMEVLRNNVLKSDTETKAAKKKYNDECDKLNKFPFYYTH

SEQ ID NO: 199658 - protein, 237 aa, Glycine max
  Coding DNA Sequence Number=SeqID_82880
  Homolog annotation: Hit_ID=Q2QYQ2; Match level="QueryCoverage=67%, HitCoverage=33%, E-value=8e-59, Identity=72%"; Hit description =Expressed protein
  Subcellular localization annotation: CTP_CleavageSite=64; ConfidenceScore=5.18e-01
GRSLWKNASNAAFLRFLAFCWPFAHMFFPALSPDSVDNRITAFEKRKSAQYANRLSPRVGRFINAAGTTGFPTGKRAGDMRALEDLTYERRREFLKEHHLPKEVPIVSFRTEAGISPAVLATLSHVAHAELPLVAPAGESRKLPVVMPLGAAMAACAQLLQVRYGEKSDGLVTCRDAEVPGSVVVRPKRKLDHAWMVYSSLNDDLSEGDAFQVCEALLTLLVEIGQKKMHELAMKDE

SEQ ID NO: 199659 - protein, 69 aa, Glycine max
  Coding DNA Sequence Number=SeqID_82881
  Gene Ontology: Mol. function=protein translocase activity; Cellular component=mitochondrial outer membrane; Biological process =intracellular protein transport
  Subcellular localization annotation: CTP_CleavageSite=22; ConfidenceScore=5.21e-01
MASRRGGVSLPDRPSNNSSSVLAKISRSSIVTRGKEVADDAAFVAKKLLRSTGKAAFLLLEYLKRKFRT

SEQ ID NO: 199660 - protein, 119 aa, Glycine max
  Coding DNA Sequence Number=SeqID_82882
MGQTEPELLLKLDCGVWRWFPNVAWCILHFIRYIWFTMTSLVEFEEAPKYMEYFIWWVQPTWPYYHFVEHVEIIEILSSLDALEYVLRPPYAKDDSPQYVPRPPYASEDSEHTVQPISL

SEQ ID NO: 199661 - protein, 620 aa, Glycine max
  Coding DNA Sequence Number=SeqID_82883
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=94%, HitCoverage=94%, E-value=1e-136, Identity=43%"; Hit description =Protein kinase
  Pfam annotation: Domain name=DUF26; Domain location=201-255; Score =79.1; E_value=1.4e-20; Accession=PF01657.8; Description=Domain of unknown function DUF26
  Pfam annotation: Domain name=DUF26; Domain location=86-142; Score =67.2; E_value=5.4e-17; Accession=PF01657.8; Description=Domain of unknown function DUF26
  Pfam annotation: Domain name=Pkinase; Domain location=348-611; Score =150.7; E_value=3.9e-42; Accession=PF00069.15; Description=Protein kinase domain
  Pfam annotation: Domain name=Pkinase_Tyr; Domain location=348-573; Score=113.7; E_value=5.4e-31; Accession=PF07714.7; Description =Protein tyrosine kinase
  Pfam module annotation: Pfam domain module=DUF26::DUF26::Pkinase::Pkin ase_Tyr; Domain location=201-255::86-142::348-611::348-573
  Subcellular localization annotation: CTP_CleavageSite=40; ConfidenceScore=5.44e-01
MASNSFMLVFLCVLVTLFNFATTTKAQNVDQVYFVSQSCSANKTTANSAYEKNLKTLLSSLSSNATTTLFYNNTVLGSTNTTSDTVYGLFMCRGDIPLRLCKECVANATQKLSSDQSCSLSKQAVMWYAECIVRYSNVGFFSTVSTSPEYSLYNPNDITDNSTNSFMNFLSNTINQTAEAAANSAKRFSTKEANLSQSQTLYCLAQCTEDLPPQNCTTCLAQAIRELPICCYAKQGGRVGFPSCNVWYELYPFYGLITDQTPSPTSTPLPPPPSSSSSGKGQPRNIILILTSSITLPGILFTFYYYFIRRKAKKNNKTILRKNFGHETSTIESLQFNLAIIETATNNFSHENKIGKGGFGEVYKGILIDGRPIAIKRLSRNSKQGVEEFKNEVLLIAKLQHRNLVTFIGFSLDQQEKILIYEYVPNKSLDFFLFDTKLENVLSWSKRYKIIRGIAQGIQYLHEHSRLKVIHRDLKPSNVLLDENMNPKISDFGLARIVEIDKEKGSTKRIIGTYGYMSPEYCMFGHFSEKSDVYSFGVMVLEIISGRKNIDSYESHQDYSEDRPTMMTIASYLSSHSVELPSPREPKFFLYHRIDPIAAHASSRQLANNSLPSSINEISI

SEQ ID NO: 199662 - protein, 42 aa, Glycine max
  Coding DNA Sequence Number=SeqID_82884
MARLSPTSYASHLSGLPSRHYGNTTKNLMFLSPRTLKSRVYL

SEQ ID NO: 199663 - protein, 364 aa, Glycine max
  Coding DNA Sequence Number=SeqID_82885
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=66%, HitCoverage=36%, E-value=2e-38, Identity=36%"; Hit description =Receptor protein kinase-like protein
  Pfam annotation: Domain name=DUF26; Domain location=199-253; Score =86.8; E_value=6.4e-23; Accession=PF01657.8; Description=Domain of unknown function DUF26
  Pfam annotation: Domain name=DUF26; Domain location=85-141; Score =77.2; E_value=5e-20; Accession=PF01657.8; Description=Domain of unknown function DUF26
  Pfam module annotation: Pfam domain module=DUF26::DUF26; Domain location=199-253::85-141
MPWKSFKLIFLCIFVCFFFNFATTTKAQDADPLIIGQICSANRTTANSAYEKNLNTLLSSLSSNANATLFYNNTVLGSTNSSDTVYGLFMCRGDVPSQLCARCVVNATERLSSDPECSLSIKGVIWYDECMVRYSNVTFFSTVDTRPSYYMWNLANISSNPENFNNLLASTFRKTAEEAANSGNRYSTKQANLSEFQTLYCLAQCTQDLSPQHCRDCLDSAESKIQICCDGKQGGRVFFPSCNIRYQLYPFYRNLTYEASEALVPETKYPERDSEYSEDPGYIYHNCSTNQNVNDTAFQSDRKTLFSDLSSNATSGDRYSVKAGTLRGLFRCRGDLSRYLCGQCVQNATEKILSECGWATDVTI

SEQ ID NO: 199664 - protein, 60 aa, Glycine max
  Coding DNA Sequence Number=SeqID_82886
  Gene Ontology: Mol. function=serine-type endopeptidase activity; Cellular component=chloroplast; Biological process=proteolysis
  Homolog annotation: Hit_ID=Q1T3A6; Match level="QueryCoverage=83%, HitCoverage=11%, E-value=2e-14, Identity=78%"; Hit description =Peptidase S1 and S6, chymotrypsin/Hap
VNGIVDQLVKFGKITRHILGIKFAPDQFVDQLGVSAVFVLNVPANGLAGKAISYLLYYFL

SEQ ID NO: 199665 - protein, 137 aa, Glycine max
  Coding DNA Sequence Number=SeqID_82887
MMMSMWSQAIVQKDRQHLASSFIIRAIIQYMRVTRTQQKASSCLEQEDEVSALVRGQGSSLRKLTNLLRKRFFSEFYSCMYQALYKSRYANAFYVLRSCANPSWSGFSRYYGIIFFQMAAGAIIIAPWENHIVLKVM

SEQ ID NO: 199666 - protein, 89 aa, Glycine max
  Coding DNA Sequence Number=SeqID_82888
  Homolog annotation: Hit_ID=Q1SMF0; Match level="QueryCoverage=91%, HitCoverage=15%, E-value=3e-12, Identity=43%"; Hit description =Tetratricopeptide-like helical
MERNLVFATRYDFLHWTRPIAYDIGFVAVIMRSDKDTGNRGQTSYVLIGCERSGQYRAYKKDLVRTITGSRKCGCPFKLRAKPVLGGEG

SEQ ID NO: 199667 - protein, 270 aa, Glycine max
  Coding DNA Sequence Number=SeqID_82889
  Gene Ontology: Mol. function=transcription factor activity; Cellular component=nucleus; Biological process=regulation of transcription, DNA-dependent
  Homolog annotation: Hit_ID=Q1SFQ2; Match level="QueryCoverage=80%, HitCoverage=94%, E-value=3e-56, Identity=55%"; Hit description =Pathogenesis-related transcriptional factor and ERF
  Pfam annotation: Domain name=AP2; Domain location=95-159; Score =148.2; E_value=2.2e-41; Accession=PF00847.10; Description=AP2 domain
  Subcellular localization annotation: CTP_CleavageSite=72; ConfidenceScore=5.78e-01
MRKRINMESDADFNSFATSTPSIFFDTNTSSTSSSSSSSSSSSSTSPTSNKDSCTKEHTKTPQNDSTISQTSLENKEDSKECKKRQRDNSNQNHHPTYRGVRMRNWGKWVSEIREPRKKSRIWLGTYPTAEMAARAHDVAALAIKGHSAYLNFPELAQELPRPASTSPKDIQAAASKAANTAFEVVKHCQITEEQEQEQNQAEQETSSTLSMDNTQEPSSSHSTNDDDTLFDLPDLFPDGNNGLCSFSSWHLCAVDSGFRLEESFFWENY

SEQ ID NO: 199668 - protein, 216 aa, Glycine max
  Coding DNA Sequence Number=SeqID_82890
  Gene Ontology: Mol. function=phosphoglycerate mutase activity; Cellular component=cytoplasm; Biological process=glucose catabolic process
  Homolog annotation: Hit_ID=P35493; Match level="QueryCoverage=94%, HitCoverage=37%, E-value=2e-83, Identity=75%"; Hit description=2,3 -bisphosphoglycerate-independent phosphoglycerate mutase
  Pfam annotation: Domain name=Metalloenzyme; Domain location=57-184; Score=193.7; E_value=4.5e-55; Accession=PF01676.8; Description =Metalloenzyme superfamily
MAIVLTCTNFFVNSETVKFGHVTFFWNGNRSGYFNAELEEYVEIPSDSGITFNEQPLMKALQIAEKARDAILSGKFDQVRVNLPNGDMVGHTGDIEATVVACKAADAAVKMILDAIEQVGGIYVVTADHGNAEDMVKRDKSGKPLLGKDGKIQILTSHTLEPVPIAIGGPGLAPGVRFRNNVPTGGLANVAATVMNLHGFEAPSDYETTLIEVVDN

SEQ ID NO: 199669 - protein, 93 aa, Glycine max
  Coding DNA Sequence Number=SeqID_82891
MTVTVSWRRNHQQVKMNGGLKKIAEQDGIAKTKAVDEETNKCRGCCFSILIEGKIQQLTYIVGCRRRNNGVGRKCLKLITQSRAQIRNLIIQV

SEQ ID NO: 199670 - protein, 50 aa, Glycine max
  Coding DNA Sequence Number=SeqID_82892
MVLAEEGSSAGRKSTPAEEPFFRGCQRKMEDMALLREPPRKNLLPRVPVL

SEQ ID NO: 199671 - protein, 246 aa, Glycine max
  Coding DNA Sequence Number=SeqID_82893
  Gene Ontology: Mol. function=hydrolase activity
  Homolog annotation: Hit_ID=Q2HRX8; Match level="QueryCoverage=79%, HitCoverage=27%, E-value=7e-21, Identity=32%"; Hit description=IMP dehydrogenase/GMP reductase
  Pfam annotation: Domain name=DUF1723; Domain location=155-204; Score =53.0; E_value=1e-12; Accession=PF08330.1; Description=Protein of unknown function (DUF1723)
MVRTRGLRRVVGTGRGRDLSQDVAEDVPRRRRPTGSAHRQRVTQRVEDLAEDVPHASDGSPERTGAADGAETDRVASDGITADDEWFPGGPRDPSVLIGFADHVAHNIWSGQERPDLKLVSHGRKVDKFGRPTAEIKGMIAATGLDPLIRCSVITTDPRLISAFVERWHRETSSFHLPVGEVMITLDDVSSLLHIPITSALHSFEPLVTSDAVALLTELLEVTADEATAETRQAGGPHVRLSWLRD

SEQ ID NO: 199672 - protein, 146 aa, Glycine max
  Coding DNA Sequence Number=SeqID_82894
MNKAVISLYGLLGLFAGAILSSSICGTPKNFKAENNCIPRGKIETSLNNSTIPKTIYNGFLILAIKFVHYLISRGYNKSSAPYTTIVPFWVRRPLKGRSTATCFYSWLIHGQLQLQLQHGEASSKSCHLSGNIQEVESNQYRIKKI

SEQ ID NO: 199673 - protein, 141 aa, Glycine max
  Coding DNA Sequence Number=SeqID_82895
MASGSYAWGDAALCWIYKHFPSIVFSIAVEDYHERKPCASLWKSGKASLVSTYHKRLDRLTSDACSTDYMEWFYMISHPFMSLAQLGDPPRHPPIDAHVDAYQAIEERLERLLNLRIVTEGTKAYTITEDYLRIARGVTAQ

SEQ ID NO: 199674 - protein, 63 aa, Glycine max
  Coding DNA Sequence Number=SeqID_82896
MGSIYCHTPTGEGCTTVWCSTDYMEWFYMICHPFMSLAQLGDPPRHPPVDAHVDVDQLRHAVV

SEQ ID NO: 199675 - protein, 511 aa, Glycine max
  Coding DNA Sequence Number=SeqID_82897
  Gene Ontology: Mol. function=sugar porter activity; Cellular component=integral to membrane; Biological process=carbohydrate transport
  Homolog annotation: Hit_ID=Q9FMX3; Match level="QueryCoverage=98%, HitCoverage=98%, E-value=0.0, Identity=64%"; Hit description=Sugar transport protein 11
  Pfam annotation: Domain name=MFS_1; Domain location=44-447; Score =86.6; E_value=7.5e-23; Accession=PF07690.6; Description=Major Facilitator Superfamily
  Pfam annotation: Domain name=Sugar_tr; Domain location=26-487; Score =551.1; E_value=1.2e-162; Accession=PF00083.14; Description=Sugar (and other) transporter
  Pfam module annotation: Pfam domain module=MFS_1::Sugar_tr; Domain location=44-447::26-487
MAGGAYVDSGNAKQFDGKVTAFVLVTCFVAAMGGLLFGYDLGITGGVTSMEPFLIKFFPGVYKQMQDDVGHRSQYCKFDNELLTLFTSSLYLAALVASFFASTTTRMMGRKASMFLGGLFFLVGALLNGFAVNIEMLIIGRLLLGFGVGYCNQSVPVYLSEMAPAKIRGALNMGFQMMITIGILIANLINYGTSKLENGWRISLGVGAVPAVLLCFGALFLGDTPNSLIERGQKEEARKMLQKIRGIDNVEEELQELVLASESAKEVEHPWKNITTPKYRPQLTFCTLIPFFQQLTGINVVMFYAPVLFKTLGFGNDASLMSSVITGGVNVVATLVSILTVDKVGRKVLFLEGGVQMLICQIATGVMIAMKFGVSGEGSFSSGEANLILFFICAFVAAFAWSWGPLGWLVPSEICPLEVRSAGQAINVAVNMLFTFAIAQVFLVMLCHLKFGLFFFFAAFVLIMTIFIAMLLPETKNIPIEEMHTVWRSHWFWSKIVPHADDDRKPEAAQS

SEQ ID NO: 199676 - protein, 204 aa, Glycine max
  Coding DNA Sequence Number=SeqID_82898
  Gene Ontology: Mol. function=nucleic acid binding; Cellular component= intracellular
  Homolog annotation: Hit_ID=Q9FJ17; Match level="QueryCoverage=64%, HitCoverage=65%, E-value=2e-22, Identity=41%"; Hit description =Drought-induced protein Di19-like protein
  Pfam annotation: Domain name=Di19; Domain location=57-204; Score =132.8; E_value=9.4e-37; Accession=PF05605.3; Description=Drought induced 19 protein (Di19)
MAAEKGVEMVALECLGKGFNLASNFWLKFAKGICEERLVVLDEQNKRDILIPGTGGVTIKGVSENIRCDKGDYDVVSLCCHIDDHHPVQAKIGVCPICGKKVGLDLVGHITMQHGNFLRVQRKRRVKKVGSGSTMSILRKELREGALQSLLGGSSYLASSNSEPDPLLSSFMFNPAVTDDSASAKPPSVEDTLVKESLFRVRDL

SEQ ID NO: 199677 - protein, 121 aa, Glycine max
  Coding DNA Sequence Number=SeqID_82899
  Homolog annotation: Hit_ID=Q1RX00; Match level="QueryCoverage=75%, HitCoverage=16%, E-value=2e-23, Identity=61%"; Hit description =Pentatricopeptide repeat
MDAYGKSGDFDSAVHWFKEMESNGIPPDQKAKNVLLSLAKTDEEREEANELVVHFSENSSLPKVNGIVKLVDEDEEEDNYEYFDAQLARAYEHSTEHYIIKQLKVFNLDIIYSKYGSHIGK

SEQ ID NO: 199678 - protein, 821 aa, Glycine max
  Coding DNA Sequence Number=SeqID_82900
  Gene Ontology: Mol. function=binding; Cellular component =mitochondrion; Biological process=protein amino acid phosphorylation
  Homolog annotation: Hit_ID=Q7X9T6; Match level="QueryCoverage=80%, HitCoverage=86%, E-value=2e-57, Identity=26%"; Hit description =Fertility restorer homologue A
  Pfam annotation: Domain name=PPR; Domain location=138-172; Score =20.2; E_value=0.0074; Accession=PF01535.11; Description=PPR repeat
  Pfam annotation: Domain name=PPR; Domain location=174-208; Score =21.8; E_value=0.0025; Accession=PF01535.11; Description=PPR repeat
  Pfam annotation: Domain name=PPR; Domain location=209-242; Score =24.4; E_value=0.00041; Accession=PF01535.11; Description=PPR repeat
  Pfam annotation: Domain name=PPR; Domain location=243-277; Score =25.4; E_value=0.00021; Accession=PF01535.11; Description=PPR repeat
  Pfam annotation: Domain name=PPR; Domain location=278-312; Score =37.4; E_value=5e-08; Accession=PF01535.11; Description=PPR repeat
  Pfam annotation: Domain name=PPR; Domain location=313-347; Score =41.5; E_value=2.9e-09; Accession=PF01535.11; Description=PPR repeat
  Pfam annotation: Domain name=PPR; Domain location=381-415; Score =23.2; E_value=0.00095; Accession=PF01535.11; Description=PPR repeat
  Pfam annotation: Domain name=PPR; Domain location=433-467; Score =27.8; E_value=3.8e-05; Accession=PF01535.11; Description=PPR repeat
  Pfam annotation: Domain name=PPR; Domain location=468-502; Score =41.9; E_value=2.2e-09; Accession=PF01535.11; Description=PPR repeat
  Pfam annotation: Domain name=PPR; Domain location=503-537; Score =23.3; E_value=0.00086; Accession=PF01535.11; Description=PPR repeat
  Pfam annotation: Domain name=PPR; Domain location=538-572; Score =16.6; E_value=0.08; Accession=PF01535.11; Description=PPR repeat
  Pfam annotation: Domain name=PPR; Domain location=573-607; Score =23.2; E_value=0.00091; Accession=PF01535.11; Description=PPR repeat
  Pfam annotation: Domain name=PPR; Domain location=608-642; Score =33.9; E_value=5.4e-07; Accession=PF01535.11; Description=PPR repeat
  Pfam annotation: Domain name=PPR; Domain location=643-677; Score =44.0; E_value=5.1e-10; Accession=PF01535.11; Description=PPR repeat
  Pfam annotation: Domain name=PPR; Domain location=678-712; Score =47.8; E_value=3.7e-11; Accession=PF01535.11; Description=PPR repeat
  Pfam annotation: Domain name=PPR; Domain location=713-747; Score =29.0; E_value=1.6e-05; Accession=PF01535.11; Description=PPR repeat
  Pfam annotation: Domain name=PPR; Domain location=748-782; Score =20.6; E_value=0.0058; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=138-172::174-208::209-242::243-277::278-312::313-347::381 -415::433-467::...
  Pfam module annotation: Domain location=468-502::503-537::538 -572::573-607::608-642::643-677::678-712::713-747::748-782
  Subcellular localization annotation: CTP_CleavageSite=16; ConfidenceScore=5.23e-01
MALRTPQKLKLRPLPLFSVFSKLPLSTTPHNNNNNHSDASVADILVSVFTEQPNADTPELNCFAPILTPPLVESVLTRLRTWKLAHSFFHWASNQGFRHTCYTYNSIASILSRSHQTSPLKTLLKQISDSAPCSFTPGALGFLIRCLGHAGLAREAHHLFDEMRLKGLCVPNDYCYNCLLEALSKSGEVDLIEARLEEMKGFGWEFDKFTLTPLLQAYCNARRFDEALRVYNVMREKGWVDGHVCSMLALSFSKWGDVDKAFELVERMEGHGMRLNEKTFCVLIHGFVKEGRVDRALQLFDIMCRVGFTPPVSLFDVLIGGLCRNGDSHRALSLLSEMKEFGVTPDVGIFTKLISAFPDRGVIAKLLEEVPGGEEERTLVLIYNAVLTCYVNDGLMDEACRFLRMMIQSKASGDVQMDGFFNKVKKLVFPNGASFSIVINGLLKNDQLDLALSLFNDMKQFVDRPSVLIYNNLINSLCDSNRLEESRELLREMKESGVEPTHFTYNSIYGCLCKRKDVLGAIDMLKGMRACGHEPWIKNSTLLVKELCDHGMAIEACNFLDSMVQQGFLPDIVSYSAAIGGLIQIQELNRALQLFSDLYSRGHCPDVVASNILMRGLCKAYRVREAEKLLDEIVVKGFFPSVVTYNLLIDSWCKNGSVDKAMALLSRMSGEDREPNVITYSTLVDGFCRAERPDDALLVWNEMERKGCFPNQIAFMALIYGLCKCCRPTTALHYLREMEQKDMKPDSFIYIALISSFLSDMDLASAFEIFKEMVYSGYFPESHDKNYSIVMDAIDKFSKDHRTSSGIQVLMEEGKLPTHCP

SEQ ID NO: 199679 - protein, 157 aa, Glycine max
  Coding DNA Sequence Number=SeqID_82901
  Gene Ontology: Mol. function=zinc ion binding; Biological process =superoxide metabolic process
  Homolog annotation: Hit_ID=Q1RX06; Match level="QueryCoverage=57%, HitCoverage=84%, E-value=6e-47, Identity=96%"; Hit description=Zinc finger, RING-type; RINGv
  Pfam annotation: Domain name=zf-C3HC4; Domain location=109-144; Score= 14.1; E_value=0.0055; Accession=PF00097.15; Description=Zinc finger, C3HC4 type (RING finger)
MGLAAPRCDNNIDNYALKSSTSLAEQRVVKKNESCKLPLRSLTLGTMARLLPWDAWEDVDPDELSYEELLALGEAVGTESRGLSTDTIACLPSVNYKTGSDQHGSNDSCVICRVDYEDDESLTVLSCKHLYHPECINNWLKINKEEALALKKYLITS

SEQ ID NO: 199680 - protein, 257 aa, Glycine max
  Coding DNA Sequence Number=SeqID_82902
  Homolog annotation: Hit_ID=Q1RX01; Match level="QueryCoverage=20%, HitCoverage=28%, E-value=5e-14, Identity=69%"; Hit description =Thioredoxin domain 2
  Pfam annotation: Domain name=Thioredoxin; Domain location=202-256; Score=-29.4; E_value=0.042; Accession=PF00085.10; Description =Thioredoxin
MRKPNAPGVKEQGAESEICLRRVLRGEDGGDGVVGVAGVAEALVGCPVEEGVGEFPRAEAREDGLDKGRGENGGEAVQFRGVGVGLFGEDRDEDVGNRSIGVIIIIVMGRCGKREFAEDREKRKRTEFEFLWCPQCHQSHLDDDDNNYNCLDMSERGYSLILVYNYLMANWLENIGYSECPRLHQPRPLFLSLTPVVTCGAAVTEINETQFKDTVLKANRPVLVEFVATWCGPCRLISPSMESLAKGWLKAHVRALG

SEQ ID NO: 199681 - protein, 326 aa, Glycine max
  Coding DNA Sequence Number=SeqID_82903
  Gene Ontology: Mol. function=molecular_function; Cellular component =membrane; Biological process=auxin mediated signaling pathway
  Homolog annotation: Hit_ID=Q9LI65; Match level="QueryCoverage=95%, HitCoverage=78%, E-value=6e-78, Identity=45%"; Hit description =Nodulin-like protein
  Pfam annotation: Domain name=DUF6; Domain location=147-276; Score =21.6; E_value=0.0029; Accession=PF00892.11; Description=Integral membrane protein DUF6
MTMNEYLILEVGLEEHMKHKLEVHIICLLFLSAILGITIPQYLFLLGLEYTSATFSCAFLNMVPVFTFIMAVPFGVEKVNMQSKSGKAKVMGTLVCIGGALLLVLYKGMPLINPQSQHIANKITSTLPAAKLEKWIVGSILLTLGCLLWSSWFIIQAKISKKYPCQYSSTAILSLFAAIQSATLTLVFKRNNASWILKGKLEIMSVAYAGLIGSGLCYVAMSWCVKQRGPVFTAAFTPLMQIFVATLDFSVLKEEIYLGRLVSLITFMIPPFLHSTAPNVSLSAISSLAGSALVIAGVYILLWGKSKEEGQHVLKDTQTNQDVECQ

SEQ ID NO: 199682 - protein, 206 aa, Glycine max
  Coding DNA Sequence Number=SeqID_82904
  Homolog annotation: Hit_ID=Q9LT17; Match level="QueryCoverage=34%, HitCoverage=14%, E-value=7e-12, Identity=56%"; Hit description =Genomic DNA, chromosome 3, P1 clone: MPN9
MENDTAAAVNNNTTATATAKAGSGGVKSNNHNLEEEHSNLNGEEHMAEQVEAEEEEDREADDGEGEQTGSRQPSRTPFTNLSQVDADLALARTLQEQLPKDMQIPGVDIPDPRCWPFTNSCERAYMMLRMNNEGSDYGSWEGGSYLHDEGDDFDDLHDGTDVDEDEDDDDDEDDDDEEDEDEDAFDVHAHASAGEHDNPTIEFDPD

SEQ ID NO: 199683 - protein, 548 aa, Glycine max
  Coding DNA Sequence Number=SeqID_82905
  Gene Ontology: Mol. function=metal ion binding; Cellular component =intracellular; Biological process=regulation of transcription
  Homolog annotation: Hit_ID=Q7XE15; Match level="QueryCoverage=82%, HitCoverage=92%, E-value=1e-127, Identity=50%"; Hit description =Pentatricopeptide, putative
  Pfam annotation: Domain name=PPR; Domain location=150-184; Score=5.5; E_value=1.7; Accession=PF01535.11; Description=PPR repeat
  Pfam annotation: Domain name=PPR; Domain location=212-246; Score =44.9; E_value=2.8e-10; Accession=PF01535.11; Description=PPR repeat
  Pfam annotation: Domain name=PPR; Domain location=247-281; Score=7.8; E_value=0.89; Accession=PF01535.11; Description=PPR repeat
  Pfam annotation: Domain name=PPR; Domain location=315-349; Score =39.3; E_value=1.3e-08; Accession=PF01535.11; Description=PPR repeat
  Pfam annotation: Domain name=PPR; Domain location=350-384; Score =28.1; E_value=3.1e-05; Accession=PF01535.11; Description=PPR repeat
  Pfam annotation: Domain name=PPR; Domain location=385-419; Score=3.2; E_value=3.1; Accession=PF01535.11; Description=PPR repeat
  Pfam annotation: Domain name=PPR; Domain location=451-485; Score=1.2; E_value=5.4; Accession=PF01535.11; Description=PPR repeat
  Pfam annotation: Domain name=PPR; Domain location=80-114; Score=32.8; E_value=1.2e-06; Accession=PF01535.11; Description=PPR repeat
  Pfam module annotation: Pfam domain module=PPR::PPR::PPR::PPR::PPR::PP R::PPR::PPR; Domain location=150-184::212-246::247-281::315-349::350 -384::385-419::451-485::80-114
MLGVSLACKITNISHNLLSLLDKCKSILELKQLHAVVISCGLSQDDPFISKILCFSALSNSGDINYSYRVFSQLSSPTIFSWNTIIRGYSNSKNPIQSLSIFLKMLRLGVAPDYLTYPFLVKASARLLNQETGVSVHAHIIKTGHESDRFIQNSLIHMYAACGNSMWAQKVFDSIQQKNVVSWNSMLDGYAKCGEMVMAQKAFESMSEKDVRSWSSLIDGYVKAGEYSEAMAIFEKMQSAGPKANEVTMVSVSCACAHMGALEKGRMIYKYIVDNGLPLTLVLQTSLVDMYAKCGAIEEALLIFRRVSKSQTDVLIWNAVIGGLATHGLVEESLKLFKEMQIVGICPDEVTYLCLLAACAHGGLVKEAWFFFESLSKCGMTPTSEHYACMVDVLARAGQLTTAYQFICQMPTEPTASMLGALLSGCINHRNLALAEIVGRKLIELEPNHDGRYIGLSNMYAVDKRWDDARSMREAMERRGVKKSPGFSFVEISGVLHRFIAHDKTHPDSEETYFMLNFVVYQMKLSCHEDNQERSLNDTSMEDDLLLF

SEQ ID NO: 199684 - protein, 77 aa, Glycine max
  Coding DNA Sequence Number=SeqID_82906
  Homolog annotation: Hit_ID=Q9SFU0; Match level="QueryCoverage=96%, HitCoverage=7%, E-value=6e-19, Identity=54%"; Hit description =Protein transport protein Sec24-like At3g07100
MVTLKDNDNEMSRRLKKVLEKFRSTDCAYYQLCHLVRQGEHPKEGFFLLSNLFEDQMGANIGYADWMLQISRQVQQA

SEQ ID NO: 199685 - protein, 130 aa, Glycine max
  Coding DNA Sequence Number=SeqID_82907
  Gene Ontology: Mol. function=zinc ion binding; Cellular component =endoplasmic reticulum; Biological process=ER to Golgi vesicle -mediated transport
  Homolog annotation: Hit_ID=Q9SFU0; Match level="QueryCoverage=97%, HitCoverage=12%, E-value=2e-25, Identity=53%"; Hit description =Protein transport protein Sec24-like At3g07100
  Pfam annotation: Domain name=Sec23_trunk; Domain location=5-130; Score=-122.4; E_value=0.0028; Accession=PF04811.5; Description =Sec23Sec24 trunk domain
MVRPPMLPVYFFLIDVSITAVRSVMVEPASTENNNYCIPANQSLLPNAAITDPHAQQKKERRGGIRPLGESTHLDDIFVPLPDYLLVNLSESRSVVETFLDSLPSMFQDKVNLESAFGPALKAAFMIMVC

SEQ ID NO: 199686 - protein, 865 aa, Glycine max
  Coding DNA Sequence Number=SeqID_82908
  Gene Ontology: Mol. function=protein kinase activity; Cellular component=cell surface; Biological process=protein amino acid phosphorylation
  Homolog annotation: Hit_ID=Q1SHY1; Match level="QueryCoverage=92%, HitCoverage=100%, E-value=3e-48, Identity=44%"; Hit description =Protein kinase
MCPEAFAGMPYGYKSDMWSLGCCMFEIVAHQPAFRAPDRAGLINKINRSSISPLPIVYSSTLKQLIKSMLRKNPEHRPTASELLKNPHLQPYVLRCRNASSIFLPVHLINSNSKDKTKNKSSGSKDHWDKEAELAGLVNRLDQLYPLEGNGDVQIRNWHNDGKLAVSTITEDNLETKMVDLTSYTAEFSTSISGSKDGSTTSESTVYSVCKEGDFKNRLTRDSADCEITSKSTMDSVHEDQGLDGHKSYAIDINMVINKVEDTLSNEDFNTDEALSEGAKPEDSSKSIMSSEDSNGNDKDEFIDEITSKGTLDSVHEKQGFTAEHFQNSDVIDTSAVSTKVEDNFFNEDRTEAERENAKPEDSRKSIVSSENSGGNDNDGSINEITSKSMLDSVHEEQGFTAEHFPKSDVIDTNAVATKVEDNFSNEGFDQTETERENAKPDDSRKSVVSSENSDGNDNDGSIDEKTSKSTLDSVHEEQGFTAEHFLNSDVIDTNAVASKVQDNFSNEGFDQTETERENAKPDDSRESIVSSENSDGNDKDGSVDETTLKSTLDSVHEEQGFIAEHVQMLDVEIDAAASKVEDKFSNDGFDKAEAQREDAKLESSSKSIISCKNSNGNDEDGSGYEITSNSMLDSVGEEKRLSAEYFQKSDAIDINAETTEVEDKLSKEGFDRAVTQEKDDKPEDSNNSLSSEDSNSNDKDGSIDEERSSPIAHAVKVEHDTDTGNRLKENKNPEAFTEGSHMDSLACESNETRPGKDEGQADTRTISCSMHKEVDNAVMADKTPNGVPSRTHISRGGDNTCHQRADALESLLELCAQLLQQGQLEELAAVLRPFGEDAVSVSSRETAIWLTKSLMASQKLHPET

SEQ ID NO: 199687 - protein, 340 aa, Glycine max
  Coding DNA Sequence Number=SeqID_82909
  Gene Ontology: Mol. function=helicase activity; Biological process =viral genome replication
  Homolog annotation: Hit_ID=Q9LTU4; Match level="QueryCoverage=99%, HitCoverage=32%, E-value=2e-75, Identity=38%"; Hit description =Helicase-like protein
  Pfam annotation: Domain name=DUF889; Domain location=67-256; Score =157.3; E_value=4e-44; Accession=PF05970.5; Description=Eukaryotic protein of unknown function (DUF889)
MFFLYGYGGIGKTFMWKTLASALHSKGDIVLTIASSGIASLLLPNGRNAHLKFAIPMPTLDNSTCNIHQGYFRKIIPVIPRGSRSNIVHATINALYLWDYCTVLKLTKKLCLHPNSTMRNAQEIKTFSQWLIDVGDGKLGKAIVNHTYPDIQQMYKDEDFLKSRAILASTNEIIDQINEYVLNIILGEEREYFICDSIDMTDVVNLDQAEGLCHGIRLIVSRMTNHVIEAQIIYGGNIGSLVYIPRMSLSPSQSPWLFNMTRRQFPFIVSYAMTINKSQGQSLESIGLYLPQPVFSHGQLYVAFLRVQSKNGLKILIRDKKGKPQNITTNVVYKEVLQNL

SEQ ID NO: 199688 - protein, 132 aa, Glycine max
  Coding DNA Sequence Number=SeqID_82910
  Gene Ontology: Mol. function=DNA binding; Biological process =regulation of transcription
  Homolog annotation: Hit_ID=Q7XIF1; Match level="QueryCoverage=48%, HitCoverage=19%, E-value=6e-11, Identity=58%"; Hit description =Putative cytoskeletal protein-like protein
ILPSRIGKSGVLFLIGLFAAVATPKQIRELMQVVGLTNDEVKSHLQKYRLHFKRPQGSSIGHANSGLCKMAQDKCGDDKSGSPQGPLFLGGSGKGLSSSGRNSMDTEGDEESDCRNWKGGIHHQLQPESDVL

SEQ ID NO: 199689 - protein, 91 aa, Glycine max
  Coding DNA Sequence Number=SeqID_82911
  Homolog annotation: Hit_ID=Q9SH74; Match level="QueryCoverage=91%, HitCoverage=19%, E-value=3e-07, Identity=36%"; Hit description =Putative replication protein A1
MVYDFTLFDDVLAGSVNPNYLIDVIRELVDVFQWSLDGKPKKVVFTMKDKCGTIVSCTLWEDFAFLLKDYLDKHENESVILLLHLAKIKEA

SEQ ID NO: 199690 - protein, 51 aa, Glycine max
  Coding DNA Sequence Number=SeqID_82912
METTCKESLARAQDESTKISETITNAKSKVRHFDNCSLVDGFFHGNDFRIV

SEQ ID NO: 199691 - protein, 1329 aa, Glycine max
  Coding DNA Sequence Number=SeqID_82913
MELALALEWDDQVREGVLKKLKLWQQRNNKPPTAWVTELVEHFNTLGIALPCPELGELLVSQICFDNNHPLIWKFIHHALSSRLLFPLQILSLLSSNVLRHRHSHPHAFALFLPLLAQHAFSFLPTLSNNLKMVNSVDAVMRFSETYKIRDLELGHVFVLFFYDIVVALIDCVLIDWGFQVTFSEKSRLVTGGGGGDDEEDYMEIDRNMTTMTQSFEKSEQIRKRNSFTALEVLERLTESRKATILLQSVLLNMPEKFNCLQQRLQFLESLELASSELKSVNQVLTKVSASIRGVSRFDYCLRKHQLVGMLKASLRCNYRFCQSPCWVPFDIYMENAMDSRQIPTKSAIDVLTEAIKTLQILNQASWQETFLALWLSALRLVQRVETGPIPHLVARLCVLLCIVPLAIANVLRDDSEHNSSSVQVSMESEYRHEMKSGSSMKLGLISSVQVLGHFSGLLCPPTLVIDAANQAARKAASFIYNTMNGKGESGTGIHANTNTKAGGNLRHLIVEACIARNLMDTSVYFWPGYVSTSVLSLSDSSPLEKSPWSIFMEGTPLNNTLINSLTVTPASSLVEIEKLYYIALNGSDVERPAAAKILCGASLSHGWYIQEHVVHHVVKLLASPVPPSHSGSQSPLVNNMPMLCAVLRGTSSIDTIHILSLYGVVPAVAASLLPLCETFGSIKPTSNSTGDESSSTSTSTSTYMTFSLAFLFLIRLWKFCRPPLDLCITELGVAVGGLEYILSLHNNRAMFSQDKLKSNPSLSDSASVKPVYIDSFPKLRALYCQYKSCVASALSGISTGNSIHQTANMILSMIYQKITKGGISSSNSSSPTTASSNACSSLMNSGEDNFQRPLLPAWEVLEALPFVLESILTACVHGRISSRELTTGLRDLVDFLPASLAAIIDYFSSEVTRGVWKLVPMNGTDWPSPAALIQSIESEIKAILTHVGVEVPNRSSGGSPVMLPLPMAALVSLSITFKLDKSQEYMHAITGAALENCASGCPWPSMPVIGSLWAQKVRRWHNFIVVSGSRSVFRHSNECVAQLLRSCFTSFLGTLCVSTSKLTAECNVNGLLGSTITAPGPYPFVAPGFLFLRSCRNIHNVQYVNDIIVGLVTEYSNELAGRRTGASSRHIKSNEVSLSLSAQSAKEVATLGASLLCAAGGILLVQELYKETIPTWLLSSRDVKQNNDSVGSYILEGYAMAYLLILSGSIIWGVGTKLPSGTFNRRKRTIEVHLDFLAEVMEKKISLSCNPITWKTYVCCLVGLMVSLAPAWVQEVKVDTLRKLARGLSRWNEHELALSLLHRGGTAAMGALAELVNVIESEHMLPCS

SEQ ID NO: 199692 - protein, 491 aa, Glycine max
  Coding DNA Sequence Number=SeqID_82914
  Homolog annotation: Hit_ID=Q2QQD3; Match level="QueryCoverage=90%, HitCoverage=88%, E-value=1e-150, Identity=62%"; Hit description =Expressed protein
MEGRRRGGYSGRRIVASRRGSGKSNANNNNNNNNKNNNNINVIKKLQSREIWSKPHRAFASVTASHRFRSMCLTHQYDTHDPSKTPSSLWPFLMKRTKVVEIVAAKNVVFALYHSETMKLGFVCEFQAETDERICFLNVCPDEIIRSLFYNKNNDSLITVSVYASENFSSLKCRYLRRGKPDAGFPLFQSESLKWPGFVEFDDVNGKVLTYSAQDWYLPHFLVFLFHFYCYVFDLKNYTMLYSILDRNVQEIKISPGIMLLIYNRTSGHIPLKIISIEDGTVLKVFNHLLHRNKKVDFIEQFNEKLLVKQENENLQILDVHNSELMEVSRTEFMTPSAFIFLYDNQLFLTFRNRTVSVWNFHGELVTSFEDHQLWHPDCNTNNIYITSDQDLIMSYCKADSDDQWIEGTAGSINVSNILTGKCVAKIIATSSSAKADECSSSGCSCKQSDSCLMRNSVAEALEDITALFYEEDRNEIYTGNRHGLVHVWSN

SEQ ID NO: 199693 - protein, 391 aa, Glycine max
  Coding DNA Sequence Number=SeqID_82915
  Gene Ontology: Mol. function=oxidoreductase activity; Cellular component=integral to membrane; Biological process=electron transport
  Homolog annotation: Hit_ID=Q9ATV0; Match level="QueryCoverage=89%, HitCoverage=70%, E-value=1e-60, Identity=35%"; Hit description =Putative cytochrome P450
  Pfam annotation: Domain name=p450; Domain location=77-391; Score= -106.2; E_value=3.9e-06; Accession=PF00067.12; Description=Cytochrome P450
MYKSKWLSQRVEMDVEGQWQISQREICWSMMFIASWSIIVLLYVKLWYRSQRIRSVLQKQGINGPKPSFPFGNLSEMQQLNQGAPVSLEALDKWAFSLYPFFHTWRQRYGPVFMYSTGTKQHLYVEIPELMKWIGLNTSLDLGRPSHLTKTLKPLLGDGIIMSNGLHWAFQRNLLVPEFFQSKIKNWVDIMGESTMAIIKKWESHITESEGGITELVIDGDMKTLTADVISKVCFGTSYALGNLIFAKLASMQAILAKSSVLFGFLNLRFLPTKENKELWKLQKEVETMILKVIKDREGENQKSGTHENEKDLLQIILEGAANATTGTSGKGYESSALAIIWTLLLLALHPEWQQRIRSEIMETYDNTVPHSFLDMDKLRNLKAVSTTLLF

SEQ ID NO: 199694 - protein, 235 aa, Glycine max
  Coding DNA Sequence Number=SeqID_82916
  Homolog annotation: Hit_ID=Q1STP6; Match level="QueryCoverage=82%, HitCoverage=100%, E-value=2e-49, Identity=51%"; Hit description =Harpin-induced 1
  Pfam annotation: Domain name=Hin1; Domain location=69-211; Score =68.1; E_value=2.8e-17; Accession=PF07320.4; Description=Harpin -induced protein 1 (Hin1)
MYYVYEAELWRNSKFVPCDWLVMGSNLKTVSLHRSTLGTMKKGSGCKGSIVCLMVTLCVVIALVLLGVILAMTVFKPRHPITNVDSVRLQNMSLDMDIFSMSVNVNLTLEVDVSVNNPNKLGFNYYNSYAQLNYRGQLIGEAPIPNGHILAEEIKGLNSTLTVMADRLVSNSEVTKDVALGLLPLNSLVRIFGQVNVLGFIKFYVASTSSCDFTLNLSNRTIVDNKCQEKTKISG

SEQ ID NO: 199695 - protein, 407 aa, Glycine max
  Coding DNA Sequence Number=SeqID_82917
  Gene Ontology: Mol. function=oxidoreductase activity; Cellular component=integral to membrane; Biological process=electron transport
  Homolog annotation: Hit_ID=Q9ATU9; Match level="QueryCoverage=91%, HitCoverage=70%, E-value=9e-71, Identity=38%"; Hit description =Putative cytochrome P450
  Pfam annotation: Domain name=p450; Domain location=68-407; Score= -118.0; E_value=1.3e-05; Accession=PF00067.12; Description=Cytochrome P450
MEAEGQWQISEREICWSVVFIATCSIIILLYVKLWYRPQRIRSVLQKQGINGPKPSFPFGNISEMQQLPNQLAPVSLEALDEWAYSIFPYFHTWRQLYGPMFMYSTGTNEHLYVETPELVKWIGMHKSLHLGRPSYLTKTLKPLLGNGIIRSNGLHWAFQRNLLAPEFFHSKIKNWVDIMEESTMAINKKWENHITESEGGIAELVIDGDMKALTADVISKACFGSTYAQGNLIFAKLASMQTALAKPNHIFGFLNLRFLPTKENKEIWKLQKEVEAMILKMIKEREAENQKSSTHGNQTQKDLLQIILEGATSATSTESSGKGIFGPGYNIYQSIVDICKNMYFAGSESTALAITWTLFLFALHPEWQQLVRSEIMETYGNMLPHSFRDMDRLRNLKAVSTTTPLF

SEQ ID NO: 199696 - protein, 126 aa, Glycine max
  Coding DNA Sequence Number=SeqID_82918
  Gene Ontology: Mol. function=oxidoreductase activity; Cellular component=membrane; Biological process=electron transport
  Homolog annotation: Hit_ID=Q2QYH7; Match level="QueryCoverage=92%, HitCoverage=25%, E-value=3e-22, Identity=41%"; Hit description =Cytochrome P450 family protein, expressed
MVIQESLRLYGPAVTTARGVLAEMKLGEHVLPKGINMWLYIPALHRDPDNWGPDAREFKPERFAGGVSAACQNFALLEIKEALCLLLSNFSFAVSPNYHHCPQYRMLLTPKYGMRLLVSKVHKTRT

SEQ ID NO: 199697 - protein, 86 aa, Glycine max
  Coding DNA Sequence Number=SeqID_82919
  Gene Ontology: Mol. function=pyruvate kinase activity; Biological process=glycolysis
  Homolog annotation: Hit_ID=Q1RYJ8; Match level="QueryCoverage=83%, HitCoverage=12%, E-value=2e-12, Identity=53%"; Hit description =Pyruvate kinase
  Subcellular localization annotation: CTP_CleavageSite=60; ConfidenceScore=5.51e-01
MVQVVASRSIQSTPLCPISGFAHDKTQNLLKPSSFASKVFPLVENNNKHSKLNLRSLQISARKSSPSEVIPMSPEDDPKVRAFCIF

SEQ ID NO: 199698 - protein, 424 aa, Glycine max
  Coding DNA Sequence Number=SeqID_82920
  Homolog annotation: Hit_ID=O04342; Match level="QueryCoverage=79%, HitCoverage=83%, E-value=5e-52, Identity=40%"; Hit description =Expressed protein
MAYRRRQGISRSSTFKEEFHDPSLEDVHVKDSNHDNASPSIFSSSSSTPASSLAAQAIKATASRHQPSLSFAFAPAESDHQRSKSFEAYGNGNSKSGFWGVIAQKAKSILDDDKPTPQHDTMPQTHTLKSHSFNTCSGPSAAQNSPSQFKPVYESLDSSRKMDNPKFRKGLDKITTSLNQLGDTFEKAFEEGRTIMESKKADLRTQIRRKGNNSGDTNLTSDMRNPLQEATQTQNQSSHETKLKASRDVAMATAAKAKLLLRELKSVKADLAFAKARCTQLEEENKVLRDREGSDKGQNREDDDLIRHQLETLLAEKARLASENETYSRENRFLREIVEYHQLTMQDVVYIDEGMGEVSEVYPVDDSGITRLLSVSPHSSDEDVLVSPSPPMLSKEIFTVPEEDSKSISEDDAPSAVSVSPHTK

SEQ ID NO: 199699 - protein, 559 aa, Glycine max
  Coding DNA Sequence Number=SeqID_82921
  Gene Ontology: Mol. function=metal ion binding
  Homolog annotation: Hit_ID=Q2QYH9; Match level="QueryCoverage=94%, HitCoverage=95%, E-value=2e-63, Identity=31%"; Hit description=Zinc finger, C3HC4 type family protein, expressed
  Pfam annotation: Domain name=zf-C3HC4; Domain location=373-413; Score= 42.7; E_value=1.3e-09; Accession=PF00097.15; Description=Zinc finger, C3HC4 type (RING finger)
  Pfam annotation: Domain name=zf-RING-like; Domain location=373-413; Score=2.6; E_value=0.072; Accession=PF08746.1; Description=RING-like domain
  Pfam module annotation: Pfam domain module=zf-C3HC4::zf-RING-like; Domain location=373-413::373-413
  Subcellular localization annotation: CTP_CleavageSite=20; ConfidenceScore=5.26e-01
MAANFGNILFTSSQSSSQVHGATDSVQVAVCSLCQKALSPDNEMASDLASSGVCGDCKFLLLEDFGNHTLTQSSRWRLRGRFRHNSSESVENNFSQQIPHVVNTVRQHQSAASGEDDQLVDGDTPAWSLQYASAHTTPSGSRRWRQVLSDTDSDGFDNWNSLYGENESSASFRQYRLPHGETDSFSHSAYGGDSDISMDTHSFVGTRVLNFPDEGDEFDSDTDIDPMHAGLSQWISTDEDNEEEEEEEEEEEEEEDREWELAEAEEAEATSHLQIFFTSSPSESRDHINSTESGGMFSQIIRETWHAFEDVDLPHGANFGDYLDARGFEDLLEHLAENDSSRRGAPPAAVSFVNNLPRVVIGKENEKHGELVCAICKDVLTPGTEVNQLPCSHLYHNNCILPWLSARNSCPLCRYELPTDDKDYEEGKQNIDSRNVIHERQRIDVTDDSSSDVSDGDEVNEETGSSQGGIQQRLLSSGSTMNSSATRSGRGRWFFLAAAPIVSLVGIVLVLWLGNNNSQIEGSRHLGGHYLSGQNQHTIHAYSSPNQREGRSRGWWCPF

SEQ ID NO: 199700 - protein, 99 aa, Glycine max
  Coding DNA Sequence Number=SeqID_82922
  Homolog annotation: Hit_ID=Q9M508; Match level="QueryCoverage=30%, HitCoverage=6%, E-value=4e-07, Identity=90%"; Hit description=Beta -ketoacyl-ACP synthetase I
MIITRFFGSFCRCAVDTFGATVADTKNTRFAEVRVQGRTVEGDDHGRTGGAVEREYSRAGIVRRSLDGAATYTGGSRGGLGVGDGEDRRRGRERMEGIL

SEQ ID NO: 199701 - protein, 255 aa, Glycine max
  Coding DNA Sequence Number=SeqID_82923
  Homolog annotation: Hit_ID=Q1SCU4; Match level="QueryCoverage=22%, HitCoverage=14%, E-value=1e-11, Identity=63%"; Hit description=Zinc finger, BED-type predicted; HAT dimerisation
  Pfam annotation: Domain name=hATC; Domain location=8-88; Score=46.2; E_value=1.1e-10; Accession=PF05699.5; Description=hAT family dimerisation domain
MTEKMMITFDKYWVVIHDIMGVVTVLDPRSNGLKYPTLQAIAKDILAIHVSTVASEYAFSTSGQILSLHHSQLHWTTLEALICTRCWLLSTETDGDNASDMMGSDLITHLEERILHEIYVEAKLHDESRLIQRCFDDNKGDDKKLKGQSKNEFKMFKIESRTLQDSRGKLISRINNQDSRIKLPRIKIKIQESREDLIKISIKRGYIYLGLTENKRGYISCGSVLVEGTSSMFKENRGGYIPCGSLLGIVHPCVE

SEQ ID NO: 199702 - protein, 75 aa, Glycine max
  Coding DNA Sequence Number=SeqID_82924
MKEGLGFGVMDGEDEELGEKLERERERETKMGWVQDKRQTIQEKERSNHFGCYTCSMLYPPPINICHFISYENIQ

SEQ ID NO: 199703 - protein, 41 aa, Glycine max
  Coding DNA Sequence Number=SeqID_82925
MGLALVFGNDMEGYYEKLLGGESDITAPAAVLRPLTNDYLQ

SEQ ID NO: 199704 - protein, 45 aa, Glycine max
  Coding DNA Sequence Number=SeqID_82926
MRQTCFWHINDAAAVQGHSSDNKETPTKQGYICKYQGPEIRVERV

SEQ ID NO: 199705 - protein, 34 aa, Glycine max
  Coding DNA Sequence Number=SeqID_82927
MTPLHFADMLISPNQTSRFEGPEQADSWGIGSAS

SEQ ID NO: 199706 - protein, 324 aa, Glycine max
  Coding DNA Sequence Number=SeqID_82928
  Homolog annotation: Hit_ID=Q84YF3; Match level="QueryCoverage=86%, HitCoverage=88%, E-value=3e-53, Identity=43%"; Hit description =Hypothetical protein 4B
  Pfam annotation: Domain name=DUF1191; Domain location=33-316; Score =357.8; E_value=1.8e-104; Accession=PF06697.3; Description=Protein of unknown function (DUF1191)
MELLLPSLVMVFALVLCFESLPSVRVQSSTTSPGSSSKREEAKALDALLQQYAYRALVNPKTGIIYNATHLPSNLTEIEVAALRLRSGSLRRKGFQAYNEFEIPKGLIGSPYVERLVLVYQNLGNWSSRYYYPLPNYTYLAPVLGLLAYDGSNLSVTSLSELDIDASEGPILVKFRDVKQAPHGAVAKCVWFDLQGSSNFSNVTGGNTCSTTQQGHFSIVVKSTAPLAPSPTPAGAAPKGEGEKGNNKKVWIIVGSVVGGLALLVLLSLLVLWMSKYKQKKRMQQMERAAEVGEPLQMASIGDTKAPAATVTRTQPTLEHEYAP

SEQ ID NO: 199707 - protein, 84 aa, Glycine max
  Coding DNA Sequence Number=SeqID_82929
MGGNLKFVISDTREVKDSFRITNFRTARVTIRLQRTKSDNDSDVAVPREVAMLTVTELECRERLQIRVRKRLSENDESERFQSY

SEQ ID NO: 199708 - protein, 182 aa, Glycine max
  Coding DNA Sequence Number=SeqID_82930
  Gene Ontology: Mol. function=RNA binding
  Homolog annotation: Hit_ID=Q9ZVI3; Match level="QueryCoverage=86%, HitCoverage=38%, E-value=5e-39, Identity=59%"; Hit description =Putative RNA-binding protein
MSGLYNPNFSPARAASPQIRSNPEVDSQYLSELLAEHQKLGPFMQVLPICSRLLNQGLALPVCGSITSCFCTLVVYGGMFGVCSQRKELNVPDLKCLAWLFMFGEELEILRVSGMLSNQGFGDFDRLRHRSPSPMASSNLMSNVSGTGLGGWNSLQQEYHKMRRFTATALARSSLLFFKAVS

SEQ ID NO: 199709 - protein, 93 aa, Glycine max
  Coding DNA Sequence Number=SeqID_82931
  Gene Ontology: Mol. function=glutamate decarboxylase activity; Cellular component=membrane fraction; Biological process=carboxylic acid metabolic process
  Homolog annotation: Hit_ID=Q94KK8; Match level="QueryCoverage=63%, HitCoverage=12%, E-value=3e-27, Identity=93%"; Hit description =Glutamate decarboxylase isozyme 3
MAQEAQKFLSWMKNKHGGKLDNRLPLVKSINVSGHKYGLVYAGIGWVIWRTKDDLPEDLVFHINYLGADQPTFTLNFSKGDLIHYKVCTFLDP

SEQ ID NO: 199710 - protein, 56 aa, Glycine max
  Coding DNA Sequence Number=SeqID_82932
MARLSSATSLILALVIFTSEISKGKGNENATCWEDMLFVIGGGCPDLNECPETCRP

SEQ ID NO: 199711 - protein, 234 aa, Glycine max
  Coding DNA Sequence Number=SeqID_82933
  Gene Ontology: Mol. function=DNA binding; Biological process =regulation of transcription
  Homolog annotation: Hit_ID=Q1EPE4; Match level="QueryCoverage=95%, HitCoverage=70%, E-value=3e-15, Identity=28%"; Hit description=Myb DNA-binding domain-containing protein
MEVSLDLSLAFVPRRTVCEILGDIAKSKDGSRRMATIEDLVKRLEDEKKKIEAFKPISKLKEEIKGGVRMKDEAVVEELMKLMKTNSEANGSLMIVGNESSDTKNWMNSVQLWNVETKQRNEEGDLFVPSNPIEQKNDTNKSVSKTVMKDNKKMSQVPSLGLMSPAVLELNHRKTESGYGHGSSMIITSSVEIKGHHQSQQPQQNPRKQRRCWSPDLHRRFVDALQQLGAHKLD

SEQ ID NO: 199712 - protein, 97 aa, Glycine max
  Coding DNA Sequence Number=SeqID_82934
MNVEMQRSISNHKMQNIGDAIPNSCKDLAKQVLTMLELVNNIIKHQTLMLIHPVLRLGFRCIYDNEDSAKSELPCLDGDWCMLGYVLEDETIGDGMR

SEQ ID NO: 199713 - protein, 120 aa, Glycine max
  Coding DNA Sequence Number=SeqID_82935
  Gene Ontology: Mol. function=RNA-directed DNA polymerase activity; Biological process=RNA-dependent DNA replication
  Pfam annotation: Domain name=AT_hook; Domain location=60-72; Score =14.9; E_value=0.061; Accession=PF02178.9; Description=AT hook motif
MCGKTRQDKIRNEAIRERVGVAPIVEKMVENRLRWFGHVERRPVDSVVRRVDQMERRQTIRGRGRPKKTIREVIKKDLEINGLDRSMVFDKIYHLRVTSSNSVSGGTVFVKGNFDLSQTH

SEQ ID NO: 199714 - protein, 68 aa, Glycine max
  Coding DNA Sequence Number=SeqID_82936
MAPYGRFIANILIAVMFVCLFFVTNIVAQDSEIAPTGQLEAGTGFDLPVSKELQLQVCNFYSAIIGVS

SEQ ID NO: 199715 - protein, 72 aa, Glycine max
  Coding DNA Sequence Number=SeqID_82937
  Gene Ontology: Mol. function=binding
  Homolog annotation: Hit_ID=Q2R0N3; Match level="QueryCoverage=78%, HitCoverage=10%, E-value=1e-08, Identity=42%"; Hit description =Armadillo/beta-catenin-like repeat family protein, expressed
MRVGRQPLPCFPLQWVIVNLTFPASPGAFGRIVKLLNVGIVSQIKKMVNDPCIDVKLRARQALGQIITSGDS

SEQ ID NO: 199716 - protein, 90 aa, Glycine max
  Coding DNA Sequence Number=SeqID_82938
MVVRRQVLVGVVVNDGGKQGLKENEEELGVNEENEEEFGVHQHVNCSDTLNTSQARSVASDIGFVAVIMRSDHSCQDRPSGAERLTPKLG

SEQ ID NO: 199717 - protein, 262 aa, Glycine max
  Coding DNA Sequence Number=SeqID_82939
  Gene Ontology: Mol. function=zinc ion binding; Biological process =regulation of transcription
  Homolog annotation: Hit_ID=Q0GLD6; Match level="QueryCoverage=98%, HitCoverage=81%, E-value=1e-33, Identity=38%"; Hit description=Dof16
YWTKGGSLRNVPVGGGCKKNRRGNKTLLRQSIDGFTFKNSSPPCGYATDHNNNPLGHSYDPRIRASSASSSSSVVTDGPNIDLALVFANFLNQKPNSSEGGVESSTNPDQEQTVFDPSLENNSRLSNTDVVGPSTLPEELGLTGCLNLPEQQPHTHSSEANNNNNQMCYGEFNTMQTLQKDGIEQYSSHGGAMNFELPPLPGEGEASHDHHMMWSNSEMMINHHAFQVTQPPLLGLEVHDADLLIGNWSPFDSPKDTSFSRP

SEQ ID NO: 199718 - protein, 84 aa, Glycine max
  Coding DNA Sequence Number=SeqID_82940
MLLRRNYEGRIIGSILYKILELSFEDFTPIKVFLPCGGPMASGGGSWRSLMVVGGEGGGLWFLVRVWEKERGEKRVLFTLLSYL

SEQ ID NO: 199719 - protein, 58 aa, Glycine max
  Coding DNA Sequence Number=SeqID_82941
  Homolog annotation: Hit_ID=Q5XLE2; Match level="QueryCoverage=47%, HitCoverage=26%, E-value=1e-07, Identity=78%"; Hit description=Brain protein 44-like
MDTRLRVISDPMNGVQQIVAPILYGLLRAFWNSPAGPKTTHFWGPIANWGFVAAMYWE

SEQ ID NO: 199720 - protein, 64 aa, Glycine max
  Coding DNA Sequence Number=SeqID_82942
MTFKKSFRFENAWLLEDKLENVVNEEWNVEERRKKFRLEVDGLKRELERCKNFDDVDLVTRVNS

SEQ ID NO: 199721 - protein, 90 aa, Glycine max
  Coding DNA Sequence Number=SeqID_82943
MELQMHAYMQHLADQQAANHWGQMQLNDSFYQYTLHQNRQDPNPYPWPTPEQFREEAGSTDAQGTAQGDEGGAEDDGDMAELLDFFIRGG

SEQ ID NO: 199722 - protein, 143 aa, Glycine max
  Coding DNA Sequence Number=SeqID_82944
MMLIEGTKIKVKVENKDGWENNIDIDTLASMRSFNGDFPPWRCSGRQWRRGERRRHPLGNKPWKKELHHQDEPWIRSLEGCFNGGKERGRERERGEHEIEGIKEGDKWNFEVCLTRLSFIKVTTSTVTHASIYRLGSFLEKLS

SEQ ID NO: 199723 - protein, 59 aa, Glycine max
  Coding DNA Sequence Number=SeqID_82945
MMAPKKLPAKRFRKTITGEGSSSAPPVEIEFDGHHFQSEEHQRRFEMIKDWYFLKERRV

SEQ ID NO: 199724 - protein, 134 aa, Glycine max
  Coding DNA Sequence Number=SeqID_82946
  Gene Ontology: Mol. function=oxidoreductase activity; Cellular component=cytoplasm; Biological process=metabolic process
  Homolog annotation: Hit_ID=Q9LRE9; Match level="QueryCoverage=74%, HitCoverage=20%, E-value=8e-34, Identity=67%"; Hit description =Cytosolic aldehyde dehydrogenase
MKTNSVQFHEPIINPKNFPNIIFYIKVAPSLVVGCTMVLKPTEQTPISTFFNAHLAKLVGILDEVINVVPGFGPTVGATLSLHMDVDKVSFTCSTQIEREIMQVAAKSNLKQASLELGGKSPFIIFLKVHKCIG

SEQ ID NO: 199725 - protein, 83 aa, Glycine max
  Coding DNA Sequence Number=SeqID_82947
MGLYIQDDYSTRLVALGKVYEGVSIIHNVPYAYDVVNVSVGKFMRVMLKSLFPCQRIHRFIQRNKLNMFIGRISLVELIPWVT

SEQ ID NO: 199726 - protein, 90 aa, Glycine max
  Coding DNA Sequence Number=SeqID_82948
MVSCIDSLSLSKAKDRHDECQHYIKTWVKESQREVYRGAYLNHLLLSNSGAIGSLSLCVLGTISLSGSVPYCFGDGTPLDIETIKTIYKK

SEQ ID NO: 199727 - protein, 116 aa, Glycine max
  Coding DNA Sequence Number=SeqID_82949
  Gene Ontology: Mol. function=phospholipid binding; Cellular component= coated pit; Biological process=endocytosis
  Homolog annotation: Hit_ID=Q69SJ3; Match level="QueryCoverage=52%, HitCoverage=11%, E-value=1e-14, Identity=64%"; Hit description =Clathrin assembly protein AP180 short form-like
MSSGDLLGNQAGGLDNRTLDSLYNDALRRNNQNASYDPWEPALGGNMMQPTMHNPFFASNTIAAPPSVQMASRKKPFGVGKGHPGELELAQASWLLSPEGNSSPRRAGARPGELVT

SEQ ID NO: 199728 - protein, 133 aa, Glycine max
  Coding DNA Sequence Number=SeqID_82950
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=85%, HitCoverage=11%, E-value=9e-33, Identity=58%"; Hit description=CTR1 -like kinase kinase kinase
MLKLQLRCIKFIHASQNYNALGYDDKISDGFYDLYGILTEATSARMPSLVDLQGTPTSDDVTWEAVLVNRAADSNLLKLEQEAMEMAVNSRKDFEVLLDSDLVHKLAIVVAEYMGGSVEDHESMLRAWRSVIT

SEQ ID NO: 199729 - protein, 145 aa, Glycine max
  Coding DNA Sequence Number=SeqID_82951
MAFGIRAQKWKRQESCEDNNKERAEAKTTETRSKWEKVGATKHDPLEKREGHKYYYFTFPEKKLKGGGSWKTTNLISLSSSSSSLLNPYLNFQIEVVLVLVVNCSEMAYRMNKLEKNNMVALSLQLLLFQANPIFVLSDMQSKGL

SEQ ID NO: 199730 - protein, 36 aa, Glycine max
  Coding DNA Sequence Number=SeqID_82952
MPPWKAHVALGLYHRGNGGILGRRGIGQGGNPILAK

SEQ ID NO: 199731 - protein, 74 aa, Glycine max
  Coding DNA Sequence Number=SeqID_82953
  Subcellular localization annotation: CTP_CleavageSite=44; ConfidenceScore=5.20e-01
GTYLRDLHGVASKPPLSMASLLCNAHVAWKSLPRVTSCLQVEVATMTGESGPGFGNRQSNWRVGFRGLQARVQA

SEQ ID NO: 199732 - protein, 185 aa, Glycine max
  Coding DNA Sequence Number=SeqID_82954
MVEKKKFDHIEERLGDIEGGDIEGGEDYAFADMAELCLVPNIVIPPKFKVPDFDKYKGTTCPKNHLKMYCRKMGAYAKDEKFLMHFFQESLAGAAIIWYTNLESSRMVGYMPSSFAHLVFAGERIKVGLRMGKFDYVALTSFGNRRPGAGGAKKNEGDAHAMTAIPTWPSSPQTPHNPMYQYPPH

SEQ ID NO: 199733 - protein, 112 aa, Glycine max
  Coding DNA Sequence Number=SeqID_82955
MGKWGEDSTHHFVIRAPNPVGPEWHKQDGSKIGREGKENSKCPLGKSLSQRYPKVQMIFPTLSHPPLPDIFSPLPLIAYSFAITHLEHSSTRSTTCDLHRCNASNNHPPVQD

SEQ ID NO: 199734 - protein, 243 aa, Glycine max
  Coding DNA Sequence Number=SeqID_82956
  Homolog annotation: Hit_ID=Q0IAP0; Match level="QueryCoverage=40%, HitCoverage=66%, E-value=5e-15, Identity=42%"; Hit description =Uncharacterized protein
MMHVLLVENCVEFGSLQTIRAWHIIGRLGGCNAMNMQLSQSPMDARPSYDYIQGANVEPTTFYNIGDLEVQDNLARIWVDIGTVEPLLLNVLINALTQISSDFVGIKQVMFGGSEFENWNENLKSEDAVYQESFLQGQQLIAMLSVNCNFTERWWEAHKHTLGSMEYQVCHFNATEHEVIIFIETRNVEGTLATYLIRIYKSPWQAKTSSRPWEHEFLSPRKPNTMITGGDYLETKVIIMVLE

SEQ ID NO: 199735 - protein, 138 aa, Glycine max
  Coding DNA Sequence Number=SeqID_82957
MVPRLALSYARTRTFSCSARNRLKDLNGRDFSIDIVNENLELEDDGGDDGFSARGLYARSEANDTDEEEAQKDGDGGYSGSPGKDYDRDPELGNILGSFLENPQEAQSKLEDRLRKKRSKILHTKTGSGKPMKVSFNK

SEQ ID NO: 199736 - protein, 276 aa, Glycine max
  Coding DNA Sequence Number=SeqID_82958
  Gene Ontology: Cellular component=cytosol; Biological process=cell cycle
  Homolog annotation: Hit_ID=Q9FM51; Match level="QueryCoverage=100%, HitCoverage=96%, E-value=3e-78, Identity=46%"; Hit description =Arabidopsis thaliana genomic DNA, chromosome 5, P1 clone:MJH22
  Pfam annotation: Domain name=WD40; Domain location=121-160; Score =17.5; E_value=0.049; Accession=PF00400.22; Description=WD domain, G -beta repeat
  Pfam annotation: Domain name=WD40; Domain location=167-206; Score =8.8; E_value=3.4; Accession=PF00400.22; Description=WD domain, G -beta repeat
  Pfam annotation: Domain name=WD40; Domain location=22-64; Score=8.4; E_value=3.8; Accession=PF00400.22; Description=WD domain, G-beta repeat
  Pfam annotation: Domain name=WD40; Domain location=77-115; Score=0.7; E_value=30; Accession=PF00400.22; Description=WD domain, G-beta repeat
  Pfam module annotation: Pfam domain module=WD40::WD40::WD40::WD40; Domain location=121-160::167-206::22-64::77-115
MDIAHCYLKGNADSVDVDVDTGHLDMVFSEETAGIFDIKWSPAGGHASPFLAQADADGYLRIKILGGCCNGVEGANLKEITNGKISNSMCLYLDWNPSATSITVGLSDGSVSIVSLLESKLEIQDEWKAHDFELWTTSFDIHQPNLVYTGSDDCKFSCWDLRDKPPNVVFQSSKVHKMGVCCIEKSPHDPNTLLTGSYDEYLRHHPFIPGLVLAACMHNGFAIVAIKGNNAEVSETYKKHDSLAYGADWQKREANHIGGNTKPLVATCSFYDKLVR

SEQ ID NO: 199737 - protein, 65 aa, Glycine max
  Coding DNA Sequence Number=SeqID_82959
MEFQALDWEMAEKLQEEMKGSGLRVKGMTRGLIRAIKETEKEVVGATATMLSASTTSFFKNEKKV

SEQ ID NO: 199738 - protein, 100 aa, Glycine max
  Coding DNA Sequence Number=SeqID_82960
  Homolog annotation: Hit_ID=UPI00000529F6; Match level="QueryCoverage =42%, HitCoverage=3%, E-value=5e-08, Identity=60%"; Hit description =transcription factor
  Pfam annotation: Domain name=JmjN; Domain location=33-78; Score=36.3; E_value=1e-07; Accession=PF02375.7; Description=jmjN domain
MENTLESSGSPRHRKISARWDSVEACRPIVDEAPEFEDTLSYIAKVRSQVEPYGICRIVPPACWKRKPWGDEPYLDIDGGAQPNERPQCRQSKAPKHNAD

SEQ ID NO: 199739 - protein, 350 aa, Glycine max
  Coding DNA Sequence Number=SeqID_82961
  Gene Ontology: Mol. function=GPI anchor binding; Cellular component =anchored to membrane
  Homolog annotation: Hit_ID=Q9SUC9; Match level="QueryCoverage=71%, HitCoverage=80%, E-value=2e-38, Identity=37%"; Hit description =Uncharacterized GPI-anchored protein At4g28100 precursor
TMTLTLLPPPKSPFLKTLLFLCSTSLLLPDADAVQPIIPNPSSSSTTGTIPAFPEQAEAAGCPLNLSDDHYEAIKSACGSNKPDDDDLHRSRCCPVLAAWLYSAYSATALSASQGHTTSYDMPLLPDDSETCVSDLGKALKVRGIQLFQPNETCDVVYCYCGIRLHPLTCPESFSVTPSGSLVVNQSVKRLARDCSSSSTNVNKFPGLGGCSKCLHSLYSLRKKSSNSSKSEEDRTSKIHNKDCELMGLTWLLAKNRTAYIHTVSGVLRALMLSREGSDPQSCTLNSDGMPLAVDSSEISPSGTRPGNPVMASSDRSDAKSWNSLFLDPSFVKLFLSRIRTMFHTLLLHS

SEQ ID NO: 199740 - protein, 157 aa, Glycine max
  Coding DNA Sequence Number=SeqID_82962
  Homolog annotation: Hit_ID=Q1RSK5; Match level="QueryCoverage=62%, HitCoverage=13%, E-value=3e-12, Identity=37%"; Hit description =Ovarian tumour, otubain
MVKLIYESHNHALTKSLVGHSYASRLTKDEKIIIGDMTKPMVKPKNILLTLKKYNANSYTTIKQVYNASNTHRSSIRGNNTEMQQLMKLLGRDQYIHWHRLKDEGVTCLARVTGLAHDHRLTRSVQQSRLARVLMKVESIPHRAKTRVHAGIWEINP

SEQ ID NO: 199741 - protein, 89 aa, Glycine max
  Coding DNA Sequence Number=SeqID_82963
  Homolog annotation: Hit_ID=Q8LGI2; Match level="QueryCoverage=66%, HitCoverage=13%, E-value=5e-07, Identity=46%"; Hit description =Probable mitochondrial saccharopine dehydrogenase At5g39410
MSKNRVGVMACGQSRVEVASKDDNHFGLHDPLVAYGLNIHHGLKLVGDGEIVKPHNDTSGHDKLAMEVKRACAIEEGRKKLVKGRKQEG

SEQ ID NO: 199742 - protein, 704 aa, Glycine max
  Coding DNA Sequence Number=SeqID_82964
  Gene Ontology: Mol. function=protein serine/threonine kinase activity; Cellular component=integral to membrane; Biological process=protein amino acid phosphorylation
  Homolog annotation: Hit_ID=UPI0000196B24; Match level="QueryCoverage =97%, HitCoverage=70%, E-value=0.0, Identity=54%"; Hit description =ATP binding / kinase/ protein serine/threonine kinase
  Pfam annotation: Domain name=LRR_1; Domain location=39-60; Score =11.6; E_value=1.9; Accession=PF00560.23; Description=Leucine Rich Repeat
  Pfam annotation: Domain name=LRR_1; Domain location=62-85; Score =16.8; E_value=0.08; Accession=PF00560.23; Description=Leucine Rich Repeat
  Pfam annotation: Domain name=Pkinase; Domain location=367-639; Score =150.0; E_value=6.3e-42; Accession=PF00069.15; Description=Protein kinase domain
  Pfam annotation: Domain name=Pkinase_Tyr; Domain location=367-639; Score=148.1; E_value=2.3e-41; Accession=PF07714.7; Description =Protein tyrosine kinase
  Pfam module annotation: Pfam domain module=LRR_1::LRR_1::Pkinase::Pkin ase_Tyr; Domain location=39-60::62-85::367-639::367-639
MSVVFYALYQEHYMYTTRQLDNNDFSGSEIPSTYANLTRLVKLSLRNCSLQGAIPDFSSISKLTYLSLANNLLSGSIPGSIWQNMSFSAKDKLTIDLQNNSFSDVLGNLTPPENVTLRLSGNPICKNSNIQSIGQYCGPEADNKAAQDSTNSTFCPVQSCPVDDFYEYAPSSPVPCFCAAPLRIGYRLKSPSFSYFAPYRSSFEDYITRSLDLDLYQLSIDSVAWEEGPRLRMYLKLFPSYNDSGSSMFNESEVHRIKGIYSSWHFPRTDFFGPYELLNFTLLGPYANLNVDSKKKKNNVGIKISAVIAAVACALAISAIIILLISKRNMKYQKKISRKRMSTNVSIKIDGMKAFTYKELAIATNKFNISTKVGQGGYGNVYKGILSDETFVAVKRAEEGSLQGQKEFLTEIELLSRLHHRNLVSLIGYCNEKEEQMLVYEFMPNGTLRDWISGKSRKTKGSLNFSMRLRIAMGAAKGILYLHTEANPPIFHRDIKASNILLDSKFTAKVADFGLSRLVPDLYEEGTGPKYVSTVVKGTPGYLDPEYLLTHKLTDKCDVYSLGIVYLELLTGMQPISHGKNIVREVNTARQSGTIYSIIDSRMGLYPSDCLDKFLTLALRCCQDNPEERPSMLDVVRELEDIITMLPEPETLFSDVSLLNSGNIAPPSSATTSTSNVTREEQHMSSYVSGSDLVSDVIPTVVPR

SEQ ID NO: 199743 - protein, 282 aa, Glycine max
  Coding DNA Sequence Number=SeqID_82965
  Gene Ontology: Mol. function=hydrolase activity; Cellular component =cytosol; Biological process=carbohydrate biosynthetic process
  Homolog annotation: Hit_ID=Q67V42; Match level="QueryCoverage=97%, HitCoverage=91%, E-value=4e-81, Identity=54%"; Hit description=MutT domain protein-like
  Pfam annotation: Domain name=NUDIX; Domain location=113-243; Score =100.2; E_value=6.1e-27; Accession=PF00293.18; Description=NUDIX domain
MSATLASLAKEEEVPSKAIDTLRAVEDQHGGVIVNIEEPMDSSVFASLLEDSILQWREKGKKGVWIKLSREHSNLVDSAVKAGFRFHHAEPDYLMLVNWIPNTPDTLPANASHRVAVGAFVMNANREVLVVQESNGRFSGQGIWKLPTGGVDEGEDICTAAVREVKEETGIDTQFVEVIAFKERHKSFFRKSELFFVCMLQPHSFKIQRQVSEIEAAQWMAIEDYMAQPFVRENELFDFLTKIGLSKFDGKYNGFSTVLSSTSSRKKSYFYFNNKDAGHMLA

SEQ ID NO: 199744 - protein, 58 aa, Glycine max
  Coding DNA Sequence Number=SeqID_82966
MKYLTKDDPRRSLEHGNNHTTLSALCASKIAISEPIMCQRFLFIVIEIFTRLAKASSS

SEQ ID NO: 199745 - protein, 78 aa, Glycine max
  Coding DNA Sequence Number=SeqID_82967
MTPAHTRIIIFTITSISTQFASVMLCIIRMSCSGLEERGSGDWLVARRGTMARGGIAEGGTVGGGTCGASGAARTLGK

SEQ ID NO: 199746 - protein, 148 aa, Glycine max
  Coding DNA Sequence Number=SeqID_82968
  Gene Ontology: Mol. function=DNA binding; Biological process=DNA integration
  Homolog annotation: Hit_ID=Q1SQ35; Match level="QueryCoverage=51%, HitCoverage=82%, E-value=6e-15, Identity=45%"; Hit description=Pol -related
MRLNAYESSKNYKQKMKIYHDRKLLKKTFQLGQQLKSKWSSPFIIEEVKPYKAVELLNPASNDLERSWIINNQRFQTSIRLEKHIDIALVKKFYANIYDPEDGMPKQCLTSSSFHKGRSTLLTPSTSTPALRTRPSWPRSAHRADSSF

SEQ ID NO: 199747 - protein, 80 aa, Glycine max
  Coding DNA Sequence Number=SeqID_82969
MEIEDDDDDGMRISVPSHTLSFFPSLQFWIIAKEVWQEVSLKHKVDCLALSVDDMRAFIFAALQQLSHPKIEVFVLEKVQ

SEQ ID NO: 199748 - protein, 83 aa, Glycine max
  Coding DNA Sequence Number=SeqID_82970
MALTREHYYIYMMKVGAGWFDVWIANTRGTRYSGRHILLDPSSQAFLKACKATCQSNSHISPHHTSKTDILVEAYYLQWSMQV

SEQ ID NO: 199749 - protein, 242 aa, Glycine max
  Coding DNA Sequence Number=SeqID_82971
  Gene Ontology: Mol. function=zinc ion binding
  Homolog annotation: Hit_ID=Q1SDI6; Match level="QueryCoverage=45%, HitCoverage=17%, E-value=3e-49, Identity=80%"; Hit description=FAR1; Zinc finger, SWIM-type
MVLDYGYFGDVVSLDTTYCTNQANRPLALFSGFNHYRSLVIFGTTLLYDEMDESFKWLFKTFLEAHSHKKPQTIFTGQDQAMAKALVEVMPKTHHGLCTWHLMQNGIKHLKPDVDIKKFFCHFERFVEEKCYNELVWEERLKMILDFLAQGEYCQLVEESTNVMCKKIKELRLQAHSIYKNKDDAVALAINDDTQPKGFKKRPSIKRHNQKNFKSWSVLQLKKKKKALTRVNHKVKHLRDTP

SEQ ID NO: 199750 - protein, 217 aa, Glycine max
  Coding DNA Sequence Number=SeqID_82972
  Gene Ontology: Mol. function=N-acetyltransferase activity; Cellular component=chloroplast; Biological process=metabolic process
  Homolog annotation: Hit_ID=Q7X9V3; Match level="QueryCoverage=90%, HitCoverage=74%, E-value=4e-70, Identity=66%"; Hit description =Nuclear shuttle interacting protein
  Pfam annotation: Domain name=Acetyltransf_1; Domain location=108-202; Score=27.7; E_value=4.1e-05; Accession=PF00583.14; Description =Acetyltransferase (GNAT) family
MGSNPETTSLHMQRLMKNNSMQVIDPPSTDEENVEPLSQDFVLVEKTEPDGTIEQIIFSSGGDVDVYDLQALCDKVGWPRRPLSKLAAALKNSYIVASLHSIRKSHGSEGNEQKRLIGMARATSDHAFNATIWDVLVDPGYQGDIKELKFRLYLNGWSGVGQGLGKALIEKLIRTLLQRDIGNITLFADSQVVEFYRNLGFEADPEGIKGMFWYPNH

SEQ ID NO: 199751 - protein, 123 aa, Glycine max
  Coding DNA Sequence Number=SeqID_82973
  Gene Ontology: Mol. function=protein kinase activity; Cellular component=integral to membrane; Biological process=protein amino acid phosphorylation
  Homolog annotation: Hit_ID=Q6K2A4; Match level="QueryCoverage=72%, HitCoverage=12%, E-value=2e-36, Identity=82%"; Hit description=ABC1 family protein-like
KSRRRKTAAWLRECVLQLGPTFIKLGQLSSTRSDLFPREFVEELAKLQDRVPAFSPKKARGFIESELGAPINILFKEFEDRPIAAASLGQRILSVGNFCLLDSNCIAVFVSYETDRDLGIMGS

SEQ ID NO: 199752 - protein, 87 aa, Glycine max
  Coding DNA Sequence Number=SeqID_82974
  Gene Ontology: Mol. function=protein binding; Cellular component =nucleus; Biological process=multicellular organismal development
  Homolog annotation: Hit_ID=Q6L5N9; Match level="QueryCoverage=82%, HitCoverage=42%, E-value=4e-24, Identity=71%"; Hit description =Flowering locus T like protein
  Pfam annotation: Domain name=PBP; Domain location=2-79; Score=-30.0; E_value=0.011; Accession=PF01161.10; Description=Phosphatidylethanola mine-binding protein
MAASGDPLLVGRVIGKEIVPYLGPRPPIGIHRYIFLLFQQKVPLGLVEQPPTRASFNTRYFVRQLDLGLPVATVYFNSQKEPAAKRR

SEQ ID NO: 199753 - protein, 189 aa, Glycine max
  Coding DNA Sequence Number=SeqID_82975
  Gene Ontology: Mol. function=RNA-directed DNA polymerase activity; Biological process=RNA-dependent DNA replication
MHVDGSSNQQGSGAGVILEGPNGVTMAQSLHFGFNATCNQAEYKAPRRTKTHQRGWHPKSLVPKGNFEEVQVIHISREVNDKADKLARLETSPKLGQLKTFILLSVPEPSVLGKEVLQVKEGPSGWKKEILEYLKHETLSADKGKARKLKAQAAKYTLVAGELYRRGFSFVATYPSKGGRRAESPPTFI

SEQ ID NO: 199754 - protein, 210 aa, Glycine max
  Coding DNA Sequence Number=SeqID_82976
  Gene Ontology: Mol. function=RNA-directed DNA polymerase activity; Biological process=RNA-dependent DNA replication
MHHLITTLRLGPFVNNLCIKLASDLNKLRRRTAKYVKMEELAESVRTEEESKPLEGEKGKSPRPTKASHKHHCRRFRWGRSHRLWRKRHLYMIVHAHMLYNILLGRLSLKSSGAIVSTPHLAMKFPSEDETIIIVHADQRMTRECYMASLRLRPHFAVDMPRIDQSFKDAKPIAQRKRKIGEERSQSGMLEGYIPIPEHRSPGQWSSRTL

SEQ ID NO: 199755 - protein, 751 aa, Glycine max
  Coding DNA Sequence Number=SeqID_82977
  Homolog annotation: Hit_ID=Q2WBV9; Match level="QueryCoverage=13%, HitCoverage=11%, E-value=5e-14, Identity=42%"; Hit description =Hypothetical protein upg3
  Pfam annotation: Domain name=DUF408; Domain location=1-205; Score =155.2; E_value=1.7e-43; Accession=PF04181.3; Description=Domain of Unknown Function (DUF408)
MAKDKPVSVKDAVFKLQMSLLEGIQNEDQLFAAGSLMSRSDYEDIVTERSITNMCGYPLCSNALPSDRPRKGRYRISLKEHKVYDLQETYMFCSSNCLVSSKTFAGSLQAERCSGLDLEKLNNVLSLFENLNLEPVETLQKNGDLGLSDLKIQEKTERSSGEVSLEQWAGPSNAIEGYVPKPRNRDSKGLRKNVKKGSKTGHGKSISDINLINSEMGFVSTIIMQDEYSVSKVPPGQMDATANHQIKPTATVKQPEKVDAEVVRKDDDSIQDLSSSFKSSLILSTSEKEEEVTKSCEAVLKFSPGCAIQKKDVHSISISERQCDVEQNDSARKSVQVKGKTSRVIANDDASTSNLDPANVEEKFQVEKAGGSLKTKPRSSLKSAGEKKFSRTVTWADEKINSTGSKDLCEFKEFGDIKKESDSVGNNIDVANDEDILRRASAEACAIALSSASEAVASGDSDVSDAVSEAGITILPPPHDAAEEGTVEDADILQNDSVTLKWPRKTGISEADFFESDDSWFDAPPEGFSLTLSPFATMWNTLFSWTTSSSLAYIYGRDESFHEEYLSVNGREYPCKVVLADGRSSEIKQTLASCLARALPALVAVLRLPIPVSIMEQGMYSCPKLRVITDLLYFSRHGLKSVKVGESWHRGFKQWHQLLAETMLACLLETMSFVDALPAFRTKQWQVVALLFIDALSVCRLPALISYMTDRRASFHRVLSGSQIRMEEYEVLKDLVVPLGRAPHISSQSGA

SEQ ID NO: 199756 - protein, 557 aa, Glycine max
  Coding DNA Sequence Number=SeqID_82978
  Gene Ontology: Mol. function=actin binding; Cellular component =cytoskeleton; Biological process=sensory perception of sound
  Homolog annotation: Hit_ID=Q9LV35; Match level="QueryCoverage=99%, HitCoverage=86%, E-value=0.0, Identity=65%"; Hit description=WD40 -repeat protein
  Pfam annotation: Domain name=WD40; Domain location=108-146; Score =31.1; E_value=3.9e-06; Accession=PF00400.22; Description=WD domain, G-beta repeat
  Pfam annotation: Domain name=WD40; Domain location=153-191; Score =43.6; E_value=6.8e-10; Accession=PF00400.22; Description=WD domain, G-beta repeat
  Pfam annotation: Domain name=WD40; Domain location=244-283; Score =17.6; E_value=0.044; Accession=PF00400.22; Description=WD domain, G -beta repeat
  Pfam annotation: Domain name=WD40; Domain location=424-461; Score =8.6; E_value=3.6; Accession=PF00400.22; Description=WD domain, G -beta repeat
  Pfam annotation: Domain name=WD40; Domain location=486-524; Score =35.9; E_value=1.4e-07; Accession=PF00400.22; Description=WD domain, G-beta repeat
  Pfam annotation: Domain name=WD40; Domain location=65-104; Score =21.8; E_value=0.0025; Accession=PF00400.22; Description=WD domain, G- beta repeat
  Pfam module annotation: Pfam domain module=WD40::WD40::WD40::WD40::WD4 0::WD40; Domain location=108-146::153-191::244-283::424-461::486 -524::65-104
WVASADASGTVRIWGTRNDFVLKKEFRVLSARIDDLQWSPDGLRIVACGEGKGKSFVRAFMWDSGTNVGEFDGHSRRVLSCAYKPTRPFRVVTCGEDFLVNFYEGPPFRFKLSHRDHSNFVNCVRYSPDGSKFISVSSDKKGVIFDGKSAEKIGELSSEGGHTGSIYAVSWSPDGKQVLTVSADKSAKVWDITEGNNGKVKKTLTCAGSGGVEDMLVGCLWLNDYLVTVSLGGTISIFLATDLDKAPTTFSGHMKNVSSLTILRSNPRVLLSSSYDGLIVKWIQGIGYSGKLHRKENSQIKCLAAVEEEIVTSGFDNKVEQDLDQLLDLDPSTNKPKIWKVYSRRQQKGIGRRISYANFANWLGPRLANSKASAVNEYYGEMDQCGDTEAIDIGSQPKDLSVALLSPELALVSIDSGVVMLRGTKIVSTINLGFIVTASAVSPDGSEAIIGGQDGKLHIYSVSGDTLVEEVVLEKHRVVWDRASREVKLKNMLYHTARINCLAWSPDSHRIATGSLDTCVIIYEVDQPASSRITIKGAHLGGVYGLAFTDEYSLVSS

SEQ ID NO: 199757 - protein, 164 aa, Glycine max
  Coding DNA Sequence Number=SeqID_82979
  Homolog annotation: Hit_ID=Q1RST2; Match level="QueryCoverage=50%, HitCoverage=6%, E-value=2e-08, Identity=49%"; Hit description =Peptidase S1 and S6, chymotrypsin/Hap; Immunoglobulin/major histocompatibility complex; ...
  Homolog annotation: Hit description=AAA ATPase, central region
MLSDLPETASLKAVDGCVAMSPDKSPSVPVEGEALVSPQCQGETAEKSKGVLMAAATTTGGRSKKQRPSKLSPKVAWGKLLSQCSQGEEEEGERRRRRPWGNENESEKEGSVVEVVFGNIVGGVVVCGWLVLRCGQDRTREGTTNLVGEVANVRRVHTWTLLIG

SEQ ID NO: 199758 - protein, 158 aa, Glycine max
  Coding DNA Sequence Number=SeqID_82980
  Gene Ontology: Mol. function=oxidoreductase activity, acting on single donors with incorporation of molecular oxygen, incorporation of two atoms of oxygen; Biological process=response to salicylic acid stimulus
  Homolog annotation: Hit_ID=Q5WM33; Match level="QueryCoverage=94%, HitCoverage=23%, E-value=2e-60, Identity=72%"; Hit description=Alpha- dioxygenase 2
MHFREPMKELLGKEGERRLSNLGMEQMLVSMGHQSSGAVDLWNYPTWLGNLIAHDINGEDIPDPVDMATMEENVAPVYRDRERGVARYNEFRRNLLMIPISKWEDLTDDEEVIEALRDVYEDDAEKLDLIVGLHAEKRIRGFAISETAFFIFLIMAWS

SEQ ID NO: 199759 - protein, 218 aa, Glycine max
  Coding DNA Sequence Number=SeqID_82981
  Gene Ontology: Mol. function=oxidoreductase activity, acting on single donors with incorporation of molecular oxygen, incorporation of two atoms of oxygen; Biological process=response to salicylic acid stimulus
  Homolog annotation: Hit_ID=Q5WM33; Match level="QueryCoverage=97%, HitCoverage=42%, E-value=6e-89, Identity=59%"; Hit description=Alpha- dioxygenase 2
  Pfam annotation: Domain name=An_peroxidase; Domain location=15-218; Score=-326.7; E_value=0.0024; Accession=PF03098.6; Description =Animal haem peroxidase
VIHFVDKLELWQRLPVLLGLAYLGIRRHLHYRYNLLHAGGVNGHKYDTQEYAYTTPDGKQFNMIACSWMQLMIHDWIDHLEDTEQVEIRAPDGYSSGCPLKSFMYFKTKKFKTDASCMKFGFQNIRTPWWDGSVIYGNNEKGMKRARTFKDGKLKISEDGLLEHDEKGIPISGDVRNCWAGFSLLQALFVKEHNALCDMLKVHYPDFDDEQLYRMQDW

SEQ ID NO: 199760 - protein, 98 aa, Glycine max
  Coding DNA Sequence Number=SeqID_82982
MSAFPLALSVTILTQRNSLSVSDPGVFDINKDVYDDELVLIDDIPEDVAPTPERLATPCRREGTVSESSSSTLVEEGAREGTINESLSSTLVEEGARE

SEQ ID NO: 199761 - protein, 70 aa, Glycine max
  Coding DNA Sequence Number=SeqID_82983
MAENLHEFAHGNISEALWKHLGLDFLHGNTEKGRCLPPRGFLRKISEHTPITKFTPIFVLYGSLTGAFQT

SEQ ID NO: 199762 - protein, 67 aa, Glycine max
  Coding DNA Sequence Number=SeqID_82984
  Subcellular localization annotation: CTP_CleavageSite=22; ConfidenceScore=5.25e-01
MDKILLRPPSSSSSSRPMPIVSCTSKVAHQNVNAHPSFTASELQDGKILALDSTASNKTPRTYHYHY

SEQ ID NO: 199763 - protein, 137 aa, Glycine max
  Coding DNA Sequence Number=SeqID_82985
MVSVKGSLLGELVGNGFEVCGYNGEVFEVSSDSYSSRSYFSSSINLLATKGSSDLLEFLSQLPENMGENVATLMVDPAAKTGTSMGDAPRPKKYLVLKEKRLPSPITLPRYTWVDGEVGIMTQAGANMNAFWLEVFL

SEQ ID NO: 199764 - protein, 81 aa, Glycine max
  Coding DNA Sequence Number=SeqID_82986
MHLSSTSHHDIQFKSKYAKNKFFRTTKREKPRNPKCEKMQKDLHWCVVKNWELKDSERDRGKGGNLLRIAPRHASELNLTP

SEQ ID NO: 199765 - protein, 64 aa, Glycine max
  Coding DNA Sequence Number=SeqID_82987
  Subcellular localization annotation: CTP_CleavageSite=32; ConfidenceScore=5.22e-01
MKPLQGTTQTLTRVIDMWQSHMALTCGSQRLRPSRQSSFEFSPKKSSRLEFDLNSTGDDGHTQH

SEQ ID NO: 199766 - protein, 425 aa, Glycine max
  Coding DNA Sequence Number=SeqID_82988
  Gene Ontology: Mol. function=zinc ion binding
  Homolog annotation: Hit_ID=Q2HT04; Match level="QueryCoverage=79%, HitCoverage=90%, E-value=2e-81, Identity=50%"; Hit description=Zinc finger, RING-type
MEGKTESHMTSAAAFVEGGVQEACDDACSICLEDFCKSDPATVSEKLPVSYVLATYQLEGCYQLYAFHHSQELLEAVELERSLRDTPSRNAAIFHHPTLGDFELQHLPMGVNEADIEERIIQHLTAAAAMRRSHHLSRREGHRTRPSAHGRPHFLVYSTQPSAPPSAAGGGSEPAAIPVGSPSTPLTFDGNEQSSLQQIPHVQTQSSSLTSASTVSTTNLQGVHSDDRSFASHSFPASQDRAQPSEQSFSDSLRSRFNAVSMRYKDSISKGTRGWKERLFSPNSSMSELGSEVRRELNAKIASVSRLMERLETRENNSAAGTSLSNHLVNRSIAETSNQSNVEARIFAQRIMFEAFGGGGTMFYGTTTQQSQALKWFVEVITYYQDWARAKAVQHNATRLGGDNENNRWKPPPQGTWKCNFDASF

SEQ ID NO: 199767 - protein, 141 aa, Glycine max
  Coding DNA Sequence Number=SeqID_82989
MEPDAQHAPPIIPMLQSLFRGQLVIVYNQQQLAHNRPIVSMEKFLDKVARPEAQLPLGRAPEVVPPSPIPTRTKPALAESQPPVVEPPASLEVEILSPSPTPRAPPLILIPDDSDAEAAAPPDSPAYYLEDGSDFSDWMDY

SEQ ID NO: 199768 - protein, 110 aa, Glycine max
  Coding DNA Sequence Number=SeqID_82990
MSVMGLEGWWCWRRRRRWGVKLKQVELFLDGVESNDEVMVSIGEDGLVLVRRRKTSSKQLVVLERVWHLSMRHGVLKVRWPLGIPLRSRLVHPINFYSSLLIMLNNSVKY

SEQ ID NO: 199769 - protein, 104 aa, Glycine max
  Coding DNA Sequence Number=SeqID_82991
MAELYETHVHHLYYLFLNLCLLKVMVSIYLKKVGDSRERVLQEGGQALKQKGRCIRRSCWSIYLKSDGVATIPKFHGQGVIIGDDGSKLFEPLNAENDVDTTNG

SEQ ID NO: 199770 - protein, 156 aa, Glycine max
  Coding DNA Sequence Number=SeqID_82992
MSLFAYCIGDGMKFPDMRGGALKTRAKNGGLRHKLLEFVKGQLGVLVPLEVVFPQQGRQRIGQSTIAWILIGSGATPCDDTLWSRPKKRKCKKLLINSLSEADWLSESHPLSEAASSLSGWETLEEDKLEICALSIQPARPMRTLSLFALSAPELA

SEQ ID NO: 199771 - protein, 414 aa, Glycine max
  Coding DNA Sequence Number=SeqID_82993
  Gene Ontology: Mol. function=RNA-directed DNA polymerase activity; Cellular component=chromatin; Biological process=chromatin assembly or disassembly
MLVCLATTRIFGTHCICHWSSSRPFKDTGDGGLARPYHNSVLTGIFGFDRILLQVIQGYASIVAPLTSLLQKDNFHWGVEAQTAFDNLKQAMTQAPVLALSDFSTPFMLETNALCLAMGVVLMQYGHPLAFFNKAFCPCLQRSSTFILTIPNFTFHDALHRHFLTNDSFQEKVQQVTLEPNSHPDFKIHNGSLFFQNKIWLNTENLFLSSLMEEFHSTPLGGHLGFAKTLHRLQANIYWPNMRKDMRQFVRKCSTCQQVKYEPKRPAGLLPPLPILSSPWKELSLDFIIGLPPSQGYTTILVVVDRFTKGAHFGALASHYTTHKVAFLFQDMVGITTFEDTYRKPHPSISTYLLSSSNVEVVDHLLSIRQDLWASLTTRLQKMQLAMKTQANSKQRDVSYKVGDWVYLKLHPYH

SEQ ID NO: 199772 - protein, 190 aa, Glycine max
  Coding DNA Sequence Number=SeqID_82994
  Gene Ontology: Mol. function=chromatin binding; Cellular component =chromatin; Biological process=chromatin assembly or disassembly
  Homolog annotation: Hit_ID=Q1SAV4; Match level="QueryCoverage=69%, HitCoverage=49%, E-value=6e-17, Identity=39%"; Hit description =Integrase, catalytic region
MEQRGLPAIPTSSGTKEWVDDYRWPSEEGKPDQQEWVLSEASPMKHGISSGFKKRIKKFVSMDEDEKTPYHGLRTKHHDNECQCIISWRTQENNWEWKGDACHMSPRKVKTGARMNRSVVGSFGECQKFEPLRWFIVDKCLKVLFEYVIENLCLVVCLRAMGKIVQLAENVKEKQPMLYNVEEGHRSEPL

SEQ ID NO: 199773 - protein, 299 aa, Glycine max
  Coding DNA Sequence Number=SeqID_82995
  Gene Ontology: Mol. function=RNA-directed DNA polymerase activity; Biological process=RNA-dependent DNA replication
MIIYTTTPAAILLFEQKHRRREWALTGPDEASIEHRSHMSFQFGFLAVRVSVWLHVDKVRMGKEMDKVVGTMQEMVSGVVRCYRAQGDLRTCGAIVQKVTVSDHYLQCRCGGGGEVKKFSNPRLNEIIGATTIVKDHDAMMRDLAIDMKGFEHQYPKQNTKTNLGVVIKNFFERGHHCGPLSLRTTISSNERRFTGILGLEVVGGPDGWFVKGGQSETHNSVHESLKLIEGSLQNEGANLNSRAWSIACHDVRKPFLDIHWYQQKGGVVLCQDYLAMHEMDGGGLTGIVVWHGRSDQMI

SEQ ID NO: 199774 - protein, 231 aa, Glycine max
  Coding DNA Sequence Number=SeqID_82996
MGRREGGVDDEHILERQLDSIVIGGMKLYVIIPRYGRQRGGKQHEQVHRNENEASRPIQKGARTNHASFAEVVARKENKNASHSREGGLSSIYLEPSLDMLKWLSEAWVGRLTNPTMFDKVEDELRWDFGVDISTKYLGDDMVLLLEVDAESASGLQADLSPVLGNPNPSLGRDVHQEDSGGCMKCTYWRNADTPLTSASVEEAALRRRQNKLTPTEASWGLRLRRNHMSR

SEQ ID NO: 199775 - protein, 101 aa, Glycine max
  Coding DNA Sequence Number=SeqID_82997
MPPQLSRHWHWRDSVHVSPCLIATTGGTHVAPVSPFVLAASSTCLHPTHTAMHAGGIGWGYVKKVTRLGNSFEIDLFWELVSKTNPIRSKCPKFPINYLYL

SEQ ID NO: 199776 - protein, 77 aa, Glycine max
  Coding DNA Sequence Number=SeqID_82998
MGSKSTLRLMRTLGPFLESLAQSTWSLLANALAGSKVKLLLEEMTKRIKDELLIKVKEGENHKELNWSVLKIAEQLA

SEQ ID NO: 199777 - protein, 358 aa, Glycine max
  Coding DNA Sequence Number=SeqID_82999
  Gene Ontology: Mol. function=protein serine/threonine kinase activity; Cellular component=integral to membrane; Biological process=protein amino acid phosphorylation
  Homolog annotation: Hit_ID=Q5JN27; Match level="QueryCoverage=98%, HitCoverage=38%, E-value=1e-118, Identity=61%"; Hit description =Putative receptor-like protein kinase 1
  Pfam annotation: Domain name=Pkinase; Domain location=25-296; Score =148.7; E_value=1.5e-41; Accession=PF00069.15; Description=Protein kinase domain
  Pfam annotation: Domain name=Pkinase_Tyr; Domain location=25-296; Score=141.8; E_value=1.9e-39; Accession=PF07714.7; Description =Protein tyrosine kinase
  Pfam module annotation: Pfam domain module=Pkinase::Pkinase_Tyr; Domain location=25-296::25-296
PNVSIKIDSVKEFTFRELALATNNFSSSTKVGQGGYGNVYKGILSGETLVAIKRAAEGSLQGKKEFLTEIELLSRLHHRNLVSLIGYCNEEQEQMLVYEFMPNGTLRDWISGKSEKAKERQNFGMGLKIAMGAAKGILYLHTDADPPIFHRDIKAGNILLDSKFTAKVADFGLSRLASFEEGSNNTKYMSTVVRGTPGYLDPEYVLTQKFTDKSDVYSLGIVFLELLTGMQPISRGKHIIYEVNQACRSGKIYSIIGSRMGLCPSDCLDKFLSLALSCCQENPEERPSMLDVVRELENIVAMLSESEASLPDVTLDNSGEMAPSSSLGSNSAREDQHTYAYVSGSNLVSGVIPTIVPR

SEQ ID NO: 199778 - protein, 133 aa, Glycine max
  Coding DNA Sequence Number=SeqID_83000
  Gene Ontology: Mol. function=glutamyl-tRNA reductase activity; Biological process=tetrapyrrole biosynthetic process
  Homolog annotation: Hit_ID=Q9LVD1; Match level="QueryCoverage=82%, HitCoverage=28%, E-value=1e-30, Identity=50%"; Hit description =Arabidopsis thaliana genomic DNA, chromosome 5, P1 clone:MJB24
  Pfam annotation: Domain name=DUF266; Domain location=14-129; Score =189.5; E_value=8.2e-54; Accession=PF03267.4; Description=Arabidopsis protein of unknown function, DUF266
MQGHEGKFSVYVHSSKEKPIHVSPFFVGRDIHSEPVGWGKISMVEAERRLLAHALLDPDNQHFVLLSESCIPVRRFEFVYNYLLLTNVSFIDRYIEHMLPEVEKKDFRKGSQIVETMGTSLVSVIKYFFLFII

SEQ ID NO: 199779 - protein, 389 aa, Glycine max
  Coding DNA Sequence Number=SeqID_83001
  Gene Ontology: Mol. function=protein serine/threonine kinase activity; Cellular component=integral to membrane; Biological process=protein amino acid phosphorylation
  Homolog annotation: Hit_ID=UPI0000196B24; Match level="QueryCoverage =98%, HitCoverage=35%, E-value=9e-76, Identity=40%"; Hit description =ATP binding / kinase/ protein serine/threonine kinase
  Pfam annotation: Domain name=LRRNT_2; Domain location=47-87; Score =40.5; E_value=5.8e-09; Accession=PF08263.3; Description=Leucine rich repeat N-terminal domain
  Pfam annotation: Domain name=LRR_1; Domain location=121-143; Score =17.7; E_value=0.042; Accession=PF00560.23; Description=Leucine Rich Repeat
  Pfam annotation: Domain name=LRR_1; Domain location=145-167; Score =8.9; E_value=6.1; Accession=PF00560.23; Description=Leucine Rich Repeat
  Pfam annotation: Domain name=LRR_1; Domain location=169-191; Score =8.4; E_value=7.7; Accession=PF00560.23; Description=Leucine Rich Repeat
  Pfam annotation: Domain name=LRR_1; Domain location=193-215; Score =14.4; E_value=0.4; Accession=PF00560.23; Description=Leucine Rich Repeat
  Pfam annotation: Domain name=LRR_1; Domain location=287-308; Score =13.1; E_value=1; Accession=PF00560.23; Description=Leucine Rich Repeat
  Pfam annotation: Domain name=LRR_1; Domain location=310-329; Score =17.0; E_value=0.071; Accession=PF00560.23; Description=Leucine Rich Repeat
  Pfam annotation: Domain name=LRR_1; Domain location=332-355; Score =8.0; E_value=9; Accession=PF00560.23; Description=Leucine Rich Repeat
  Pfam annotation: Domain name=LRR_1; Domain location=356-379; Score =15.0; E_value=0.28; Accession=PF00560.23; Description=Leucine Rich Repeat
  Pfam annotation: Domain name=LRR_1; Domain location=97-119; Score =9.2; E_value=5.5; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=47 -87::121-143::145-167::169-191::193-215::287-308::310-329::332 -355::356-379::97-119
MFQYFFRSSFPFACFPGYTVMPTLRIHGYALLVSSCFIILIAASQTDPSEVNALIDIKKSLIDPMGNMRNWNSGDPCMANWAGVWCSDREEANGYFHVQKLSFMRNNLTGTIPKEIGNITSLELLLLSGNKLSGTLPDELGNLTNLDRFQVDENQLSGPIPESFVKMVKVKHLHMNNNSFNNQLPSKLSKLPNLVHLLVDNNNLSGYLPPEFSMLERLRILHSILCSQGLPTLYADFSSSGQPLDVSSSLQLHVYHTIQHILQVCCQLDNNNFSGSGIPSTYANFSSLVKLSLRNCSLQGTIPDFSSIANLTYLDLSWNQFTGHIPSELADNMTTIDLSNNNHLDGSIPRSFIYPHLQKLSLENNLLSGSIPASIWENVALNTKDKLTM

SEQ ID NO: 199780 - protein, 214 aa, Glycine max
  Coding DNA Sequence Number=SeqID_83002
  Homolog annotation: Hit_ID=Q9LVD1; Match level="QueryCoverage=51%, HitCoverage=26%, E-value=7e-13, Identity=38%"; Hit description =Arabidopsis thaliana genomic DNA, chromosome 5, P1 clone:MJB24
MKKERAWPQFIRNLLIMVGSRSRPQLRRPTWIIVLLSIVCVFLIAAYVYPPPSPSSCSVFSSHGCGSSAFELPPAAHTRELTDAEVQSRVVINEILNYYPVQTKKPKVAFLFLTPGSLPFEKLWHMFFQSQSDPSIFSSLVLGLLPDDYTFSSLLKACARESGLKPTNATMLVALLSCALLGSLDLGMWIHEHVRKNGYDQYVKENTARIDMHA

SEQ ID NO: 199781 - protein, 78 aa, Glycine max
  Coding DNA Sequence Number=SeqID_83003
MKISTSKAYSSSSNPETLIEDAKADTPSTIVRPMGQKTAKRKSKGKGVGTSTNTEATTVNKEGLEESLIAIVKMNIYD

SEQ ID NO: 199782 - protein, 635 aa, Glycine max
  Coding DNA Sequence Number=SeqID_83004
  Gene Ontology: Mol. function=protein serine/threonine kinase activity; Cellular component=membrane; Biological process=protein amino acid phosphorylation
  Homolog annotation: Hit_ID=Q2N1D8; Match level="QueryCoverage=54%, HitCoverage=60%, E-value=1e-106, Identity=58%"; Hit description=CMV 1a interacting protein 2
  Pfam annotation: Domain name=Pkinase; Domain location=291-566; Score =127.0; E_value=5.1e-35; Accession=PF00069.15; Description=Protein kinase domain
  Pfam annotation: Domain name=Pkinase_Tyr; Domain location=291-566; Score=114.9; E_value=2.3e-31; Accession=PF07714.7; Description =Protein tyrosine kinase
  Pfam module annotation: Pfam domain module=Pkinase::Pkinase_Tyr; Domain location=291-566::291-566
MKEPCDSHWNVVILILRYLKNAPGRGLIYGDKGNAKIVCYSDADRARSPSDRRSTSGYCVPIGGNLTWRSKKPNTVARSSAEVEYRAMAATASEITWLRQLLQQLKFGDTQDTRLLCDNQTALHISSNLVFHERTKHIEIDCHFVREKVLLGEIITDFVSSGDQLVDMLTESLKAPTISTSPMKAPQRRAPTATLSSTSDRGRRSNLLLILGIVTGILFISIVCVLILCLCTMRPKTKTPPTETGLLLRFALLSTEKPRIESAVSAVGSLPHPTSTRFIAYEELKEATNNFEPASVLGEGGFGRVYKGVLNDGTAVAIKRLTSGGQQGDKEFLVEVEMLSRLHHRNLVKLVGYYSNRDSSQNLLCYELVPNGSLEAWLHGPLGINCPLDWDTRMKIALDAARGLAYMHEDSQPCVIHRDFKASNILLENNFHAKVADFGLAKQAPEGRANYLSTRVMGTFGYVAPEYAMTGHLLVKSDVYSYGVVLLELLIGRKPVDMSQPSGQENLVTWARPILRDKDSLEELADPRLGGRYPKEDFVRVCTIAAACVAPEASQRPAMGEVVQSLKMVQRVTESHDPVLASSNTRPNLRQSSTTYDSDGTSSMFSSGPYSGLSTFDYHNISRTAVFSEDLHEGR

SEQ ID NO: 199783 - protein, 216 aa, Glycine max
  Coding DNA Sequence Number=SeqID_83005
  Gene Ontology: Mol. function=protein serine/threonine kinase activity; Cellular component=membrane; Biological process=protein amino acid phosphorylation
ALKWLLVLLSCMVWFVVDYGACGRALQLEAPSLSPAAAPVVAVDDLPLPTNAHGLKHLPAPIPSRANFTKGRGELQPPVSGFKNIAPMHPIADAIPSALAQPPLSPYVSDCCKQDMVWKRGSEVCHCAYPIKLDLLLLNVSENPDQNAFLNGISFSAEEAAKINSLLLLHKVQLDRRFVGDYKVINITWFKPPPHSPGRERYADAKGTNLLIAHSF

SEQ ID NO: 199784 - protein, 45 aa, Glycine max
  Coding DNA Sequence Number=SeqID_83006
MGLRLQSKGKGSMLEPRRQKKGKGERFKRKSGLRTSDMDPCHGTQ

SEQ ID NO: 199785 - protein, 84 aa, Glycine max
  Coding DNA Sequence Number=SeqID_83007
MENSGAGDDGGQMFGAEDDVGGSVGGTTGSACVRQWYVSSGGGLGAGAMSGVGTTGEKWRLGGGTAELAVVAVTVHETKKGGCG

SEQ ID NO: 199786 - protein, 177 aa, Glycine max
  Coding DNA Sequence Number=SeqID_83008
  Gene Ontology: Mol. function=nucleic acid binding; Biological process= DNA integration
  Homolog annotation: Hit_ID=Q1SJY4; Match level="QueryCoverage=94%, HitCoverage=40%, E-value=3e-22, Identity=32%"; Hit description=Zinc finger, CCHC-type
MTNNNNNDQFIVEGACLIRPLGFTREDYPCWKDKMEMYIKSTLYILWLIITNGDISIPRPKAEWTNTNLAIIKLNKKPHYTLTCALSRNEYNKICGLKIAKEIRKVVALTRHYESFSMRDKESMDDMFGRLQVLLKKLEALGHTFIKAQINLKIHDNFPKVWEPKTMVIQEAQNLKT

SEQ ID NO: 199787 - protein, 66 aa, Glycine max
  Coding DNA Sequence Number=SeqID_83009
MIWLERVVNLAGNQHLKHVILMLNAWWIVDHLTDLIPQRTNSYIINTRPLLLSVGHQPTSMTDLLH

SEQ ID NO: 199788 - protein, 363 aa, Glycine max
  Coding DNA Sequence Number=SeqID_83010
  Homolog annotation: Hit_ID=Q1SWP7; Match level="QueryCoverage=41%, HitCoverage=24%, E-value=2e-15, Identity=36%"; Hit description =Ribonuclease H
MVKLASKEPLCGKVPLVHIYDSILKVKDVWNGMDWDLHKLYSTLPQSAAADVVSVKPMLVVSLPDLWIWEPCVSCTFSVSAIYKWLQGSCFIVGLAGIGFGSLNSLRTSNSLCGSFATKQYQPDLCLWPVVLFLMTLARFIRITRKLLSSIYSDVIMLMMFGGLVVDRPRGDDWIAWIKQASHRFGNMVPIVLCTKWCNRNGPFSRPITFGSWLWGDVEMIVLNVDESVTIDVRKAGYGGLCTNHSGDFLVGIPDKYLDKTRRRTPNVTYPMKLGTLSAICLLILYNMSQSFAYTSGTIGFYGYAGDTIIMHSEIMAVFSDSKHVDDLIRDGCPQQHLYANELHTIHRDWNLDYSVRPQPQGG

SEQ ID NO: 199789 - protein, 100 aa, Glycine max
  Coding DNA Sequence Number=SeqID_83011
MHLSLSHTDPTPPQVREAANLAKEVCRSTIQSCRFVVPSHLHGHRHWSSALTFGTSRQSVTHIFFGSNFVTVTKCKEVEREFFKVETLVAVMYWWPLCFM

SEQ ID NO: 199790 - protein, 232 aa, Glycine max
  Coding DNA Sequence Number=SeqID_83012
  Gene Ontology: Mol. function=serine-type endopeptidase activity; Cellular component=membrane fraction; Biological process=proteolysis
  Homolog annotation: Hit_ID=Q9S834; Match level="QueryCoverage=99%, HitCoverage=76%, E-value=1e-67, Identity=70%"; Hit description=ATP -dependent Clp protease subunit ClpP
  Pfam annotation: Domain name=CLP_protease; Domain location=105-223; Score=54.7; E_value=3e-13; Accession=PF00574.13; Description=Clp protease
  Subcellular localization annotation: CTP_CleavageSite=60; ConfidenceScore=5.75e-01
MAHTSLFTPSSSLRFNPLLLTSTPSSSSSSRSNNLSFPALSRNLRKSVEDRKINKKSAVKAVYGDEFWTPERSSRPGIWSIRSDLQVPSSPYFPTYAQGQGPPPMVAERFQSVISQLFQYRIIRCGGAVDDDMANIIVAQLLYLDAVDPNKDIVMYVNSPGGSVTAGMAIFDTMRHIRPDVSTVCVGLAARPFNLQYGSFSAECRDKRKEIQLAKFKDNDSSTAWWCSRRAN

SEQ ID NO: 199791 - protein, 591 aa, Glycine max
  Coding DNA Sequence Number=SeqID_83013
  Gene Ontology: Mol. function=signal transducer activity; Cellular component=membrane; Biological process=response to light stimulus
  Homolog annotation: Hit_ID=Q9C9Z0; Match level="QueryCoverage=94%, HitCoverage=90%, E-value=1e-154, Identity=55%"; Hit description =Putative non-phototropic hypocotyl; 42053-44089
  Pfam annotation: Domain name=BTB; Domain location=2-99; Score=-0.5; E_ value=0.0045; Accession=PF00651.21; Description=BTBPOZ domain
  Pfam annotation: Domain name=NPH3; Domain location=176-444; Score =273.7; E_value=3.7e-79; Accession=PF03000.5; Description=NPH3 family
  Pfam module annotation: Pfam domain module=BTB::NPH3; Domain location= 2-99::176-444
IFADVAGDITIVVDGESFLLHKFPLVTLSGKIRKMVAEAKGSNVSSLELINFPGGHQTFELAMKFCYGMNFEITTFDVARLRCAAEYLEMTEEYREQNLISRTDIYLNEIVFQSLQKSVEVLSTCEMLPPDTVDEIEISNGCVEAIAMNACKEQLVSGLSKLDCDGKSEELKEDCVAWWVEDLSVLRIDYFQRVICAMGRMGVRSDSIIASLMHYAQSSLKGIGKCQFWNPSRTNSSPTSVEKDQRIIVETLVSLMPTDKSSSIPLTFLFGMLKMAIMLGATIPCRLELERRIALRLEMVSLDDLLIPSLQSGDSLFDVDTVHRLLVNFLQRVEEEETEDYGYESDGFCSSGHGSLLKVGQLIDAYLAEIAPDPYLSLQKFIALIEILPDYARGRNIYDSKILMVGHFLVKPHILNHAHPALTEQECKKLCKLIDCQKLSEEACNHAAQNDRLPLQMVVQVLYFEQLRLKNALSGSSGDGLLSQRISSGVPSAAMSPRDNYASLRRENRELKLEISRMRVRLSELEKEQMFMKQGIIDKAGNGRTFLTSLSKGIGRIAIFSSQGGGKRQKSGRKSRGSEGKTGRSRRYSVS

SEQ ID NO: 199792 - protein, 72 aa, Glycine max
  Coding DNA Sequence Number=SeqID_83014
  Gene Ontology: Mol. function=transporter activity; Cellular component= integral to membrane; Biological process=oligopeptide transport
  Homolog annotation: Hit_ID=Q9LYR6; Match level="QueryCoverage=91%, HitCoverage=10%, E-value=8e-21, Identity=74%"; Hit description =Peptide transporter-like protein
  Subcellular localization annotation: CTP_CleavageSite=52; ConfidenceScore=5.02e-01
MVFFIGTPLYRHRLLGGSSLTRVAQVLVATFRKRKASFGSNEFIGLYEVPVRQSVIKGSQKIAHTNDFWGET

SEQ ID NO: 199793 - protein, 187 aa, Glycine max
  Coding DNA Sequence Number=SeqID_83015
  Gene Ontology: Mol. function=peptidase activity; Cellular component =nucleus; Biological process=spore germination
  Homolog annotation: Hit_ID=Q01CP2; Match level="QueryCoverage=44%, HitCoverage=87%, E-value=6e-19, Identity=53%"; Hit description =Homology to unknown gene
  Pfam annotation: Domain name=DUF163; Domain location=45-187; Score =164.6; E_value=2.5e-46; Accession=PF02590.8; Description =Uncharacterized ACR, COG1576
  Subcellular localization annotation: CTP_CleavageSite=25; ConfidenceScore=5.45e-01
MGTALHLCVSFNPAQGFYSPTRFSLCNAFSSHSLKLTPKIFQRALPIRILSVGKKRSRGLQLMVDEYVDKLRYYCSVEDVQIRPNPQNARDQRAQVDAEDEAVMNLIRSDDWVVMLDERGQDIGSEQMAELVGDAGNTGASRLSFCIGGPYGHGRKMRERANLSIKLSSLVLNHQIALLVLVEQLYR

SEQ ID NO: 199794 - protein, 82 aa, Glycine max
  Coding DNA Sequence Number=SeqID_83016
MEATRSTFIRTGKRSVTVTELGVGGLSLNGEEGRKRDAAMAIPLSRNATVTQNKAEASHVPRVMKIELGSYMSRIIGFCDAT

SEQ ID NO: 199795 - protein, 55 aa, Glycine max
  Coding DNA Sequence Number=SeqID_83017
METTLNDEKAHAVARMLLKYLDMMDAKENEKPKSDEEEDEEDGGMKAFECGNGGC

SEQ ID NO: 199796 - protein, 94 aa, Glycine max
  Coding DNA Sequence Number=SeqID_83018
MEGLVSHCYERLLKLQVVDGKRRRPIGMMMGKECSQSLTLSAIVALSILSSQLFGLLPVRRKSSFEEIFCNFDFPTFELFYFYLQALLGRHTGT

SEQ ID NO: 199797 - protein, 83 aa, Glycine max
  Coding DNA Sequence Number=SeqID_83019
MEEGGATWAGAAVYDSNDATAEKGTIASGHQWRPPMDLMTVLDIGNSMSNAELHMLKRAMRLVISSLGAANWLAVVAFMIDSK

SEQ ID NO: 199798 - protein, 280 aa, Glycine max
  Coding DNA Sequence Number=SeqID_83020
MSKMGNWKKKCRELLRPREVLYLLTITILSLLLPLSFLLLATLSGAQYYLQALTYYSSQPFPYLFHLALNINPCILYFLVSIVSVGTLIQGLMGKITLLSELPSKSSRISTAWILLCAFQVCVGLGIEGSIAAGLYDDDDVSSFGAERSLLSRMIFLLGLHETTHVWCRMVVRPVVDDTVFGGARRERWVERVGQAAGLGTLWWWRLREEVETLVVVAQVKSEQLMDVGLGDFVGWWLYYLIVTIGMVRIVKGLMWIFMISLCRTRPTIEVESSQNDDKV

SEQ ID NO: 199799 - protein, 220 aa, Glycine max
  Coding DNA Sequence Number=SeqID_83021
MKKKLLFFMVLPMAISAQVGINTTQPTKTLDVNGELRVRTLNQGTETDVILSADAAGNVRKISRNELNGGGSSGFNSTILGYDPQPVSKRQIPPGPVPGGGTATELGCKKWAVNNHTYCAYQISQPITWFNAFNFGKQMGGYLVTMPSDTERAWVNTNIVASGTGYNLANNIWIGFNKIRRPGNPDQLQWITGEEFRINWSTNPATTENWFASGEPNNAG

SEQ ID NO: 199800 - protein, 630 aa, Glycine max
  Coding DNA Sequence Number=SeqID_83022
  Homolog annotation: Hit_ID=Q5QLZ3; Match level="QueryCoverage=40%, HitCoverage=44%, E-value=1e-47, Identity=44%"; Hit description =Gastric mucin-like protein
MEKKKEEGGKVGLRKKPCGMMSGRNVRESLLGSLNHHRRGHSFNGVANNNHHHDDNLDLFSDNRRSLALAASSDDSSDVSVKLGRLSVGTAKPVRSGIDDLLSSTEGGKHDYDWLLTPPGTPVFPSEGESQTTLAPPRRSLTRSTSTSKASREDYPPPYQQGARVFAFLGGFGVKKDKLAVSQSENNPPSRPARSSSVTRSSISTSHSQYSSYSSNRHSSSILNTSSASVSSYIRPSSPVTHSSSAARPSTPSSRPTASRSSTPSKPRSVSTNSTAEKNRPSSQGSRPSTPSSRPHIPANLHSPSASSTRSLSRPSTPTRRSSMPSLSPSPSPTTGSLTSAGRVSSNGRSSAPASRPSSPSPRVRPPPQPIVPPDFPLETPPNLRTTLPDRPVSAGRSRPGGVTMKANVSETQASPVTMPRRHSSPIVSRGRVTEPAAKTRGYSNGHHADASEPRKVSHAPEVAARKSIRSSTTAPDNTGFGRTISKKSLDMAIKHMDIRNSSGNIRSLSSTTLFPQSIRTSTSKSHRVSSAPASVDMNGSMISSKNGANFDVGNGIDRNMMMKGRDADERQYSAKLSEVDIYESSRYDALLFKEDLKNTNWLHGADDKCDQGPIFDNGFEHLPEPFGLL

SEQ ID NO: 199801 - protein, 607 aa, Glycine max
  Coding DNA Sequence Number=SeqID_83023
  Gene Ontology: Mol. function=protein kinase activity; Cellular component=integral to membrane; Biological process=protein amino acid phosphorylation
  Homolog annotation: Hit_ID=Q9LVM0; Match level="QueryCoverage=95%, HitCoverage=90%, E-value=0.0, Identity=57%"; Hit description =Receptor-like protein kinase
  Pfam annotation: Domain name=LRRNT_2; Domain location=26-64; Score =47.9; E_value=3.3e-11; Accession=PF08263.3; Description=Leucine rich repeat N-terminal domain
  Pfam annotation: Domain name=LRR_1; Domain location=118-137; Score =11.6; E_value=1.9; Accession=PF00560.23; Description=Leucine Rich Repeat
  Pfam annotation: Domain name=LRR_1; Domain location=140-162; Score =19.0; E_value=0.017; Accession=PF00560.23; Description=Leucine Rich Repeat
  Pfam annotation: Domain name=LRR_1; Domain location=164-184; Score =7.2; E_value=13; Accession=PF00560.23; Description=Leucine Rich Repeat
  Pfam annotation: Domain name=LRR_1; Domain location=186-208; Score =16.1; E_value=0.13; Accession=PF00560.23; Description=Leucine Rich Repeat
  Pfam annotation: Domain name=LRR_1; Domain location=94-116; Score =7.7; E_value=10; Accession=PF00560.23; Description=Leucine Rich Repeat
  Pfam annotation: Domain name=Pkinase; Domain location=332-599; Score =86.2; E_value=1e-22; Accession=PF00069.15; Description=Protein kinase domain
  Pfam annotation: Domain name=Pkinase_Tyr; Domain location=331-599; Score=57.7; E_value=5.2e-16; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=26-64::118 -137::140-162::164-184::186-208::94-116::332-599::331-599
MMLQSYFTTIPIFLLLLVFTRTKADLQSEKQALLDFAAALHHGPKVNWNSSTSICTSWVGVTCSHDGSHVLSVRLPGVGLRGFLPPRTLGKLNGLISLSLRSNSLRGNLPTDLLSLPSLRFVYLQHNNFSGVIPDSLPPRLIFLDLSHNSFTGQIPASIQNLTHLIGFNLQNNSLTGPIPDVNLPSLKDLDLSFNYLNGSIPSGLHKFPASSFRGNLMLCGAPLKQCSSVSPNTTLSPPTVSQRPSDLSNRKMSKGAKIAIVLGGVTLLFLPGLLVVFFCFKKKVGEQNVAPKEKGQKLKEDFGSGVQEPERNKLVFFEGCSYNFDLEDLLRASAEVLGKGSAGTTYKAILEDGTTVVVKRLREVAMGKKEFEQQMEIVQRLDHHPNVIPLRAYYYSKDEKLMVYDYSTAGSFSKLLHGTTETGRAPLDWHTRLKIIVGAARGLAHIHSANGKKLVHGNIKSSNVILSIDLQGCISDFGLTPLTNFCGSSRSPGYGSPEVIESRKSTQKSDVYSFGVLLLEMLTGKTPVQYSGHDEVVDLPKWVQSVVREEWTAEVFDLELMRYPNIEDELVQMLQLAMACVAVMPDVRPSMEEVVRTIEELRASIY

SEQ ID NO: 199802 - protein, 109 aa, Glycine max
  Coding DNA Sequence Number=SeqID_83024
MTSSSLRRKLKNIFKDFTISFGKTSNKQQEAKRGRELTRIFSTQQHQNKALNNPNTGCFASGNDNTYMQPVSLTRLAIHTCTCHLKSAPTPCHLRPSLVPLLRLSEYLQ

SEQ ID NO: 199803 - protein, 309 aa, Glycine max
  Coding DNA Sequence Number=SeqID_83025
  Homolog annotation: Hit_ID=Q9SLE2; Match level="QueryCoverage=93%, HitCoverage=89%, E-value=1e-102, Identity=64%"; Hit description =Expressed protein
  Pfam annotation: Domain name=SGL; Domain location=27-286; Score= -94.1; E_value=0.0023; Accession=PF08450.2; Description=SMP -30GluconolaconaseLRE-like region
LLLLLSAIPIGIIVTLERAKPATHVYHYHSNGWFRECAKWDSHNRRFIVSFFEGGLGQVLLPEKDYESSPPLEEVTVVKETHLAGNASLGIAIDAPRNRVLVVNADVIGNRYGALAAYDLSTWNRLFLTQLSAPSDEKSFADDVAVDAEGNAYVTDAKGNKIWKVGVEGKLISIIRNPLFTSKEWYKNLVGLNGIVYHPDGFLIVIHTFSGNLFKIDLTKGEEVKIIKLKEGTLSFGDGLELLSPTKLVVAGNPSGRLVESTDGWNTASVVGTFSGPKHRLATAATVKDGKKSKHWGTGNVGIIHLQDV

SEQ ID NO: 199804 - protein, 845 aa, Glycine max
  Coding DNA Sequence Number=SeqID_83026
  Gene Ontology: Mol. function=protein binding; Cellular component =nucleus; Biological process=regulation of transcription, DNA -dependent
  Homolog annotation: Hit_ID=Q76I94; Match level="QueryCoverage=99%, HitCoverage=99%, E-value=0.0, Identity=50%"; Hit description=PHCLF3
  Pfam annotation: Domain name=SET; Domain location=650-817; Score =40.0; E_value=8.1e-09; Accession=PF00856.18; Description=SET domain
MVSKPTDSASKPRKQLGEPANDGIGSLSLELNQLKKQIQAERIVCIKEKIRSNEKKLQCHMSGVLSETSTRGSSQTEENRKNPILSSRIDHPLCKFSGFSPVWGDKDHNNQDVLSATSIKMPYIETLPPYTSWIFLDRNQRMAEDQSVVGRRRIYYDQHGSEALICSDSEEELTEPEEEKHEFSEAEDRVIWMAFEEYGLNKEVPNIVSEFVGGTSLEIQERYKTIKEKNIGRLDQPSQNSGEYESTIGICLEKSLSAALDSFDNLFCRRCLIFDCRLHGCSQPLIYHSEKQTVWSDPEGDRKPCSDQCYLQLKVVKNVTEDSTSGSDQNKRTTITEEADVILAPSIIEEPSNQSIIPFQTEVDCHGSLNLNVPISVSVEKRKVLNQSDMSPRDSTLHPNDCQNSYKKLKAISDAVVTVNSDSSKKISLGACGESIHTITSAILDKSVKDNSIKLIDSSSTCPSDEQDKSIGDGPKDPTNETEFKMSNSMEGIVDGMLSLSDWKPLEKELYLKGVELFGRNSCLIARNLLPGLKTCMEIASYMHSGGVSMPHGSIVAPSSIMEEKGKFDADCTDQEMPSRSRLLRKRGKTRKFKYSWKSAGHPSIWKRIADGKNQSCKQYTPCGCQSMCGKEFVQKAAKIGSEDAIVPRVSVEVDNAHVLLQDGNVIQMSVGIAGLLNEHVSNLLLHLIKKVIDSQNHSNILYPNNPVFQCCGDGSLGEPPRRGEGQCGNMRLLLRQQQRILLAKSDVAGWGAFLKYVLDAYRKGDKLKFANHSSNPNCYAKVMLVAGDHRVGIFAKEHIDASEELFYDYRYGPDQAPPWARKPEGSKRDESTAPQGRAKKHQSH

SEQ ID NO: 199805 - protein, 864 aa, Glycine max
  Coding DNA Sequence Number=SeqID_83027
  Gene Ontology: Mol. function=RNA-directed DNA polymerase activity; Cellular component=chromatin; Biological process=chromatin assembly or disassembly
  Pfam annotation: Domain name=Chromo; Domain location=760-814; Score =55.0; E_value=2.5e-13; Accession=PF00385.14; Description='chromo' (CHRromatin Organisation MOdifier
  Pfam annotation: Domain name=RnaseH; Domain location=220-326; Score= -30.7; E_value=0.042; Accession=PF00075.14; Description=RNase H
  Pfam annotation: Domain name=rve; Domain location=458-614; Score =125.3; E_value=1.7e-34; Accession=PF00665.16; Description=Integrase core domain
  Pfam annotation: Domain name=zf-H2C2; Domain location=399-440; Score =13.2; E_value=0.0065; Accession=PF09337.1; Description=His(2)-Cys(2) zinc finger
  Pfam module annotation: Pfam domain module=Chromo::RnaseH::rve::zf -H2C2; Domain location=760-814::220-326::458-614::399-440
MLSIFCNIFRHIDRTQPAAGMPHEQLIHHESNGPKELLDELNGAKFYSKLDLKSGYHQVRVKESDVHKTAFRTHEGHYEFLVMPFGLMNAPSTFQSLMNHVLSLLSSHSLVANRKKCHFAQRAVEYLGHLITEEGVAVDPSKVASVIKWPQPKNVKGVRGFLGLTGYYRRFIKDYGKVARPLTELTKKDNFKWGEEAQQSFEALKEKLTTAPVLALPDFSKNFVIECDASGGGALGTRNLVKSTYEKELMAVVLAIQHWRPYLLGRKFVVSTDQKSLKQLLQQRVVNADQQNWASKLLGYDFEIVYKQGRLNRGADALSRINKGLELNTINSYVKWMQEEQVRAENKQDEKLQRITKEVQEDPTLWPGYEYRQGVLLYEGRLVISNKSELIPTLLEEFHSSPHGGHSGFYKTYRRLAANVYWVGMKRTIQEFVKGCDTCQRQKYMASSPGGLLQPLPIPAQVWEDISIDFITGLPKSKGYEAILVVVDRLSKYSHFIPLRHPYTARSVADVFCKEIIRLHGVPLSIVSDRDPIFMSSFWKELFKMQGTKLKMSTAYHPESDGQTEVVNRCLETYLRCFISDQPKTWMSWVHWAEYWFNTTFHAATEKTPFEIVYGRPPPVLTRWLQGETRVEAVQRDLLDRDEALRQLKSQLLRAQDRMRNQADKRRVDRSFVCGEWVFVKLRAHRQKSVVSRINAKLAARYYGPYPIIEKIGAVAYRLKLPEGSRVHPVFHVSLLKKAVGRYEEKEELPDLLEEHIEMYEPEAVLAARKVKQQGEEVKQVLIHWKGKTVEEATWEDEIMIRSQFPKFGLEDKATTEEGGIDRTQPAAGMPHEQLIHHESNGPKVWKDVVGGEKGGSWEIGGIF

SEQ ID NO: 199806 - protein, 166 aa, Glycine max
  Coding DNA Sequence Number=SeqID_83028
  Gene Ontology: Mol. function=two-component response regulator activity; Cellular component=thylakoid; Biological process=cell redox homeostasis
  Homolog annotation: Hit_ID=Q8H6X3; Match level="QueryCoverage=72%, HitCoverage=80%, E-value=7e-54, Identity=80%"; Hit description =Thioredoxin h-like protein
  Pfam annotation: Domain name=AhpC-TSA; Domain location=46-157; Score=- 22.0; E_value=0.057; Accession=PF00578.11; Description=AhpCTSA family
  Pfam annotation: Domain name=Thioredoxin; Domain location=53-157; Score=93.0; E_value=8.8e-25; Accession=PF00085.10; Description =Thioredoxin
  Pfam module annotation: Pfam domain module=AhpC-TSA::Thioredoxin; Domain location=46-157::53-157
RLDSDDENKNRETNLTGCKTNENYGRIRNWQLFYNKARDNDSDHNVDFAAGNVKLITTKEAWDQYLEEARRDGKIVIANFSAAWCGPCKMIAPYYCELSEKYTSMMFLVVDVDELTDFSTSWDIKATPTFFFLKDGQQLDKLVGANKPELQKKIVAINDSLPEYKQ

SEQ ID NO: 199807 - protein, 199 aa, Glycine max
  Coding DNA Sequence Number=SeqID_83029
  Gene Ontology: Mol. function=protein dimerization activity; Cellular component=nucleus; Biological process=regulation of transcription, DNA-dependent
  Homolog annotation: Hit_ID=Q0GPH6; Match level="QueryCoverage=67%, HitCoverage=90%, E-value=1e-70, Identity=97%"; Hit description=BZIP transcription factor bZIP60
  Pfam annotation: Domain name=RRM_1; Domain location=30-103; Score =19.0; E_value=0.0025; Accession=PF00076.12; Description=RNA recognition motif. (a.k.a. RRM, R
  Pfam annotation: Domain name=bZIP_1; Domain location=72-133; Score =38.0; E_value=3.2e-08; Accession=PF00170.11; Description=bZIP transcription factor
  Pfam annotation: Domain name=bZIP_2; Domain location=69-123; Score =27.1; E_value=6.2e-05; Accession=PF07716.5; Description=Basic region leucine zipper
  Pfam module annotation: Pfam domain module=RRM_1::bZIP_1::bZIP_2; Domain location=30-103::72-133::69-123
MAQVHVPPHNAILVRNGGGTVRNQFVTTSLYVGDLDPNVTDAQLYDLFNQLGQVVSVRICRDLTGGDPVMYERKRKRMESNRESARRSRMKKQKQLEDLTDEVSRLEGENARLAPSIKVKEEAYVEMEAANDILRAQTMELADRLRFLNSIIEIADEVGGESFEIPQIPDPLFMPWQIPHPMMATPPDMFFHGNEGLFA

SEQ ID NO: 199808 - protein, 1765 aa, Glycine max
  Coding DNA Sequence Number=SeqID_83030
  Gene Ontology: Mol. function=molecular_function; Cellular component =cellular_component; Biological process=regulation of transcription, DNA-dependent
  Homolog annotation: Hit_ID=Q8L7M8; Match level="QueryCoverage=96%, HitCoverage=92%, E-value=0.0, Identity=51%"; Hit description =Putative WD-40 repeat protein
  Pfam annotation: Domain name=WD40; Domain location=205-243; Score =40.5; E_value=5.6e-09; Accession=PF00400.22; Description=WD domain, G-beta repeat
  Pfam annotation: Domain name=WD40; Domain location=247-285; Score =35.7; E_value=1.6e-07; Accession=PF00400.22; Description=WD domain, G-beta repeat
  Pfam annotation: Domain name=WD40; Domain location=308-346; Score =21.5; E_value=0.0031; Accession=PF00400.22; Description=WD domain, G- beta repeat
  Pfam annotation: Domain name=WD40; Domain location=359-423; Score =14.8; E_value=0.31; Accession=PF00400.22; Description=WD domain, G -beta repeat
  Pfam annotation: Domain name=WD40; Domain location=492-531; Score =12.0; E_value=1.5; Accession=PF00400.22; Description=WD domain, G -beta repeat
  Pfam module annotation: Pfam domain module=WD40::WD40::WD40::WD40::WD4 0; Domain location=205-243::247-285::308-346::359-423::492-531
  Subcellular localization annotation: CTP_CleavageSite=11; ConfidenceScore=5.05e-01
MDSRKGKASVSASSLSAAPLSVSNKVDQMVSPPRDVRAVETDEELLEHQLLPRRYHAWFSRSGEPSGDDADEDDDGISLPLDYSNLVGRYPHITKDHLVKLLKQLMLSTVNPLHGKLEGSSPNAADVPTLLGYGSFSLLNVDRKTADKLVKPPPLYMRWPHMKANQVQGLSLREIGGGFTKHHRSPSIRSACYAIAKPSTMVQKMQNIKKLRGHRVAVYCAIFDGSGRYVISGSDDRLVKIWSMETAFCLASCRGHEGDITDLAVSSNNALVASASNDFVIRVWRLPDGMPISVLRGHTGAGNAPPASLPSSSNVQQSYQVLCCAYNANGTVFVTGSSDTYARVWSALKPNTDDAEQPIHEMDLLSGHENDVNYVQFSGCSVASKILTSDPWKEENTLKFRNFWYCHDNIVTCSRDGSAIIWVPRSRKSHGKVGRWTRAYHLKVPPPPLPPQPPRGGPRQRFLPTPRGVNMIIWSLDNRFVLAAIMGNLLANPLLYENRGRGNNSYVLDVHPFNPRIAMSAGYDGRTIVWDIWEGIPIRTYEIGRFKLVDGKFSPNMRNLQLLAYHLRDPVPCAWSFLACRIGLNNLLNSERAATFCLLDHQETRLDPRKIEALEVDLLSSKSQVPRNSTLKIPKYPFHYRPVLFQRLRHELTFLLTEKLISGLVMDWLLTEKLLIRPFGMAPTTNLYRLASRSVGFCRMDGTSIVLSDDVGQIYFLNTGQGESQKDAKYDQFFLGDYRPLIQDTQGYVLDQVVSSHCAPETQLPPHRRNIQEPLCDSSMLPYPEPYQSQFQQRRLGALGIEWRPSLIKYAVGPDFTVGQDYPVVPLVDLEVMVEPQPEFLDAMFWEPEYDIIVSDDADSEYNANEDSSSAAGQGSVISSSDLEYSDDSSNRDGLRRSRRKKHNVGVMTSSGRRVRKRNLDECNGNTSGSNRLRKKSKGSSKASKRKSSIAKTLRPQRIAAHNARSMFSQIDETSTDGEDNDSDEEASDSFQDPDDLSESEREMDNKHLEIKKPLLEKFATVSKPPAFSESLVNVETRPRLVVKFSLRDSKKNVPTEDTRLACETQDNMVSQSSRPQPEESDQKTFPDTKSLDPALSSMVATNAELPQSLNGNENDDKEQTENATNNLYAFRYVEANTDQCRKMKTHTHELSRSGDALLTDAEIDDLLEHNANGYVKPEMNLRKRRSEHVIGKLETVGSMVNTELTDFEDAPKFSSLEPSLFGNPQPNADGSLTSGYDKFNEGDKGQSGSDKCAEDTLENNEVVHSSHCHDLKMKAPVKSTKLVIKKKQISADTEGPCKLKIVSSKADSSCARGIGISENSSSMGPNLVTEVPEGEDDRKFSSPQLLHSYSDKRSYDHFHKRDKSYKGKVNQDGFESFDCDMGEHTSVFSNQHGLGIGLSDVTSDPMRQTRFIRMKTTSEEPSTSNRRIKIRQGQSSRGKSDREDSSTRMSDQLHRRIRTARHRNGEYIANDSGTLTRRVSNHHVKKLSWLMLSEPEEGYRYIPQLGDEVVYLRQGHQEYIKSYSLSESGPWRSFTGLGASEICKVEELEYAELPGSGDSCCKLKLRFLDPSSCVHGKSFKLTLPELINFTDFVIEKTWYDTAMKRNWSSRDKCMVWWRNEDGKGGSWWDGRIIQVQAKSDDFPESPWERYRVQYKTDPTENHLHSPWELYDSEMLWEHPHIDHEIRDKLLSYFTKLDRRERFDIQALNQVAEKLEFANRFPAPFYPELIQSRLKNDYYRSVEGEYQNGLEGNLKGYRKLKLDFI

SEQ ID NO: 199809 - protein, 199 aa, Glycine max
  Coding DNA Sequence Number=SeqID_83031
  Gene Ontology: Mol. function=transferase activity; Cellular component= intracellular; Biological process=regulation of transcription
  Homolog annotation: Hit_ID=Q9FI49; Match level="QueryCoverage=94%, HitCoverage=47%, E-value=2e-42, Identity=40%"; Hit description =Similarity to selenium-binding protein
  Pfam annotation: Domain name=PPR; Domain location=103-137; Score=6.4; E_value=1.3; Accession=PF01535.11; Description=PPR repeat
  Pfam annotation: Domain name=PPR; Domain location=68-102; Score=8.2; E_value=0.79; Accession=PF01535.11; Description=PPR repeat
  Pfam annotation: Domain name=PPR; Domain location=7-41; Score=44.4; E_ value=3.9e-10; Accession=PF01535.11; Description=PPR repeat
  Pfam module annotation: Pfam domain module=PPR::PPR::PPR; Domain location=103-137::68-102::7-41
MSVRDVVTWNSMVGGYVKNSRFFDALSIFRRMLSDKVEPDGFTFALVVTACARLGARQCQMGAWFDGLMFQDRFSGLAIHGLAMNANVVFSRMQMESVLPDSITFIGILTACSHCGFVEEGHKYFGMMQNRFMIQPQLKHYGTVVDLLGRAGLMEDVIWRALLSACRIHRKKELGEVAIANISRLESGDLCCCQICIAL

SEQ ID NO: 199810 - protein, 84 aa, Glycine max
  Coding DNA Sequence Number=SeqID_83032
  Gene Ontology: Mol. function=transferase activity, transferring glycosyl groups; Cellular component=integral to Golgi membrane; Biological process=protein amino acid glycosylation
  Homolog annotation: Hit_ID=Q4JEZ7; Match level="QueryCoverage=76%, HitCoverage=14%, E-value=6e-31, Identity=100%"; Hit description =Sialyltransferase-like protein
MAYELHLRLFGDSQIYDFDRRVGAGSEDPLAACSIIKKQVKRNLNAVSKLRKAALDHLRYVKRTTMYPLEHSPGHGSLCTVPTD

SEQ ID NO: 199811 - protein, 458 aa, Glycine max
  Coding DNA Sequence Number=SeqID_83033
  Gene Ontology: Mol. function=acyltransferase activity; Cellular component=integral to membrane; Biological process=biosynthetic process
  Homolog annotation: Hit_ID=Q9FH27; Match level="QueryCoverage=97%, HitCoverage=96%, E-value=1e-135, Identity=53%"; Hit description =Probable 3-ketoacyl-CoA synthase 20
  Pfam annotation: Domain name=ACP_syn_III; Domain location=180-253; Score=-15.3; E_value=0.026; Accession=PF08545.1; Description=3 -Oxoacyl-[acyl-carrier-protein (ACP)
  Pfam annotation: Domain name=ACP_syn_III_C; Domain location=349-431; Score=13.4; E_value=5.8e-07; Accession=PF08541.1; Description=3 -Oxoacyl-[acyl-carrier-protein (ACP)
  Pfam annotation: Domain name=Chal_sti_synt_C; Domain location=287 -433; Score=16.0; E_value=8.1e-05; Accession=PF02797.6; Description =Chalcone and stilbene synthases, C-te
  Pfam annotation: Domain name=FAE1_CUT1_RppA; Domain location=43-332; Score=522.6; E_value=4.2e-154; Accession=PF08392.2; Description =FAE1Type III polyketide synthase-lik
  Pfam module annotation: Pfam domain module=ACP_syn_III::ACP_syn_III _C::Chal_sti_synt_C::FAE1_CUT1_RppA; Domain location=180-253::349 -431::287-433::43-332
MEPQSLCSSLEILTQHINTIIDLISSPYHCFTVVLVAFLATLFFACRRKAPIYLIDFTCYCPPSSYRLPLAMFEENQLYDNMDPDAVAFQCKIMAKSGFSEQTSISPSLAQIPKIKALSFALDEAETIMCSVIKDLFEKHNINPKAIDIIITNSSVFCPTPSLSAVVVNKFRMRSNIMSFNLSGMGCSAGIISMSLAKDLLRVHRNSLALIVSTETLSLNWYTGKVPSMLLSNCLFRMGGAAILMSSRVQDKHKAKYKLQHIVRTITAQDDQSHGCVYQQVDPENKEGISISKNIVNVSGDALKKNIASLGPLVLPLREQFLYLFSIICRKVWSSRRISIYTPNFNHAFEHFCIHSGGRAIIEAVERNLRLRKQDVEPSTMTLYRFGNISSSSIWYELSYIEAKGRMKSGDRVWQIAFGSGFKCNSAVWKCVCDVKPDTATAWRDTIHSYPLDIVRKN

SEQ ID NO: 199812 - protein, 421 aa, Glycine max
  Coding DNA Sequence Number=SeqID_83034
  Gene Ontology: Mol. function=transferase activity, transferring glycosyl groups; Cellular component=integral to Golgi membrane; Biological process=protein amino acid glycosylation
  Homolog annotation: Hit_ID=Q4JEZ6; Match level="QueryCoverage=99%, HitCoverage=85%, E-value=0.0, Identity=85%"; Hit description =Sialyltransferase-like
  Pfam annotation: Domain name=Glyco_transf_29; Domain location=116 -408; Score=-0.9; E_value=4.4e-07; Accession=PF00777.9; Description =Glycosyltransferase family 29 (sialyltransferase)
MRILQLGLFLALASGFAAISIYITGLSDPFVFLFFCLESNNNVTTTRADPSYHLTDEDTQALLSLHDTFQKCVSANGLGLKATRGTDYCQTTINFPSDTIPKWKDPKTGELEALSFDFNLCEAVATWEQVRNSTTILTKEFIDSLPNGWEEYAWRRINKGIQLNRCENKTLCMEKLSLVLPETPPYFPRQFGRCAVIGNSGDLLKTKFGNEIDGYEVVIRENGAPTQNYTDYVGRKSTFRLLNRGSAKALDKVVELDGIATCYLVSSTCCNVNYYNLTIIAVSAEQRKEVLIIKTTIHDIMNKMIREVPIKNPVYLMLGASFGSAAKGTGLKALEFALSMCDSVDMYGFTVDPGYKEWTRYFSESRQGHTPLHGRAYYQMMECLGLIKIHSPMRADLNRVVKWVPSRHIIRSARIASEKLL

SEQ ID NO: 199813 - protein, 116 aa, Glycine max
  Coding DNA Sequence Number=SeqID_83035
MHEQSTSRVKNHIRLNLSQLDHNFWLEENTTTKQGQEVSDCVDHPERRGLCSSMYQSMAKGQPDKGGSWLRFSAETSIGDQQRRLVCQLVTNKEGEEPKTETTSRGKTQWKSEESH

SEQ ID NO: 199814 - protein, 86 aa, Glycine max
  Coding DNA Sequence Number=SeqID_83036
MIVGTSSGGDRDRSNEDNNNDRDIGSYNVDGSATKIVIMMVIMVVHDDDNNDNNSHNDNSSNTIRVTTTTLWCGVCGDRQPPEKEQ

SEQ ID NO: 199815 - protein, 175 aa, Glycine max
  Coding DNA Sequence Number=SeqID_83037
MLLLERLIGSVRLYASEVVITFSFKDWSSFDNLDVFSNKEQNKKSPDTVLQPKRGRPYLLAIKQSMRSCICIHQKKAHTKPNQSDYLQVSRVSMMSISDLVGSYRLQNYQFFKSNTSESEATNSTFSICACNNSRQRPKIPETVYVGEPSSFCDSYQYPPTEEEVEYDSMRLPEI

SEQ ID NO: 199816 - protein, 651 aa, Glycine max
  Coding DNA Sequence Number=SeqID_83038
  Gene Ontology: Mol. function=RNA-directed DNA polymerase activity; Cellular component=chromatin; Biological process=chromatin assembly or disassembly
  Pfam annotation: Domain name=rve; Domain location=460-637; Score =37.7; E_value=4.1e-08; Accession=PF00665.16; Description=Integrase core domain
  Pfam annotation: Domain name=zf-H2C2; Domain location=405-442; Score =19.7; E_value=0.00087; Accession=PF09337.1; Description=His(2) -Cys(2) zinc finger
  Pfam module annotation: Pfam domain module=RVT_1::rve::zf-H2C2; Domain location=47-335::460-637::405-442
MDRHIQLLPHSTSVNVHPYRYPHFQKCEIELQVESMLQKGLIQPSTSPFSSLMLLVRKQDGTWQFCVDYRALNVITIKDCLPIPTIDELLDELGGATCFSKLDLLQGYHQIRMNAKDTPKTAFHTHHGHYEFRVEYLGHLVLRKGVEPLALKIEAIIHWPTPRTTRAVRSFLGLAGFYHRFIRGYASIAASLVHVTTMEQFVWTLQAQEAFDQLKRALVAAPILALPDFNLPFTIETDASGIGMGAVLSHKGHPLAFFSKSFSPKLLRESAYVRELFAITTAMKKWRQYLLAHVLASLMGYDYQIQYRSGTHNQAVDALLRCFDKELFTLMNLSVPCPLFFEELKAQMEHHSKYQKLRQDISTAPDKYPNFIIVHDLILRKGRIWLPQGLPLIRTLLVEFLSTPTDGHMGVAKTLARISENFCWTGLRDDVVKFVAQCINCQYAKYETKRTAELLCPLPVPHRPWENLSMDFITGLPPYHDNTVILVVVDHFSKGIHLDMFPAAHTAHAVASLFMEIVGKIHCLPQSLVSDRDPLFVSKFWQELFRRSGTQLRMSSTYHPQSDGQTEVLNRWSHNTSWNAGRGMTPYEITFGRKPFNFSEYLAGSSKLNVVDEMLTDREGIFQTIRKKLLKAQEKMKTIADAKRREVEYHP

SEQ ID NO: 199817 - protein, 1301 aa, Glycine max
  Coding DNA Sequence Number=SeqID_83039
  Gene Ontology: Mol. function=ubiquitin-protein ligase activity; Cellular component=ubiquitin ligase complex; Biological process =protein ubiquitination
  Homolog annotation: Hit_ID=Q42384; Match level="QueryCoverage=17%, HitCoverage=47%, E-value=1e-123, Identity=92%"; Hit description =PP1/PP2A phosphatases pleiotropic regulator PRL1
  Pfam annotation: Domain name=WD40; Domain location=1080-1118; Score =33.3; E_value=8.5e-07; Accession=PF00400.22; Description=WD domain, G-beta repeat
  Pfam annotation: Domain name=WD40; Domain location=1122-1160; Score =41.0; E_value=4.2e-09; Accession=PF00400.22; Description=WD domain, G-beta repeat
  Pfam annotation: Domain name=WD40; Domain location=1164-1202; Score =36.2; E_value=1.1e-07; Accession=PF00400.22; Description=WD domain, G-beta repeat
  Pfam annotation: Domain name=WD40; Domain location=1206-1243; Score =17.9; E_value=0.037; Accession=PF00400.22; Description=WD domain, G -beta repeat
  Pfam annotation: Domain name=WD40; Domain location=1248-1285; Score =4.7; E_value=10; Accession=PF00400.22; Description=WD domain, G-beta repeat
  Pfam annotation: Domain name=WD40; Domain location=683-719; Score =11.7; E_value=1.6; Accession=PF00400.22; Description=WD domain, G -beta repeat
  Pfam module annotation: Pfam domain module=WD40::WD40::WD40::WD40::WD4 0::WD40; Domain location=1080-1118::1122-1160::1164-1202::1206 -1243::1248-1285::683-719
MEHESKQFMDIAEYEGHKKALKQLKSVQYQGKEDQTMSSIKCFKDMMIEAHSKTPVSVDACYKDFRDRKDLENVDDRKFYIQTTITKADDLPPEIYNWKLQQHSGLPQAHQHPMQEQLDKRNIIKLDSSRFNRSIEDFTLSISKYRDKTGNTLLNCHVEDELNEDASQPKKLFDHVTFTSACKHRPSQKNHEESSEIQRSYSLGKFDEVCSNSRRYSLRDLSELTERRISELHYSEVLGKCDEEYTVDIASIYESLISSSGATYASLKDVILDELLIAISTSKEERKIRASVSILTTIISRNKSIIEDVKKKGLRLCDLASALKQNVHEAVILIYLINPSPIDIKTLELLPILVEIVCTSNSYKNKQESLLLTPHAASLMIIEELVTSFDYATNNMHLATISSPHVLSGFLEVARNDNLEEFFSLTTILIKCMQYDAQCRKSSAISLLQRIQQESSINIMQILMHCAHQLQPDHQLLAANILLQLDILNSPDKGVFREEAVQILLRAMTSEESSEQILAASILSNLAGTYAWTGEPYTAAWLLRKTGLTSPYHQNMIRNFNWLDQSLQDTSTDLWCGKIAKCIISLGDSVFHTLERVLRSKIKRVSRDCLIAISWLGCQISKIPDSISYSASEVILSGIEQFLHPGIELEERLLACMCMFNYASGKGIVLNIVYVWDIRGHSASLVWDIKEHKKSVTCFSLYEPSDSLLSGSTDKTIRRKLECVEVIALKEPIHHLRAHGETIFSISESLGLKLVNESRVTKDILKGKHVKCMTVAQGKLYFGCTDSSIQEYSSTHNRELEIKPPTRSWRKQSKPINAVVAYRDWLYSANKHVEGTTFKEWKRTKRPKVSILTDKGDNVVDMEVVEDFLYLISSSSPNNIQAPKKLGRISAGSKITSILAANDIIFCGTETGLIKLAGEGFSAAPYHAVRKRRCCETLDRSDAVDGGGARGATVAKEAKLQVSEARSRSLLSHSRTPRSSRCRKVSVEYGGIKSTANQPPHQVSSATQDPGPSNTLALPGPGDSKDSQKGGPQNALVVGPTMPSTTPNDTGFQSKSTAVVSASGSSESCSSGQIWDLASGVLKLTLTGHIEQVRGLAVSNRHTYMFSAGDDKQVKCWDLEQNKVIRSYHGHLSGVYCLALHPTIDVLLTGGRDSVCRVWDIRSKMQIHALSGHDNTVCSVFTRPTDPQVVTGSHDTTIKMWDLRYGKTMSTLTNHKKSVRAMAQHPKEQAFASASADNIKKFNLPKGEFLHNMLSQQKTIINAMAVNEEGVMVTGGDNGSMWFWDWKSGHNFQQSQTIVQP

SEQ ID NO: 199818 - protein, 220 aa, Glycine max
  Coding DNA Sequence Number=SeqID_83040
MVKLVETRKPNWEKRREELIMLVLLNFWDGRELGIWREKEGKDLMVSLRMENGEWGPFCLPTFTFRLALALEVSSLLFFYHFGALVELTLPTSSMASSEKLDEALLKLTNNQVSLGESMQSLTLKIDDLLHRMTLIISPIPSPSPMVPPSSSTPATQHRMKLEVPRFDGTELLGWISKINQYFDYHGTPEHDRLTVASFYMEGRALAWFQWMSGNDQFTS

SEQ ID NO: 199819 - protein, 222 aa, Glycine max
  Coding DNA Sequence Number=SeqID_83041
  Gene Ontology: Mol. function=peroxidase activity
  Homolog annotation: Hit_ID=Q6H6D6; Match level="QueryCoverage=65%, HitCoverage=16%, E-value=1e-08, Identity=29%"; Hit description =Transducin-like
MKKRKEKEKAIVIRFIQDTLEDEKTRNGLKLRCTSNLRIQKQEFFEFSEQSVLSNLYWGIDSIEAAIQAQQPEERSFRLRNSEQMLQVPAMLDEEEVTATIPNRYLVCCSYFYLSVVRKLQGDEWQAALHFLQAVLVSPKLVWTEFASQLCESLFPQSGITMMQRNSSSRSLESVSSEDEMDEAIKEVARKYKEWLVYYQVMLYGETPWWRSYCSKQSPRSV

SEQ ID NO: 199820 - protein, 152 aa, Glycine max
  Coding DNA Sequence Number=SeqID_83042
MGVAAVHQHDHLVAGDQAQQAQRFWSEVTRQRIETNLGRARVTGVRLWFTWSYKRQRVLFFVCDQQKNPRGTTVASMRLFRPGRGASTEAMEDVPAKEVKGAEKLCAVVAEALLVVAEVTIGVAEHGAETTGLISGVGPEHQAISPPGGKQV

SEQ ID NO: 199821 - protein, 471 aa, Glycine max
  Coding DNA Sequence Number=SeqID_83043
  Gene Ontology: Mol. function=drug transporter activity; Cellular component=integral to membrane; Biological process=response to nematode
  Homolog annotation: Hit_ID=Q9FHB6; Match level="QueryCoverage=92%, HitCoverage=90%, E-value=1e-151, Identity=58%"; Hit description =Genomic DNA, chromosome 5, TAC clone:K24M7
  Pfam annotation: Domain name=MatE; Domain location=21-181; Score =142.1; E_value=1.5e-39; Accession=PF01554.9; Description=MatE
  Pfam annotation: Domain name=MatE; Domain location=242-401; Score =115.2; E_value=1.9e-31; Accession=PF01554.9; Description=MatE
  Pfam module annotation: Pfam domain module=MatE::MatE; Domain location=21-181::242-401
MRIGREEVVEEVKRLLWLAVPLFSVGILQYILQAISVMFIGHLGTLPLSGASMASSFASATGFNLLLGLATALDTFCGQSNGAGQYHMLGIHMQRSMLVVLMMSVFLSIIWYNTEPILKAMHQDKAISKEAGSYTQYMIPSLFAYGLLQCILKFLQTQKIVFPMVLTSGIAAVLHVLLCWLLVFKSGLGIKGAALANSISYWINVILISLYVRFSSACKHSWTGFSKMALHNLLDFLKLAAPSAVMHCLKVWTFELMVLMSGLLPNPKLETSVLSICLNTFGLAWMIPFGFSAAVSVRVSNELGSGNPQAASLAVRVVLSMALIEGVILVSAMILLRNVWGHVYSNDKEVIRYVSFMMPVLALSSFLDGIQGILAGCGWQKIGAYVNLGSFYLVGVPCAVVLAFIVHMKAKGLWMGIIFAFIVQVSLYIIITFRTNWEEQARKAQRRVELITIPPTTRDSVLPHQKQELVP

SEQ ID NO: 199822 - protein, 231 aa, Glycine max
  Coding DNA Sequence Number=SeqID_83044
  Gene Ontology: Mol. function=nucleic acid binding; Biological process= DNA integration
  Homolog annotation: Hit_ID=Q1S7C5; Match level="QueryCoverage=67%, HitCoverage=14%, E-value=4e-14, Identity=36%"; Hit description =Integrase, catalytic region
MRRTIHNLRKLVRKTTTRILRIGGIHNISVKGQIQTIIFRRTRGTRLSKVHSRRKGITQRIKFIVLPKWQFLCKNKAFNFFFTGDIWKSTLNKSNNRIEIPRKTFKNGIHVLAIGSNISYRSKRLNARKELRNEMIIKSSSMTKFPSELTRLHSSLMMKISVNLRARKCGLKPNKQKFREFLCASVFLRKYLESLELSALKSHQSLSESHHRSCSGSRHLWLNDRRRKEES

SEQ ID NO: 199823 - protein, 601 aa, Glycine max
  Coding DNA Sequence Number=SeqID_83045
  Gene Ontology: Mol. function=binding; Cellular component=nuclear condensin complex; Biological process=mitotic chromosome condensation
  Homolog annotation: Hit_ID=Q2QP00; Match level="QueryCoverage=99%, HitCoverage=44%, E-value=1e-178, Identity=55%"; Hit description =G14587-6, putative, expressed
MHSTEVDAHLKALKTLCKRKASNLKEAEALVLKWFHQVLSRASGIIEKFISENSEQNAEGSFFTPPRSGTRKGRKSVAKSKALSKAITAIYTVGSLVIVCPSADMSNVVPLLHTIITSGSSGPILNKLPGPSTSLQQEAPSFYIQGWLAMGKLCLADGKLAKNYIPLFVQELEKSGSAALRNNIVVIMADFCVRFTALVDCYITRITRCLLDPCELVRRQTFILLSRLLQRDYVKWRGVLFLRFLLSLVDESEKIRQLADFLFGNILKVKSPLLAYNSFVEAVFVLNDCHVHNGHRESQGSRKESQIFSIRGTDEESRSKRMHIYVSLLKQMAPEHLLATFAKLCAEILAAASDGMLNIEDATGQSVLQDAFQILGCKEIRISSTRASSESADVEEEGGENGSAARRKAITQAVKKGLIQNTVPIFIELKRLLETKNSPLIGSLMECLRIILKDYKNEIDDILVADKQLQKELIYDIQKYEAAKAKATVAEAVGTKPKSGSNQLADVSKNLTKTQEQTVGQSSNELPSDSRVASAIADTAAAATARSVLREINKGTGTPPLSSLSVPKVKSCTGMCNSKDKCMDVIQSLRKRQSFDSDEEN

SEQ ID NO: 199824 - protein, 317 aa, Glycine max
  Coding DNA Sequence Number=SeqID_83046
  Gene Ontology: Mol. function=microtubule motor activity; Cellular component=microtubule associated complex; Biological process =microtubule-based movement
  Homolog annotation: Hit_ID=Q6WJ05; Match level="QueryCoverage=80%, HitCoverage=28%, E-value=1e-112, Identity=79%"; Hit description =Central motor kinesin 1
  Pfam annotation: Domain name=Kinesin; Domain location=191-316; Score=- 174.9; E_value=0.0023; Accession=PF00225.13; Description=Kinesin motor domain
MPQGNAAAAAALLDHGGDAGDAVMARWLQSAGLQHLASPLASTAIDHRLLPNLLMQGYGAQSTEEKQRLLKLMRNLNFNGESGSEPYTPTTQSLGVAGSDGFYSPEFRGEFGAGLLDLHAMDDTELLSEHVVSEPFEPSPFMPGDTRVFEDDFDPINSKLESGEADTDASISLPMNSTRENNVAKIKVVVRKRPLNKKELAKKEDDVVTVTGNAYLTVHEPKLKVDLTAYVEKHEFCFDAVLDEHVTNDEVYRSTVEPIIPTIFERTKATCFAYGQTAFIFGSQCENLVNKEGMHLSLFFFGGEGVMFIAGMSDIVL

SEQ ID NO: 199825 - protein, 462 aa, Glycine max
  Coding DNA Sequence Number=SeqID_83047
  Gene Ontology: Mol. function=transferase activity
  Homolog annotation: Hit_ID=Q6Z0Z4; Match level="QueryCoverage=85%, HitCoverage=80%, E-value=1e-91, Identity=44%"; Hit description =Putative HGA1
  Pfam annotation: Domain name=DUF563; Domain location=82-328; Score =321.1; E_value=1.9e-93; Accession=PF04577.5; Description=Protein of unknown function (DUF563)
MIYDTVLAKSFSRYDQKRLGYGAFVSCLFIILSLCTVFKPYLGPVHVLSLKLFIDVDTKMLITSSSLQIAKVKGKETKKEELLCTSEERTEFCQARGDIRVHGKSSTVSIVSSKTTMLEKTMSRSLKPYARRGDIDAMNRVREWSVKAVNASQKAPQCTQSHNITAVLFSTGGYSGNHFHEFTDIVIPLFLTARQFNGEVQFIITDKRPWWISKHKPLLKKLSNYETMDIDGDDQVHCFPSVTVGLKRYQKELSIDPQKYSYSMKDFRDLLRSSYALKRVEAMKIRDGLRGKPRLMILSRKRSRSFTNTDEIAKMAASLGFDVIVKEAGWSMWGFANVVNSCDVLLGVHGAGLTNILFLPENAVFIQVVPYGGFTLDWLATNDFGKPSKDMNLKYLEYKIGLKESTLIQQYPLDHIFIKDPPLVEKIGWEEFKSVYLDKQNVKLDVDRFRPTLQKAFELLHQ

SEQ ID NO: 199826 - protein, 257 aa, Glycine max
  Coding DNA Sequence Number=SeqID_83048
  Gene Ontology: Mol. function=polynucleotide adenylyltransferase activity; Cellular component=nucleus; Biological process=RNA polyadenylation
  Homolog annotation: Hit_ID=Q9LMT2; Match level="QueryCoverage=50%, HitCoverage=21%, E-value=9e-26, Identity=49%"; Hit description =F2H15.20 protein (Hypothetical protein At1g17980) (At1g17980) (Poly(A) polymerase)
MACFSAIHILVTFQTNPDLSTAPTLWDCDVSKDFLSIMVDSLILTVEEFKHSVNIYTLWKPGMDINVSHVKRRNIPTFVTWEIKPSSELRVSDHSQAEKSQEGKMVVFGANGDRKRKQAEDSVNCTDSEINSTSEKPDLKSSVEFAGDRETNGSVTSNLQVTSTGASSSKEAKKLAIEKIMCGPYDAQRVFSEEPDELEDDLEFRNQVKDFGGKMKNSNLDSSYSEIAVATEPIIPKKETTSATRLYSNGGSEELEV

SEQ ID NO: 199827 - protein, 1177 aa, Glycine max
  Coding DNA Sequence Number=SeqID_83049
  Gene Ontology: Mol. function=ATP-dependent helicase activity; Cellular component=intracellular; Biological process=protein modification process
  Homolog annotation: Hit_ID=Q5ZEC6; Match level="QueryCoverage=88%, HitCoverage=98%, E-value=0.0, Identity=70%"; Hit description =Putative DEAD/H box polypeptide 36 protein
  Pfam annotation: Domain name=DEAD; Domain location=282-443; Score =21.4; E_value=8.8e-08; Accession=PF00270.19; Description=DEADDEAH box helicase
  Pfam annotation: Domain name=DUF1605; Domain location=869-980; Score =79.2; E_value=1.3e-20; Accession=PF07717.6; Description=Domain of unknown function (DUF1605)
  Pfam annotation: Domain name=HA2; Domain location=741-832; Score =112.8; E_value=9.8e-31; Accession=PF04408.13; Description=Helicase associated domain (HA2)
  Pfam annotation: Domain name=Helicase_C; Domain location=585-679; Score=58.1; E_value=2.8e-14; Accession=PF00271.21; Description =Helicase conserved C-terminal domain
  Pfam annotation: Domain name=NACHT; Domain location=296-474; Score= -37.0; E_value=0.044; Accession=PF05729.3; Description=NACHT domain
  Pfam annotation: Domain name=dsrm; Domain location=1080-1142; Score =48.1; E_value=3e-11; Accession=PF00035.15; Description=Double -stranded RNA binding motif
  Pfam module annotation: Pfam domain module=DEAD::DUF1605::HA2::Helicas e_C::NACHT::dsrm; Domain location=282-443::869-980::741-832::585 -679::296-474::1080-1142
  Subcellular localization annotation: CTP_CleavageSite=54; ConfidenceScore=5.42e-01
MTMAYSGIFQGFIRFKAMSRLRSTPLRPSLPSIPLHRTAIRLRHHSCSFALQVVKNTRQRTLKLPFWHQRSSTYGRFAYQDVSSDESDVEFASSPSHNQQLGDSTHENIDEWRWKLTMLMRNKDDQEVVSREKKDRRDFEQLSTVASRMGLYSRQYARVVVFSKAPLPNYRPDLDDKRPQREVVLPLGVHKEVDAHLLAHLSQKARNKWGSLSDSLHKSRDSRSIPANEGMYEQPEPMTHNSVVKEKILDRKSLQLLHRQHDWQESPEGQKMLEFRRSLPAFKEKDAFLRVISQNQVVVVSGETGCGKTTQLPQYILESETEAARGAVCNIICTQPRRISAMSVSERVAAERGEKLGESVGYKVRLEGMKGRDTRLLFCTTGVLLRRLLVDRNLKGVTHVIVDEIHERGMNEDFLLIVLKELLPHRPDLRLILMSATLNAELFSSYFNGAPTMHIPGFTFPVRAHFLEDILERTGYRLTPSNQIDDYGQEKTWKMQKQAQAFRKRKSQIASAVEDALEVAEFKGYSLRTRDSLSCWCPDSIGFNLIEHVLCHIVKNERPGAVLVFMTGWDDINSLKDQLQVHPLLGDHSQVLILACHGSMASSEQRLIFENPEGGVRKIVLATNMAETSITINDVVFVVDIGKAKETSYDALNNTPCLLPSWISKAAARQRRGRAGRVQPGECYHLYPRCVYDAFADYQLPELLRTPLQSLCLQIKTLQLGSISEFLSRALQPPEPLSVQNAIDYLKIIGALDENENLTVLGHKLAMLPVEPKLGKMLILGAIFKCLDPIMTVVAGLSVRDPFVMPSDKKDLAESAKAQLAARGYSDHLALIRAYEGWRDAEAQQAGYEYCWRNFLSSQTLRAIDSLRKQFFYLLKDIGLVNNNSETYNTWSHEEHLLRAVICAGLFPGISSVVNKDKSIALKTMEDGQVLLYSSSVNGCVSRIPFPWLVFNEKVKVNSVFLRDSTGISDSVLLLFGGNVSRGGLDGHLKMLGGYLEFFMKPELAKTYLSLKMELEELIQKKLLDPMLETQSHSELLSAVRLLVSEDHCDGRFVFGRQVLPQSKKETNSKTGGGAEGKNYKNHLQAFLNRAGHDSPTYKTKELKNNQFRTTVVFNGLNFVGQPCSSKKLAEKSAAAEALLWIKGDGHSSDDIDHASVLLKKSNKKSRKNSFSGAKWS

SEQ ID NO: 199828 - protein, 481 aa, Glycine max
  Coding DNA Sequence Number=SeqID_83050
  Homolog annotation: Hit_ID=Q2QP00; Match level="QueryCoverage=85%, HitCoverage=30%, E-value=2e-30, Identity=28%"; Hit description =G14587-6, putative, expressed
MEETVSRIISELEDLRGNPQPPPPLSEQTLMDLQFLLKHSLTETLYDELPSKNLSPSSLIPPIASAMDSSPPHHSLLASDVFLSLLLAPNAPVFTLFTPISFLSFLRSLRRSCKAHSHPGPAQDNSMNRKRKRPGRGRASNPQNDDDSPDTGSQHDPRVLLRVLEKLVKVMGLIHLNRFPETLKSLIQTVAEIPVTSLDTCGNAAVYSRLLSLCSHVLKEVLKSEHGEPSNTAAEVLKSLCSLVLMAKSLARTFAIGFVTGLSNQCDGVKKALVNFPRYLAKKAPEKAEPRALAVDSIMEVVKVMEFDDQIAFVKYVVQMAQGKSNLRLLAVDLILNLVTSLRDPLGVESEGSEAWGVWCLEALVKRCSDVSGAIRARALSNLAQLVGFLSRGERTSAVLKEFTGFGRVGDGNVGGGMNDMLRRRCMDDKAAVRKAALLLVTNLTSLLGGAIDEVVLKTMGMACSDPLISMRKAAITALSE

SEQ ID NO: 199829 - protein, 173 aa, Glycine max
  Coding DNA Sequence Number=SeqID_83051
  Gene Ontology: Mol. function=microtubule motor activity; Cellular component=microtubule associated complex; Biological process =microtubule-based movement
  Homolog annotation: Hit_ID=Q6WJ05; Match level="QueryCoverage=97%, HitCoverage=17%, E-value=5e-73, Identity=82%"; Hit description =Central motor kinesin 1
  Pfam annotation: Domain name=Kinesin; Domain location=3-169; Score= -117.1; E_value=6.4e-07; Accession=PF00225.13; Description=Kinesin motor domain
MQPLPLRAAEDLVRQLHQPVYRDQRFKLWLSYFEIYGGKLYDLLSDRKWVFNLLYDYVGKLCMREDGRQQVCIVGLQEFEVCDVLIVKEFIEKGSAARSTGSTGANEESSRSHAILQLAVKKHSEVKASKRNNDGNEARSGKVVGKISFIDLAGSERGADTTDNDRQTRYFYI

SEQ ID NO: 199830 - protein, 224 aa, Glycine max
  Coding DNA Sequence Number=SeqID_83052
  Gene Ontology: Mol. function=ribonuclease H activity; Biological process=RNA-dependent DNA replication
  Homolog annotation: Hit_ID=Q1T2T2; Match level="QueryCoverage=88%, HitCoverage=45%, E-value=1e-25, Identity=29%"; Hit description =Ribonuclease H
MDHMTANRRSCHKFLSFLPLTKPLCCKTSMEDQIGNVANRKKTKQEKNKIRFDNHRMNYISVINSIKENVYLSGSLTSASMTNSMQYFLILKQFGIEAHPRKAPIIKQAFNQLLLAVIIAIEMAMEKNWSVLWLETNSSLLVNAFKNPSSGPWSLFNCWKNCISLTNSFSFRILHIYREANACADSLASFGAHNLGFIWWDSPPSFISMELLRYRQDLPSYKFA

SEQ ID NO: 199831 - protein, 69 aa, Glycine max
  Coding DNA Sequence Number=SeqID_83053
MAKCLMGEGMQVKDSECCMKSEPQKAKYLDQIFNSSESSYHSQQGYSIKDKPCVTFIWTVPVAVNTTIF

SEQ ID NO: 199832 - protein, 261 aa, Glycine max
  Coding DNA Sequence Number=SeqID_83054
  Gene Ontology: Mol. function=cysteine-type peptidase activity; Cellular component=nucleus; Biological process=proteolysis
  Homolog annotation: Hit_ID=Q70G10; Match level="QueryCoverage=91%, HitCoverage=49%, E-value=8e-95, Identity=67%"; Hit description=SUMO protease
  Pfam annotation: Domain name=Peptidase_C48; Domain location=59-259; Score=192.0; E_value=1.4e-54; Accession=PF02902.9; Description=Ulp1 protease family, C-terminal catalytic domain
MRNRVKVTAVYPVCCHGFQEEEVPQEPFVALTSEEEDEVERAFSANRWRILVTHKNSNIEITGEKFQCLRPAGWLNDEVINLYLELLKEREQREPLKFLKCHFFNTFFYKKLISGPKGYDFKSVRRWTSQRNLGYSLLECDKIFVPIHQEIHWCLAVINKKDKKFQYLDSMKGEDSFVLEKLAKYFADEVNDKTGKHIDVNTWKKEFVKDLPQQKNGYDCGVFMIKYADFYSRGLELCFNQENMSYFRCRTAKEILRLKAE

SEQ ID NO: 199833 - protein, 97 aa, Glycine max
  Coding DNA Sequence Number=SeqID_83055
MEMGWGWGVMISSAWTQIFQNQQNPKREKNDELEGSEGRERMGFDLPYAMGRGAEKRLGESKRNDPEFLGLHCICQVLRAGNTRGQREEGGWKLKME

SEQ ID NO: 199834 - protein, 179 aa, Glycine max
  Coding DNA Sequence Number=SeqID_83056
  Gene Ontology: Mol. function=hydrolase activity, hydrolyzing O -glycosyl compounds; Cellular component=membrane; Biological process =carbohydrate metabolic process
  Homolog annotation: Hit_ID=Q5ZP79; Match level="QueryCoverage=99%, HitCoverage=42%, E-value=5e-79, Identity=78%"; Hit description=Alpha- galactosidase 1 precursor
MVSRADMNEVYAEYARPGGWNDPDMLEVGNGGMTKNEYIVHFSLWALSKAPLLLGCDVRNMTKETMEIVANKEVISVNQDPLGVQGKKVRMEGDQEVTLFGQIWAGPLSGYRVAVVLLNRGPSKISITANWDDIDIPPKSAVEARDLWEHKTLMRPFVDKLTATVDPHGCKMYVLKPVA

SEQ ID NO: 199835 - protein, 270 aa, Glycine max
  Coding DNA Sequence Number=SeqID_83057
  Gene Ontology: Mol. function=zinc ion binding
  Homolog annotation: Hit_ID=Q1RUT0; Match level="QueryCoverage=91%, HitCoverage=94%, E-value=4e-75, Identity=60%"; Hit description=Zinc finger, RING-type; RINGv
  Pfam annotation: Domain name=zf-C3HC4; Domain location=29-76; Score =62.7; E_value=1.2e-15; Accession=PF00097.15; Description=Zinc finger, C3HC4 type (RING finger)
MELSVVARDMEEVVLLVDDLRSLSGISRCRICHEEEFESSKTLEAPCACSGTVKFAHRDCIQTWCDEKGNTTCEICLQQYEPGYTAAPKKSQITDAAMTIRDSLQISRNEQEPLNTRIVGIVEGNNYSECTYAADRTAACCRSLALAFTLILLVRHLFALLTDGMEDYPFTILTVFLLRASGIIIPMYIIIKAIGAIHDNIKRHHHEVLKFSMHYFFVLADSSIMGDMQPQLKNDCSSIYQDSDDDSSISDGDDEENETPNDEILRHSQS

SEQ ID NO: 199836 - protein, 276 aa, Glycine max
  Coding DNA Sequence Number=SeqID_83058
  Homolog annotation: Hit_ID=Q8UJ01; Match level="QueryCoverage=45%, HitCoverage=60%, E-value=2e-64, Identity=94%"; Hit description =Cytochrome o ubiquinol oxidase subunit III
MGLCVGAERGPPENRQAADICCSGQVLHILDVQRHHVLVHVVHDPERAGERDQEHHDGEDQRHEGPAAFGLGVHVQEVDHVHEDLDDAEAHDGDDEQRLVFKDVAHDQPEGDRRQNDRKDEADHVAFERAVARAIMVMMVVAMRVVMCVNEGEDADPDDVEEVPEHRQAHQATLVRRDQAVLGDLHHQRDEPDDAEGDVQTVRADEREERRQESRTVRTGSFFDQVMELVKFDGKEGEAEETGDSEPDQGRLYLLLFHFQHGEAIGDGGEKQEAGC

SEQ ID NO: 199837 - protein, 90 aa, Glycine max
  Coding DNA Sequence Number=SeqID_83059
  Homolog annotation: Hit_ID=Q2HVD3; Match level="QueryCoverage=91%, HitCoverage=28%, E-value=5e-15, Identity=45%"; Hit description =SMAD/FHA
MEAEIHGEDGSKFVLGSNEKLVFGQGCGFGNYNCRVSHCHMPFELGHLNSEDANVVSFEVLKENPFWVYDRETLRLFKKFDKGHLQFRHI

SEQ ID NO: 199838 - protein, 71 aa, Glycine max
  Coding DNA Sequence Number=SeqID_83060
  Subcellular localization annotation: CTP_CleavageSite=22; ConfidenceScore=5.38e-01
MKFCTFLSKQTSSVRTPRLRLRYSTKKPCRRRVSQMKGLKKARAHWKTDNGFQEGSTSEEFRPVWWTWCFK

SEQ ID NO: 199839 - protein, 359 aa, Glycine max
  Coding DNA Sequence Number=SeqID_83061
  Gene Ontology: Mol. function=calcium ion binding
  Homolog annotation: Hit_ID=O82062; Match level="QueryCoverage=62%, HitCoverage=92%, E-value=4e-11, Identity=25%"; Hit description=39 kDa EF-Hand containing protein
MSDGTLQVLDGTHLRGVDLSLGDDGPFTGANILDIAHSRASSSLFGLSLPDYLKASALTRLRTPDADAFRSAEYTADKASEILRDYISAIANELKGLFYSPSSDHHATHYSIRTHAFSNLDFSIRDSDDNPLVVSVLDGSTLRLLLEDEDDFAMLAENLFTDLDVEDKGKISKSEIRNALVQMGVEMGVPPFSEFPQLNDLLKKHGADGEEKLGQAQFAQLLQSVLQDLEEELSKQNVVSIQNIRIINGCKLRQLLANEQELNTIVEKALLEKPEAKDGLVGNTEIIRSFLERNAKELGLPPAQADNAVVLLYDAVFAEITKEKDGAELDKEELAKLVKNILEKFAEQLEVNPVYQDLA

SEQ ID NO: 199840 - protein, 461 aa, Glycine max
  Coding DNA Sequence Number=SeqID_83062
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9LZV3; Match level="QueryCoverage=87%, HitCoverage=90%, E-value=1e-173, Identity=68%"; Hit description=(1 -4)-beta-mannan endohydrolase-like protein
  Pfam annotation: Domain name=Cellulase; Domain location=68-406; Score= -19.5; E_value=4.2e-06; Accession=PF00150.8; Description=Cellulase (glycosyl hydrolase family 5
MERFGVRIISLILLLMLTKNLSSNALGDSMKDEEGLKEDQNEMENSLSNYDEMRGMKDDDWQMVQKKGNHFVVNDKPFYVNGFNTYWLMVFAADESTRGKVTEVFKQASSVGMTVCRTWAFNDGQWRALQKSPSVYDEEVFKKYKIRLILSLANNWEAYGGKAQYVKWGNAAGLNLTSDDDFFSHPTLRSYYKAHVKASSFKLMQQTVLNRVNTFTNITYKEDPTIFAWELMNEPRCTSDPTGDKLQDWIQEMAFHVKKIDPKHLVEVGVEGFYGPSTPQRTQFNPNTYATQVGTDFIRNHLVLGVDFASVHIYADSWISQQIADTHIPFIKSWMEAHIEDAEKYLGMPVVFAEFGVSSKDPGYNSSYRDTVISTVYSTILNSTKKGGSGAGSLLWQFFPDGTDNMDDGYAIVLSKSPSTSGIIQLQSTRLALFNSLCNTKCNWGCKKKKLLEEILYRDEL

SEQ ID NO: 199841 - protein, 153 aa, Glycine max
  Coding DNA Sequence Number=SeqID_83063
TTEARNQSWKPQDPVGLLRVHWVSLWARNQSWKPQGPVGLLRGPVGLLRVHWASCGGRLALWSLGKMLLNSNVIHVRVVMLVRMIHTHLFAAALVKSCPGMHSRCVIASLSGCARTVGRPPISGGGPGTDKRKLLALVTGSASLGEASKGKGP

SEQ ID NO: 199842 - protein, 126 aa, Glycine max
  Coding DNA Sequence Number=SeqID_83064
  Gene Ontology: Mol. function=protein serine/threonine kinase activity; Biological process=protein amino acid phosphorylation
  Homolog annotation: Hit_ID=Q1RY80; Match level="QueryCoverage=77%, HitCoverage=18%, E-value=6e-32, Identity=71%"; Hit description =Protein kinase
MAIPTLRSPAALKNFNLEIRTCGYDLNKWRASTRMRSDFQILDSDSSRGWDLATKLISKRGSQRRGRLSAAAALRHPYFLLGGDQAAAVLSKLSLSTKEPPERSERKLGFSTMIQKAKATLAVLPV

SEQ ID NO: 199843 - protein, 178 aa, Glycine max
  Coding DNA Sequence Number=SeqID_83065
  Gene Ontology: Mol. function=ammonium transporter activity; Cellular component=membrane; Biological process=transport
  Homolog annotation: Hit_ID=Q851M9; Match level="QueryCoverage=84%, HitCoverage=29%, E-value=4e-30, Identity=45%"; Hit description =Putative ammonium transporter
VVQGWAAILMGVMSGSIPWYTMMILHDKLPFLKQIDDPMAVFHTHAVAGALGGVLTGLLAVPKLCRLFYMVPDWEKYIGLAYGLQNGATHAGLRQMAIQVGAIVFVIIFNFVTTSLICLLVGSIVPLRIDTDALQMGDKAMHGEEAFAFYGGDPTAKFENLKHNKVYDTQDFSFVRDT

SEQ ID NO: 199844 - protein, 69 aa, Glycine max
  Coding DNA Sequence Number=SeqID_83066
MKFAHFHGWDLQDNVRGGRKRNRMKTVQVEVSIPFRLSDVWELYQSSRRKNWRNLRKPLEMPLSLLEDT

SEQ ID NO: 199845 - protein, 386 aa, Glycine max
  Coding DNA Sequence Number=SeqID_83067
  Gene Ontology: Mol. function=protein serine/threonine kinase activity; Cellular component=chloroplast; Biological process=protein amino acid phosphorylation
  Homolog annotation: Hit_ID=Q1RY80; Match level="QueryCoverage=95%, HitCoverage=67%, E-value=1e-130, Identity=67%"; Hit description =Protein kinase
  Pfam annotation: Domain name=Pkinase; Domain location=140-385; Score=- 45.0; E_value=7e-06; Accession=PF00069.15; Description=Protein kinase domain
  Pfam annotation: Domain name=Pkinase_Tyr; Domain location=140-384; Score=-135.3; E_value=0.00036; Accession=PF07714.7; Description =Protein tyrosine kinase
  Pfam module annotation: Pfam domain module=Pkinase::Pkinase_Tyr; Domain location=140-385::140-384
  Subcellular localization annotation: CTP_CleavageSite=45; ConfidenceScore=5.60e-01
MASLLSTTATTLQHNHTICFSPVKPTTPNTIPFSTNRCFKNNSAKCNAFFDKFPKDLLETTFHLDQFPVFQSVIVKFQNVTEDLSDVQRWGLGILAGLTWAYFTARPGVLVGAIDAFLLAPIQLVLDSLSGRRNLKRTDFLVGDKLGEGSFGVVYSGVLVPRNVDVQEWMQKSGRDKVAKLDAKSKDKVVLKKVKVGIEGAEEFGDFEEWFNYRLSRAAPETCAKFLGSFVADKTNSQFTKGGKWLVWKFEGGRSLADYMADQSFPSNLESIMFGRVLQGVDSSKRNALIIKQIMRQIITSLKKIHDIGIVHRDVKPANLVVTKRGQIKLIDFGAATDLRIGKNYVPNRTPLDRDYCPPELYVLPEETLSLPPEPIAAFLSPILWQ

SEQ ID NO: 199846 - protein, 201 aa, Glycine max
  Coding DNA Sequence Number=SeqID_83068
MRPATLPERKPARCSLFFLPFCQNRVSAVAQEVPAETDIRIERGIGQRDRGQHLIGRQLRCHVFEIIGYPQVHYAGCVWCKTLQLFGQLASGERGIHGYSGYRLHGISAVTSRQPGHCGGRRVEGRSRTRRRSGLNVPRNGGERVSHEAKLPCGRSGPAKVKSRRSPMVRRERRRGIFIKGCFVPVADVSIRHRKKGIPAL

SEQ ID NO: 199847 - protein, 231 aa, Glycine max
  Coding DNA Sequence Number=SeqID_83069
  Gene Ontology: Mol. function=transcription factor activity; Biological process=regulation of transcription, DNA-dependent
  Homolog annotation: Hit_ID=Q13M79; Match level="QueryCoverage=88%, HitCoverage=93%, E-value=2e-26, Identity=34%"; Hit description =Transcriptional regulator, TetR family
  Pfam annotation: Domain name=TetR_N; Domain location=35-81; Score =45.1; E_value=2.4e-10; Accession=PF00440.13; Description=Bacterial regulatory proteins, tetR family
MSGQQTYTHQALQPGQVCQMKASVGRPREFDPETFLNTALECFWQKGYRATSMSDLMKASGLASASIYKLYPDKRTIYLAALQQYMDEGASRAAERDAEFSPEMALRETLEFVALLSSSPDGEKGCFTIAAASELLPGDAEVKSKVHHKFNSIINQLEKILCRGQTQQLFRCDESPRTMAISIFMMLEGMRVYGKIQPEIDELKKSNEFIVRSVLSNRHEDGKGLSRQAST

SEQ ID NO: 199848 - protein, 120 aa, Glycine max
  Coding DNA Sequence Number=SeqID_83070
MQCGLTMEGFHIRQRTRLSARKPHGHPWLSPAVAAPQQQQQQQQQQQQQKPGPPSASRQAGSSSPMSLSGKAAKRHRTPAGFVRERFRADVQGQRLQTAAPSRSPSRPVAGTLRSVRGAA

SEQ ID NO: 199849 - protein, 498 aa, Glycine max
  Coding DNA Sequence Number=SeqID_83071
  Gene Ontology: Mol. function=binding
  Homolog annotation: Hit_ID=UPI000065F51C; Match level="QueryCoverage =80%, HitCoverage=95%, E-value=2e-21, Identity=23%"; Hit description =Homolog of Homo sapiens "Ataxin-10
MGGDTAFLEHPISEDTLQLLFEASNSSNMEKSLEILIQNAKSDSGRLELASKRILPAVLNIVHSLTHASHHHHHQHNHILCLSFKLLRNLCAGEAANQDSFLELDGVAVVCSVLRSEAACSGPDHGLVRWGLQVLANVSLAGKQHQCAIWKELYLDGFVSLARLHTKETCDPLCMVIYTCCDGNPEWFKRLSSEDGWFVMAEIVRTASSASFGEDWLKLLLSRICLEESQLPVLFSKLQFADVPKVEVAESKDDHFSFEQAFLLRILSEILNERHKDVTVSKDVALFVFGIFKNSIGVLEHATRGKSGLPSGFVGVDVLGYSLTILRDICAQDGVRGNTEDSNDVVDALLSYGLIELLLYLLEALEPPAIIRKGLKQCENQDGASCSFKPCPYKGFRRDIVALIGNCVYRRKHAQDEIRHRNGILLLLQQCVTDEDNPFLREWGIWSVRNMLEGNDENQKVVAELEIQGSADVPEITSLGLRVEVDQRTRRAKLVNIP

SEQ ID NO: 199850 - protein, 53 aa, Glycine max
  Coding DNA Sequence Number=SeqID_83072
MARSVEIPRVKLGTQGLVPYRELGIGIVPYSPLGRGFFGGKGIVQDVCQQLAH

SEQ ID NO: 199851 - protein, 377 aa, Glycine max
  Coding DNA Sequence Number=SeqID_83073
  Homolog annotation: Hit_ID=Q8GSM4; Match level="QueryCoverage=53%, HitCoverage=54%, E-value=4e-11, Identity=27%"; Hit description=Ovate protein
  Pfam annotation: Domain name=DUF623; Domain location=317-376; Score =120.1; E_value=6.2e-33; Accession=PF04844.4; Description=Protein of unknown function, DUF623
MGNYRFRLSDMIPNAWFYKLKDMGKTRKQTPTTHSRKKKQPSPASTQKASKPKQPHQYNLRKSYYFTRELTPNDRIYSSPTPTNNQNAKYTNSLEPPRKSSKQRLKKRTSRTSSPKLVVVSNNNNSSSPNDSSTESEYPDPEFRTDRVLPTESFDETVPWANSCACRVHSNAKDIIIDVDNNSIARKDGKLEGYEYECDSFSDLVLPPIVTKPAIFNDLLSDVKKKETKPRSKMAAHEEPNLNKGPLRVKIVKEDTSSMKEHKNTYGRRFSVSSPGVRLRMNSPRIASRRIQAHGRRSVSSAPRRSLSDSFAVVKSSLNPQRDFRESMVEMIVQNNIRTSKDLEDLLACYLSLNSDEYHDLIIKVFKQIWFDLTDNN

SEQ ID NO: 199852 - protein, 254 aa, Glycine max
  Coding DNA Sequence Number=SeqID_83074
  Gene Ontology: Mol. function=oxidoreductase activity; Cellular component=intracellular; Biological process=auxin mediated signaling pathway
  Homolog annotation: Hit_ID=Q338B1; Match level="QueryCoverage=98%, HitCoverage=82%, E-value=1e-106, Identity=65%"; Hit description =Auxin-induced protein PCNT115, putative, expressed
  Pfam annotation: Domain name=Aldo_ket_red; Domain location=13-254; Score=101.1; E_value=3.3e-27; Accession=PF00248.11; Description =Aldoketo reductase family
MAQSVEIPRVKLGTQGLEVSKLGYGCMGLTGAYNDPLPEEEGISIIKHAFSKGITFFDTSDIYGPDHANEIVVGKALKQLPREKIQIATKFGITKIDSSGMFVKGTPEYARSCCEASLKRLGVEYIDLYYQHRVDLSVPIEETIGELKKLVEEGKVRYIGLSEASPDTIRRAHAVHPITAVQMEWSLWTRDIEDEIIPLCKFTHPRFRAENLDKNKKLYGKIESLATKQQCTPSQLALAWVLHQGNDVVPIPGE

SEQ ID NO: 199853 - protein, 388 aa, Glycine max
  Coding DNA Sequence Number=SeqID_83075
  Gene Ontology: Mol. function=protein serine/threonine kinase activity; Cellular component=membrane; Biological process=protein amino acid phosphorylation
  Homolog annotation: Hit_ID=Q8LF75; Match level="QueryCoverage=96%, HitCoverage=99%, E-value=1e-128, Identity=61%"; Hit description =Putative receptor ser thr protein kinase
  Pfam annotation: Domain name=Pkinase; Domain location=52-322; Score =145.3; E_value=1.7e-40; Accession=PF00069.15; Description=Protein kinase domain
  Pfam annotation: Domain name=Pkinase_Tyr; Domain location=52-322; Score=110.4; E_value=5.3e-30; Accession=PF07714.7; Description =Protein tyrosine kinase
  Pfam module annotation: Pfam domain module=Pkinase::Pkinase_Tyr; Domain location=52-322::52-322
ETGAGAIAMFCNCFGALNRCGRRDDSEDQPHEQVVATKMFSYNSLRSATGDFHPSSKIGGGGYGVVYKGVLRDGTQAAIKSLSVESKQGTHEFMTEIDMISNIRHPNLVELIGCCVEGSHRILVYEFLENNSLASSLLGSKSKYVALDWPKRVAICRGTASGLTFLHDEAQPNIVHRDIKASNILLDGNFNPKIGDFGLAKLFPDNVTHVSTRVAGTVGYLAPEYALLGQLTKKADVYSFGILMLEIISGKSSSIAAFEDDYLVLVEWAWKLRGENRLLDLVDSELSEYDESEVYRFLIVALFCTQSAAQHRPSMKQVLEMLCKEVHLNEKALTEPGIYRWHSNGKRGGSLNETSSSQAIKYKRTENPHEAPSTHFSGTDIVTEMLPR

SEQ ID NO: 199854 - protein, 315 aa, Glycine max
  Coding DNA Sequence Number=SeqID_83076
  Gene Ontology: Mol. function=zinc ion binding
  Homolog annotation: Hit_ID=Q1SUW3; Match level="QueryCoverage=52%, HitCoverage=43%, E-value=2e-77, Identity=64%"; Hit description=Zinc finger, RING-type; Zinc finger, CHY-type; RINGv
  Pfam annotation: Domain name=Hemerythrin; Domain location=165-226; Score=29.4; E_value=1.2e-05; Accession=PF01814.13; Description =Hemerythrin
  Pfam annotation: Domain name=Hemerythrin; Domain location=236-282; Score=1.4; E_value=18; Accession=PF01814.13; Description=Hemerythrin
  Pfam module annotation: Pfam domain module=Hemerythrin::Hemerythrin; Domain location=165-226::236-282
MTGLTSSQGYNFSAFVYSWKGVCSDANREHVVDLVFSAYSLLQILLRTSCLCLSHATKFVLKQFPTPLTLSQWQHDFIHHMQDPPTLHNTPAIDSALVTLFCGWACKVRNEGLAVSSNNLGLSSLSTAKSLQSLSFSSSASSLNSNLFIWEIESSSCNVGSTQRPIDTIFKFHKVIRKDLEYLDVESRKLNDGDETILWQFNGRFRLLWDLYRAHSNVEDEIVFPALESKEALHNVSHSYMLDHKQEEQLFEDISYVLSEFFVLHEVLQMTHMLENLTQSNFGTSDANNSDDIKKYNELATKVQGMCKSIRITLD

SEQ ID NO: 199855 - protein, 91 aa, Glycine max
  Coding DNA Sequence Number=SeqID_83077
  Gene Ontology: Mol. function=calcium ion binding; Cellular component =oxygen evolving complex; Biological process=photosynthesis
  Homolog annotation: Hit_ID=Q5VQX1; Match level="QueryCoverage=63%, HitCoverage=21%, E-value=1e-17, Identity=70%"; Hit description =Thylakoid lumenal 20 kDa protein-like
MYDINFSSYPLSISYAGRTRMFQLKHFTKMSNVEEYYKYVLETPYALTGTHNLAKATTKGNTVVLFVVSANDKQWQTSKETLKVVLNSFEV

SEQ ID NO: 199856 - protein, 181 aa, Glycine max
  Coding DNA Sequence Number=SeqID_83078
  Homolog annotation: Hit_ID=Q1SUW3; Match level="QueryCoverage=34%, HitCoverage=5%, E-value=3e-16, Identity=64%"; Hit description=Zinc finger, RING-type; Zinc finger, CHY-type; RINGv
MYLGVSTIREITSFGRHVVASYLLADFVMTMSAITLRIARNICVFACVLLSEEKAHELALHVIAKIKGYGDIAKVVALDNQKLLALNPIIHVLPIKCKKKLTCMVELCYWFTIAFKFSPAELVEDVNRRLGIEKTMFEASNQRISKSFIKQYSQKLVCYLYMYTNVHKYFVVVEFASILFE

SEQ ID NO: 199857 - protein, 385 aa, Glycine max
  Coding DNA Sequence Number=SeqID_83079
  Gene Ontology: Mol. function=isomerase activity
  Homolog annotation: Hit_ID=Q1T2S4; Match level="QueryCoverage=91%, HitCoverage=93%, E-value=3e-51, Identity=37%"; Hit description =Cyclin-like F-box; F-box protein interaction domain
  Pfam annotation: Domain name=F-box; Domain location=1-48; Score=42.0; E_value=2e-09; Accession=PF00646.23; Description=F-box domain
MKNHSLPLELIEEILLRLPVRSILRFKCVCKSWFSLISEPQFAVSHYDLAATPTHRLLLRSDYYFYAQSIDTDTPLNMHPTTVNLLLPPPSPPRDPGPSNFNHYYDSRFQPEILGSCRGFLLLYYITRREIILWNPSIGLHKRITDVAYRNITNEFLFGFGYDPSTDDYLLILVSTFFITPPEVGLHVFSFKTCSWKEYYPSLSYDDCGNKCRAGSLLNGALHWLVFSRDKKRHVIIAIDLIQMILFEIPLLDSLISEKYLIDCLRVIGGCLGVCCWVQEREVTEIWVMKEYKVQSSWTKSFVIPNYDEYIHFSPICITKDGGIFGSNNGGKFLKLNKEGEWLEELLYGHYEWSYCHNLQSALYRESLLLIPGVIGETSEDDDQK

SEQ ID NO: 199858 - protein, 93 aa, Glycine max
  Coding DNA Sequence Number=SeqID_83080
MEYTGINSNASENGMGPQNTHGTLLDTLKQVSTLHVSPGTGARIREGVEMLLKDSLNKPDWLSEAHSLSEAASSLSECKTLEDVELESSALSA

SEQ ID NO: 199859 - protein, 92 aa, Glycine max
  Coding DNA Sequence Number=SeqID_83081
MERCREEELRKLKADHDQLEAHVRCPHDYGYQNHILNRRIVRFHKALLLNGFFVFFVVSSSVQRACCRSATVRCSGEGILRETMRCIVQVQH

SEQ ID NO: 199860 - protein, 378 aa, Glycine max
  Coding DNA Sequence Number=SeqID_83082
  Gene Ontology: Mol. function=DNA-directed DNA polymerase activity; Cellular component=intracellular; Biological process=response to DNA damage stimulus
  Homolog annotation: Hit_ID=P23832; Match level="QueryCoverage=99%, HitCoverage=88%, E-value=1e-157, Identity=74%"; Hit description =Protein samB
  Pfam annotation: Domain name=IMS; Domain location=7-355; Score=505.2; E_value=7.6e-149; Accession=PF00817.11; Description=impBmucBsamB family
MPMFGLADVNSFYASCEALFRPDLRGRPVVVLSNNDGCVIARSAGAKKLGIKMGAPWFQIRGQDFAERVHVFSSNYALYHSLSNRVMMALEEMTPKVEQYSIDEMFLDLTGIDGCEDFEHFGRRLRAHVLATTGLTVGVGMGPTKTLAKSAQWASKEWPQFRGVLALTPDNPKRTATLLENQPVEEIWGVGRRIGKRLNLMGIENALQLSRAHPALIRKNFSVVLERTVRELNGESCIPLEEFAPAKQQIVCSRSFGERITTKVAMQEALCQYATRAAEKLRKERQFCRRISVFIRTSPHAQGEVFYGNSAGENLTLPTQDTRDVIGVAMRSLDRIWLDGRRYMKAGIMLDDFTPNGVSQLNLFDEDKPRANSAQLMK

SEQ ID NO: 199861 - protein, 90 aa, Glycine max
  Coding DNA Sequence Number=SeqID_83083
  Gene Ontology: Mol. function=transferase activity; Cellular component= integral to membrane; Biological process=metabolic process
  Homolog annotation: Hit_ID=Q39GG9; Match level="QueryCoverage=100%, HitCoverage=22%, E-value=5e-34, Identity=72%"; Hit description=L -carnitine dehydratase/bile acid-inducible protein F
MALPLEGLRVIEMGQLIAGPMAGRMLAEFGADVIKIEPPGKGDPLRKWRMLHNGTSVWWAAQSRNKRSVTVDLRQPEGQQIAMSLLNSAD

SEQ ID NO: 199862 - protein, 218 aa, Glycine max
  Coding DNA Sequence Number=SeqID_83084
  Homolog annotation: Hit_ID=Q1HA46; Match level="QueryCoverage=35%, HitCoverage=13%, E-value=8e-25, Identity=61%"; Hit description=Site -specific recombinase, phage integrase family
AELLTEVNAMLIPPNEHVLLLAERGLKLLSDLGRTQATLAAYRSALRHYFAFCRQNRIEPEKARFEDLAAYISPQLPVMPTPAASATLQLRLSAILLCAILNRTVIPMLCARAGVPLEDSGGMITSHRGRASAVTALASVPQSAMHYLRIRPIQLAVSFVKADRVAHIISVLIDHDPEAAQPDRTRDEVPLTPDKKGIVEQGAEKIEQALKRPPFKPE

SEQ ID NO: 199863 - protein, 167 aa, Glycine max
  Coding DNA Sequence Number=SeqID_83085
  Gene Ontology: Mol. function=oxidoreductase activity; Cellular component=intracellular; Biological process=auxin mediated signaling pathway
  Homolog annotation: Hit_ID=Q5ZBH8; Match level="QueryCoverage=66%, HitCoverage=28%, E-value=9e-36, Identity=67%"; Hit description =Putative auxin-induced protein
  Pfam annotation: Domain name=Aldo_ket_red; Domain location=1-164; Score=-125.4; E_value=0.053; Accession=PF00248.11; Description =Aldoketo reductase family
MENGNVIVNGSPEYVRSCCEGSLQRLGVSYIDLYYQHCVDTTVPIEDTVSDAIKHFLLLLHIGELKKLVQEGKIRYIGLSEASLDTIRRAHAVYPITAVQMEWSLWTREIEQDIVPLCSKDDLKEIIDAVPISEVSGDRTTDAFVRCSWKFANTPPKALLYIPVMHL

SEQ ID NO: 199864 - protein, 109 aa, Glycine max
  Coding DNA Sequence Number=SeqID_83086
MERCDGNDVVGGKTIKMKMKIAMVVGVRKEVFSKAEIGTRGTLDGCTPFRVGSTTFRVTCFPAIEVYGVYHRRAPVIAPSSVWLGPPKSKLYAVRKTNNNVNPKEKDSL

SEQ ID NO: 199865 - protein, 107 aa, Glycine max
  Coding DNA Sequence Number=SeqID_83087
MEKSLWWRNCVQMSDDLNNVDGKDGNQVNGLPRVDVVFGHRVEVVSGNKLEIGMKFDIVKVFVEVVRDYTIYHGRDINWKKRDLIRATFVYKVNECPWEIYCAWADK

SEQ ID NO: 199866 - protein, 149 aa, Glycine max
  Coding DNA Sequence Number=SeqID_83088
MITHFQHSLLADDPFMNDDASSQASMNSFKCSSFQFCDPGHEDEHATPTDGPERKKCTPLLSYRIEEPEPNFTKPFNYYPPRMNSSCGCSRFGSSHACPRLTRIRSCPHERRSQQQRSMMLEEMYKYKRRFFNTVGAVENIGFQHPDRV

SEQ ID NO: 199867 - protein, 391 aa, Glycine max
  Coding DNA Sequence Number=SeqID_83089
MPFARCNSQIPAPLPSPIPTGRGTRSAANEIFSQFLEKTLQIPELTLPGPHLPPAPAEIDFRSLTLVSTDLMLRSAREFGAFRIRCHGISGSELGTMADEAERVFQKSRNVVVVERNGTGGEMIPCVRSSKGALEFAAQTITGDQTHRNFWVHMGNVASRLDTIVEQVTMVLQHKTSKEFKERIQDTESWICLCRYPHDNVPKQNEDTSVKKKDKLCDHALRFYLPMEQCIFYVQTERGPLSFDAGPENIVVTVGKQLEEWSHGVFKCVPGEMIFMPSFQSSPASFSIELVCLASSNDLSHSLDNSDNCDKIISLADQILIVFCLVKNNSHFFNLTEVYTFSKEKDAKGRKKRSINVLSEIMRIKSINAKQVNLKVDMPNGSTWLVGSDSF

SEQ ID NO: 199868 - protein, 71 aa, Glycine max
  Coding DNA Sequence Number=SeqID_83090
MTTITPPKMTITEMSCSPSVGMKLMKLGCIILGDDSVGNGIIIGVGGLNAGVVVEDLVIVVFASLMAEVNL

SEQ ID NO: 199869 - protein, 145 aa, Glycine max
  Coding DNA Sequence Number=SeqID_83091
  Homolog annotation: Hit_ID=O04892; Match level="QueryCoverage=48%, HitCoverage=13%, E-value=1e-23, Identity=76%"; Hit description =Cytochrome P450 like_TBP
VVGADLGGSSKYSNENLKAEEGKGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQN

SEQ ID NO: 199870 - protein, 356 aa, Glycine max
  Coding DNA Sequence Number=SeqID_83092
  Gene Ontology: Mol. function=protein serine/threonine kinase activity; Cellular component=cytoplasm; Biological process=protein amino acid phosphorylation
  Homolog annotation: Hit_ID=Q9XFS5; Match level="QueryCoverage=90%, HitCoverage=62%, E-value=1e-119, Identity=63%"; Hit description=MAP kinase
  Pfam annotation: Domain name=Pkinase; Domain location=38-276; Score =148.8; E_value=1.4e-41; Accession=PF00069.15; Description=Protein kinase domain
  Pfam annotation: Domain name=Pkinase_Tyr; Domain location=39-281; Score=-43.5; E_value=8.4e-10; Accession=PF07714.7; Description =Protein tyrosine kinase
  Pfam module annotation: Pfam domain module=Pkinase::Pkinase_Tyr; Domain location=38-276::39-281
MELPDTISTAMYKGRFCTSGGVKSQLGYVETDPSGRYGRFRDVLGKGAMKTVYRAFDELLGIEVAWNQVKLGDVFHSPEQLQRLYSEVHLLKHLNHDSMMIFYGSWIDVNNKTFNFVTELFTSGTLREYRQKYKRVDITAVKNWARQILSGLEYLHSHNPPVIHRDLKCDNIFVNGHQGRVKIGDLGLAAILKSSQHAHSVIGTPEFMAPELYEEKYNELVDIYSFAQIYKKVTSGKIPEAFYRIENLEAQKFVGKCLANVSERPSAKELLLDPFLAMEQLEIQLPPSIPALFTNKSFKLSCPAPFPSEHRDQTKSADMTITGSINEEDNTVFLKVRISDIMGMHNFIPHFAVILQ

SEQ ID NO: 199871 - protein, 157 aa, Glycine max
  Coding DNA Sequence Number=SeqID_83093
MVWLAVSLLADGLAVARQICLILGLALAFILGIGLHFGAKIFTQDANVLQICLILGLALAFILGIGLHFGAKIFTQDANVLQICLILGLTLTFILGIGLHFGAKIFTQDANVLHLIQIGITNWNGIRTLGVPKELMTAHGRHRSYSFILGLGFSGVC

SEQ ID NO: 199872 - protein, 57 aa, Glycine max
  Coding DNA Sequence Number=SeqID_83094
MIEVDLRYSGSDLHGVTAKVVDMPHHYVEVHPEIRKQFWDSQHWPKHILVRYTCSQT

SEQ ID NO: 199873 - protein, 76 aa, Glycine max
  Coding DNA Sequence Number=SeqID_83095
  Subcellular localization annotation: CTP_CleavageSite=44; ConfidenceScore=5.07e-01
MKTNNHQQQQPQHEHRGRRMISKKGGRSTNTNDGGRKRKKYMVRGRGKRSGVRRETRRISAVWTKLHIHARISVNF

SEQ ID NO: 199874 - protein, 75 aa, Glycine max
  Coding DNA Sequence Number=SeqID_83096
MEREMVIVMVDTLPVFYYENGGLHTFKLCGYGLHRRKDQTITPARFPNLHFSEVTTRAQRVLVMEKPRGIPLSIV

SEQ ID NO: 199875 - protein, 582 aa, Glycine max
  Coding DNA Sequence Number=SeqID_83097
  Gene Ontology: Mol. function=transcription factor activity; Biological process=regulation of transcription, DNA-dependent
  Homolog annotation: Hit_ID=Q7W4D5; Match level="QueryCoverage=49%, HitCoverage=99%, E-value=1e-117, Identity=75%"; Hit description =Putative transcriptional regulator
AEDQQHRHQQGDAGHLDDGGHFRGGGVDVAGRADHLRHFVDGAADVDAQRLGVERQPARVVKHRIQEHRQRAEQHHGGHRHGALVRLRAQGRLEGQHGGRAADGAAGGGQHGGVAVQPQHALADPGAQQQRAHHHRHRHRQAGQADGGDLLDADVQAVEGHRYAQQAARGEVDAHAPVDRHGAAQEVAVQHAADDADHQRRKAQLADGGEVRQLHDRGRHEADEQDAVELVAPGRGGGGRRAGSCGRRGGGNSDINAAMAAGSPGTHDSRSIAHLRHRGRRRQYQPRRPAAAPVAAGGFGPVAGLAGMVRRAAVSPQRPRHRLDRGGRAPGRAGAPAAPGVPPGAGRARIVARPGNGRAAVGGQHHAGQLPAARPGGRFPPCLSGRQPAPVRWQYPGNRRTPAGAGPGLHRRRRARGPAGRHRRACLAAGRGGGHRARRPCPGGQGRGHAAGSGGFAAGDARTRFGRAAAGRARLHRCRPGALGRLGAGRGGRREAGRARRPRRGVRVGHVDAARGWRAGGAAAVAATLDAHLEHPGAACRRGRARRPALPGDVPGSAGGAGSHLARGAVAFFVRQAPFPAP

SEQ ID NO: 199876 - protein, 224 aa, Glycine max
  Coding DNA Sequence Number=SeqID_83098
  Gene Ontology: Mol. function=RNA-directed DNA polymerase activity; Biological process=RNA-dependent DNA replication
MRKGKSEANSEKKKDTTLNEGKEVPYPLVPSRKEKERHLAIFLDIFKKLEITLPFGEALQQMPLYAKFLKDMLTMKNWYIHSDRIVVEGNYSVVIQHSLPPKHKDPGVVMIPCSIGEVFVGKALIDLGASINLMPLSMCQRLGEIEIMLTCMTLQLADRSITRPYGVIEHVLVKVKHLIFPTNFVVIDIEEDADIPLIHGRPFMSTASCVVDMGKKMLQMGIED

SEQ ID NO: 199877 - protein, 245 aa, Glycine max
  Coding DNA Sequence Number=SeqID_83099
  Homolog annotation: Hit_ID=Q1ZJ01; Match level="QueryCoverage=47%, HitCoverage=45%, E-value=3e-09, Identity=27%"; Hit description =General secretion pathway protein C
MRNAFLSRLMTPCVMLVMLIFCSQQGYVVYKDYKKVTNKLANADKPALKKPDAEKSFGLFTAAVRQSDAPAAAKAPLSAEIEGIIRSDESWLSFAVIKTPAGQQSYREGEPLVGFDDAYYEGAKQTLALNKPAYFKGGVDSAPVTKSKKDAGADSLHLDDYLVLKPLIDKGQLEGFTINPRNATPFYHNAGLEKGDVVLKVNDVDMTQEAQAKNIIANWSKMKEADVVVRRHAHLENIRINVLNN

SEQ ID NO: 199878 - protein, 363 aa, Glycine max
  Coding DNA Sequence Number=SeqID_83100
  Homolog annotation: Hit_ID=Q1SS26; Match level="QueryCoverage=72%, HitCoverage=31%, E-value=2e-09, Identity=20%"; Hit description =Unnamed protein product; no similarity, hypothetical start
  Subcellular localization annotation: CTP_CleavageSite=73; ConfidenceScore=5.81e-01
MAESSKKRKGSSASASASRAHRSGATSASTAPIPPSLSSSPVFSSNEQQKRYSNLFSSRSIIDPNFIDMEFFSAETFDCIQAFQNLGLLPFRSLQLPIYPELVKAFYCNLEIQDSTLISEIFGIKMVIDQSLFHDLTKLPSDGVPFEGTLNDDWKFDFSAHDARQLVCTNNADMTGRLLAGSLAFESRILHYLIVRILLPRSSNLAQVSEEDLIIMWAFHTGRQLDWAHLVRYRMHKALRLNAPLPYPQLVTLFFHHFQIPLDSEPYVPIKRSFLIGAAVIASFGYRKELDGSWVKKGAPPADDESNQPVEDNSSLLRKLLEKFDGLQTFVGDKFDNMELQVDMRFDAMESRITKVEEDVSFI

SEQ ID NO: 199879 - protein, 219 aa, Glycine max
  Coding DNA Sequence Number=SeqID_83101
  Gene Ontology: Mol. function=nucleic acid binding; Biological process= DNA integration
MHEEAQRLAVLNKKLKSKLKLHITKLASTQGEVNKLKQENEKVVSSCKATGCDYTSTSFYMDDHKSLQTKFENFKMDHYAKRMKLQTELSYHKDMFEKLNKGKSNLNHMLTVQKHTTDKTSLAYNMQTTFSKKTKFVSSKGVCLKAKDSLWYLDSGYSRHMASDKSKLSDFVSKDGGYVTFRDNNKGKIMGEGNIGNQYKTQIKNVLYVEGLKHKLLKH

SEQ ID NO: 199880 - protein, 171 aa, Glycine max
  Coding DNA Sequence Number=SeqID_83102
MTFGSWEQSYNYLPLWLTAAQHFVPGTIVTYKTPSSMDDCEDESPRMILNRVLWAFKPCIKGFQYCKPIVQGMRSGNHDLRQSPSQCEKSFHKQWIGWTKFPTVNGLRPMMKENGHTYSEDIYVMMQENQHSATSHYVPMHVRETGEFEVQGIENIWLSRRAMACTAKLNE

SEQ ID NO: 199881 - protein, 47 aa, Glycine max
  Coding DNA Sequence Number=SeqID_83103
MGLLVAMNSTEPVGCEVYVHLGEEGNQSIHSIEVVQVYLVTVTRVLL

SEQ ID NO: 199882 - protein, 111 aa, Glycine max
  Coding DNA Sequence Number=SeqID_83104
MASYSNMYKDNWTQPWPMGSEIYPEVHENPRAFFNSSSPILSEPLAHSSSEWSLHREDCIICSFTHQINNAKEECGVGGGGEMTLGREEREREREKKKMKDDEEEAQWLSE

SEQ ID NO: 199883 - protein, 162 aa, Glycine max
  Coding DNA Sequence Number=SeqID_83105
MAFPMAATTFPPERDRPASSIQTCKWRSVRFGHRSNIDDFNFLKLHQEPQVGLWFIERERLSKLGKQWSLLSVETVYALLPCKRSVCSMDITCHDISMVKVEESNRLETLKKFFGCLQVDALLVSLENSTPRIDTLIVLIITHLSHPTLLSSKNNTYGPIVP

SEQ ID NO: 199884 - protein, 77 aa, Glycine max
  Coding DNA Sequence Number=SeqID_83106
ALAPKMNGAKRSPEAVGCKKESVGGAFRLRGKDPREQCWTKRKREWPKIRPKGVVDGQQVNIPVLPFVGPEGRRRLG

SEQ ID NO: 199885 - protein, 73 aa, Glycine max
  Coding DNA Sequence Number=SeqID_83107
MEEFNAQVAWPGDQPSSSGGGGASAAQEPETEEPPAPAEEQTIPVQTPQPSPSSAPAPEETQTSALDLNEDQP

SEQ ID NO: 199886 - protein, 67 aa, Glycine max
  Coding DNA Sequence Number=SeqID_83108
MENWRTALRNNFAGLQTRRWRMHEQRQAMTFMGLRKKVENGELRQAMTFMGLRKKVENGELANNATQ

SEQ ID NO: 199887 - protein, 92 aa, Glycine max
  Coding DNA Sequence Number=SeqID_83109
LGRIDGDPVFRETRIWATWEYVSSVGGGLQGMSGTWRYVAGVRRPWGRQASSWQSTDKRNKDHKARRLVEAKGASGNRLPACVIDYTEGWVT

SEQ ID NO: 199888 - protein, 86 aa, Glycine max
  Coding DNA Sequence Number=SeqID_83110
MAPDRMQLQNMYKKEHESFKEYAQRWRDLAAQVAPPMMEREMITMIVDKKPWANGENKKEGGTHVVTVVPTSANINPSHYPPPYQP

SEQ ID NO: 199889 - protein, 229 aa, Glycine max
  Coding DNA Sequence Number=SeqID_83111
MGVKYLEAVKRGSHAIKQWSPDEITGAEDDSSLFLFVRRNYLCISARHLTSRVSMTGIDYAEKLLVYLHTSPDFRVSLTEIDCAEKLLVYLRTLPDFRVSVTEIDCAEKLLVYLCTSLDFRVSVTEIDCVEKLLVYLRTSPDFRVSVTEIDCAEKLLMYLRTSPDFRGSVTEIDCAEKLLVYLRTSPDFKLSVREIDYAECRNLPFGGRATRDSRDACSTKGICAESPP

SEQ ID NO: 199890 - protein, 65 aa, Glycine max
  Coding DNA Sequence Number=SeqID_83112
GDLGKASLMLEGFTALLTSSPDLFCARLDAISDVLVLVQGVKREAVPKGQTPFNDTRDKVMKEFA

SEQ ID NO: 199891 - protein, 45 aa, Glycine max
  Coding DNA Sequence Number=SeqID_83113
MADQQATKSKAKGKQKMHLVAHDPGNLNKTSASSEGSHTSQNIYV

SEQ ID NO: 199892 - protein, 103 aa, Glycine max
  Coding DNA Sequence Number=SeqID_83114
MGNKALMKGVPKIISLLRIHDVGYNVQDILPENTGIAKSIEAAGSTMSDTMSRTSCLKILELLKALKLQDPRCRIRCPGHLARKYWTYKSVISLTDYCAVSKR

SEQ ID NO: 199893 - protein, 86 aa, Glycine max
  Coding DNA Sequence Number=SeqID_83115
MGLRIRFDGGGCAKSAMQSIRGASDSEVEDVARPALGNQFVGLRIQWWRMHERQKIPGAPNNMVEDALTALEYQFVGIPGSMVEDA

SEQ ID NO: 199894 - protein, 315 aa, Glycine max
  Coding DNA Sequence Number=SeqID_83116
  Gene Ontology: Mol. function=tryptophan synthase activity; Cellular component=cytoplasm; Biological process=aromatic amino acid family biosynthetic process
  Homolog annotation: Hit_ID=Q8P7S0; Match level="QueryCoverage=83%, HitCoverage=97%, E-value=5e-73, Identity=56%"; Hit description =Tryptophan synthase alpha chain
  Pfam annotation: Domain name=Trp_syntA; Domain location=56-314; Score= 313.6; E_value=3.6e-91; Accession=PF00290.11; Description=Tryptophan synthase alpha chain
MAQFRKPPVSSPHAYDGDQGEYLTWQDPGSDLGIRLELFEGKDVPEMPVSRLDACFQRLREQQRKALIPFITAGDPSLEATVPVMHALVDAGADVIELGVPLSDPMADGPTIQRSSERAMARGAGSRYVLQAVAQFRERDAQTPVVLMGYLNPVEIHGYAAFAKAAVEAGVDGVLLVDLPPEEAGEAQQAFDAAGLALVLLASPTTSEARADKLLALARGYLYYVSFAGVTGASERLDSDAASARLQALRARASVPVVAGFGIKDAASAAAMARQADGVVVGSALVAVLAEAGSAEEAEQRAGAFLAPLRQALDA

SEQ ID NO: 199895 - protein, 100 aa, Glycine max
  Coding DNA Sequence Number=SeqID_83117
AAPDQVKNWFQSNPEFLKPADPETSLFLNQKSQLAAFLASSKSKESLAQNLKEVLQLLQQEVEEEPSKKEAESSETNDDQEDDPFYQNEDDCFGISLDDD

SEQ ID NO: 199896 - protein, 102 aa, Glycine max
  Coding DNA Sequence Number=SeqID_83118
  Gene Ontology: Mol. function=transferase activity; Biological process= DNA integration
MQNQNCKMLSMNCRRFQVPIISILERIQNRAMRRALLSKNKFKFVDQTISIPYQSSSIYDAWERCNVMVISCITRTQIPKIAPSKVYIDDARMLWEDLKGQF

SEQ ID NO: 199897 - protein, 329 aa, Glycine max
  Coding DNA Sequence Number=SeqID_83119
  Gene Ontology: Mol. function=chitin binding; Cellular component =extracellular region; Biological process=chitin metabolic process
  Homolog annotation: Hit_ID=UPI000044A8F0; Match level="QueryCoverage =52%, HitCoverage=99%, E-value=1e-26, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGTVHEPQAHLGAGQKFSPVDGGPLGTSTLALRGLHTLAFRGLHDLTFRELHALAFRGLHDLAFRGLHALAFRGLHVLAFRGLHALTYRGLHVLAFRGLHILDFKGLHVLHSESYTGLHVLAVRGLHAFAFRGLHALAFRGLHVLAFRGLHACTFKGLNTLAFRGLHVLTFRGLHALAFRGLNVLAFRGLHVLAFRGLHICAFRELKFLGHPSDLRGGPTVGAQLKEEAGNAPARHPVDSEKSNRVQGFPALIMNLRQFYGVPVTPSRVIRPLLTRLSLRSIVPPGRRRARHHSSGQQMHCHHLSSSTKAGVLPTTCGRPVGDQVQRQ

SEQ ID NO: 199898 - protein, 183 aa, Glycine max
  Coding DNA Sequence Number=SeqID_83120
  Pfam annotation: Domain name=zf-CCHC; Domain location=8-25; Score =17.7; E_value=0.0012; Accession=PF00098.13; Description=Zinc knuckle
MQEKTSSIKCFKCLGRGHITSQCLTKNTMIMRSQDIYSSQDEATTSPSSSESEEAKGEESSEEIYPQEEGQPLIVKEECKEVSVSSKRLAKKERNFEIKTNFKEISPLRQPPHFLLCKKTLVSIATPLGLELIPQVKELLDEGLVRKSLNPYALLVPKIGIINMKIQKKVLREKAKSFKNLGI

SEQ ID NO: 199899 - protein, 267 aa, Glycine max
  Coding DNA Sequence Number=SeqID_83121
  Gene Ontology: Mol. function=RNA-directed DNA polymerase activity; Biological process=RNA-dependent DNA replication
MIQDCDEDGVILNVQHIRTPLVPIHIKMCEAALFDHDHAACEVCPVNVKGCPKVQEDIQGLIDSRELIITRKGKEVCVITPEFQRVEISYNSGESTTTPLVISLPGPMPYASLKAVPYKYSATMLEGGQEVPLPSLTPAISVDNIASDSRILRNGRVIPTLFAKKVNDPAVKQVAVNGPGTRKEVGQSNGTNKNSDHDEILKLIQKSEYKVVDQLLQTPSKISILSLLLNSEAHREALMKVLDQAFVERDVTVNPIGQYSRKHYCLQ

SEQ ID NO: 199900 - protein, 110 aa, Glycine max
  Coding DNA Sequence Number=SeqID_83122
MSSSAPLSSRDGESDDMRGYLMVIRTFCQPEASEPVDMLRLTSSSAPFANRGFYSRRPETFKSNDARDSSLLARDDRVQWRREVSRLSNFVVFKTLRDIDWPDDVPLEGN

SEQ ID NO: 199901 - protein, 42 aa, Glycine max
  Coding DNA Sequence Number=SeqID_83123
MKKERVSKVRYMACKERYLVGGLWCYYSHKCDHGLPVETTVK

SEQ ID NO: 199902 - protein, 227 aa, Glycine max
  Coding DNA Sequence Number=SeqID_83124
  Homolog annotation: Hit_ID=P0AB38; Match level="QueryCoverage=37%, HitCoverage=50%, E-value=1e-20, Identity=70%"; Hit description =Hypothetical protein ycfM
VLLVDRIKNSTNGSLQTEKATAAIENALANNGKFSLVSNDQLNQAKQTLGLSPEDSLNSRSKAIGLARIVNAQCKPAKSSGRATALHNPDPRLQHLVQQQWPTAQAAGTQRAGRSAGAPDTVAAHPVCRSSARIPHPASVAYYGAGAAAADVAGAVAAAALAAGRGAVAGSVQRAARSGADTAAAPASPAADRLSLTAGAVAAALLAAVSAAALALAAALKPVAAAR

SEQ ID NO: 199903 - protein, 181 aa, Glycine max
  Coding DNA Sequence Number=SeqID_83125
MVCNDHADMTDRLLAGSFTFECRIMHYILCRVLLPRSINLAQASDEDLILLWALQTGGQIDWAHLVRYRIYKALRANAPLPYPHLVTLFLQHFNIPLEDEPFVKVKRSFAIGAGVVASFGYRKDVDGQWVHKQDLPPPIPDERTPSPPPQRDTSSSLSNDVLTKLRDLWAFIGDRFDAMDS

SEQ ID NO: 199904 - protein, 315 aa, Glycine max
  Coding DNA Sequence Number=SeqID_83126
  Gene Ontology: Mol. function=hydroxymethyl-, formyl- and related transferase activity; Biological process='de novo' IMP biosynthetic process
  Homolog annotation: Hit_ID=P37051; Match level="QueryCoverage=48%, HitCoverage=54%, E-value=2e-71, Identity=86%"; Hit description =Formyltetrahydrofolate deformylase (EC 3.5.1.10) (Formyl-FH(4) hydrolase)
  Pfam annotation: Domain name=ACT; Domain location=169-234; Score =28.1; E_value=3.1e-05; Accession=PF01842.15; Description=ACT domain
  Pfam annotation: Domain name=SEC-C; Domain location=138-159; Score =8.3; E_value=0.2; Accession=PF02810.6; Description=SEC-C motif
  Pfam annotation: Domain name=SEC-C; Domain location=5-25; Score=24.6; E_value=0.00035; Accession=PF02810.6; Description=SEC-C motif
  Pfam module annotation: Pfam domain module=ACT::SEC-C::SEC-C; Domain location=169-234::138-159::5-25
MEAILSHLCPCGSALEYSSCCQRYLTGGQLAPSPSQLMRSRYSAFVMKDVDYLIKTWHPHCEAPRFRADIEKGFANTQWLGLTVFATDNGRSPDEGFVSFIARFTEDNRPGAIIERSRFLKENGQWYYIDGTRPLIGRNDPCPCGSVRPGISNCKHNRIFPAMHSLQRKVLRTICPDQKGLIARITNICYKHELNIVQNNEFVDHRTGRFFMRTELEGIFNDATLLADLDSALPEGSIRELNPAGRRRVVILVTKEAHCLGDLLMKANYGGLDVDIAAVIGNHETLRTLVERFDIPFELVSHEGLSREEHDQRMG

SEQ ID NO: 199905 - protein, 90 aa, Glycine max
  Coding DNA Sequence Number=SeqID_83127
MASSTCFQQISSQITIMKQKPSKTTHYISQNPIPTKIKDALHDSENAFLSRFGAEMMTKGWSFVGASMVEEEEENGNVRERGKRLLKFWG

SEQ ID NO: 199906 - protein, 204 aa, Glycine max
  Coding DNA Sequence Number=SeqID_83128
  Gene Ontology: Mol. function=transporter activity; Cellular component= integral to membrane; Biological process=transport
  Homolog annotation: Hit_ID=Q0LUS3; Match level="QueryCoverage=66%, HitCoverage=34%, E-value=2e-21, Identity=48%"; Hit description=Major facilitator superfamily MFS_1
MAIRPMRAIGRRSGSTRSRGVTGREGGTDRPRRRAAHRADRYAAEDQRGGAALAGFRHQMAAVVGGERPKASYADAQQHAAQQHHREVDGLRRHQVGHHQLHLQSQQGRRLSSRPEARLNPGAATAATMPGVVTISPAVPVLTPSEGAMLVFTPIGTNSVVTMTKQATVSEKIAGHGDDAGLSLLFSIMPLVLGECAGRARGAV

SEQ ID NO: 199907 - protein, 82 aa, Glycine max
  Coding DNA Sequence Number=SeqID_83129
MGAKYLEVVKRGSHPNNGCITCILSLTQIRALCIFALFFHLYASSANNNPNELAMCAYCAKRVLLLGMNIHLPEGIPMAKRG

SEQ ID NO: 199908 - protein, 195 aa, Glycine max
  Coding DNA Sequence Number=SeqID_83130
  Gene Ontology: Mol. function=chitin binding; Cellular component =extracellular region; Biological process=chitin metabolic process
  Homolog annotation: Hit_ID=UPI000044A8F0; Match level="QueryCoverage =84%, HitCoverage=99%, E-value=2e-18, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTDPLNESISCFLIRVDPWVLEPVTFRGLHILTFRGLHALAFRRLHALTFRGSCTFTFRGLHILSFRELHVLTFRGLHVLAFKGSCTFAFVGLHALTFRGLHVLAIRGLHVPTFRGLHAFAFRGLHVPLFKELHALTLRGRHALTFRGLHVLAIIGLHSLTFKRRHVLNFRGLHALTFRGLRVLTFSGLHIHTLR

SEQ ID NO: 199909 - protein, 316 aa, Glycine max
  Coding DNA Sequence Number=SeqID_83131
  Gene Ontology: Mol. function=translation release factor activity, codon specific; Cellular component=cytoplasm; Biological process =translational termination
  Homolog annotation: Hit_ID=Q9PGX4; Match level="QueryCoverage=28%, HitCoverage=18%, E-value=2e-32, Identity=74%"; Hit description =Peptide chain release factor 3
  Pfam annotation: Domain name=GTP_EFTU; Domain location=123-282; Score= -12.2; E_value=2.4e-06; Accession=PF00009.17; Description=Elongation factor Tu GTP binding domain
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRQAGSVKSRKSAKHATSDWMTLEKERGISVTSSVMQFPYDGRIVNLLDTPGHADFSEDTYRVLTAVDSALMVIDCAKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 199910 - protein, 44 aa, Glycine max
  Coding DNA Sequence Number=SeqID_83132
TVVVRIDFNVGCDLGPTLFQKSIKTVEVAPVVAFKNFNIGLMHT

SEQ ID NO: 199911 - protein, 108 aa, Glycine max
  Coding DNA Sequence Number=SeqID_83133
MYIKYGPKYIMKHSQQNKLSNETKTPHTYSQNNSKAPKFLKDMVISWKGKQGSKGLSKELIQGKSIWLEAYKNKIASIISKYACELGSINKNQAKAIVQAINGAKHTK

SEQ ID NO: 199912 - protein, 138 aa, Glycine max
  Coding DNA Sequence Number=SeqID_83134
MTSKIQILGRLGVLAMYIMNSIITMLYFNGRVYEDNDGVIFEGSKKAIQIKRGISFNALKKKLEIRFLVSGKYVALQICDDEDVETMIESFQQQQQMSVLELYVENDVAGGSMFHAANSVTSCERNVSHHESELPRNI

SEQ ID NO: 199913 - protein, 314 aa, Glycine max
  Coding DNA Sequence Number=SeqID_83135
  Gene Ontology: Mol. function=RNA-directed DNA polymerase activity; Biological process=RNA-dependent DNA replication
MKADIEAMKEQMTTMMEAMMSMRKMMEVNTATVVDASTATEVDQTHPSGLNQLNPPVSDMNKHSFPPYGLPPNYTPSNVAHAPDENVNNSTPILIESQQPQSSQAQVPQLMGETHEVPRDHTLADSEPCLEYATEGQALGKVPPAKVEKEKLDHIEERLRAIEGGGDYVFPDMVELCLVPDIVIPPKFKVSDFDKYKGTTCPKNHLKMYIRKIGAYSKNEKLLMHFFQESLIGAAITCYTNLEPSQNMCKKEHESFQEYAQRWRDLATQVTPPMIEREMITMIVDMLPVFYYEKMVGYTPSSFADLVFTSERIE

SEQ ID NO: 199914 - protein, 63 aa, Glycine max
  Coding DNA Sequence Number=SeqID_83136
MVQVEEVGGHCHEIGGVAYGIWIKLKKSETLVWLDFVECPKPMVQVEKVGTLIWIWWSSQRFV

SEQ ID NO: 199915 - protein, 60 aa, Glycine max
  Coding DNA Sequence Number=SeqID_83137
LIRQVCEVLIFICSLSQSAGLASHLLSALFPWLSARKKDELCMFAKRGFIPLSAPLQSIR

SEQ ID NO: 199916 - protein, 273 aa, Glycine max
  Coding DNA Sequence Number=SeqID_83138
  Homolog annotation: Hit_ID=Q8UGV4; Match level="QueryCoverage=48%, HitCoverage=17%, E-value=4e-54, Identity=82%"; Hit description =Penicillin binding protein
MHCFGIAGDEIVPPVEILDIAHQRICAGGRQPADLVNLLQVKLDTIRHGGTAVLVIRASTALAVEQHAADGGEHHFAGVPVLQLVETAQSAAVAQAFPFLAGHLGQRFGSPERRHIGRRRRGHWPAKGRHVKHFRHNHATVLRREWVEAQNIDGRIALNRKYRQVQEEKDDKKGRKKRHILLRIDSFIDSGLWTAAARLVDFWEDVTIASRKLHVRGWKKLLVNLTCDALTFGTAGSVVLLALAMPAFEETKKDWRYRGDFAVTFLDRYGNTI

SEQ ID NO: 199917 - protein, 77 aa, Glycine max
  Coding DNA Sequence Number=SeqID_83139
  Homolog annotation: Hit_ID=UPI00006A2901; Match level="QueryCoverage =41%, HitCoverage=20%, E-value=2e-10, Identity=96%"; Hit description =UPI00006A2901 related cluster
SRTVGCRWTARAASRESGSSRAGRGTDWERAFGASSPGVEQSTQNCALNVKVKKFNQARVNGGSNYDSLKVAKCLVI

SEQ ID NO: 199918 - protein, 86 aa, Glycine max
  Coding DNA Sequence Number=SeqID_83140
MVKEECKEVNVSSKRTLVSIVIPLELEVIPQVKELLDEGLVRKSLNPCALLVPKIGIMRHQIPMIDVPLIKLIRNYVPSWEDAHKS

SEQ ID NO: 199919 - protein, 256 aa, Glycine max
  Coding DNA Sequence Number=SeqID_83141
  Gene Ontology: Mol. function=peptidase activity; Cellular component =integral to membrane
  Homolog annotation: Hit_ID=Q8YIB9; Match level="QueryCoverage=99%, HitCoverage=82%, E-value=1e-134, Identity=91%"; Hit description=ZINC PROTEASE
  Pfam annotation: Domain name=Zn_peptidase; Domain location=1-252; Score=517.4; E_value=1.6e-152; Accession=PF04228.4; Description =Putative neutral zinc metallopeptidase
MFFVLRAVGIDPLPILFGDGSMGPSVTQQAGQSGRTAAEGGAVANDETTQFARTVLAETEDVWSGIFKSRGQTYTPPTMVLFSGQVRSACGFASAASGPFYCPGDRKLYIDLSFYKELANRFGASGDFAQAYVLAHEVGHHIQNLLGILPKFNQMRQQMSEAQANQMSVRVELQADCFAGVWGYYTEQKGILEAGDLEEALNAAHQIGDDTLQRRSQGYVVPESFNHGTSAQRAKWFQRGFDSGKLESCDTFSGDV

SEQ ID NO: 199920 - protein, 73 aa, Glycine max
  Coding DNA Sequence Number=SeqID_83142
MQVAGGIGAFRDDVTPDTSVINAVSALQEGAGQQRPFPRVAVCNAQRLQDVARFNGDLVGQKCQHQQRFALLE

SEQ ID NO: 199921 - protein, 136 aa, Glycine max
  Coding DNA Sequence Number=SeqID_83143
MQFIEVSQASFEANKNTIRNLEIQVGRLANQIVERSFMTIREEKSIEIKAHKESLIKEHDSRENGEEKEAKFEERTPKQGRRHEEVDKFLKGFIALLTNTSSAMVWRSLHGCMNFMEFLPKKRKKDDVFFMTYMPP

SEQ ID NO: 199922 - protein, 182 aa, Glycine max
  Coding DNA Sequence Number=SeqID_83144
  Gene Ontology: Mol. function=transcription regulator activity; Cellular component=nucleus; Biological process=regulation of transcription
  Homolog annotation: Hit_ID=Q1SJ77; Match level="QueryCoverage=53%, HitCoverage=29%, E-value=4e-31, Identity=69%"; Hit description=Helix- loop-helix DNA-binding
MKLAAVNPVIDFNLDSLLATEGVTPMDCNFPPTVAPVMWPEIPQNGNRQQYQQPWQFDAFHQPLWGREEDNTNMTPENSLWSYDSSANSVLAISHDLSSLNIHQVFPVSILSEPVGKPGFYSASKEEELLQAFQMLQMMNLKRIYIKLNLFSIFLFSKMMLLSRCCLLYSLFESITLVMGDP

SEQ ID NO: 199923 - protein, 137 aa, Glycine max
  Coding DNA Sequence Number=SeqID_83145
  Pfam annotation: Domain name=zf-CCCH; Domain location=40-61; Score =9.3; E_value=0.077; Accession=PF00642.15; Description=Zinc finger C -x8-C-x5-C-x3-H type (and similar)
MAVKKCYCEKQFQDTAADRKRHVLGIQQQQAKARWYDSFKQQQIPPGFCRYGDSCKYLHPIPNNNLQQPPVLTTPSPSPPPVSEQHNNKCAGNVVGVSLDNLPPLLQPPPEADVWSSFGDERHCKGANENKHGLVVI

SEQ ID NO: 199924 - protein, 57 aa, Glycine max
  Coding DNA Sequence Number=SeqID_83146
MTKLNGTIPNQQTWDLMIKFHITMLLGESSGAVMKLCIQTLEGRGMSLAEKGYCDVR

SEQ ID NO: 199925 - protein, 190 aa, Glycine max
  Coding DNA Sequence Number=SeqID_83147
  Homolog annotation: Hit_ID=Q60EM0; Match level="QueryCoverage=90%, HitCoverage=22%, E-value=1e-08, Identity=24%"; Hit description =Unknow protein
  Pfam annotation: Domain name=PPR; Domain location=147-181; Score =12.9; E_value=0.22; Accession=PF01535.11; Description=PPR repeat
  Pfam annotation: Domain name=PPR; Domain location=39-73; Score=10.8; E_value=0.39; Accession=PF01535.11; Description=PPR repeat
  Pfam module annotation: Pfam domain module=PPR::PPR; Domain location =147-181::39-73
MVFTFPIVNQALSCMRGDVVYGKMMHCVATQMGLDGDLNFCNTMVDVYVECRCVDSARCVFDEMSLRDEDGNGTKCGYAYCDVASILCFHALRAAIRVASWFKEMQSLEVHLWNIETLTLVILAFAKFGSLSEGEDVHNLVIQTSNITQGAMMSGFIQNGPFVEAIVLFQQMRAEDLNIVPEIWRNLLDA

SEQ ID NO: 199926 - protein, 210 aa, Glycine max
  Coding DNA Sequence Number=SeqID_83148
  Gene Ontology: Mol. function=nucleic acid binding; Biological process= DNA integration
  Homolog annotation: Hit_ID=Q1ST43; Match level="QueryCoverage=58%, HitCoverage=11%, E-value=1e-24, Identity=37%"; Hit description =Integrase, catalytic region; Peptidase aspartic, catalytic
  Pfam annotation: Domain name=zf-CCHC; Domain location=160-177; Score =10.4; E_value=0.019; Accession=PF00098.13; Description=Zinc knuckle
MSDVSDDATPTWFDPCLDPSSPYHIHPSENPSSVSIYPTLDGNNYHSWSRSIRMALISKNKIGFLAGTIPAPDVHSPSYPSWERCNTLISDLLRIAELQEEIYGLRQGSRFVMDYFTALKSMWESISCSFSNPAYGPVNRRGGGAPVGQSRSNTRTFSNKKCVYCGRNGHTVDICYAKHGYPPGHPRHSGRPRFHNKESSSSSTTVNNVA

SEQ ID NO: 199927 - protein, 123 aa, Glycine max
  Coding DNA Sequence Number=SeqID_83149
  Gene Ontology: Mol. function=hydrolase activity; Biological process =intracellular signaling cascade
  Homolog annotation: Hit_ID=Q1S1N3; Match level="QueryCoverage=90%, HitCoverage=49%, E-value=5e-14, Identity=33%"; Hit description =Calcineurin-like phosphoesterase family protein, related
  Pfam annotation: Domain name=DUF1723; Domain location=27-76; Score =53.7; E_value=5.9e-13; Accession=PF08330.1; Description=Protein of unknown function (DUF1723)
MPTPNPRIKPLLVQAGFLDVAKVEQVKIDETLVTALVERWIPELHTLHLHVGECIITLEDVALQLGLCIDAKPTPQKLAGHCREYILGLIGGVLMSDKSGNIVQLMYLPLLAYFDRASYTARV

SEQ ID NO: 199928 - protein, 55 aa, Glycine max
  Coding DNA Sequence Number=SeqID_83150
MQGTVMKGKKIIPNDTASQYYLWIGSTLSIGDVRRCKIMPMEHPHPCQCRATKLG

SEQ ID NO: 199929 - protein, 354 aa, Glycine max
  Coding DNA Sequence Number=SeqID_83151
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=26%, E-value=1e-123, Identity=58%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=201-354; Score =164.2; E_value=3.4e-46; Accession=PF00665.16; Description=Integrase core domain
MVTTNDAGVVVDWWYLDTGCSNHLTGNRQWLINYDSSKESRIRCADDEYLVAEGMGDVLVELKDGGTVLIENVWYVPGMKSNLMSVGQLLEKGYSVTMRGAVLQLFDNSDKLVLKSKLSRNRTFKCNVKDSGVKVLSTVTESQSWLWHRRFGHLNFKSLTQLSEKELVTGMPKIGVCDKTCDVCLKGKQTKLPFADQSPMRASSPLHAVSSDICGPIEVPTLGGNKYFITFIDEFTRMIWLYVIKQKSEALEVFKKFKAVAETQSGQKLKILRTDGGGEYTSKAFEEFCEAQGVVHEVTPSYTPQHNGLAERRNRTLLDMARSMLKQKNMPHEFWGEAVTTSAYILNRCPTKSL

SEQ ID NO: 199930 - protein, 107 aa, Glycine max
  Coding DNA Sequence Number=SeqID_83152
  Gene Ontology: Cellular component=membrane
  Homolog annotation: Hit_ID=Q84TV1; Match level="QueryCoverage=54%, HitCoverage=15%, E-value=9e-17, Identity=66%"; Hit description =Nodulin-like protein
MASSIIPLLAMIIVQLGYAGMNITSKLAIQSGMQPLVLVAYRQIFATISLAPFAFWFERSYTLCSRNLIVLEPFRPKAISPISDSASNFSSSINTTSIQSSTSGMIS

SEQ ID NO: 199931 - protein, 63 aa, Glycine max
  Coding DNA Sequence Number=SeqID_83153
  Subcellular localization annotation: CTP_CleavageSite=39; ConfidenceScore=5.24e-01
MRDLEMLGMATYLALSSAARLKSSFILGSNFNLSFMSCKKQMAVAIFMGHSSTSSAPPLMLIL

SEQ ID NO: 199932 - protein, 38 aa, Glycine max
  Coding DNA Sequence Number=SeqID_83154
MATMPKTKHGFHLMMERGGCFMTTTDAASFGKINSVEE

SEQ ID NO: 199933 - protein, 200 aa, Glycine max
  Coding DNA Sequence Number=SeqID_83155
  Gene Ontology: Mol. function=molecular_function; Cellular component =membrane; Biological process=auxin mediated signaling pathway
  Homolog annotation: Hit_ID=Q84TV1; Match level="QueryCoverage=51%, HitCoverage=29%, E-value=5e-25, Identity=53%"; Hit description =Nodulin-like protein
MSQLGHSTGTISTGLAYVLMSWTIERKGPLYVSVFSPLLLVIIAVASWALLHEQLYVGTAIGSLLIVLGLYFVLWGKNKEMNKIDMVEVEGTVMEAIKESEKDEVKDLELQPYDPSNGNVMLWEKCFYFHLEQLPTKKFDSSLEGKRPATHDGEGDIIISITEDECQGEIEGNGEAWLARKMTTTNGFNVKAFKTTMAYT

SEQ ID NO: 199934 - protein, 48 aa, Glycine max
  Coding DNA Sequence Number=SeqID_83156
MDAYCTIKALMFLTNANVVVWPIVQRTKLDDNIFLRQNDDHLPMCTAV

SEQ ID NO: 199935 - protein, 106 aa, Glycine max
  Coding DNA Sequence Number=SeqID_83157
  Gene Ontology: Mol. function=serine carboxypeptidase activity; Biological process=proteolysis
  Homolog annotation: Hit_ID=Q1EP77; Match level="QueryCoverage=59%, HitCoverage=13%, E-value=3e-15, Identity=68%"; Hit description =Serine carboxypeptidase (Carboxypeptidase D), putative
ALGVAKPSVASYLSQEILAEQEADRVHGLPAQPPVKFNNMVVILLSMKLKEQHCSIGFSRPLTNQNKNSFSYGSMENHKPEGQEVSAVGVNIDNHMNEGSGWITSA

SEQ ID NO: 199936 - protein, 149 aa, Glycine max
  Coding DNA Sequence Number=SeqID_83158
MEETHGMPHHNLADFEPCLGYATEGQAVGGMGKLDHLEERLRAIEGGEDYSFANLEELFPIPNIITPPKFKVLDFDKYKGTTCPKNHPKMYCRKIRAYAKDDELLIHFFQESLTGVVVTWYTNLEPSRVHSWEDLMVAFVRQCRYNGFG

SEQ ID NO: 199937 - protein, 94 aa, Glycine max
  Coding DNA Sequence Number=SeqID_83159
MAPFTCACGKYNKEVVLRYRLEVMINQGNESTKFLLWDRKCSELIGQSTDVVNKHKIEDGDVDLNASPQALDKLLGYELAFKIKVQPKFGILLF

SEQ ID NO: 199938 - protein, 300 aa, Glycine max
  Coding DNA Sequence Number=SeqID_83160
MDHVLKECEEPGVEVDDEDYDNYPFSPDLSPPPPKPKRWSIDGVSQTNDYGTHPTLEIESSMMNVGISLENFSLMTLIKEPNLLSEGKKGDMMGQVKGDMEPKVLPSLGKKRGRGKGLGENPNMNNETEEGKKDFVERPEIKGKRSMEMVAKGDSMEVEDEHLNKKNSPSKTTRYSRGSQCNVNGDKEEGREYNFLRNLGYLKHYFGVDCKGCGKAKASALILLWKDLLKPLDDYPWVCLRDFNQVRLTKEMVRGDAPNLTSMRTFYVGLSNCGLTDICQVGFCLTWSNMIKDPYNTQEK

SEQ ID NO: 199939 - protein, 264 aa, Glycine max
  Coding DNA Sequence Number=SeqID_83161
MAKSEKSCRCGTMRWAMQGIRKGGETYNGNAITTAHHGGVMGHKEMCEIGNGMRVVVAVRGGVNDSVATWVEQERRSRDKSGSVMRRQRSLEIASPIEHGEVRLCMMMWESMFNAINLSLAIVAFSFALIPGVVMWFCTNGAHNKIIQDINNMVMAKPKKQGGDDAYLPPFVVTPPWFRTIRPPSVVTPPWSSTRPTRASLLAPTILSLFHGSVGALPSPFALGPFAGGVRPLPPWWPHAARPCTSGVTGSTLVVSTLGVLFST

SEQ ID NO: 199940 - protein, 142 aa, Glycine max
  Coding DNA Sequence Number=SeqID_83162
MAACKSVNVDLMTYVPMLFTLQHILHIYDNSFGLVPHKSICGKNMKEISGVLIQGERGLQRVVPFQLAFLLRWTKTKMNEQEERKSGCEIPTSVKWPKQSCGGGGVGMGNEEVRWEVRDKVGNREKKGIKEKKEKEKVSAFG

SEQ ID NO: 199941 - protein, 141 aa, Glycine max
  Coding DNA Sequence Number=SeqID_83163
  Gene Ontology: Mol. function=nucleotide binding; Cellular component =intracellular; Biological process=small GTPase mediated signal transduction
  Homolog annotation: Hit_ID=Q9LYJ3; Match level="QueryCoverage=75%, HitCoverage=56%, E-value=9e-57, Identity=99%"; Hit description=ADP -ribosylation factor-like protein
  Pfam annotation: Domain name=Arf; Domain location=1-104; Score=146.0; E_value=1e-40; Accession=PF00025.11; Description=ADP-ribosylation factor family
IRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKSFIYSVRCSYLVPVNYEWLLANTFHFPHISPPGF

SEQ ID NO: 199942 - protein, 245 aa, Glycine max
  Coding DNA Sequence Number=SeqID_83164
  Gene Ontology: Mol. function=nucleoside-triphosphatase activity; Cellular component=membrane; Biological process=transport
  Homolog annotation: Hit_ID=Q9LZ98; Match level="QueryCoverage=99%, HitCoverage=76%, E-value=7e-93, Identity=70%"; Hit description=Non -intrinsic ABC protein 9
  Pfam annotation: Domain name=ABC_tran; Domain location=26-156; Score =7.1; E_value=4e-08; Accession=PF00005.17; Description=ABC transporter
MVRVLGRPAFHDTTLISSGHLCYLGGEWRQDVAFAGFEVPIQMDISAQKMIFGVPGIDPQRRDELIKVLDIDLSWRLHKVSDGQRRRVQICMGLLKPFKVLLLDEITVDLDVLARADLLRFLRKECDEMGATIIYATHIFDGLEDWPTNIVYVAHGKLQLAMPMDKRTVESWLRKERDEDRKKRKERKAAGLPEFGKQVVGSHVTGDPARAAVQVINNGWAAGRLNSTIAGEENFLLSSNRVLRQ

SEQ ID NO: 199943 - protein, 84 aa, Glycine max
  Coding DNA Sequence Number=SeqID_83165
MIIFETTDLQVLCYGSVRDVFGGEREADRIEPIAVFLLVMVRLAMVLLDEVATVVFLVGGVLVGHDDDRVAVSGEYKSSTHFGG

SEQ ID NO: 199944 - protein, 73 aa, Glycine max
  Coding DNA Sequence Number=SeqID_83166
MFLHIKWHQALNESPIGHNQSPKVTSEVVAIAEDINDMSFISAQSVEVTSHTTDKGHDGLLEEDENGAEQRIV

SEQ ID NO: 199945 - protein, 108 aa, Glycine max
  Coding DNA Sequence Number=SeqID_83167
MYCSFSLDTSSPSSPMNKFQHKEQNKPTQEVSNLFLTAHWSLFILYLHHHGRVGEVNRKGKGVFWKEGGECRLRFSFFDRFLEERTVWTDENGNGVAFGSLRPLFKPA

SEQ ID NO: 199946 - protein, 266 aa, Glycine max
  Coding DNA Sequence Number=SeqID_83168
  Homolog annotation: Hit_ID=O22227; Match level="QueryCoverage=62%, HitCoverage=56%, E-value=1e-24, Identity=39%"; Hit description =Expressed protein
  Pfam annotation: Domain name=DUF617; Domain location=75-243; Score =273.0; E_value=5.9e-79; Accession=PF04759.4; Description=Protein of unknown function, DUF617
MASGVTTVDCEKQVRSWRLLRSLMQLLIPTCNCATIIEDDQDLTTTTNETLRNTRSKYYNYYTPSSSSLMSSTTNITGTIFGYRRGKVSFCIQANANSNNPILLLELAVPTAILAKEMRGATLRIALESGRGDGDDDGKADTLLSTPLWTMYCNGRKVRYAVKRRPSNTDFEALRLMGSVVVGTGVMKCKELVSWKKLEEDDQLMYLRASFKRVRGSDNCESFHLIDPEGDIDQELSVFFFRPELEYNIPPSCVGHGAQIPMNQNE

SEQ ID NO: 199947 - protein, 942 aa, Glycine max
  Coding DNA Sequence Number=SeqID_83169
  Gene Ontology: Mol. function=hydrolase activity, acting on acid anhydrides, catalyzing transmembrane movement of substances; Cellular component=integral to membrane; Biological process =magnesium ion transport
  Homolog annotation: Hit_ID=Q818V1; Match level="QueryCoverage=90%, HitCoverage=93%, E-value=1e-160, Identity=36%"; Hit description =Mg(2+) transport ATPase, P-type
  Pfam annotation: Domain name=Cation_ATPase_N; Domain location=68-139; Score=3.9; E_value=0.0015; Accession=PF00690.16; Description=Cation transporterATPase, N-terminus
  Pfam annotation: Domain name=E1-E2_ATPase; Domain location=145-390; Score=145.5; E_value=1.4e-40; Accession=PF00122.10; Description=E1 -E2 ATPase
  Pfam annotation: Domain name=Hydrolase; Domain location=394-705; Score=38.0; E_value=3.3e-08; Accession=PF00702.16; Description =haloacid dehalogenase-like hydrolase
  Pfam module annotation: Pfam domain module=Cation_ATPase_N::E1-E2 _ATPase::Hydrolase; Domain location=68-139::145-390::394-705
  Subcellular localization annotation: CTP_CleavageSite=24; ConfidenceScore=5.17e-01
MYILSYFSTIALLFLFHYYFNAPMGRTKVSTLFANSHNNNYMPPYSNTIRQTLEKLMGTQKLRKRRKSTLGYTPWLSLTKTWSSSLSFTEADRRLRENGPNVPLEYSFPRWWHLLWNALFHPFIITLIVLSALSFITCDSPNGFIMLILVIISVTLRFYQEYSSSKAAMKLSEFVKCPIKVQRCAGRVVQKELVVQVDQRDVVPGDIVIFEPGDLFPGDIRLLSSKQLVVSQASLTGESWTTDKTAEIREDHSTPLLDLKNICFMLLTSQGTSVVSGTGTGLVISTGSNTYMSTMFSKVGKKKPPDEFEKGLRRIFYLLISVILVVVTIMFVINYITSLNLSQSVLFAISVASALNPQMLPLIINTCLAKGALAMAKDRCIVKSLTSIRDMGSMDILCIDKTGTLTINHAIMVNHLDCRGLPQEKVLRYAFFNSYFKSDQKYPLDDAILAFVYSNGFRFQPSKWRKIDEIPFDFIRRRVSIILETEDKHSQFFGRFLVTKGALLEVLRVCSFIENFDKDEISPFSSDDYQRILNLSEDLSNEGLRVIAVAIRKLKMPQKCETSNGSKREEEDIERDMMFLGLITFFDPPKDSAKQALRRLSEKGVKAKVLTGDSLSLTTRVCREVGISTTHVITGPELEQLDQDTFHETVQRATVLARLTPIQKQRVVQSLQTIENHVVGFLGDGVNDSLALDAANVSISVDSGVAIAKDMADIILLEKDLNVLVAGVEHGRISFGNTMKYVKMSVIANLGSVISLLIATLLFKYELLTSRQLLTQNFIYSVGQIAIAWDKMDEEYVKTPHKSSERGLSMFILWNAPVCTLCDVATLLLLRFYYKAYTDVTRKFFHSAWFVEGLLLQTLIIHLIRTEKNPFIQDVASWPVIFSTVVTSAIGIALPFTLIGKILGFSVIPISYFGFLVLLFLGYFAVGQVVKRLYILVYKRWL

SEQ ID NO: 199948 - protein, 474 aa, Glycine max
  Coding DNA Sequence Number=SeqID_83170
  Gene Ontology: Mol. function=3,4-dihydroxy-2-butanone-4-phosphate synthase activity; Cellular component=chloroplast; Biological process=riboflavin biosynthetic process
  Homolog annotation: Hit_ID=P47924; Match level="QueryCoverage=97%, HitCoverage=86%, E-value=1e-178, Identity=69%"; Hit description =Riboflavin biosynthesis protein ribAB, chloroplast precursor [Includes: GTP ...
  Homolog annotation: Hit description=cyclohydrolase-2 (EC 3.5.4.25) (GTP cyclohydrolase II); 3,4-dihydroxy-2-butanone 4-phosphate synthase (DHBP synthase)]
  Pfam annotation: Domain name=DHBP_synthase; Domain location=106-303; Score=415.5; E_value=7.3e-122; Accession=PF00926.10; Description=3,4- dihydroxy-2-butanone 4-phosphate synthase
  Pfam annotation: Domain name=GTP_cyclohydro2; Domain location=308 -470; Score=213.8; E_value=3.8e-61; Accession=PF00925.11; Description= GTP cyclohydrolase II
  Pfam module annotation: Pfam domain module=DHBP_synthase::GTP _cyclohydro2; Domain location=106-303::308-470
MSLSATIRFQPCDLMITSSSLLMEFDKVRAVISGEGDILSHPNNYNSPRQDVLIDKLAEEPIRIRQQLDTFSFGTVADEISPTINGFFADRNEYDLDCPTQGFSSIPEAIEDIRQGKLVIVVDDEDRENEGDLIMAASMVTPTAITFIVEYGTGIVCVSMKEDDLERLQLPLMVTLKDNGEQLGTAFTMTVDAKQGTTTGVSAQDRATTILKLASRNSRPDDFNRPGHIFPLKYREGGVLKRPGHTEASVDLAVLAGLEPAAVLCEIVDDDGSMARLPKLRQMAKQENLKIISIADLIRYRRKREKLVECASAALIPTLWGHFKAYCYQSFLDGIEHIAMVKGEIGDGQDVLVRVHSECLIGDIFGATCQCKNQLKLALKQIEAAGRGVLVYLRGNEGRGIGLSHMVRASPLEDDKYEELQLPVDSREYGIGAQILRDLGVHTIRLMTKYPAEYDGLKGYGLTVAGEVPLLTPD

SEQ ID NO: 199949 - protein, 158 aa, Glycine max
  Coding DNA Sequence Number=SeqID_83171
  Homolog annotation: Hit_ID=Q8H3G8; Match level="QueryCoverage=83%, HitCoverage=15%, E-value=9e-13, Identity=34%"; Hit description =Myosin heavy chain-like protein
MFLHIKWHQALNESPIGHNQSPKVTSEVVAIAEDINDMSFISAQSVEVTSHTTDKGHDGLLEEDENGAEQRIEYVRKSICSVCECWEKAENEVTSLKNQVQTLTLRNSILEDRVTHLDSALKECVRQLRQTRVQLMNGQPKRKQTTKVELEVLPTPCN

SEQ ID NO: 199950 - protein, 55 aa, Glycine max
  Coding DNA Sequence Number=SeqID_83172
MDSIVQRVCDVERLKGSERLWRREIERFREVVVTKGWGYFVWIEKCRKVMAQYRG

SEQ ID NO: 199951 - protein, 1092 aa, Glycine max
  Coding DNA Sequence Number=SeqID_83173
  Gene Ontology: Mol. function=binding; Cellular component=nucleus; Biological process=metabolic process
  Homolog annotation: Hit_ID=Q2QTL4; Match level="QueryCoverage=58%, HitCoverage=85%, E-value=1e-112, Identity=31%"; Hit description =Pentatricopeptide, putative, expressed
  Pfam annotation: Domain name=DUF846; Domain location=48-173; Score =184.4; E_value=2.8e-52; Accession=PF05832.3; Description=Eukaryotic protein of unknown function (DUF846)
  Pfam annotation: Domain name=PPR; Domain location=364-398; Score =11.8; E_value=0.3; Accession=PF01535.11; Description=PPR repeat
  Pfam annotation: Domain name=PPR; Domain location=426-460; Score =35.0; E_value=2.6e-07; Accession=PF01535.11; Description=PPR repeat
  Pfam annotation: Domain name=PPR; Domain location=488-522; Score =39.1; E_value=1.6e-08; Accession=PF01535.11; Description=PPR repeat
  Pfam annotation: Domain name=PPR; Domain location=550-584; Score =27.4; E_value=5e-05; Accession=PF01535.11; Description=PPR repeat
  Pfam annotation: Domain name=PPR; Domain location=656-690; Score =24.0; E_value=0.00052; Accession=PF01535.11; Description=PPR repeat
  Pfam annotation: Domain name=PPR; Domain location=718-752; Score =30.8; E_value=4.7e-06; Accession=PF01535.11; Description=PPR repeat
  Pfam annotation: Domain name=PPR; Domain location=819-853; Score =43.0; E_value=1e-09; Accession=PF01535.11; Description=PPR repeat
  Pfam annotation: Domain name=PPR; Domain location=854-888; Score=5.4; E_value=1.7; Accession=PF01535.11; Description=PPR repeat
  Pfam annotation: Domain name=PPR; Domain location=890-924; Score =10.0; E_value=0.48; Accession=PF01535.11; Description=PPR repeat
  Pfam module annotation: Pfam domain module=DUF846::PPR::PPR::PPR::PPR: :PPR::PPR::PPR::PPR::PPR; Domain location=48-173::364-398::426 -460::488-522::550-584::656-690::718-752::819-853::854-888::890-924
EGVNAILLTSTCALGTNFGLKIVALQSIRSCSHVSDYLQASSALMDPNQPVGENYANPRTCFFHVLFKAAALAFYILSALFIDNFVIIFVVTVLLAALDFWVVKNVSGRILVGLRWWNEINDLGESVWKFECLDHESLARMNKKDSWLFWWTLYLTRMLDKQLSGHRMDRSICAWFWEQAISPGDSFKPSAGKERREGKRSLKTRSVIGLMITASHNKVSDNGVKIADPSGGMLSQHWESFADALANAPSPQHLLLGSRWVGTGKSKCFWGETRDQVEMLCFKQLNRHEQGFKLQSIFPRILKSSFRNVYRINHSRPRKSPFPFPKRTECDESLLLHYLSNGWLNDARNLLQNSSGGDLHLRVVRWTSLLSNFSRHGFVAEARTLFDIMPHRNLVSYNSMLSVYLRSGMLDEASRFFDTMPERNVVSWTAMLGGFSDAGRIEDAKKVFDEMPERNVVSWNAMVVALVRNGDLEEARIVFEETPYKNVVSWNAMIAGYVERGRMNEARELFEKMEFRNVVTWTSMISGYCREGNLEGAYCLFRAMPEKNVVSWTAMIGGFAWNGFYEEALLLFLEMLRVSDAKPNGETFVSLVYACGGLGFSCIGKQLHAQLIVNSWGIDDYDGRLRRGLVRMYSGFGLMDSAHNVLEGNLKDCDDQCFNSMINGYVQAGQLESAQELFDMVPVRNKVASTCMIAGYLSAGQVLKAWNLFNDMPDRDSIAWTEMIYGYVQNELIAEAFCLFVEMMAHGVSPMSSTYAVLFGAMGSVAYLDQGRQLHGMQLKTVYVYDLILENSLIAMYTKCGEIDDAYRIFSNMTYRDKISWNTMIMGLSDHGMANKALKVYETMLEFGIYPDGLTFLGVLTACAHAGLVDKGWELFLAMVNAYAIQPGLEHYVSIINLLGRAGKVKEAEEFVLRLPVEPNHAIWGALIGVCGFSKTNADVARRAAKRLFELEPLNAPGHVALCNIYAANDRHIEDTSLRKEMRMKDKGMKASEQDYFEQLSSSFRCLVDLIPAEKCKFDGVNNKVVVDAANGVGGVKLKYLGKLLNGLIIEVRNSSEDGGVLNDGVGADYVQKEKVLPNSFGSKDTGIRLVC

SEQ ID NO: 199952 - protein, 95 aa, Glycine max
  Coding DNA Sequence Number=SeqID_83174
MKKVLLARKFGRKRSPRLEERRGTRQEWGPFSNEVETGCDVGPHHELVAYHLVATFGGGPTLANQVTHPLTNVFLQKAQCFIIITIDNYQCDSQK

SEQ ID NO: 199953 - protein, 296 aa, Glycine max
  Coding DNA Sequence Number=SeqID_83175
  Gene Ontology: Mol. function=intramolecular transferase activity, phosphotransferases; Cellular component=cellular_component; Biological process=carbohydrate metabolic process
  Homolog annotation: Hit_ID=Q1SGB6; Match level="QueryCoverage=95%, HitCoverage=49%, E-value=1e-128, Identity=83%"; Hit description =Phosphoglucosamine mutase
  Pfam annotation: Domain name=PGM_PMM_IV; Domain location=220-292; Score=25.2; E_value=2.2e-05; Accession=PF00408.10; Description =Phosphoglucomutasephosphomannomutase, C-
MELVLVCRCVSLDGDADRLVYFIVPPESSGRIDLVDGDKILSLFALFIREQLSFLNEKEDMKNCHQAHLGVVQTAYANGASTNYLKLLGLEVNFTPTGVKYLHEKATEFDIGIYFEANGHGTVLFSESFIESLEARTNEISLGSKGSEGEKAALRLLAVSKLINQAVGDALSGLLLVEVILQHMGWSINKWNELYHDLPSKQLKVKVADRTAIVTTNAETVVVSPPGLKEAINEETAWYSSSAFTAKYPQGRCFVRPSGTEDVVRVYAEASTPEAADTLANCVAKLVDQFLGFNSS

SEQ ID NO: 199954 - protein, 78 aa, Glycine max
  Coding DNA Sequence Number=SeqID_83176
MVIFHLGDAAEDKGKEDCIKLSELNASRCSSGACLARWSRLVQFQTREGFGLSGYDPLGPINMRVQTERELRLAHWCA

SEQ ID NO: 199955 - protein, 399 aa, Glycine max
  Coding DNA Sequence Number=SeqID_83177
  Gene Ontology: Mol. function=RNA-directed DNA polymerase activity; Biological process=RNA-dependent DNA replication
MRPEVQAHNITYPYSLIQLIQGKLFHGLPNEDPYAHLATYFEICNTVKIVNVPKDAIRLSLFSFSLSREAKRWLHSFKGNSLKTWDEFLDESLSEALERFRSLLRKTPTHGFSEPIQLNIFIDGLRSQSKQLLDASAGGKIKLKTPEKAMELIENMAANALLAQNKLLAKQLEILAETLSKLPNQLQVIQPSHLVVLQVVAYEEELMSLGFQQGSNFNQNQGQWRSHPGNQFNKDQSGPSNRPQNQGHSLYERTTKLEETLAQFMQVTMSNHKSTKSAIKNLEIQVGQLAKQITENSSGSFGANTEKNPKEECKAIMTRGKKAIMVENEGRGSEEQELVAENDKEKEGDQLREIEINDEKEEEKNEKKGERKTKSELARERKKEVVPCSRKSTISFGIV

SEQ ID NO: 199956 - protein, 139 aa, Glycine max
  Coding DNA Sequence Number=SeqID_83178
  Gene Ontology: Mol. function=gamma-glutamyl hydrolase activity; Biological process=glutamine metabolic process
  Homolog annotation: Hit_ID=P93164; Match level="QueryCoverage=97%, HitCoverage=39%, E-value=3e-53, Identity=78%"; Hit description=Gamma- glutamyl hydrolase precursor
  Pfam annotation: Domain name=Peptidase_C26; Domain location=54-138; Score=-101.0; E_value=0.01; Accession=PF07722.3; Description =Peptidase C26
MPNDSVLSLFFFVTLFTCLLSATSHDDHIFLPSQLHDDDSVSCTATDPSLNYKPVIGILTHPGDGASGRLSNATGVSYIAASYVKFVESGGARVIPLIYNESPENLNKKLDLVNGVLFTGGKKIKIKKEDMVQGIFAFL

SEQ ID NO: 199957 - protein, 712 aa, Glycine max
  Coding DNA Sequence Number=SeqID_83179
  Gene Ontology: Mol. function=hydrolase activity, acting on glycosyl bonds; Cellular component=membrane; Biological process=metabolic process
  Homolog annotation: Hit_ID=Q9ZR47; Match level="QueryCoverage=99%, HitCoverage=99%, E-value=0.0, Identity=60%"; Hit description=Neutral invertase
  Pfam annotation: Domain name=Invertase_neut; Domain location=160-690; Score=1188.2; E_value=0; Accession=PF04853.3; Description=Plant neutral invertase
MNIITLIRNRAMNSARRILIGSRNSSFSGSTPAKSDHTLSIANNSLKPRFYHDHSNHHLFQIHRTKGIAQKFFGLPSSNFAPSPMHFSFSTFNSDVSTFKVRNFSNSVETRINDNNFERIYVQGGMNNVKPLVVEGVHKDDESVAGEKNLGGDVNASVGKSKGEDSEVEKEAWKLLQGAVVTYCGNPVGTMAANDPGDKLPLNYDQVFIRDFIPSALAFLLRGESEIVKNFLLHTLQLQSWEKTVDCYSPGQGLMPASFKVRTVALDEDNHEEVLDPDFGESAIGRVAPVDSGLWWIILLRAYGKLTGDCSLQERADVQTGLKMILNLCLTDGFDMFPSLLVTDGSCMIDRRMGIHGHPLEIQALFYSALRCSREMLVATDGTKNLIRAINNRLSALSFHIREYYWVDMKKMNEIYRYKTEEYSMDAINKFNIYPEQIPLWLMDWIPEEGGYLIGNLQPAHMDFRFFSLGNLWSIVSSLGTPRQNHAILNLIEAKWDDLVGHMPLKICYPALDNEEWRIVTGCDPKNTPWSYHNGGSWPTLLWQVSSDILLAIHFVLCLTTSTIEPLILVALIVGNKTQGGVLTRPPIETHSAENWKLKPYTPEFTLACIKMGRIELAQKAVALAEKRLPVDSWPEYYDTRTGKFIGKQARMYQTWTIAGFLTSKMLLKNPEMASMLFWEEDYELLDICVCGLSKSGRKRCSRGAARSQIRV

SEQ ID NO: 199958 - protein, 144 aa, Glycine max
  Coding DNA Sequence Number=SeqID_83180
  Gene Ontology: Mol. function=nucleic acid binding; Cellular component= nucleus; Biological process=DNA integration
MSAMDMFKSLSIQTDATIKHDVSDKDILCHGRILSALADNIYKIFCHTKTSVELWEALELKYGSAEKGLSHYSCEKMIEFQMIDGKSISDQIHEFENIVYDMKLKGIVLPDIMLVAFMISKLPPSWTDFALFCLKMILKLMVRP

SEQ ID NO: 199959 - protein, 516 aa, Glycine max
  Coding DNA Sequence Number=SeqID_83181
  Gene Ontology: Mol. function=DNA-directed DNA polymerase activity; Cellular component=delta DNA polymerase complex; Biological process =DNA synthesis during DNA repair
  Homolog annotation: Hit_ID=Q15054; Match level="QueryCoverage=82%, HitCoverage=77%, E-value=2e-10, Identity=23%"; Hit description=DNA polymerase subunit delta 3
MAQTQTLSFIHEIDFLISHKLQVISYKWLSRNYMVSSDEAKRLLQEFVQKHEGGLEVVYALSGWLKSNHPSYHVRLVTGPKLEDGNRSNMKLLPTFYAEAQQEFDGDCSVQIYSVQASIPKDPAVLWNAEFIQAEELFKQPSSVDNCLRDNSLLVRFSGVFNSFVRWNVDGPTVVSAAPQSKSLGEGPTKSNIVHQPSKNIACDSIDKVDTKPQSVVKEVKSESNGIGNTVVHDNINTPTADKEKAPPLPTGQKKVQADKSGSVNGGSLASLWGRASAKPRPCSSSAENNNKISNPPDVSLRRSSNRKRRVVFDFSDEDEDEDDVVSLASPDFPNKQSSLDSTPNDKKTSEKTTLNFDSQEENKSTVKEERATDQKARLPLRENVSAISKCTNTGKSSSEKLQSGAPEVHLSKHSVNNPPPCSPKRRKVMKTRIDERGREVTEVVWEGEETEEKKPDKVTTKKSDSNASTKAIDSAPATKKPPANSNAISGKGGKKKAGNSKDPKQGNILSFFKRV

SEQ ID NO: 199960 - protein, 145 aa, Glycine max
  Coding DNA Sequence Number=SeqID_83182
  Subcellular localization annotation: CTP_CleavageSite=59; ConfidenceScore=5.11e-01
MERQNKQADHKSQLRSSKTNFQSLCEKTQIWYSSLPRSKSAISGRVGAVANCWGRAGVRLGMVVGGGSGPEMVVGARDSLACPHVVLVRGGGVSAEVALEVIGLRRREEQRWLRASGLGIRTIAKESMASEGDLRERCGGDWWLR

SEQ ID NO: 199961 - protein, 958 aa, Glycine max
  Coding DNA Sequence Number=SeqID_83183
  Gene Ontology: Mol. function=protein serine/threonine kinase activity; Cellular component=integral to membrane; Biological process=protein amino acid phosphorylation
  Homolog annotation: Hit_ID=Q9SD62; Match level="QueryCoverage=98%, HitCoverage=95%, E-value=0.0, Identity=42%"; Hit description =Receptor protein kinase-like protein
  Pfam annotation: Domain name=LRRNT_2; Domain location=4-44; Score =44.9; E_value=2.7e-10; Accession=PF08263.3; Description=Leucine rich repeat N-terminal domain
  Pfam annotation: Domain name=LRR_1; Domain location=121-143; Score =15.1; E_value=0.26; Accession=PF00560.23; Description=Leucine Rich Repeat
  Pfam annotation: Domain name=LRR_1; Domain location=145-167; Score =12.2; E_value=1.5; Accession=PF00560.23; Description=Leucine Rich Repeat
  Pfam annotation: Domain name=LRR_1; Domain location=169-191; Score =9.2; E_value=5.4; Accession=PF00560.23; Description=Leucine Rich Repeat
  Pfam annotation: Domain name=LRR_1; Domain location=193-215; Score =1.4; E_value=1.5e+02; Accession=PF00560.23; Description=Leucine Rich Repeat
  Pfam annotation: Domain name=LRR_1; Domain location=217-240; Score =8.3; E_value=8; Accession=PF00560.23; Description=Leucine Rich Repeat
  Pfam annotation: Domain name=LRR_1; Domain location=242-264; Score =8.5; E_value=7.3; Accession=PF00560.23; Description=Leucine Rich Repeat
  Pfam annotation: Domain name=LRR_1; Domain location=266-287; Score =6.4; E_value=18; Accession=PF00560.23; Description=Leucine Rich Repeat
  Pfam annotation: Domain name=LRR_1; Domain location=289-315; Score =7.5; E_value=11; Accession=PF00560.23; Description=Leucine Rich Repeat
  Pfam annotation: Domain name=LRR_1; Domain location=320-342; Score =12.1; E_value=1.6; Accession=PF00560.23; Description=Leucine Rich Repeat
  Pfam annotation: Domain name=LRR_1; Domain location=345-367; Score =13.3; E_value=0.9; Accession=PF00560.23; Description=Leucine Rich Repeat
  Pfam annotation: Domain name=LRR_1; Domain location=369-391; Score =9.5; E_value=4.8; Accession=PF00560.23; Description=Leucine Rich Repeat
  Pfam annotation: Domain name=LRR_1; Domain location=393-415; Score =13.1; E_value=1; Accession=PF00560.23; Description=Leucine Rich Repeat
  Pfam annotation: Domain name=LRR_1; Domain location=417-439; Score =7.2; E_value=13; Accession=PF00560.23; Description=Leucine Rich Repeat
  Pfam annotation: Domain name=LRR_1; Domain location=441-464; Score =11.0; E_value=2.5; Accession=PF00560.23; Description=Leucine Rich Repeat
  Pfam annotation: Domain name=LRR_1; Domain location=466-488; Score =6.3; E_value=19; Accession=PF00560.23; Description=Leucine Rich Repeat
  Pfam annotation: Domain name=LRR_1; Domain location=49-71; Score=1.0; E_value=1.8e+02; Accession=PF00560.23; Description=Leucine Rich Repeat
  Pfam annotation: Domain name=LRR_1; Domain location=490-512; Score =14.3; E_value=0.44; Accession=PF00560.23; Description=Leucine Rich Repeat
  Pfam annotation: Domain name=LRR_1; Domain location=514-536; Score =10.8; E_value=2.8; Accession=PF00560.23; Description=Leucine Rich Repeat
  Pfam annotation: Domain name=LRR_1; Domain location=538-560; Score =17.3; E_value=0.054; Accession=PF00560.23; Description=Leucine Rich Repeat
  Pfam annotation: Domain name=LRR_1; Domain location=585-609; Score =2.6; E_value=93; Accession=PF00560.23; Description=Leucine Rich Repeat
  Pfam annotation: Domain name=LRR_1; Domain location=73-95; Score =13.9; E_value=0.59; Accession=PF00560.23; Description=Leucine Rich Repeat
  Pfam annotation: Domain name=LRR_1; Domain location=97-119; Score =16.1; E_value=0.13; Accession=PF00560.23; Description=Leucine Rich Repeat
  Pfam annotation: Domain name=Pkinase; Domain location=679-942; Score =97.3; E_value=4.5e-26; Accession=PF00069.15; Description=Protein kinase domain
  Pfam annotation: Domain name=Pkinase_Tyr; Domain location=679-942; Score=62.1; E_value=2.8e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=4-44::121-143::145-167::169-191::193-215::217-240::242 -264::266-287::289-315::320-342::345-367::369-391::393-415::417 -439::441-464::466-488::49-71::...
  Pfam module annotation: Domain location=490-512::514-536::538 -560::585-609::73-95::97-119::679-942::679-942
MLGNETDHLALLKFKESISSDPYGIMKSWNSSIHFCKWHGISCYPMHQRVVELNLHGYQLYGPILPQLGNLSFLRILKLENNSFNGKIPRELGHLSRLEVLYLTNNSLVGEIPSNLTSCSELKDLDLSGNNLIGKIPIEIGSLQKLQYFYVAKNNLTGEVPPSIGNLSSLIELSVGLNNLEGKIPQEVCSLKNLSLMSVPVNKLSGTLPTCLYNLSSLTLFSVPGNQFSGSLSPNMFHTLPNLQGISIGGNLFSGPIPISITNATVPQVLSFSGNSFTGQVPNLGKLKDLRWLGLSENNLGEGNSTKDLEFLRSLTNCSKLQMLSISYNYFGGSLPNSVGNLSIQLSQLYLGSNLISGKIPIELGNLISLALLNMAYNYFEGTIPTVFGKFQKMQALILSGNKLVGDIPASIGNLTQLFHLRLAQNMLGGSIPRTIGNCQKLQLLTLGKNNLAGTIPSEVFSLSSLTNLLDLSQNSLSGSLPNVVSKLKNLEKMDVSENHLSGDIPGSIGDCTSLEYLYLQGNSFHGIIPTTMASLKGLRRLDMSRNHLSGSIPKGLQNISFLAYFNASFNMLDGEVPTEGVFQNASELAVTGNNKLCGGIPQLHLPSCPINAEEPTKHHNFRLIGVIVGVLAFLLILLFILTFYCMRKRNKKPTLDSPVTDQVPKVSYQNLHNGTDGFAGRNLIGSGNFGSVYKGTLESEDEVVAIKVLNLQKKGAHKSFIAECIALKNIRHRNLIKILTCCSSTDYKGQEFKALIFEYMKNGSLESWLHSSIDIEYQGRSLDLEQRFNIITDVASAVHYLHYECEQTILHCDLKPSNVLLDDCMVAHVSDFGLARLLSSIGISLLQSSTIGIKGTIGYAPPEYGMGSEVSIEGDMYSFGILIVDPTILPSELERTAGSEKLGPVHPNAEKCLLSLFRIALACSVESPKERMSMVDVLRELNLIKSFSPFEVRGRLS

SEQ ID NO: 199962 - protein, 351 aa, Glycine max
  Coding DNA Sequence Number=SeqID_83184
  Gene Ontology: Mol. function=RNA binding
  Homolog annotation: Hit_ID=UPI0000162D1C; Match level="QueryCoverage =82%, HitCoverage=43%, E-value=7e-24, Identity=30%"; Hit description =RNA binding
  Pfam annotation: Domain name=Agenet; Domain location=187-252; Score =85.8; E_value=1.3e-22; Accession=PF05641.3; Description=Agenet domain
  Pfam annotation: Domain name=Agenet; Domain location=22-89; Score =85.5; E_value=1.7e-22; Accession=PF05641.3; Description=Agenet domain
  Pfam module annotation: Pfam domain module=Agenet::Agenet; Domain location=187-252::22-89
  Subcellular localization annotation: CTP_CleavageSite=29; ConfidenceScore=5.21e-01
MARTPKPKGGPSAAASAATAFFKPGTAVEVSSEDDGFRGSWFTGTVIRRLASERFLVEYDNLLADDKTTKKLREVLGLRHLRPLPPTETDREFKFGDEVDAFHNDGWWEGHITQELENERFAVYFRVSKEQLVFSKEQLRLHREWLNHDWVPPLQQKQQRQQGNGESKKVLLTPNVKSVETVKGKGIGVGAIVEVSSDEDGFSGAWFAATVVEALGKDKFLVEYHDLLADDDSQLREEIDALHIRPHPLDTDVDGQFSILDEVDAFYNDGWWVGVISKALADSRYVVYFRSSNEELEFENSQLRLHQDWIGGKWVMPCKVEFKALNWALLRCSIVEQPQVATGGCHGSGLV

SEQ ID NO: 199963 - protein, 145 aa, Glycine max
  Coding DNA Sequence Number=SeqID_83185
  Gene Ontology: Mol. function=binding; Cellular component =intracellular; Biological process=protein amino acid phosphorylation
  Homolog annotation: Hit_ID=Q1SZI6; Match level="QueryCoverage=78%, HitCoverage=43%, E-value=2e-19, Identity=35%"; Hit description =Tetratricopeptide-like helical
  Pfam annotation: Domain name=PPR; Domain location=89-123; Score=45.4; E_value=1.9e-10; Accession=PF01535.11; Description=PPR repeat
IGFQRVSMHIFTNGVRRFSPDCFSFTSAVGACANLAVLYCGQQLHGVIVRSGLDNYLEISNALIYMYAKCGNIADSRKIFSKMPCTNLVSWTSMINGYGDHGYGKDAVELFNEMIRSGIMIRILQGGSFDTGYEGLDDATSGEGR

SEQ ID NO: 199964 - protein, 183 aa, Glycine max
  Coding DNA Sequence Number=SeqID_83186
  Gene Ontology: Mol. function=binding; Cellular component =intracellular; Biological process=metabolic process
  Homolog annotation: Hit_ID=Q67UW7; Match level="QueryCoverage=95%, HitCoverage=19%, E-value=9e-36, Identity=42%"; Hit description =Putative pentatricopeptide (PPR) repeat-containing protein
  Pfam annotation: Domain name=PPR; Domain location=1-35; Score=11.2; E_ value=0.35; Accession=PF01535.11; Description=PPR repeat
  Pfam annotation: Domain name=PPR; Domain location=37-71; Score=8.2; E_ value=0.8; Accession=PF01535.11; Description=PPR repeat
  Pfam module annotation: Pfam domain module=PPR::PPR; Domain location =1-35::37-71
MVFMAVLSACSHAGLVDEGLRYFRLMTSYYNITPDIEIYGCVVDLFGRAGRVKEAYQLIENMPFNPDESIWAALLGACKVHNQPSVAKFAALRALDMKPISAGTYALISNIYAAEGNWDDFASSTKLRRGIKNKSDSGRSWIELKDQICSFVVGDRFVSSNEQVCEVLKLLMVHMKDADMDLI

SEQ ID NO: 199965 - protein, 1075 aa, Glycine max
  Coding DNA Sequence Number=SeqID_83187
  Homolog annotation: Hit_ID=Q2QNJ1; Match level="QueryCoverage=34%, HitCoverage=76%, E-value=1e-109, Identity=51%"; Hit description =Metallopeptidase family M24 containing protein, expressed
  Pfam annotation: Domain name=AMP_N; Domain location=563-689; Score =132.3; E_value=1.3e-36; Accession=PF05195.6; Description =Aminopeptidase P, N-terminal domain
  Pfam annotation: Domain name=Abhydrolase_2; Domain location=306-531; Score=-64.3; E_value=0.0049; Accession=PF02230.7; Description =PhospholipaseCarboxylesterase
  Pfam annotation: Domain name=FSH1; Domain location=291-539; Score= -4.7; E_value=4.5e-07; Accession=PF03959.4; Description=Serine hydrolase (FSH1)
  Pfam annotation: Domain name=Peptidase_M24; Domain location=752-926; Score=26.0; E_value=1.4e-09; Accession=PF00557.14; Description =metallopeptidase family M24
  Pfam annotation: Domain name=Rhodanese; Domain location=138-239; Score=9.4; E_value=0.018; Accession=PF00581.10; Description =Rhodanese-like domain
  Pfam module annotation: Pfam domain module=AMP_N::Abhydrolase _2::FSH1::Peptidase_M24::Rhodanese; Domain location=563-689::306 -531::291-539::752-926::138-239
MSEEMYGVLLYYKYAEIPNLDDLLTFYHSNCSSLSLLGRVRLSSRGVNVTVGGNLSSLEIHIEALKAYNSLFHDTDFKLANCHQPLNDKVAQECGFTSLSIRIVDELVTLSSHPLLKSPDISNAGKHLSALDFHSSLHNTNRESPENDLVLLDARNLYETRIGKFHVPNIETLDPQVRQYSDLSSWIDDNGERLKGKNILMYCTGGIRCEMASAYIRSKGAGFENVFQLFGGIQRYLEQFPDGGFFKGKNFVFDHRISVGSSDANVIGTCLICQCSFDDYSSRCRCAYCRMLVLVCGSCQNASSFKGRTASLAKKLKKMAEFVFINAPHELPFIYQIPVSELNVNCASSLPPSPPPPLENCKKKFAWFLAPNFDGSSGVDWKVADGPFDALQYQQQTDGYDISVSHLKNVFSQQGPFDGILGFSQGAAMAALISAQQEKLKGEMDFKFVVLCSGFALRMKEMECGPIKCPSLHIFGNEHGKDRQIANQASKELVSLYDSDCSGIVEHDCGHIIPTRSPYIDGIKDFLGRFRSYCTDKVVVDIGQPTSASHPQLLKDGDLTPGISTEEYILRRKKLLDLLPEKSLAIIAAAPVKMMTDVVPYTFRQDADYLYITGCQQPGGVAVLGHDCGLCMFMPEAKPNDVIWQGQIAGVDAALDAFKADKAYPMKKLQEVNHQLEADVITALQSKKSIFISLILPDMIRGSSKLFHNVETATPAYMELEAFKTLAYCNNVRDLTVYTHQLRWIKSPAELKLMKESASIACQALLLTMLHSKTYPFEGMLAAKVEYECKIRGAQRMGFNPVVGGGPNGSVIHYSRNDQRIKHGDLVLMDVGCELHGYASDLTRTWPPCGSFSSAQKGLKELGILRDVGSSSYHKLNPTSIGHYLGMDIHDCSMVSNDCPLKPGVPTKARRDDGDQRDARMRCVTHLWCFELAAHVHDMTIFDDGDGVTLAGDALGVVRVNFTLQGPPWCHVRRFLVGCKRGRCDDLRKGGQKNLNRRRSTAGRLSESGSHTGKGIVCECHAPECGGGRGRSWRVHVTVHAKGTLAKRGKQKQSGTKTVWCVTAAAAVARKVIGK

SEQ ID NO: 199966 - protein, 195 aa, Glycine max
  Coding DNA Sequence Number=SeqID_83188
  Homolog annotation: Hit_ID=Q9LH69; Match level="QueryCoverage=73%, HitCoverage=29%, E-value=5e-49, Identity=68%"; Hit description =Arabidopsis thaliana genomic DNA, chromosome 3, BAC clone: T21E2
  Pfam annotation: Domain name=NHL; Domain location=165-192; Score =36.3; E_value=1.1e-07; Accession=PF01436.11; Description=NHL repeat
MWNGIARAQSLKKVIDGGGQGGPRQREKVKGGLAGAVDCGVEAGMTAMEDSHGLSMKAQKMIGPLIKHISSLIKWTRSTSKTPHSDGNVLQFENGYVVETVVEGNEIGVVPYRIRVSEEDGELFAVDAINSNIVRITPPLSQCMVARPLEGYTGHVDGKPSDARFNHPKGITVDDKGNVYVADTQNLAIRKIGDA

SEQ ID NO: 199967 - protein, 32 aa, Glycine max
  Coding DNA Sequence Number=SeqID_83189
MWVGGPTSYSIKCTEGSLGCMWLYTLELRRVG

SEQ ID NO: 199968 - protein, 300 aa, Glycine max
  Coding DNA Sequence Number=SeqID_83190
  Pfam annotation: Domain name=ARID; Domain location=4-94; Score=-21.5; E_value=0.02; Accession=PF01388.11; Description=ARIDBRIGHT DNA binding domain
  Pfam annotation: Domain name=HMG_box; Domain location=163-228; Score=- 2.5; E_value=0.021; Accession=PF00505.9; Description=HMG (high mobility group) box
  Pfam module annotation: Pfam domain module=ARID::HMG_box; Domain location=4-94::163-228
MTAEKGDAKCGSFNVRETLLDLYLLYLEVTRRGGYHQVGREKKWGEVVFAMKLEANSVKLCAQVEKLYAHLLYQFEKLYFYRHPAKQAGSISTKGPLQKKRNSTASLSHTMNIKDGQMVTEMSKDYSCHMTDSNLAGAGYVEQPVFLPPPSNVKEMKKRRGSPPGRKTAYQIFLKHECARLKTCSQALDGRKILRLAIDTWRNMSDIEKQPYVEESKKNKEAMNGHNKQQSTQDTIKEEKWHSLSGDYLVTSQPETDNSLVNKAAAGLVLKMTEKAPTDPSYLMEWDAYCSLVLPTRESE

SEQ ID NO: 199969 - protein, 144 aa, Glycine max
  Coding DNA Sequence Number=SeqID_83191
  Gene Ontology: Mol. function=RNA-directed DNA polymerase activity; Biological process=RNA-dependent DNA replication
MHGGLEVRSTREANTTMLGKHIWTILKDTTKPRVQVVNAKYLHGESILRSRQFPGASCTWMSLMEAAESLEPGFKFRVGQGALSICYDRWSSRAIVCNQLGDVDIHIQDGASEDQQMVIVHVRPASLKSKVLADALGVFFTRSS

SEQ ID NO: 199970 - protein, 73 aa, Glycine max
  Coding DNA Sequence Number=SeqID_83192
MKWQTRIETLIRTCKRREANRGTQTGVQEEEYVDLGIREKEKEAAMEGEFYRRSTIWGRKFAIGKCRAYLVYR

SEQ ID NO: 199971 - protein, 413 aa, Glycine max
  Coding DNA Sequence Number=SeqID_83193
  Gene Ontology: Mol. function=acyl-CoA binding; Cellular component =membrane; Biological process=lipid transport
  Homolog annotation: Hit_ID=Q94D04; Match level="QueryCoverage=78%, HitCoverage=53%, E-value=1e-136, Identity=68%"; Hit description =Putative p40
  Pfam annotation: Domain name=Kelch_1; Domain location=128-175; Score =9.5; E_value=0.32; Accession=PF01344.15; Description=Kelch motif
  Pfam annotation: Domain name=Kelch_1; Domain location=180-225; Score =27.5; E_value=4.9e-05; Accession=PF01344.15; Description=Kelch motif
  Pfam annotation: Domain name=Kelch_1; Domain location=226-269; Score =12.9; E_value=0.13; Accession=PF01344.15; Description=Kelch motif
  Pfam annotation: Domain name=Kelch_1; Domain location=27-72; Score =39.4; E_value=1.2e-08; Accession=PF01344.15; Description=Kelch motif
  Pfam annotation: Domain name=Kelch_1; Domain location=77-122; Score =28.0; E_value=3.3e-05; Accession=PF01344.15; Description=Kelch motif
  Pfam annotation: Domain name=Kelch_2; Domain location=127-174; Score =32.1; E_value=1.9e-06; Accession=PF07646.5; Description=Kelch motif
  Pfam annotation: Domain name=Kelch_2; Domain location=180-225; Score =22.1; E_value=0.0021; Accession=PF07646.5; Description=Kelch motif
  Pfam annotation: Domain name=Kelch_2; Domain location=27-72; Score =28.4; E_value=2.6e-05; Accession=PF07646.5; Description=Kelch motif
  Pfam annotation: Domain name=Kelch_2; Domain location=77-122; Score =34.5; E_value=3.7e-07; Accession=PF07646.5; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2; Domain location=128-175::180-225::226-269::27-72::77-122::127-174::180 -225::27-72::77-122
MGSLVAETAMKKPMWLYPKVLGFNPSERWGHSACFSGGLMYVFGGCCGGLHFGDVLCLDLEKMNWSKLATTGEKPGPRDSHSAVLVGHKMIVFGGTNGLKKVNDTHILDLVTKEWICPKCEGTPPSPRESHTATLVGDERLVIFGGSGEGDANYLNDLHVLDLRTMRWTSPVVKGDLPVPRDSHSTLATGNKLIVYGGDCGDQYQGDVNVLDMDTMTWSRLKIQGSSPGVRAGHAAVYIIGGVGDKRYYNDIWVFDICTCSWTQLDIRGQQPQGRFSHTAVVADMDVAIYGGCGEDERPLNELLVLQLGAEHPNGRYNISMCKVFGTCWNHEKRTIHGGADTNSTTPRNGNNNMEVLGTSQQKRRRMAVAKVWDVDSEQEEHSLSLSQHSSPSQSDQEQTPGQKANFPVMDSQ

SEQ ID NO: 199972 - protein, 183 aa, Glycine max
  Coding DNA Sequence Number=SeqID_83194
  Homolog annotation: Hit_ID=P49208; Match level="QueryCoverage=35%, HitCoverage=31%, E-value=4e-24, Identity=89%"; Hit description=50S ribosomal protein L1, chloroplast precursor
  Pfam annotation: Domain name=Ribosomal_L1; Domain location=52-180; Score=-102.3; E_value=0.0085; Accession=PF00687.11; Description =Ribosomal protein L1pL10e family
WPKEAWILGQDVSVGFTPTIIFAILVPALPLKPLKRDRTSSKRSLEIQQLRERKKEYDLKTAISLVKETAKTKFGETVEAHFRLNIDPKYNDQQLRATDICVIQICHHEQVRTTTGFEEDISVIQICHHEQVREEDICVIQICHHEQVKTTTGFEELGANAILAVSLAVSRAGATILKVPLYK

SEQ ID NO: 199973 - protein, 58 aa, Glycine max
  Coding DNA Sequence Number=SeqID_83195
MATARWELKHPVYGIVILRLGIYTNRPNVSKMTFLNEKFYAIPEFQQTLLTTTKQVLT

SEQ ID NO: 199974 - protein, 141 aa, Glycine max
  Coding DNA Sequence Number=SeqID_83196
MARTRGIGRAIGRLVGRDRLDDQDAADVPERRRPTALAHRQRVHQMTADARDMTDDVPDVAAEAPEMRADVEGADRAEGSDADDATKRFPGGPRDPSVLTSFADHVAHAVWSGQERPDLKLVSHGRKLTLIGRPVPEIEGL

SEQ ID NO: 199975 - protein, 161 aa, Glycine max
  Coding DNA Sequence Number=SeqID_83197
MDTRLRVIGDPMNGVQRYTKMKFDGAVPFLIPMTRYIINCGNIKVEVGFPTVIFLTVIFCCCKMPIYISFLFSRNDRLRALVSFCQKFISFFSYTKLNFCESKSIGVHKVRGSFRCTRSEPTGCRILGEERNQNFLPVQWGRFLSKDSVYALQPRLFNSFP

SEQ ID NO: 199976 - protein, 63 aa, Glycine max
  Coding DNA Sequence Number=SeqID_83198
MALAEGVKEAIWLKVIVKQVNKELKLCFQIEHAQQLASGTRSRFGKQRVVASMQVTYELCVGK

SEQ ID NO: 199977 - protein, 506 aa, Glycine max
  Coding DNA Sequence Number=SeqID_83199
  Gene Ontology: Mol. function=RNA-directed DNA polymerase activity; Biological process=RNA-dependent DNA replication
MVQEFVRLEDKDQNCAGKEKKARRVGKEHVKSKTIRDLIAKEREEWGEIGNWCVHGEDKVMREFNHFIDSMELVEPLLVSRSFTWIRLNDSNKSHIDRALVSMEWYMAEERKLQGVYGGGLEEDGDSRLKGYILKEKLKGLKGCIKSWSKEKSCLYKIVTKVLASRLRKVLVGVIDSAFLTGRHLLYSVLVANKVVDEARRLKRKCLVFKVDFEKAGDSINWRLSGLVREAKRFDLFKGYFVGKDKVEVNLLRYAYDTLFVGETSLENVITIKTILRCFEVVSSLKFHWWLLISWLISKGISFWGCKEGRWKIVWVNGGRFYGRKDHFGVMEGGVGGGRNFSFWKYGWLDGVSIANKFGRLFLVSDQQDKMIGDMGRWVDGVWLWEFRWQETTIWVGRIFGLVGTIIFKEESFASQKILDDMFWSWSSMKNCYVGGQGKTQMQNARTMEIRTMRKAITTQHYSKWTYSSQLNGFLRIFLGHVATAKSSMATALSSLTPCGSTLSSR

SEQ ID NO: 199978 - protein, 168 aa, Glycine max
  Coding DNA Sequence Number=SeqID_83200
  Gene Ontology: Mol. function=hydrolase activity
  Homolog annotation: Hit_ID=Q7Y049; Match level="QueryCoverage=80%, HitCoverage=31%, E-value=2e-30, Identity=45%"; Hit description=LAF3 isoform 1
MVGAFSQNIVTLTGLPMILLSESDLTNPLCEPPGVLIDSARTLVASKIPEDSVDDRREALLRASNLALTRGVTMILDMGRYYRGFSTELSWDDFSGCDNKVSHALSEWIYIGGVKAFSDGSLGSNSALLYELPAGCLTGDSFQVAIHAIGDKANDLILDMFKSSRNFA

SEQ ID NO: 199979 - protein, 61 aa, Glycine max
  Coding DNA Sequence Number=SeqID_83201
MDEAIDSKDNSGYQWWIHTYVTGCTLMFRMKKKENKECGLKNHSSGIGVIHKVVFLDKPIP

SEQ ID NO: 199980 - protein, 606 aa, Glycine max
  Coding DNA Sequence Number=SeqID_83202
  Gene Ontology: Mol. function=RNA-directed DNA polymerase activity; Cellular component=chromatin; Biological process=chromatin assembly or disassembly
MAFMVSEYDERVAQVILSPAFHSGGNGVQFADLGAELLAEISDWMAPLHQHGSHAETRGIGLNNEGDTEKLGEWFRDLGIMVDESPVGPSQAQEPAQLLGRGWYWPLRQSCDFGGMEFTLLQSLKDAIQVFEMSPEVATINQDIIEEDQHKFANEWMELIHRRLEHGRCVTEAKWHHDGRRAPPCEFDGNLEQGPSSRTKMSCPNHQEAPTPKRSTGCDWDELAAARAYLPPAIQSPVSGSKGSGGLCGLLARVVGARSWELGLSLEKGRDSVRVDQVSDLAMVYFEWAKIDVVVNSNGLAVMFEGHCEGKSATLNRNGDIATNLIALDLCVIVDHDCQSRDRLGTQMEEVSQSVVDKVMGATTVHENDDVMGMDSAHYAKGGRSWCLNSAWRLSWAGLWSVGGGGGEMGLESARCSCSTSHACGGMPSQPGGGGVVSGARWRWVEEYGKGQNLAAYFRNETRNKTTKEERGHHGGRRRGIERNRARGPEGTRTRKVVGRCGRATGTSSGQPRQGRRKPPGGAPPQGFIQGGEGRGEWVGEEALRDWKRCAGFGLEGEQGKTQMQNARTMEIHTMRKASTTRRIRLGLVATTMSSMTAALSEFHGD

SEQ ID NO: 199981 - protein, 564 aa, Glycine max
  Coding DNA Sequence Number=SeqID_83203
  Gene Ontology: Mol. function=RNA-directed DNA polymerase activity; Cellular component=chromatin; Biological process=chromatin assembly or disassembly
  Pfam annotation: Domain name=Chromo; Domain location=482-532; Score =26.6; E_value=8.6e-05; Accession=PF00385.14; Description='chromo' (CHRromatin Organisation MOdifier
  Pfam module annotation: Pfam domain module=Chromo::RVT_1; Domain location=482-532::12-174
MLEADIIQPSHNPFSSPILLVKKKDGTWHYCVDYQALNAVTIKDHFPMPTIDELLDDLGQASWFSKLDLRQGFHQIRMVEDDIHKTTFRTHQGHYEFWVMSLGLCNAPSTFQAAMNDTLRPFLRKYVAVFFDDILVYSVDLDSHMQLNYLGHIILSQGTAPNPDKVATMIAWPIPTSPTALRGFLGLKGFYHKFIKGYSAIASPLTCLLRKEKLCWSPEAQQAFHHLQQAMVQAPVLVNPNFLLPFTIEMDASGSSMDAVLLQDDHPIAYYSKDIQVRPDAHFDLVIHQDLILRHGHIWIPFPTPFTIILLEKFHSSHLGGHTGDDVRWYVAQCSTCQQTKYEIKKVDDHFSKGAHFGALPTHHTAYKVVVLFLDIRELFRLSGTKLCMSTAYHLQIDGQMKVLNQTLEQYLCAYVHHQPSSEWSYNTTIHAGTGISPFKAIYGKSPLTIAQYLQGNSSIDGPLPSSPITLPHANSNNHPLVTPLTILDWKLDNSISPPLKQVLVQWEGLAPEEVSWESWDELRHIHNLEDKVVFEEGGVDSNSAYTNTGHITEANSYNGKPMR

SEQ ID NO: 199982 - protein, 334 aa, Glycine max
  Coding DNA Sequence Number=SeqID_83204
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9M1I3; Match level="QueryCoverage=66%, HitCoverage=20%, E-value=1e-85, Identity=68%"; Hit description=Beta Galactosidase-like protein
  Pfam annotation: Domain name=Glyco_hydro_2; Domain location=112-243; Score=34.7; E_value=2.7e-07; Accession=PF00703.11; Description =Glycosyl hydrolases family 2, immunoglobulin-like beta-sandwich domain
  Subcellular localization annotation: CTP_CleavageSite=13; ConfidenceScore=5.06e-01
MSWTIAPPAVRRRSSRRGGPPGRRRKVGRGGDFLALAELFQLGGLLLGGLFADLGLRRCCGGGGVLGIRRRHRFGVGVWVLREVFFSGLCIVDLVAWSSDLFASGSARDGRVFITDYFFKANLAEDFSYAEIMVEVKIDRLQETSKDNVLTNYTIEATLFDSGSWYTSDGNPDLLSSNLADIKLQPSSAPTQPLGFHGYVLTGELQSPKLWSAEKPYLYTLVVVLKDRSGRVVDCESCPVGFRKVSKAHKQLLVNGHAVVIRGVNRHEHHPQVGKANIESCMIKDLVKQNNINAVRNCHYPQHPRWYGLCDLFGMYMIDEANIETHYFDYSKHL

SEQ ID NO: 199983 - protein, 325 aa, Glycine max
  Coding DNA Sequence Number=SeqID_83205
  Homolog annotation: Hit_ID=Q9M1I3; Match level="QueryCoverage=43%, HitCoverage=13%, E-value=2e-55, Identity=68%"; Hit description=Beta Galactosidase-like protein
  Pfam annotation: Domain name=Bgal_small_N; Domain location=1-149; Score=-65.8; E_value=5.7e-07; Accession=PF02929.7; Description=Beta galactosidase small chain, N terminal domain
MTYTIYASGDVIIECNMKPNPDLPPLPRVGIELNVEKSLDQATWYGRGPFECYPDRKAAAQIAVYEHNVGELHVPYIVPGESSGRADVRWATFRNKNGFGIYASKYGSSPPMQMSASYYSTLEFDRATHNEELIEGDSIEVFITCFNISAYVSSRRDSHFLHPRGPPPLLQHPRCPPPLSLLPSLMRTNLTPPNSDLKKKGAWVSQLHGNHAPRWDDCGDDGEEVLERPQRLELGANPAYGAVENNTAPQHFTAAEKKRRKQGIKARTEILKGCAVIDDGVDVGDGTGGEANLGKVDGGELEEPTGLAGVAVYDNEGSDDGFMLM

SEQ ID NO: 199984 - protein, 244 aa, Glycine max
  Coding DNA Sequence Number=SeqID_83206
  Gene Ontology: Mol. function=RNA-directed DNA polymerase activity; Cellular component=chromatin; Biological process=chromatin assembly or disassembly
MGVSGGSEDGEGWADMVGVTVEGMYVAHHDVKSRGRGRRQGEKLGHMRLNEVVRAATVYQNSNLMVAQRSQKAKCLRCGAAFHGIQTNLREQQSFHLRRIWRVEGDRVRNGLHVNEKVQARHAAVTVRPLVVAVVTQPLVTMDCQLLRREAPDLDFRGIKMKRCCRFGRERGMRHGQDAGVAAAVQHLVLLESHEFGRLRQGNRSQSLNFPAEFRKQTRDKGSLRVVIEGGRETRLKCLKHRRP

SEQ ID NO: 199985 - protein, 76 aa, Glycine max
  Coding DNA Sequence Number=SeqID_83207
MNRESTLIWQDAKRMNTKCSIGRYNSSNCLSAFITIVPWWCKFYVGWESGFWKFRRQSDSRVSGDMKRVGIGKSKG

SEQ ID NO: 199986 - protein, 88 aa, Glycine max
  Coding DNA Sequence Number=SeqID_83208
  Gene Ontology: Mol. function=nucleic acid binding; Biological process= DNA integration
  Pfam annotation: Domain name=zf-CCHC; Domain location=33-50; Score =25.2; E_value=7e-05; Accession=PF00098.13; Description=Zinc knuckle
MKAEASNTLNKNRSKDAAEGSSQQNEQIEDEEFTCYFCKNSGHMRKECPKYIAWRGCLWSQMPNDDERFIFVGNDKRVAMEAIGTFRL

SEQ ID NO: 199987 - protein, 142 aa, Glycine max
  Coding DNA Sequence Number=SeqID_83209
  Homolog annotation: Hit_ID=Q1SWQ8; Match level="QueryCoverage=60%, HitCoverage=30%, E-value=1e-12, Identity=44%"; Hit description =Nucleic acid-binding, OB-fold; TonB box, N-terminal
MLLLAILCLACWLVVFRHVSSKNTRVVFRMKDLSGEILSCTLWEHYYAQFLSYLNERGDDGPMVVILTHARIKDAHGSYLASVTNSFKASKLLINDPILEIQEFKERFRCLGESSFATWRSSTLTSFRGKSAIIKGFVSFKD

SEQ ID NO: 199988 - protein, 169 aa, Glycine max
  Coding DNA Sequence Number=SeqID_83210
  Gene Ontology: Mol. function=nucleic acid binding; Biological process= DNA integration
  Homolog annotation: Hit_ID=Q1SEE1; Match level="QueryCoverage=68%, HitCoverage=16%, E-value=6e-19, Identity=67%"; Hit description =Integrase, catalytic region; Zinc finger, CCHC-type; Peptidase aspartic, catalytic
MAMVPYASAIGSWMYQMICMRLDIGHVVGVVSRFMSNPELGFTQEKSVLRNDSHSAIHLAKNSTFHSRTKHIGLRYHFIKTLIEDEVLTLREIQRSEKMKNKKVVVAGVSLSEACALCKNHPLSETSVHLASRENLSSICTLNASSAHSASRLSSLALSAPSGKSLTRT

SEQ ID NO: 199989 - protein, 927 aa, Glycine max
  Coding DNA Sequence Number=SeqID_83211
  Gene Ontology: Mol. function=DNA-directed RNA polymerase activity; Cellular component=nucleus; Biological process=transcription
  Homolog annotation: Hit_ID=Q1L5X4; Match level="QueryCoverage=99%, HitCoverage=47%, E-value=0.0, Identity=57%"; Hit description=RNA polymerase IV largest subunit
  Pfam annotation: Domain name=RNA_pol_Rpb1_1; Domain location=11-259; Score=-123.1; E_value=0.00013; Accession=PF04997.3; Description=RNA polymerase Rpb1, domain 1
  Pfam annotation: Domain name=RNA_pol_Rpb1_2; Domain location=293-446; Score=110.4; E_value=5.4e-30; Accession=PF00623.11; Description=RNA polymerase Rpb1, domain 2
  Pfam annotation: Domain name=RNA_pol_Rpb1_3; Domain location=449-595; Score=-0.9; E_value=2e-05; Accession=PF04983.8; Description=RNA polymerase Rpb1, domain 3
  Pfam annotation: Domain name=RNA_pol_Rpb1_4; Domain location=597-690; Score=0.2; E_value=0.0093; Accession=PF05000.7; Description=RNA polymerase Rpb1, domain 4
  Pfam module annotation: Pfam domain module=RNA_pol_Rpb1_1::RNA_pol _Rpb1_2::RNA_pol_Rpb1_3::RNA_pol_Rpb1_4; Domain location=11-259::293 -446::449-595::597-690
MEDNPPSSVLDGTVVGIKFGMATRQEICTASISDSSISHASQLSNPFLGLPLEFGRCESCGTSEVGKCEGHFGYIELPIPIYHPSHISDLKRMLSMVCLNCLKLRKTKLPASSSGLAQRLISPCCQEDKAALVSIREVKTSDGACYLALKAMEIIKRIPIETKKKLAGKGYFPQDGYVLKYLPVPPNCLSVPEVSDGVSVMSSDPSITILRKLLRKVEIIKSSRSGEPNFESHHVEANDLQSVVDQYFQIRGTSKPARDIETHFGVNKELTASSTKAWLEKMRTLFIRKGSGFSSRNVITGDCYKRINEVGIPVEVAQRITFEERVNIHNIRYLQKLVDEHLCLTYKEGGSTYSLREGSKGHIYLKPGQIVHRRIMDGDIVFINRPPTTHKHSLQALYVYIHEDHTVKINPLICGPLGADFDGDCVHLFYPQSLAAKAEVVELFSVENQLLSSHSGNLNLQLSTDSLLSLKMLVKRCFFDRAAANQLAMFILLPLPRPALLKASSGDACWTSIQILQCALPLGFDCTGGRYLIRQSEILEFEFSRDVLPATVNEIAASVFFGKGPKEALNFFDVLQPFLMESLFAEGFSVSLEEFSISRAIKRIIRKSIGKVSSLLYQLRSLYNELVAQQLEKHIRDVELPIINFALKSTKLGDLIDSKSKSAIDKVVQQIGFLGQQLFDRGRFYSKGLVDDVASHFHAKCCYDGDGYPSAEYGLLKGCFFNGLDPYEEMVHSISTREIMVRSSRGLSEPGTLFKNLMAILRDVVICYDGTVRNICSNSIIQFEYGIQAGDKSEHLFPAGEPVGVLAATAMSNPAYKAVLDASPSSNSSWELMKEILLCKVNFRNELVDRRVILYLNDCDCGGSYCRENAAYSVKDQLRKVSLKDAAVEFIIEYQQQRTQKENSETDVGLVGHIYLDEVIGFPFHSI

SEQ ID NO: 199990 - protein, 74 aa, Glycine max
  Coding DNA Sequence Number=SeqID_83212
MQRTCIKKEQATESVPKTRKGTKMPLHENGNAEERKRKIEAPRCAKPIETTKSERERGFRRGKTPGFWGAGFWG

SEQ ID NO: 199991 - protein, 187 aa, Glycine max
  Coding DNA Sequence Number=SeqID_83213
  Gene Ontology: Mol. function=binding; Cellular component=membrane; Biological process=photosynthesis
  Homolog annotation: Hit_ID=Q688Q3; Match level="QueryCoverage=86%, HitCoverage=43%, E-value=2e-38, Identity=46%"; Hit description =Unknow protein
  Pfam annotation: Domain name=TPR_1; Domain location=105-137; Score =8.1; E_value=0.57; Accession=PF00515.18; Description=Tetratricopeptid e repeat
  Pfam annotation: Domain name=TPR_1; Domain location=138-171; Score =26.5; E_value=9.4e-05; Accession=PF00515.18; Description =Tetratricopeptide repeat
  Pfam annotation: Domain name=TPR_1; Domain location=71-104; Score =28.2; E_value=3e-05; Accession=PF00515.18; Description =Tetratricopeptide repeat
  Pfam annotation: Domain name=TPR_2; Domain location=106-137; Score =3.3; E_value=14; Accession=PF07719.7; Description=Tetratricopeptide repeat
  Pfam annotation: Domain name=TPR_2; Domain location=138-171; Score =17.1; E_value=0.065; Accession=PF07719.7; Description=Tetratricopepti de repeat
  Pfam annotation: Domain name=TPR_2; Domain location=71-104; Score =24.0; E_value=0.00052; Accession=PF07719.7; Description =Tetratricopeptide repeat
  Pfam module annotation: Pfam domain module=TPR_1::TPR_1::TPR_1::TPR _2::TPR_2::TPR_2; Domain location=105-137::138-171::71-104::106 -137::138-171::71-104
MAAILARKSLLALRARQLASSSRITGSVGVEKASKGDTISFDNARNSPGQYDLSRINHLHSSFVPEDVPDAASEKDLGNEFFKQKKFKEARDCYSRSIALSPTAVAYANRAMANIKLRRQAYAEDDCTEALNLDDRYIKAYSRRATARKELGKIKESMDDAEFALRLEPNNQEIKKQYADAKSFYEK

SEQ ID NO: 199992 - protein, 46 aa, Glycine max
  Coding DNA Sequence Number=SeqID_83214
MVPSKEDDKEEEIGAGGALVAPRRGVPVVTAEVDEPLRFLDDSAIW

SEQ ID NO: 199993 - protein, 102 aa, Glycine max
  Coding DNA Sequence Number=SeqID_83215
  Subcellular localization annotation: CTP_CleavageSite=27; ConfidenceScore=5.13e-01
MGGVFKQPKTLKGVAFSTYPKSPTLPASSMGSQGIDVQVLERKRRHKQLGAGTNSDHERTPKKVQNRGLVRCVGGGRVWRRDHWRVSMPGKGLCTDVGFEDR

SEQ ID NO: 199994 - protein, 118 aa, Glycine max
  Coding DNA Sequence Number=SeqID_83216
MKETDHLLLEMLEIVAGHQNIRLNKIKRGITFIRIGKENGMMDKHKPEWWLETWYTELKHQQGKWHVRAHVEVSNNRASGDCQSRGSAVVCMRTGSGDHVAEGTGQTMKGSKWRKEVV

SEQ ID NO: 199995 - protein, 336 aa, Glycine max
  Coding DNA Sequence Number=SeqID_83217
  Gene Ontology: Mol. function=nucleic acid binding; Cellular component= spliceosome; Biological process=mRNA processing
  Homolog annotation: Hit_ID=Q9FKT4; Match level="QueryCoverage=48%, HitCoverage=51%, E-value=4e-73, Identity=84%"; Hit description=RNA -binding protein-like
  Subcellular localization annotation: CTP_CleavageSite=32; ConfidenceScore=5.31e-01
MQRPSLLQSSSTQNWLSPQGSSSGIIVKKTVRVDIPVDAYPNFNFVGRLLGPRGNSLKRVEASTECRVLIRGRGSIKDPAREEMMRGKPGYEHLNEPLHILVEAELPVEIVDARLMQAREILEDLLKPVDESQDFYKKQQLRELAMLNGTLREEGSPMSGSVSPFHNSLGNAVNECPDLRSGHWHHSASSNLFYVQCVYIEFGGGLKMVARSKGPIEFGEFAFIVLVKAITFPTSSSPTPLHYLGRTVALPPPCHRHLPSLQPSLCRSTPTSFMAITLPSGLAQWHRRAKAREVTEVTATFFIVARGPFSPPSSSLQPCRGGPWPYGLRIHNDFTD

SEQ ID NO: 199996 - protein, 74 aa, Glycine max
  Coding DNA Sequence Number=SeqID_83218
MDQVEKDRQEKIRNVLEERRIKEITPSPEWHLSQPMTRLSTIRQIPYPLFNFIALGPNIIQIHPPNQKNWAIPN

SEQ ID NO: 199997 - protein, 255 aa, Glycine max
  Coding DNA Sequence Number=SeqID_83219
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=98%, HitCoverage=25%, E-value=6e-74, Identity=94%"; Hit description=DNA -directed RNA polymerase beta'' chain
MEVLMAERANLVFHNKVIGGTAIKRLISRLIDHFGMAYTSHILDQVKTLGFRQATDTSISLGIDDLLTIPSKGWLVQDAEQQSFILEQHHHYGNILLYEHQMLDIFTRRLVEVVQHIVVRRTDCGTIQGISVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQ

SEQ ID NO: 199998 - protein, 81 aa, Glycine max
  Coding DNA Sequence Number=SeqID_83220
MEEDLGGEGEALHRVSEGKCVNSSNQRQRITAKGTQNKTKMARESKLKTSVPMPLRFQTVSELATHINITTEILIVVRNFF

SEQ ID NO: 199999 - protein, 127 aa, Glycine max
  Coding DNA Sequence Number=SeqID_83221
  Gene Ontology: Mol. function=RNA polymerase II transcription factor activity; Cellular component=nucleus; Biological process=regulation of transcription factor activity
  Homolog annotation: Hit_ID=Q8LRG9; Match level="QueryCoverage=78%, HitCoverage=18%, E-value=1e-39, Identity=79%"; Hit description =Putative TAF6
MGGPELFLILQKKDIYDYGKRNCIKRKKDDNLPVDIKLPVKHVLSRELQLYFDKVAELTLSESESVLFKEALVSLATDSGLHPLVPYFTCFIADEVSRGLNNYPLLFALMRVVSSLLQNPHIHIEPY

SEQ ID NO: 200000 - protein, 802 aa, Glycine max
  Coding DNA Sequence Number=SeqID_83222
  Gene Ontology: Cellular component=nucleus; Biological process =regulation of progression through cell cycle
  Homolog annotation: Hit_ID=Q10MI0; Match level="QueryCoverage=99%, HitCoverage=80%, E-value=1e-174, Identity=44%"; Hit description =Cyclin, putative, expressed
MAEFSHIFVDFDEIVRATLDNYEWSRQNEEADVRAEAHHNWVDEVIRCEGRGGSVIGNDNRSSCLIIQPRPEIKGPSLLTREEIEKPQIWAQICIQRMVELAKESTTMRRVLDPMFVYFDSRQHWAPQKGLAMIILSRMAYFMENSGNQRLILASVIHHLDHKNVMNDPQLKTCVIQVATSLAMQIRSESGLAEIGFVGVLCRHLRKSLQASSEFGGEQELNLNISLQNSIDDCLLEIANGVIDAQPLFDLMAINLENILPGVVGRATIGSLIILARAVTLALSHLHSQQGFPEALLVQLLKVMLHSDVEARVGAHLIFSILLFPSSFHTNEISSLRSRYLGQHNKRHSHAPSVSASASITALLEKLRRNRNTKVENHGNIVHDQERDIVAEDWKQGCGLKNSPNFYKLTSIIDKATGSPSLTDTEPYVMKLTEDQMAQLLSAFWIQANLPDNLPSNIEAIAHSFILTLIVLRIKNLKDRDSLVIRFFQLPLSLWTMLLDQSNGILSPACQRSVYVLSAGMLAFACKIYQIPDLNDVFASLPMSNVDPFLSISDDYRVYAKIHVDVREYDTAADNQFACSVLSELQNKIRECQSIIRDAMVHNLANITELDAGELAMLLLEKFKPGEEFVFGPQSMLDQNQIIFHSQESLSFDGDFPSNSAGEDDTISEASVSDLSRFIPKMPLSPSAPHVISIGQLMESALEVAGQVAGTAISTSPLPYNTMASQCESLGTCARKKLSNWLAFENHYSQALDDKSFLAIADIRNSAPEKVTNGGGHAQLPRDPMKLPPASPFDNFLKAAGC

SEQ ID NO: 200001 - protein, 106 aa, Glycine max
  Coding DNA Sequence Number=SeqID_83223
  Homolog annotation: Hit_ID=Q10MI0; Match level="QueryCoverage=63%, HitCoverage=6%, E-value=2e-15, Identity=58%"; Hit description=Cyclin, putative, expressed
MPLSPSAPHVISIGQLMESALEVVGQVAGTAISTSPLSYNTMASQCESLGTCARKKLSNWLAFENHYSQAPDDKSFLAIADIRNSAPVKVALIASFNKPKSSRKVN

SEQ ID NO: 200002 - protein, 468 aa, Glycine max
  Coding DNA Sequence Number=SeqID_83224
  Gene Ontology: Mol. function=binding; Cellular component=membrane; Biological process=photosynthesis
  Homolog annotation: Hit_ID=Q688Q3; Match level="QueryCoverage=63%, HitCoverage=66%, E-value=4e-43, Identity=37%"; Hit description =Unknow protein
  Pfam annotation: Domain name=TPR_1; Domain location=83-116; Score =26.5; E_value=9.4e-05; Accession=PF00515.18; Description =Tetratricopeptide repeat
  Pfam annotation: Domain name=TPR_2; Domain location=83-116; Score =17.1; E_value=0.065; Accession=PF07719.7; Description=Tetratricopepti de repeat
  Pfam module annotation: Pfam domain module=TPR_1::TPR_2; Domain location=83-116::83-116
MSITIRKTHPYRAQDNPKMLIVTYEGEHRHVLPLTAAAGGPSSVQVAVVVFCSCFFPHLFCVTRFQEAEDDCTEALNLDDRYIKAYSRRATARKELGKIKESMDDAEFALRLEPNNQEIKKQYADAKSFYEKDILQKASGVLRSTVQGTQKVGKSEEKVNGDSIHPISRSTQKSGLAEVHHHKKDNKRQILVKESLLTEDVDGREIKARSWPQSQGDDGSKGGLSASNSLEQRNHRITKPEMKASVQQLASRAASRAMSEAAKNVTPPTTAYQFEVSWRTFSGDLALQARLLKAISPHELPKIFKNALSSTILIEIIKCLASLFTEDMDLVVSYLEHLTKGFPEALLVQLLKVMLHSDVEARIGAHLIFSILLFPSSFHTNEISSLRCRYLGQHNKRHSHAASVSASASITALLEKLCRNRNTKAENHGNIVHDQERDIVAEDWKQGCGLKNSPNFYKLTSIIDKATG

SEQ ID NO: 200003 - protein, 230 aa, Glycine max
  Coding DNA Sequence Number=SeqID_83225
  Gene Ontology: Mol. function=zinc ion binding; Cellular component =nucleus; Biological process=regulation of transcription
  Homolog annotation: Hit_ID=Q1T0F7; Match level="QueryCoverage=31%, HitCoverage=20%, E-value=4e-32, Identity=83%"; Hit description=Zinc finger, Dof-type
  Pfam annotation: Domain name=zf-Dof; Domain location=56-118; Score =134.1; E_value=3.8e-37; Accession=PF02701.6; Description=Dof domain, zinc finger
  Subcellular localization annotation: CTP_CleavageSite=27; ConfidenceScore=5.03e-01
QPNQLARIGTQNPQIPLPPQRPPPSSVAAAIGNGGYQGSIRPGSMADRARMAKIHQPDASLKCPRCESTNTKFCYYNNYSLSQPRHFCKTCRRYWTRGGALRSVPVGGGCRRNKRNKGNSARSKSPMKPSTGSTSASANSSSSGCTPDHVMMTHLPTPTPAHQFPFLASLHHYNSDYASGGIGSHLGAITTPLVARNGNTTSDVEFQIGTSSASSLGNSGGGAMLSNNGL

SEQ ID NO: 200004 - protein, 201 aa, Glycine max
  Coding DNA Sequence Number=SeqID_83226
  Gene Ontology: Mol. function=RNA-directed DNA polymerase activity; Cellular component=chromatin; Biological process=chromatin assembly or disassembly
  Homolog annotation: Hit_ID=Q7XBQ5; Match level="QueryCoverage=84%, HitCoverage=43%, E-value=2e-19, Identity=29%"; Hit description =Putative retroelement
MQLTNDVHKEQGGTMGSVLGRQCPKMDSLGEAELVKVVANQWGTWSRTLLADKHDIVKHIGAHPSISMNRKNYPINGEVFLRHPSGHPKGMNGTPRVEWALVVSKNNEMLTQEVMPPFSDYGENSTHEGPGRISFDSEKFVKQRSQGIGNRSIVLYKTSVESHNAYETTELCYGQWCKPSEHGTNFLQIGGGTGSGDYVSQ

SEQ ID NO: 200005 - protein, 647 aa, Glycine max
  Coding DNA Sequence Number=SeqID_83227
  Gene Ontology: Mol. function=nucleotide binding; Cellular component =chloroplast; Biological process=response to heat
  Homolog annotation: Hit_ID=P27322; Match level="QueryCoverage=95%, HitCoverage=95%, E-value=0.0, Identity=90%"; Hit description=Heat shock cognate 70 kDa protein 2
  Pfam annotation: Domain name=HSP70; Domain location=9-618; Score =1385.2; E_value=0; Accession=PF00012.10; Description=Hsp70 protein
  Pfam annotation: Domain name=MreB_Mbl; Domain location=7-388; Score= -261.1; E_value=0.077; Accession=PF06723.3; Description=MreBMbl protein
  Pfam module annotation: Pfam domain module=HSP70::MreB_Mbl; Domain location=9-618::7-388
MAGKGEGLAIGIDLGTTYSCVGVWQHDRVEIIANDQGNRTTPSYVAFTDTERLIGDAAKNQVAMNPINTVFDAKRLIGRRVSDPSVQSDMKLWPFKVTAGAGEKPMIGVNYKGEEKQFAAEEISSMVLTKMREIAEAYLGSTVKNAVVTVPAYFNDSQRQATKDAGVIAGLNVMRIINEPTAAAIAYGLDKKATSVGEKNVLIFDLGGGTFDVSLLTIEEGIFEVKATAGDTHLGGEDFDNRMVNHFVQEFKRKNKKDITGNPRALRRLRTSCERAKRTLSSTAQTTIEIDSLFEGIDFYSTITRARFEELNMDLFRKCMEPVEKCLRDAKMDKSSVHDVVLVGGSTRIPKVQQLLQDFFNGKDLCKSINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQEAEKYKSEDEEHKKKVEGKNALENYAYNMRNTIKDEKISSKLSSEDKTKIDNAIEQAIQWLDTNQLAEADEFEDKMKELEGICNPIIAKMYQGGAGTGGDVDDDAPPAGGSGAGPKIEEVD

SEQ ID NO: 200006 - protein, 625 aa, Glycine max
  Coding DNA Sequence Number=SeqID_83228
  Gene Ontology: Mol. function=RNA-directed DNA polymerase activity; Cellular component=chromatin; Biological process=chromatin assembly or disassembly
  Homolog annotation: Hit_ID=Q1S920; Match level="QueryCoverage=23%, HitCoverage=31%, E-value=2e-61, Identity=79%"; Hit description =Prenyltransferase and squalene oxidase repeat, putative
  Pfam annotation: Domain name=Prenyltrans; Domain location=508-547; Score=35.9; E_value=1.4e-07; Accession=PF00432.11; Description =Prenyltransferase and squalene oxidase re
  Pfam annotation: Domain name=Prenyltrans; Domain location=568-611; Score=46.8; E_value=7.4e-11; Accession=PF00432.11; Description =Prenyltransferase and squalene oxidase re
  Pfam annotation: Domain name=RVP_2; Domain location=280-411; Score= -40.0; E_value=0.0013; Accession=PF08284.2; Description=Retroviral aspartyl protease
  Pfam module annotation: Pfam domain module=Prenyltrans::Prenyltrans::R VP_2::Retrotrans_gag; Domain location=508-547::568-611::280-411::68 -158
  Subcellular localization annotation: CTP_CleavageSite=32; ConfidenceScore=5.30e-01
MTHLETSHSVPCTPPSSSSNHSPQSPSDTFPRLKLEVSRFDGSDPTGWIFKITQFFEYHSTPDQERLTIASFYMEGAALAWFQWMHRNGQLTSWPAFLHALHTRFSSSTYKDPTGLLCKLTQRSSVQEYLSEFESLANRILGLPAPFLLSCFISGLSPAIHREVQALQPYSLTQATQYPRPSPAPAPSADLNTLGHLRPLLPLDLALPLPFHPSFPSHQKHLRPQYPSNASPPQSLPFEEKRDCVLIAMRNSLAETNDEPFQDTGQPTLSPFPDDETPSDTSSAQISLHALSGHLAPETLRVNGFIGNRGVCILIDGGSTHNFLHQALVTSLGLSTTATTLRVTVGNGDELHCHQLCPAVTVIIQAQPFIVDFHVLPQCGAEVVLGVQWLKSLGPILTDYSTLTMKFIYGGKLIELSGARAQNLDHISPSQLRRLVQSDTTSSYFHIRLDPPSTSTSPNIPTTTTQQLYPVVSRIVTGGATYCAIASLRLMGFIGDNILSSCASSSLIDAPLLLDWILQRQGTDGGFQGRPNKSSDTCYAFCCQSLDKHHMFVRIGAVLRILGGCKFVDSKALRGFLLSCQYKYGGFGKFPGEYPDLYHSYYGVTAFSLLEESALKSLCSELGIH

SEQ ID NO: 200007 - protein, 67 aa, Glycine max
  Coding DNA Sequence Number=SeqID_83229
  Homolog annotation: Hit_ID=Q10NA7; Match level="QueryCoverage=100%, HitCoverage=25%, E-value=5e-16, Identity=56%"; Hit description =Expressed protein
MKRNKATVLTFAEKCKNILASNWQGSLNTIKADAKGSKGNIHTSKIKYIVRRGQPYLWVPENDLHNV

SEQ ID NO: 200008 - protein, 914 aa, Glycine max
  Coding DNA Sequence Number=SeqID_83230
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-56, Identity=30%"; Hit description= UPI00006A17C9 related cluster
  Subcellular localization annotation: CTP_CleavageSite=61; ConfidenceScore=5.57e-01
TIFPHIQRTIRPHIKRTTRPRLQRDTCPRLPRTTHPRLQRATCLRLQRTTRPCLQRATRTRLQMTTRPRLQRARCPGLQMTTRPRLHRAAHPRIQRTTRPHLQRTTDPRLQRATRPHHQSTTCPRLEDYTSSPLEGYMPSPSEDYTSSPSEGHTPSPSANTRAQLKRATRPHLERTTRLAFRWLHAPDIRGLHGCTPSHVLAFRGLHVLAVRGIHALAFRGLHILAMRGLHAFVFRGLKVLTFRGLHLLTLRGLDVLTFRGLRVLAFIGLHALAFRGLHVLIFRGLQVLAFRGLRALIIRSLYILTIRALHLLALMTTGLHVLALRGLHVLALRTISPHLQRDTRPQLQRTTRPRLEDYRGQHALAFRGLHVLPFRGLHVLSNRVLHVLTFKGLHNLTIRGLHVLAFRGLHAIAFRGLHVLAFRGLHALAFRGLHFLAFKGLHTLAFSGLHVLTFRGLHVLTFRGLHILATTCPHLQRATHSHLQRTTGPRPEDYRLLHALAFKGLHALTIKGLHALSFRGLQALTFRGLQALTFRGLQVLSFRGLHVLAFRGLHVLTFSRLHALKFRGLHLLRIRGQQVLTFRELQALVFRGLHVLPFRGLQVLAFRGQHVLTFRVLHVLTFRRLHARNLSGLHLLAIRGQQWTTRLPFRGLHVLPFKGLHALPVLTFRGLHVLTFRGLHVPAFIGLHGLSFGGLRVLTFRGLHALTLRRLHVLTFRGLNSPCLKRTTGLLVLAYRGLDAHAFRGLHALAFRGLHVLALRGLHVLSFRGLHVLASRGLHALARPHLQRTTRLDALVFRGLHAVTFRGLHVLTFRGLHVLAFRGLDTLAFRGLHALAFRGLHVLTLRELHILTFRGLRALTLRGLYILTFSRLHALSFRGLHILAFRGLHALTFRGLHVLTFRGLHVLTINGLH

SEQ ID NO: 200009 - protein, 106 aa, Glycine max
  Coding DNA Sequence Number=SeqID_83231
  Homolog annotation: Hit_ID=Q10MJ2; Match level="QueryCoverage=80%, HitCoverage=33%, E-value=2e-07, Identity=59%"; Hit description =Expressed protein
MVVLSQKGSLEALVLCLVLMLEDSLGSKGLVELAILLEVIWAVGLVTAETEVREKSERSESSFFGETPVYDGSEGSSVYESPLDEESYAYKSTERQSYETYEDSEL

SEQ ID NO: 200010 - protein, 977 aa, Glycine max
  Coding DNA Sequence Number=SeqID_83232
  Gene Ontology: Mol. function=protein binding; Biological process =primary shoot apical meristem specification
  Homolog annotation: Hit_ID=Q1S365; Match level="QueryCoverage=87%, HitCoverage=76%, E-value=0.0, Identity=69%"; Hit description =Lissencephaly type-1-like homology motif; CTLH, C-terminal to LisH motif; WD40-like; ...
  Homolog annotation: Hit description=Quinonprotein alcohol dehydrogenase-like
  Pfam annotation: Domain name=LisH; Domain location=101-127; Score =19.0; E_value=0.008; Accession=PF08513.1; Description=LisH
  Pfam annotation: Domain name=WD40; Domain location=403-441; Score =10.7; E_value=2; Accession=PF00400.22; Description=WD domain, G-beta repeat
  Pfam annotation: Domain name=WD40; Domain location=464-502; Score =7.1; E_value=5.3; Accession=PF00400.22; Description=WD domain, G -beta repeat
  Pfam annotation: Domain name=WD40; Domain location=509-549; Score =29.4; E_value=1.3e-05; Accession=PF00400.22; Description=WD domain, G-beta repeat
  Pfam annotation: Domain name=WD40; Domain location=553-593; Score =26.6; E_value=8.9e-05; Accession=PF00400.22; Description=WD domain, G-beta repeat
  Pfam annotation: Domain name=WD40; Domain location=643-682; Score =5.0; E_value=9.5; Accession=PF00400.22; Description=WD domain, G -beta repeat
  Pfam annotation: Domain name=WD40; Domain location=904-941; Score =11.8; E_value=1.5; Accession=PF00400.22; Description=WD domain, G -beta repeat
  Pfam module annotation: Pfam domain module=LisH::WD40::WD40::WD40::WD4 0::WD40::WD40; Domain location=101-127::403-441::464-502::509 -549::553-593::643-682::904-941
MLPVVENTASPPENKFKSRTLDKPIAYHRPHKHKSSNTRKARERERKWSEKNTETLLRHSRSAPSLSIFARDSLAGIVDLFGSRSFRAGFVDGSVMSSLSRELVFLILQFLDEEKFKETVHKLEQESGFFFNMRYFEDMVTNGEWDEVEKYLSGFTKVDDNRYSMKIFFEIRKQKYLEALDKHNEQLSKYGDTKSARGIMLAELKKLIEANPLFRDKLQFPTLKNSRLRTLINQSLNWQHQLCKNPRPNPDIKTLFVDHSCGQPNGARAPSPVTNPLMGAVPKAGGFPPLGAHGPFQPTPAALPTSLAGWMANPSPVPHPSASAGPIGLAAANNAAILKRPRTPPTNNPAMDYQTADSDHVLKRTRPFGLSDEVSNLPVNLLPVAYSGQSHGQSSYSSDDLPKTIVMTLNQGSIVKSMDFHPLQQILLLVGTNMGDVMVWDIGSRERIAQRNFKVWELGSCSVALQASLSNDYSASVNRVVWSPDGTLCSVAYSKHIVHIYSYQGGDDLRNHLEIEAHAGSVNDLAFSYPNKQLCVVTCGEDRVIKVWDAVTGAKQYTFEGHEAPVYSVCPHHKESIQFIFSTATDGKIKAWLYDNMGSRVDYDAPGHSSTTMAYSADGTRLFSCGTNKEGESFLVEWNESEGAVKRTYHGLGKRSVGVVQFDTTKNRFLAAGDEFMIKFWDMDNTNMLTSVEADGGLLASPCIRFNKDGILLAVSTNDSGVKILANAEGIRLLRTVENRTFDASRVASAAVVKAPTIGAFPSTNVTVGTSLADRAPPVAAMVGINNDTRNLADVKPRIVDEAVEKSRIWKLTEINEPSQCRSLKLPDSLSSMRVLSDIKIVYIHNIFLVSRLIYTNQGVAILALAANAVHKLWKWQRNERNTTGKATASIQPQLWQPSSGILMTNDISDTNPEDAVSCFALSKNDSYVMSASGGKISLFNMMTFKKESMYWLFVSDSSIDEIISTVTVRRYLCIYW

SEQ ID NO: 200011 - protein, 189 aa, Glycine max
  Coding DNA Sequence Number=SeqID_83233
  Gene Ontology: Mol. function=zinc ion binding
MKNPKTWQDKYVHFETQGQSNEWSQSVKKYLGRRKLLGIEIGKKCVGGKVIGELDEDAIAIFESGTEGKGSLPDEEKVVETVEVGSTEGNEVVEGEVVGDGEDEEERRKRGLGWERGMGRGSEQVECASAFAEFRVVGLGLGLGLGLGLEDGLGIQRVVLFHRVDSEQEHASPGFSNSTVVFLFIGICV

SEQ ID NO: 200012 - protein, 783 aa, Glycine max
  Coding DNA Sequence Number=SeqID_83234
  Gene Ontology: Cellular component=integral to membrane
  Homolog annotation: Hit_ID=Q6YXY7; Match level="QueryCoverage=84%, HitCoverage=99%, E-value=0.0, Identity=62%"; Hit description =Putative WD repeat domain 11
  Pfam annotation: Domain name=WD40; Domain location=238-274; Score =1.8; E_value=22; Accession=PF00400.22; Description=WD domain, G-beta repeat
  Pfam annotation: Domain name=WD40; Domain location=277-321; Score =14.1; E_value=0.49; Accession=PF00400.22; Description=WD domain, G -beta repeat
  Pfam annotation: Domain name=WD40; Domain location=55-112; Score=2.3; E_value=20; Accession=PF00400.22; Description=WD domain, G-beta repeat
  Pfam module annotation: Pfam domain module=WD40::WD40::WD40; Domain location=238-274::277-321::55-112
  Subcellular localization annotation: CTP_CleavageSite=53; ConfidenceScore=5.40e-01
GQLQLLSSTVTMLAVPTPSLTATLARGGNYPAAAVPLVALGTQSGTIDVVDVSANAVASSLSVHNGIVRGLRWLGNSRLVSFSYTQANEKSGGYINKLVVTCLRSGLNKMFRVMQKPERAPIRALRTSSSGRYLLILFRDAPVEVWAMTKNPIMLRSLALPFTVLEWTLPTVPRPSKDQTSGASDEASKLSKTSSSDSKEGSSTEGSQDDTSESFAFALVNGALGVFEVHVSIVHRPKWPSSSFVSSDGLITAMAYRLPHVVMGDRIGNIRWWDVTTGHSSSFNTHREGIRRIKFSPFVPGDQSRGRIAVLFYDNTFSVFDLDSPDPLANSLLQPQFPGTLVLELDWLPLRTVKNDPLVLCIAGADSSFRLVEVNATTIEKRPHLIPGTPSSKGDLRTYMIDIPPLGDSVVPEMLLKVLEPYRKEGCMLDDERAKLYASIVDKGCAARFAFAAIIFGESSEALFWLQLPQALKHLLNKVLRKPPPKESTAAPISDVDDETSLLSRISSKGKPTEETGRDVLSQGQLRLMAFDREELWKSASERISWHEKLEGEEAIQKRIHELVSVGNLEAAVSLLLSTPPESSYFYVNALRAVALSSAVSRSLHELAVKVVAANMVRADRSLSGMHLLCAVGRYQEACSQLQDAGCWTDAATLAASHLKGSDYARVLQRWASHVLHTEHNIWRALILYVAAGALQEALAALREAQLPDTAAMFILACRETHAEVVSNLGILDEESSSSVKDELLNLRALDPNNEDVIAVNEYLGQYQRKLVHLCMDSQPFSE

SEQ ID NO: 200013 - protein, 738 aa, Glycine max
  Coding DNA Sequence Number=SeqID_83235
  Gene Ontology: Mol. function=RNA-directed DNA polymerase activity; Cellular component=mitochondrion; Biological process=RNA-dependent DNA replication
  Homolog annotation: Hit_ID=Q1S0N5; Match level="QueryCoverage=96%, HitCoverage=62%, E-value=0.0, Identity=84%"; Hit description =Peptidase S16, lon protease
  Pfam annotation: Domain name=AAA; Domain location=222-417; Score =170.3; E_value=4.7e-48; Accession=PF00004.19; Description=ATPase family associated with various cellular activities (AAA)
  Pfam annotation: Domain name=AAA_2; Domain location=220-360; Score= -44.9; E_value=0.024; Accession=PF07724.4; Description=ATPase family associated with various
  Pfam annotation: Domain name=AAA_3; Domain location=223-359; Score= -12.6; E_value=0.0077; Accession=PF07726.2; Description=ATPase family associated with various
  Pfam annotation: Domain name=AAA_5; Domain location=222-365; Score= -0.9; E_value=0.0021; Accession=PF07728.4; Description=ATPase family associated with various
  Pfam annotation: Domain name=Lon_C; Domain location=518-725; Score =359.4; E_value=6e-105; Accession=PF05362.3; Description=Lon protease (S16) C-terminal proteolytic domain
  Pfam module annotation: Pfam domain module=AAA::AAA_2::AAA_3::AAA _5::Lon_C; Domain location=222-417::220-360::223-359::222-365::518-725
MYWRALRLGVCYPSASYSFYRLKHIGDFTYPRLADFGAAISGANKLQCQQVLEELDVYKRLKLTLELVKKEMEISKIQESIAKAIEEKISGEQRRYLLNEQLKAIKKELGLETDDKTALTGKFRERIEPKREKCPPHILQVIDEELAKLQLLEASSSEFSVTRNYLDWLTALPWGEYSDENFDVTRAQKILDEDHYGLTDVKERILEFIAVGKLRGTSQGKIICLSGPPGVGKTSIGRSIARALNRKFFRFSVGGLADVAEIKGHRRTYIGAMPGRMVQCLKNVGTANPLVLTDEIDKLGRGHAGDPASALLELLDPEQNANFLDHYLDVTIDLSKVLFVCTANVVEMIPNPLLDRMEVVAIAGYITDEKMHIARDYLEKTTREACGIKPKQVEVTDAAILALIENYCREAGVRNLQKHIEKIYRKIALQLVRQGEMIDATVEPIKENIDSDEFGQNTVQNKNSELVEGSDPEKEGETSDKVDKVQTDLSSDESQCLEVAKESEEDKEIKTKTIEKVLVDESNLTDFVGKPVFHAERIYDQTPVGVVMGLAWTAMGGSTLYIETTLVEEGEGKGTLHPTGQLGDVMKESAQIAHTVARAILLEKEPENPFFANSKLHLHVPAGATPKDGPSAGCTMTTSLLSLAMKKPVKKDLAMTGEVTLTGKILPIGGVKEKTIAARRSEVKTIIFPSANRRDFDELAPNVKEGLDVHFVDDYMQIFNLALGDDQSQNIERVINVL

SEQ ID NO: 200014 - protein, 53 aa, Glycine max
  Coding DNA Sequence Number=SeqID_83236
MRKVKDNMCTRIRKLNEFMAGLNIKNMATSIEHPQANGQAKAANKVIIVKLKK

SEQ ID NO: 200015 - protein, 173 aa, Glycine max
  Coding DNA Sequence Number=SeqID_83237
  Gene Ontology: Mol. function=RNA-directed DNA polymerase activity; Cellular component=intracellular; Biological process=RNA-dependent DNA replication
MCIDYTNLNRACPKDAYPLLKIDRLVDGVAGYRMLSFLDEYLGYNQIKMDLEDDDKITFITESTNYCYKVMPFGLKNVKVTYQRLMDEDLKEVFGQLRKHNMRLNPKKCVFGVEGGNSQIRSPRNMKETQRLVGRIASLSRFLPRIIEKAKSTMNLRKKAKNFQWNDECEETF

SEQ ID NO: 200016 - protein, 207 aa, Glycine max
  Coding DNA Sequence Number=SeqID_83238
  Gene Ontology: Mol. function=nucleic acid binding; Cellular component= proton-transporting two-sector ATPase complex; Biological process=DNA integration
MENPTTTHLKAAKRTLRYIKGTTNFGLHYSTFDYYKLVGYSDSDWSGDVDDRKSTNGFVLYMGDTALTWMSKKQSIVTFSTCEVEYVAATILIALAKNPVYHDRSKHIDMRYHYIRECITRKDVHLKYMKTHDQVTDIFTKPLKKEDFIRLRSLIGVTKPSLRGGLGSSSSMDSFASWKMNGSGMEKEEREETPLQGEDESRRSSPP

SEQ ID NO: 200017 - protein, 481 aa, Glycine max
  Coding DNA Sequence Number=SeqID_83239
  Subcellular localization annotation: CTP_CleavageSite=83; ConfidenceScore=5.68e-01
MLPGPPSRNNFGSADLSPHGLMAFPSGSSISIVDTRSMQLLSSFPIPPPPSSAAPFVTALRWSPLPLSRHLLSSEPSSNHLLLAAADRQGRIALLDFRLKSALLWFDTDSKQGVQDLCWAQARPDSYLLAAINGPSTLSLYNASTGRCVWKYDASPEYFSCIRRDPFDSRRICAVGLRGFLLSIVLLGDSEDAVVIKELQIPTDSSELVKLERDGAGGSSATASAASPAAAAFPLYTAKFAFSQQWRHILFVTFPRELVVFDLQYETVVFNTALPRGCGKFLDVLPDPSNEWIYCAHLDGKLSTWRRKPGEQVHVMYSLEELMPSVGTSVPSPSILSVLLCQSDSILQNIGKNYSDVPSSPYLREDFENPFDFCYESNIVSKIHLISISDDGKMWNWLLTAEGQANTQKNDKKLDLVNNDHTVSHPGANSNTLVSSAGGRDLNAGRQRERFNDNRSRLQTSVFGQEEISMKGKWYILKETN

SEQ ID NO: 200018 - protein, 73 aa, Glycine max
  Coding DNA Sequence Number=SeqID_83240
MATAEREMSVEKAKRIGLSRKHITMFMKLMSVGSIIAFDNYSLTVVPNGGQPTTPLGETQMTNLAEEDEAPRG

SEQ ID NO: 200019 - protein, 70 aa, Glycine max
  Coding DNA Sequence Number=SeqID_83241
  Subcellular localization annotation: CTP_CleavageSite=62; ConfidenceScore=5.15e-01
MEEQAQGGLNKGCQKNSRHSLKFDTLVVITPSSRTFPMLLTTLSKSLFKKLEKLLDSPLPVEGESPSREE

SEQ ID NO: 200020 - protein, 118 aa, Glycine max
  Coding DNA Sequence Number=SeqID_83242
MAHSTGSDDSSCQGFSLTQQEISMASYEYNSSDNQFLYFSYLHDEDHHEYDDDEQTAYKRRAITDLGGYLPPPLGLKITMTPEMLQSTRTSQVAANNKVEKLKAVQFPMNMLKIGYFK

SEQ ID NO: 200021 - protein, 316 aa, Glycine max
  Coding DNA Sequence Number=SeqID_83243
MSTVNPLVTRIRQHIEKLAATTRQRGVKNHRLILQVKHHQLPRKRDEQNVPPLLGEGELRGIKWKGGSRGRRRGGGGRRSAGTVSLELNQFAGIGRNLKLLDDDGVLGVSEEDDRQEKAAEADGADAARIEGIAANAGEVFRRSVVFPNATSGGGVVERKSGRTVNRGEEVGIGAGLGPAEVLDALFGVGVEPEEGGLEAEIKERNAALAVSGSEEEVVGGGAVTKGAAEEGGGGMGKEESNCMERVSTMEMELPEGNAMRPIDSHDSCGCVVTVAAALGLASILHSDFDPVQGPKRVFLAFDRSLLISASYLLHK

SEQ ID NO: 200022 - protein, 51 aa, Glycine max
  Coding DNA Sequence Number=SeqID_83244
MVKGDFSAIATVSKKRKSKANDRRQEKHAWALALDRNRSEGCWRVREQQQQ

SEQ ID NO: 200023 - protein, 128 aa, Glycine max
  Coding DNA Sequence Number=SeqID_83245
  Gene Ontology: Mol. function=RNA-directed DNA polymerase activity; Biological process=RNA-dependent DNA replication
MSLRDRRRKFLGLMLTHRGIHTNLDKCQAILEMRSPRNMKEAQRLTCNPPVPSKPGTSKILIVYLSVSIEAISDIPVQEENNELRSVYFVSQMLQDQETQYQVMEKVAWALVTTAQRLQQYSQSHGIN

SEQ ID NO: 200024 - protein, 151 aa, Glycine max
  Coding DNA Sequence Number=SeqID_83246
MACPLVVVYMKCLVIFANCTSTIKLVCHCELMTWKDRFFAFYIRVELSRLGSGAPGGSEEDVWGLPLAGRWGGAMRKGCDMISAGGGDFAEEEDGEASLAMTASRRSRLVKEGSASAIEGQQVRPIDGSKGKDNKKETLNSRTRDLLTTQK

SEQ ID NO: 200025 - protein, 462 aa, Glycine max
  Coding DNA Sequence Number=SeqID_83247
  Homolog annotation: Hit_ID=Q66RN1; Match level="QueryCoverage=14%, HitCoverage=23%, E-value=8e-18, Identity=66%"; Hit description=MYB transcription factor
  Pfam annotation: Domain name=Myb_DNA-binding; Domain location=128 -174; Score=45.8; E_value=1.4e-10; Accession=PF00249.21; Description =Myb-like DNA-binding domain
MGENNNKFHCCGDDDGFDEPLYLKYPALQDLEWEGTLICLPPDLSSLSNNFTPKVLPLSMSPPSETTVTRVPPMLPPVEDATYVQPNLQDQLSALQNINANQVAPMWPGSQINHSLSRKGSSSKSNECRRWSEEEHRLFLHGLQKYGKGDWINISRIIKTRNPTQVASHAQKYFLRQASSNKGKRRNIHDMVLPDGPVPHRIYQQNGVSFRNLDGPITHHINHQNGRKQIKYLGSSLGYLNPSHTKKANTLSKADLGQCFEYHCNRGHSTEECIILKDKIEDFIKLGHLKDFIHKTQSYRLQNSYRQDKDKGRDRDCSHQSQTESERSRSRKGNDLGLKKATMLGILELELLHVTTHYSASPKKEWEPRDVYDYTIEWFEDLICDGACPHLLQHTSQSPVSKCSECHRAKGSKELDLDLRTNDNNGALSASSARPASRLSFLALSEQIALSEPSESETPRSL

SEQ ID NO: 200026 - protein, 143 aa, Glycine max
  Coding DNA Sequence Number=SeqID_83248
MESSCICGVSHILNLIVCDGLKEIDSSISKIRVASFNQFEYVEAAYELTLLTSEGGCPKEMDWKHARVFKMYRVDKTKEMLKKLDDLIRKMFAKYALEHPISIDSSNSSTLASNRASQGNANDADEDEDWDDKFRLKIKKKTW

SEQ ID NO: 200027 - protein, 131 aa, Glycine max
  Coding DNA Sequence Number=SeqID_83249
  Subcellular localization annotation: CTP_CleavageSite=81; ConfidenceScore=5.28e-01
MKNKSCTESVNALSPLSLFTPSQCPTKPEVVGAPSQSEQVPGVPTQQGPQVPSGSSEPPKVDNNRTTIVVAKACEGDPNVVSMKLVDFNERTLVELAKMITVDELPFKFVEYEGFRNFMEAAQPYFKIPLV

SEQ ID NO: 200028 - protein, 735 aa, Glycine max
  Coding DNA Sequence Number=SeqID_83250
  Gene Ontology: Mol. function=hydrogen-translocating pyrophosphatase activity; Cellular component=membrane; Biological process=proton transport
  Homolog annotation: Hit_ID=Q946X5; Match level="QueryCoverage=99%, HitCoverage=100%, E-value=0.0, Identity=81%"; Hit description =Vacuolar H+-pyrophosphatase
  Pfam annotation: Domain name=H_PPase; Domain location=6-721; Score =1434.9; E_value=0; Accession=PF03030.7; Description=Inorganic H+ pyrophosphatase
  Pfam annotation: Domain name=Voltage_CLC; Domain location=145-490; Score=-204.4; E_value=0.047; Accession=PF00654.10; Description =Voltage gated chloride channel
  Pfam module annotation: Pfam domain module=H_PPase::Voltage_CLC; Domain location=6-721::145-490
MVVLSEGLTQILIPVTAFIGIGFALLQWLLVSRVRVSSADHTEADNGYRKSLMGDSELENGVQSVEVTNKCTEIQHAISVGATSFLFTEYKYLTIFMGVFGAIIFVFLGSVKGFSTQSEPCTYNEGNICKPALANAIFSTVAFLLGALTSVLSGFLGMKIATYANARTTLEARKGIGKAFVIAFRSDDWEGLYESITGYGLGGSSMALFGRVGGGIYTKAADVGADLVGKVEHNIPEDDPRNPAVIADNVGDNVGDIAGMGSDLFGSYAESSCAALFVASISSFGTNHDHTAMSYPLIISSMGIVVCLITTLFATDLFEIKNVSQIEPSLKRQLLISTILMTAGIAIVSFTALPSEFTLYNFGAKKVVKNWHLFFCVAIGLWAGLAIGYITEYYTSNAYSPVQDVADSCRTGASTNVIFGLALGYKSVIIPVFAIAIAIYVSFSLAAMYGIAVAALGMLSTMATSLAIDAYGPISDNAGGIAEMAGMRHEIRERTDALDAAGNTTAAIGKGFAIGSAALVSLALFGAYVSRAGIKTVNVMTPKVFIGLIVGAMLPYWFSAMTMKSVGSAALKMVEEVRRQFNTIPGLLEGRAKPDYANCVKISTDASLKEMIPPGALVLLTPLIAGTFFGVETLAGVLAGSLISGVQVAISASNTGGAWDNAKKYIEAGTTPHAVSLGPKGSDAHKAAVIGDTVGDPLKDTSGPSLNILIKLMAVESLVFAPFFAAHGGLIFKLL

SEQ ID NO: 200029 - protein, 363 aa, Glycine max
  Coding DNA Sequence Number=SeqID_83251
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q4ZGK1; Match level="QueryCoverage=94%, HitCoverage=91%, E-value=1e-146, Identity=74%"; Hit description=Beta- 1,3-glucanase 1
  Pfam annotation: Domain name=Glyco_hydro_17; Domain location=28-347; Score=381.2; E_value=1.6e-111; Accession=PF00332.9; Description =Glycosyl hydrolases family 17
MTILRFFCPFFILFFTPIASVQAFTGTYGINYGRIANNIPSPDEVVTLLRAAKIRNVRIYDADHSVLKAFSGTGLEIVVGLPNGQLQDMSSNPDHALNWVKENVQSFLPDTRIRGIAVGNEVLGGTDYSLWGVLLGAVKNIYNATKKLHLDQLVQISTANSFAVFAVSYPPSSGKFDNNVNQYMKPLLEFFQQIGSPFCLNAYPFLAYAGDPEHIDINYALFEPTKGIYDPMYHLHYDNMLDAQIDAAYSALEDAGFDKMEVIVTETGWASNGDQSEAGANATNARTYNYNLRKRLAKRKGTPHRPKNVVKAYIFALFNENEKPGHSSEKNYGLFKADGSISYDIGFHGLNAGHSSLLSLKVP

SEQ ID NO: 200030 - protein, 320 aa, Glycine max
  Coding DNA Sequence Number=SeqID_83252
  Gene Ontology: Mol. function=pseudouridine synthase activity; Biological process=RNA processing
  Homolog annotation: Hit_ID=Q1S0N8; Match level="QueryCoverage=90%, HitCoverage=96%, E-value=7e-86, Identity=56%"; Hit description =Pseudouridine synthase, Rlu
  Pfam annotation: Domain name=PseudoU_synth_2; Domain location=78-261; Score=91.1; E_value=3.4e-24; Accession=PF00849.12; Description=RNA pseudouridylate synthase
  Subcellular localization annotation: CTP_CleavageSite=54; ConfidenceScore=5.43e-01
MFSVNPKPFSAVAVAMSGSHSQQAQPKSPIPTENYPVPLSPPLPPISKQLELSRAMSAASNSSLFSLSPADILYHDDHLIAVNKHPGIYCETLLSSLASQSHQLHLANRLDRDTTGVLLLTKSHKVAAKLVKAFTDHKVKKTYIALCTGPPPNWERVTLRSGHGRSKFGAWRVYAASDVGRALPGGSVVRSMETSFELLSVNRKGNFREVSDSEFGNVEGENVLVVEEKAVKEDGNNESEIVVRAYPRSGRTHQIRLHCQYLGISIVGDVKYEGVYEWKGTTHHAHHLHAETLSFEHPVTGLHVKLRAPLPPWATHAFQP

SEQ ID NO: 200031 - protein, 462 aa, Glycine max
  Coding DNA Sequence Number=SeqID_83253
  Gene Ontology: Mol. function=unfolded protein binding; Cellular component=endoplasmic reticulum; Biological process=protein folding
  Homolog annotation: Hit_ID=A0A762; Match level="QueryCoverage=84%, HitCoverage=91%, E-value=1e-180, Identity=78%"; Hit description =Calreticulin-1
  Pfam annotation: Domain name=Calreticulin; Domain location=33-346; Score=518.0; E_value=1e-152; Accession=PF00262.8; Description =Calreticulin family
MGSPFSWFICIFFFNLKSVFSIFLTRVHVLCVNADGWGNRWVKSDWKKDENLAGEWNHTSGQWNGDANDKGIQTSEDYRFYAISAQYPEFSNKDKTLVFQFSVKHEQKLDCGGGYMKLLSGDVDQKKFGGDTPYSIMFGPDICGYSTKKVHAILTYNDTNHLIKKDVPCETDQLTHVYTFILRPDATYSILIDNVEKQTGSLYSDWDLLPPKTIKDPEAKKPEDWDDKEFIPDPEDKKPEGYDDIPKELPDPEAKKPEDWDDEEDGEWTPPTIANPDYKGPWKAKKIKNPNYKGKWKAPLIDNPAFEKHLSDFKDDPDLYVFPNLKYVGIELWQVKSGTLFDNVLITDDPEYAKQLAEETWGKHKDVEKTAFEEAEKKREEEESKDDPVDSDADEEEEDADEAGNDSDAESKTEAGEDTKEEGVHPPAPLQYTCGGWVLVLQLVASIHEEYAIVVLDCIYDH

SEQ ID NO: 200032 - protein, 164 aa, Glycine max
  Coding DNA Sequence Number=SeqID_83254
MYHQIDKSKCLKFIKSSPLPSACLRKLKNTKNQGRDLVREEKKEGFDTIETLLEEDLGGSDGQEREKNEKAEVRVSHPKRHRHRRNRARDVEMKVRGELWLLGILVSEIPVLYIADQFALGFQYSGQIWKMMWLSPTWTPGGSFRPIVLCHGEFSVKLITRVIR

SEQ ID NO: 200033 - protein, 62 aa, Glycine max
  Coding DNA Sequence Number=SeqID_83255
EKWKQGKNYPTVRVEMGWEKQNKVRGRATIILPVHAGAMPIYMAVYTKTVAHVLLILFQFTR

SEQ ID NO: 200034 - protein, 490 aa, Glycine max
  Coding DNA Sequence Number=SeqID_83256
  Gene Ontology: Mol. function=phosphoribulokinase activity; Biological process=carbohydrate metabolic process
  Homolog annotation: Hit_ID=Q5PLV2; Match level="QueryCoverage=57%, HitCoverage=97%, E-value=1e-139, Identity=86%"; Hit description =Phosphoribulokinase
  Pfam annotation: Domain name=PRK; Domain location=101-308; Score =409.6; E_value=4.4e-120; Accession=PF00485.8; Description =Phosphoribulokinase  Uridine kinase family
MPKAIPFMTDAVIPQPQQLSATIEYQLTQQGGHVGFVGGSLLRPKMWLEQRVPDWLSTYLDMHRLRRAGAQPDGESGRCAPPARAGRGGAGSAVMSARHPVIAVTGSSGAGTTTTSLAFRKIFQQLDLHAAEVEGDSFHRYTRPEMDMAIRKARDLGRHISYFGPEANDFGLLEQTFRDYGQSGLGQSRKYLHTYDEAVPWNQVPGTFTPWQPLPENTDVLFYEGLHGGVVTQQHNVAEHVDLLVGVVPIVNLEWIQKLVRDTSERGHSREAVMDSVVRSMEDYINYITPQFSRTHLNFQRVPTVDTSNPFAAREIPSLDESFVVIHFRGLEGIAFPYLLAMIQGSFISHMNTLVVPGGKMGLAMELIMTPLVQRAALPAGLQLHHFVAVRYLDALAQHDRDRAVLLRGQIHRARHRFIAQRFAADNKMQIDMRKNAWRFFAAFRGQFDFTIGDIVAPLLQNRHHVNRAAAARSHQHHFHRAGRFITGIA

SEQ ID NO: 200035 - protein, 417 aa, Glycine max
  Coding DNA Sequence Number=SeqID_83257
  Homolog annotation: Hit_ID=P37610; Match level="QueryCoverage=32%, HitCoverage=48%, E-value=2e-60, Identity=80%"; Hit description=Alpha- ketoglutarate-dependent taurine dioxygenase
  Pfam annotation: Domain name=TauD; Domain location=286-417; Score= -44.7; E_value=0.0004; Accession=PF02668.6; Description=Taurine catabolism dioxygenase TauD, TfdA family
EPFGALDAFTREQMQTLLLTLWRDTGKQILLITHDIEEAVFLASELVLLSPGPGRVVERLKLDFGQRFAAGEPCRSIKSDPAFIERPPDVPRSSPALAVFPPAVAEPAERSRAAAAVVGRDRAGADCALVPAATTAGLYGCHAMAAPWCQPDAHAGGAVLCRADRHSDFTDLSGNFRSGDFVHPGRREEYAAGADPCRSGAGGDARAAAAFCHSARSVAGDSHRPAHRSWRGLVHAGGGRTDCRDARAGLYGAVGWGVSRHRCGAGGHRAPTDALEWRTAMNERVNFTALGPYIGAQVSDVDLSHPLSDAQFEQLYHGLLRHQVLFLRDQRITPEQQRALAIRFGDLHIHPVYPHAEGVEEIIVLDTHQDNPPDNDNWHTDVTFIQTPPAIAILASKLLPESGGDTLWTSGIAAYEA

SEQ ID NO: 200036 - protein, 117 aa, Glycine max
  Coding DNA Sequence Number=SeqID_83258
MWHARLGHVHLNSIRIMMFLNLIPKSSIDLKQKYETFIQAKQPRKGFTTCIERETVATYPSAGGRRETRGMRVPRKECARSRHQRLFEENVGKTGKDAIYELLSERFGSCIYARGRC

SEQ ID NO: 200037 - protein, 142 aa, Glycine max
  Coding DNA Sequence Number=SeqID_83259
  Gene Ontology: Mol. function=RNA-directed DNA polymerase activity; Cellular component=chromatin; Biological process=RNA-dependent DNA replication
MVGAFSQNKVTLSGHLMILLNESDLTYPLHRVSYAKQQKNAIDKLVQEYLATGIIQNSSSPFARPIVLVGKKDGSWRLCVDYKDLNKHTVKNKFPIPLLDDLLDELADSSIFILQVNKVDYIDLPIASTVMQKDIEATNKIA

SEQ ID NO: 200038 - protein, 261 aa, Glycine max
  Coding DNA Sequence Number=SeqID_83260
  Gene Ontology: Mol. function=calcium ion binding; Cellular component =chloroplast thylakoid membrane; Biological process=photosynthesis
  Homolog annotation: Hit_ID=O80634; Match level="QueryCoverage=69%, HitCoverage=76%, E-value=2e-68, Identity=67%"; Hit description=PsbP domain protein, putative
  Pfam annotation: Domain name=PsbP; Domain location=76-259; Score =191.0; E_value=2.9e-54; Accession=PF01789.7; Description=PsbP
MPLGRRTWAGILLKQPCSEPFLGQPTPPQLRLWNSIIPTQKQILKLNLPHTNCLPRNIATSSSNTVFCELDTTPSGESHCRRRPLLLGIGALTANLQPTNLVFAQEKPDRYRAFVDYEDGYSYVYPIDWKEFDFRAHDSAFKDRYLQLQNVRVRFIPTEKKDIRDLGPMEEVIYDLVKHRYAAPNQRPTINDMQEKTIDGKHYYTFEYILTSPNYSSASFATIAIGNGRYYTLIVGANERRWKRFRDQLKVVADSFRLLDI

SEQ ID NO: 200039 - protein, 122 aa, Glycine max
  Coding DNA Sequence Number=SeqID_83261
MENLEEEQHGVVVYVLDETIPDVLNESSYEFVVNDDVNAKEQETGSGDDDKGLLLVNSGLFEESGEIVPIIINGLVDIVDINMMNITSDEVERFLFGDLKWHTCFTIGMHELMDFLLTETKL

SEQ ID NO: 200040 - protein, 346 aa, Glycine max
  Coding DNA Sequence Number=SeqID_83262
  Gene Ontology: Mol. function=nucleic acid binding
  Homolog annotation: Hit_ID=Q75L03; Match level="QueryCoverage=38%, HitCoverage=24%, E-value=6e-49, Identity=65%"; Hit description =Hypothetical protein OSJNBb0041A22.17 (Os05g0114500 protein) (Putative RNA recognition ...
  Homolog annotation: Hit description=motif (RRM)-containing protein)
  Pfam annotation: Domain name=RRM_1; Domain location=213-283; Score =70.0; E_value=7.8e-18; Accession=PF00076.12; Description=RNA recognition motif. (a.k.a. RRM, R
MVRREEAKKKEERRMKCNNNAYEEGEERETFFKFKGLEWREVQSRMVLSNKKLKLKLRAELAQRNSNAAAEPPSSSSSTNNNNSLKTLLDSATPKARFSKREKRRKLRSDQPSQQANKEIQTETEAEGSPNKKRKRKKVEGDDVAANGVSDTPKNKKKKQKQKKNKNKNKKKSTTAEENESNGGGEMPEATELTKTNTTTSKDNGDAPTNTKAYVGGIPYYSTEDDIRSYFESCGTITEVDCMTFPETGKFRGIAIITFKTEAAAKRALALDGADMGGLFLKIQPYKATRANKASDFAPEILEGYNRIYVGNLSWDITEEELRKFFNGCEITSLRFGMDKETGEFR

SEQ ID NO: 200041 - protein, 468 aa, Glycine max
  Coding DNA Sequence Number=SeqID_83263
  Homolog annotation: Hit_ID=O82598; Match level="QueryCoverage=15%, HitCoverage=28%, E-value=5e-28, Identity=78%"; Hit description =Putative aquaporin TIP1.3
  Pfam annotation: Domain name=F-box; Domain location=88-135; Score =39.2; E_value=1.4e-08; Accession=PF00646.23; Description=F-box domain
  Pfam annotation: Domain name=MIP; Domain location=1-74; Score=-109.5; E_value=0.012; Accession=PF00230.10; Description=Major intrinsic protein
  Pfam module annotation: Pfam domain module=F-box::MIP; Domain location=88-135::1-74
MLGAPSNSRNVGVIAPIAIGSIVGANILGGGAFDGASMDPAVSFGPAVVSWSWTHHWVYWLGPFIGSAAAAILYDNIFIGDDDSPMEDLFSNLPDEVLSCIVSFLPNESALETSLISTRWRDLWNQVLVRHGTTQDITGVVAGFLSRFEELDPLKHPRKLQFHFADQDTALFASIATNSKLLLDFPGGGNKDLKKQYELKFMFNKDLNTVPPTFLVKTLYLKSVSHLTSELVSSIVSNLEHLEKLMIVECTGLQSLFIESESKLHKLTILDCPQLKSLHLRTSKLKRFRLHGPLPKIWPESHFNLSHAMLDFRLGPSCADFKAQDFNQTLLTIKNCEALTLCEWTFQALIWPSISPSGNFIFYKIRELWWIHNHRGENSMEALVSFLKLCPALEQLFVTNDSTSYSAPRSNSCLTQATKYSTKLEHLKRIKFMGFTNRVDEISVAKRLIELVRGEPPKIETCLNAVLV

SEQ ID NO: 200042 - protein, 104 aa, Glycine max
  Coding DNA Sequence Number=SeqID_83264
MFEEVDMNEENQEESGVNEENGEESGVNEENGEEPGVHELVDCSDALNTFQVFATCDDILHWAQSVACDIGFVAVIMRSNKDIGIRGMISFVLLVVKGVVSIGP

SEQ ID NO: 200043 - protein, 312 aa, Glycine max
  Coding DNA Sequence Number=SeqID_83265
  Gene Ontology: Mol. function=hydrolase activity, hydrolyzing O -glycosyl compounds; Biological process=carbohydrate metabolic process
  Homolog annotation: Hit_ID=Q1M320; Match level="QueryCoverage=90%, HitCoverage=44%, E-value=1e-133, Identity=84%"; Hit description =Putative beta-glycosidase
  Subcellular localization annotation: CTP_CleavageSite=25; ConfidenceScore=5.37e-01
MTVVGLFLTATKLAGALFTLTVAANAFSYSRFRKKNLRRFRSPIDESQDTLAHFNIAEGEDEFFFGLATAPAHVEDRLDDAWIQFAEKKRGGGGGDSEGKQRVDAVIGSASGDGGSQQAITSPRSRKPLKVAMEAMIRGIEKYMEVEVQEGEEEARPNVTAWHNVPRPEERLRFWSDPETEIKLAKDTGVTVFRMGIDWTRIMPMEPVNSLNESVNYAALERYKWIINRVRSYGMKVMLTLFHHSLPPWAGEYGGWKLEKTVDYFMDFTRLVFPLVAVVCMLWPIITLAAVDVSQVSSEINSYPVPAYGCNL

SEQ ID NO: 200044 - protein, 283 aa, Glycine max
  Coding DNA Sequence Number=SeqID_83266
  Homolog annotation: Hit_ID=Q945F5; Match level="QueryCoverage=92%, HitCoverage=66%, E-value=6e-44, Identity=41%"; Hit description=Auxin- regulated protein
  Pfam annotation: Domain name=DUF966; Domain location=26-277; Score =127.7; E_value=3.2e-35; Accession=PF06136.4; Description=Domain of unknown function (DUF966)
MLEREASLESSKIWIEPKHQATEVKVPVIYYLSRNGQLEHPHLMEVPISSPQRVLCLKDVIDRLSFLRGQGMANMYSWSTKRSYKNGFVWQDLSENDFIYPSSGHEYVLKGTQMIEASLSFRSCETISTSSSKSSTEASNSSTGADSPATITRRSQSLNSSDYKYYSANKCEEFAGKATIASTQTEEKRRERIKREEQVEECEGNGDAKELGENEEGSLPFSRSSFGTLEGSLEGFGSADIRSQRVENERPSGRIKASEVLMQFISVEGVFHGKGRLGLGFCN

SEQ ID NO: 200045 - protein, 139 aa, Glycine max
  Coding DNA Sequence Number=SeqID_83267
  Homolog annotation: Hit_ID=Q2QPD5; Match level="QueryCoverage=39%, HitCoverage=7%, E-value=2e-17, Identity=70%"; Hit description =Fibronectin type III domain containing protein, expressed
MTSSFSIKVISNFLSQCHRVSLKEFNTGRCWKKQLNIAKDARRVDVLCYRIYLSYRLVDGTSKYKELHEMVKEAKAKLETEVGPVTARVLEKKSPCNFLVFGLGHDGLMWNALNHGGRTIFLEEEESWIQQMRRFPMME

SEQ ID NO: 200046 - protein, 385 aa, Glycine max
  Coding DNA Sequence Number=SeqID_83268
  Gene Ontology: Mol. function=transposase activity; Biological process= transposition, DNA-mediated
  Homolog annotation: Hit_ID=Q2QZ53; Match level="QueryCoverage=98%, HitCoverage=97%, E-value=1e-110, Identity=50%"; Hit description =Expressed protein
MGSIRGIKKRKKADNKDGPDASATSFDWWHHFSLRISGPLARSKNIEKFESVFKISRKTFNYICSLVEEDMLARASNFVDLNGNRLSLNDQVAVALRRLSSGESLSTIGESFRMNQSTVSQVTWKFVETMEERGLHHLSWASTEMEMEEIKSKFENIRGLSNCCGAVDSTHIMMTLPSVDALNSVWLDREKNCSMVLQAIVDPDLRFRDIVTGWPGSMSDEQVLRSSSFFKLAEEGKRLNGGKKTLPDGTLFREYIIGDTGFPLFSWLLTPYEGKGFSNVQVEFNKRVVETQMVAKKALARLKDMWKIIQGVMWKPDKHKLPRIILVCCILHNIVIDMEDEVLIDMPSCHQHDSRYQDQTSEFADNTATIMREKLSLYLSGKLPT

SEQ ID NO: 200047 - protein, 252 aa, Glycine max
  Coding DNA Sequence Number=SeqID_83269
  Gene Ontology: Mol. function=serine carboxypeptidase activity; Cellular component=cellulose and pectin-containing cell wall; Biological process=proteolysis
  Homolog annotation: Hit_ID=Q5ZA26; Match level="QueryCoverage=98%, HitCoverage=59%, E-value=3e-65, Identity=48%"; Hit description =Putative serine carboxypeptidase II, CP-MII
  Pfam annotation: Domain name=Peptidase_S10; Domain location=2-251; Score=1.2; E_value=3.5e-13; Accession=PF00450.12; Description=Serine carboxypeptidase
MGKDYISTPTPGIQVAIFVDKLLESAEDTYNFLVNWLQRFPQFKSRDFFISGESYAGHYIRKFAELIFDRNKDRNKYPSISLKGFIVGNPETDYYYDYKGLLEYAWSHAVISDQQYDKAKQVCDFKQFEWSNECNQAMHEVFQDYSEIDIFNIYAQACRLNSTSSIADHSNSNSPESFTKVRNDYRLRRMRNFGGYDPCYSNYAEEYFNRKDVQSSFHADARRATNVNITWKWRRKVPVIGTQYCVEALDYL

SEQ ID NO: 200048 - protein, 86 aa, Glycine max
  Coding DNA Sequence Number=SeqID_83270
  Subcellular localization annotation: CTP_CleavageSite=77; ConfidenceScore=5.37e-01
MWDLANEAQKRLHAHTFNNPSGFKLNQTPYNCSIMVRLVTGSGAHSWAKVAKSSSSGLLCSLHGLKNATNRNNISVVCRTKEPDCY

SEQ ID NO: 200049 - protein, 299 aa, Glycine max
  Coding DNA Sequence Number=SeqID_83271
  Gene Ontology: Mol. function=nucleotide binding; Cellular component =membrane; Biological process=small GTPase mediated signal transduction
  Homolog annotation: Hit_ID=P28186; Match level="QueryCoverage=72%, HitCoverage=94%, E-value=2e-88, Identity=79%"; Hit description=Ras -related protein ARA-3
  Pfam annotation: Domain name=Arf; Domain location=23-212; Score= -71.4; E_value=0.00029; Accession=PF00025.11; Description=ADP -ribosylation factor family
  Pfam annotation: Domain name=MMR_HSR1; Domain location=39-166; Score=- 6.2; E_value=0.0037; Accession=PF01926.13; Description=GTPase of unknown function
  Pfam annotation: Domain name=Miro; Domain location=40-166; Score =71.2; E_value=3.2e-18; Accession=PF08477.3; Description=Miro-like protein
  Pfam annotation: Domain name=Ras; Domain location=40-214; Score =345.4; E_value=9.6e-101; Accession=PF00071.12; Description=Ras family
  Pfam module annotation: Pfam domain module=Arf::MMR_HSR1::Miro::Ras; Domain location=23-212::39-166::40-166::40-214
MGEASEGLEGRIECGQEYGIKSAMAAAPARARADYDYLIKLLLIGDSGVGKSCLLLRFSDGSFTTSFITTIGIDFKIRTIELDSKRIKLQIWDTAGQERFRTITTAYYRGAMGILLVYDVTDEASFNSNLPSLLGFFYPDIRNWIRNIEQHASDNVNKILVGNKADMDESKRAVPTSKGQALADEYGIKFFETSAKTNMNVEEVFFSIARDIKQRLADTDSRAEPQTIKINQPDQATSGGQPAQKSACCDADRLSQQLDHLQNIGPNVFYFVGWLRNLDANPISLHVEGKWKPCHFTAM

SEQ ID NO: 200050 - protein, 1021 aa, Glycine max
  Coding DNA Sequence Number=SeqID_83272
  Gene Ontology: Mol. function=oxidoreductase activity, acting on the aldehyde or oxo group of donors, disulfide as acceptor; Cellular component=mitochondrion; Biological process=metabolic process
  Homolog annotation: Hit_ID=Q9ZRQ2; Match level="QueryCoverage=99%, HitCoverage=99%, E-value=0.0, Identity=82%"; Hit description=2 -oxoglutarate dehydrogenase, E1 subunit
  Pfam annotation: Domain name=E1_dh; Domain location=242-570; Score =245.2; E_value=1.4e-70; Accession=PF00676.10; Description =Dehydrogenase E1 component
  Pfam annotation: Domain name=Transket_pyr; Domain location=634-850; Score=235.1; E_value=1.5e-67; Accession=PF02779.14; Description =Transketolase, pyrimidine binding dom
  Pfam module annotation: Pfam domain module=E1_dh::Transket_pyr; Domain location=242-570::634-850
  Subcellular localization annotation: CTP_CleavageSite=45; ConfidenceScore=5.46e-01
MAWFRVASSIVKHDAIRRNLYRGAKRTSTVLPSTSRIRKFHTTVVKSKEQTAPVPRPVPLSKLTDNFLDGTSSVYLEELQRAWEADPDSVDESWDNFFRNFVGQASTSPGISGQTIQESMQLLLLVRAYQVNGHMKAKLDPLGLEERKVPDELDPAFYGFTEADLDREFFLGVWKMSGFLSENRPVQTLRFILSRLQQAYCGSIGYEYMHIPDREKCNWLRDRIETPTPTQYNRERREVIFDRLAWSTLFENFLATKWTSAKRFGLEGGESVIPGMKEMFDRASDLGVESIVMGMAHRGRLNVLGNVVRKPLRQIFCEFSGGQPADEVGLYTGTGDVKYHLGTSYDRPTRGGRRIHLSLVANPSHLEAVNPLVVGKTRAKQYYSNDVDRMKNMGVLIHGDGSFAGQGVVYETLHLSALPNYTTGGTIHIVFNNQVAFTTDPKSGRSSQYCTDVAKALNAPIFHVNGDDVEAVVHVCELAAEWRQTFHSDVVVDFVCYRRFGHNEIDEPSFTQPKMYKVIRNHPSALEIYQKKLLESGELTQEDIDKIHKKVTSILNDEFLASKDYVPKRRDWLSAYWSGFKSPEQISRIRNTGVKPEILKSVGKAITILPKFFSPHKAVKRIYEQRAQMVETGEDIDWGFAEALAFATLIVEGNHVRLSGQDVERGTFSHRHAVVHDQTTGEIYCPLDHVIMNQNEEMFTVSNSSLSEFGVLGFELGYSMENPNSLVIWEAQFGDFANGAQVIFDNFLSSGESKWLRQTGLVVLLPHGYDGQGPEHSSGRLERFLQMADDHPYVIPEMDPTLRKQIQECNWQIVNVTTPANFFHVLRRQIHREFRKPLIVMSPKNLLRSKACRSNLSEFDDVQGHPGFDKQGTRFKRLIKDQNNHSDVEEGIRRLVLCSGKVYYELDEQRTKEDAKDVAICRVEQLCPFPYDLVQRELKRYPNAEVVWCQEEPMNMGGYTYILPRLISSMKAVGRGGYEDVKYVGRAPSAATATGFLKVHLNEQAELVQKAIQREPINFPY

SEQ ID NO: 200051 - protein, 53 aa, Glycine max
  Coding DNA Sequence Number=SeqID_83273
MATTILEPALAGARISAPRNRTPLSLAISESSHQVEEEEEEGDEDEHDEEDDE

SEQ ID NO: 200052 - protein, 98 aa, Glycine max
  Coding DNA Sequence Number=SeqID_83274
  Subcellular localization annotation: CTP_CleavageSite=31; ConfidenceScore=5.47e-01
MMHAPDSTLKCNVVRTNNNQISGNSLSVSTRHSHLGNCAEFVETTRVCTLSQNALLREREARLTGALSKGGKMREVATNVYLWKTSEKPKETGQKEYP

SEQ ID NO: 200053 - protein, 142 aa, Glycine max
  Coding DNA Sequence Number=SeqID_83275
MGRYTSPSNNSYAVGLKDNGEKKNKEGVEKEKEKNDEVMANEKVEEKVVSEEEKHKSKKQATNKGKVVVNHPPMEHLPYLHALSKKDKERQYKLFLDIFKRLQINIPFSEALEQMPTYTKFMKDLLTKKRRIIDDEIMVLEP

SEQ ID NO: 200054 - protein, 139 aa, Glycine max
  Coding DNA Sequence Number=SeqID_83276
MNSLSEHAALSEFINTHYSLSTFLETPVVLAEGESLPAYSRYCRMPTNIREIEAALCIPDRGFVLNAEGHPRKILRKDLTTLSQVWSVLSYSNLASTSHTSDLTVDRARLIFDLVSQLDMNVIALISGHITSMAQSNSL

SEQ ID NO: 200055 - protein, 221 aa, Glycine max
  Coding DNA Sequence Number=SeqID_83277
  Gene Ontology: Mol. function=helicase activity; Biological process =viral genome replication
  Homolog annotation: Hit_ID=Q9LTU4; Match level="QueryCoverage=90%, HitCoverage=20%, E-value=9e-32, Identity=35%"; Hit description =Helicase-like protein
  Pfam annotation: Domain name=DUF889; Domain location=1-145; Score= -56.5; E_value=1.2e-07; Accession=PF05970.5; Description=Eukaryotic protein of unknown function (DUF889)
MCLRSNFTLTNAQEIKSLSQCLIDVDDRKLDKGDDECYEIEIPPNLLIRNFIDPIEAIVNHIYPNIQKKYKDEEFLKSRAILAITNEVVDQINDYILNIIPEFRSGLCNGTRLIIYRMTNHVIEMTRRQFSLIVSYAMTINKSQGQSLQCVGLYLPQPGLNQGQIYVAFSRVQSKSELKILIHDKEGKPLNTTTNVVFKEVLQNLLLSAGLLTKLKVVTAS

SEQ ID NO: 200056 - protein, 204 aa, Glycine max
  Coding DNA Sequence Number=SeqID_83278
  Gene Ontology: Mol. function=protein serine/threonine kinase activity; Cellular component=chloroplast; Biological process=protein amino acid phosphorylation
  Homolog annotation: Hit_ID=P27450; Match level="QueryCoverage=69%, HitCoverage=34%, E-value=3e-40, Identity=55%"; Hit description =Probable serine/threonine-protein kinase Cx32, chloroplast precursor
  Pfam annotation: Domain name=Pkinase; Domain location=2-181; Score= -113.1; E_value=0.08; Accession=PF00069.15; Description=Protein kinase domain
  Pfam annotation: Domain name=Pkinase_Tyr; Domain location=2-181; Score=-154.6; E_value=0.0055; Accession=PF07714.7; Description =Protein tyrosine kinase
  Pfam module annotation: Pfam domain module=Pkinase::Pkinase_Tyr; Domain location=2-181::2-181
NYNPKISDFGLAKLGPSEGQSHNYNPKTSDFGLAKLGTSEGQSHNYNPKISDFGLEKLGPSEGQSYVTTMVSGTFGYVSPEYCLTGALYVKSDVSGFGVVLLEILTGMRTFDAKRPTGQRNLVEWTEPLLSSKKKLKTIMDTEIKGQYSLEAAWQAAQLTLKCLKFVPQERPSMKDVVETLEAIEAIQNPQFAMYISTTPSAGS

SEQ ID NO: 200057 - protein, 51 aa, Glycine max
  Coding DNA Sequence Number=SeqID_83279
MALGVMAARPGRHRLHLVPHSHRKEKERNPQEANINLPYFHGKDNVEAYVD

SEQ ID NO: 200058 - protein, 253 aa, Glycine max
  Coding DNA Sequence Number=SeqID_83280
  Gene Ontology: Mol. function=protein kinase activity; Cellular component=chloroplast; Biological process=protein amino acid phosphorylation
  Homolog annotation: Hit_ID=Q75W78; Match level="QueryCoverage=63%, HitCoverage=39%, E-value=5e-53, Identity=62%"; Hit description =Protein kinase
  Pfam annotation: Domain name=Pkinase; Domain location=109-253; Score=- 92.6; E_value=0.0048; Accession=PF00069.15; Description=Protein kinase domain
  Pfam annotation: Domain name=Pkinase_Tyr; Domain location=109-250; Score=-81.9; E_value=1.9e-07; Accession=PF07714.7; Description =Protein tyrosine kinase
  Pfam module annotation: Pfam domain module=Pkinase::Pkinase_Tyr; Domain location=109-253::109-250
  Subcellular localization annotation: CTP_CleavageSite=56; ConfidenceScore=5.85e-01
MGVCFSSGPTQNSSSLDRPYYSGKSSFYFFSPFLNTRHMGSASTNCKNVGITETTSSSTVNRQFSVIVSGSIYRRPLSLPLPPPDGLIPKWPNLKVFDFEELKSATNNFRHDTLLGQGGFCRVYKGWLDEDTLAPTKAGYGMVVAIKRLNPESTQGFVQWQTELNMRRLSHPNLVNLLGYCWDDDEHLLVYEFMPKGSLDNYLFKRNRNLELLSWNTRLKIAIGAARGLAFLHASENNVIHRDFKPLNILLDE

SEQ ID NO: 200059 - protein, 428 aa, Glycine max
  Coding DNA Sequence Number=SeqID_83281
  Gene Ontology: Mol. function=nucleotidyltransferase activity; Cellular component=mitochondrion; Biological process=tRNA processing
  Homolog annotation: Hit_ID=Q6L5J0; Match level="QueryCoverage=99%, HitCoverage=98%, E-value=7e-77, Identity=45%"; Hit description =Putative tRNA His guanylyltransferase
  Pfam annotation: Domain name=Thg1; Domain location=1-179; Score=69.5; E_value=5.7e-18; Accession=PF04446.3; Description=tRNAHis guanylyltransferase
  Pfam annotation: Domain name=Thg1; Domain location=182-425; Score =302.8; E_value=6.1e-88; Accession=PF04446.3; Description=tRNAHis guanylyltransferase
  Pfam module annotation: Pfam domain module=Thg1::Thg1; Domain location=1-179::182-425
MANSKYEYVKCFEVEDEVMFPNIILVWIKASKLHKPHDLNALKLMNSCAVKVLEEYADVVLAYGFSDEYTFVFKKTSKFYERRASKVLSIFTSFFSSIFVRKWDEFFPYKELQCSPSFHGRVIARASVEALQVYLLWRQNICHLTNLHEQCLWRLVERGMNGKEAWDFIKDFDKKINNVTPEYVRSFEFDSKLMPSTWIVVRIDGCHFHRFSEIREFVKPNDDRALNLMNLYAVAVLEKFWEDIVFAFGVSDEYSFILKKATNLYQRRANTIISAIVSFFTSTYVRRWKNFFQQSELKYPPSFDGRAVCYPSTEILRDYLSWRQVDCHINNQYNSCFWKLVASGKSKREAQNSLKGAQLQKKIKELAIDYNNLPVMYRQGSSVYRDKVDIALIHQENGEFPENYGKVIVGHIDIIGPTFWLEHPNILD

SEQ ID NO: 200060 - protein, 413 aa, Glycine max
  Coding DNA Sequence Number=SeqID_83282
  Gene Ontology: Mol. function=protein serine/threonine kinase activity; Cellular component=chloroplast; Biological process=protein amino acid phosphorylation
  Homolog annotation: Hit_ID=P27450; Match level="QueryCoverage=80%, HitCoverage=80%, E-value=2e-85, Identity=48%"; Hit description =Probable serine/threonine-protein kinase Cx32, chloroplast precursor
  Pfam annotation: Domain name=Pkinase; Domain location=121-390; Score =65.4; E_value=1.8e-16; Accession=PF00069.15; Description=Protein kinase domain
  Pfam annotation: Domain name=Pkinase_Tyr; Domain location=123-390; Score=4.1; E_value=1e-12; Accession=PF07714.7; Description=Protein tyrosine kinase
  Pfam module annotation: Pfam domain module=Pkinase::Pkinase_Tyr; Domain location=121-390::123-390
  Subcellular localization annotation: CTP_CleavageSite=74; ConfidenceScore=5.84e-01
MGLRFSSGSAPHSSSLNGSHCSGKSSTFPHPFNILGETRHGSFPFSSNANFPMMGSIPLFSGSARTGCKNVGFSATGKSQFSEIASGSDDREESLGRILKWPNLKVFSFEELISASRRFRYDIQGLVIGKGCFGPVYKGCLDENTLTPAKVGYGMAVAIKMFNQDYFRGFEEWQDKLLLVYEFMPKGSLDYHLFRGNITPLSWNTRLKIAIGAARGLAFLHASENNVIFSDFKASNILLDGNYNAKISDFGFARWGPFEGESHVSTRVIGTYDYAAPEYIATGLSVTQTVDAVEGHLYVKSDIYGFGVVLLEILTGMRALDTNRPQTMQNLVEWTKPCLSSKKKLKAIMDAKIEGQYSLEAAWQAAKLTLKCLKSVPEERPSMKDVVEALEAIEAIQNPQFAAYISSTPSAGS

SEQ ID NO: 200061 - protein, 68 aa, Glycine max
  Coding DNA Sequence Number=SeqID_83283
HNIKIPNGKNSRNWVANVVLKFHDDPTVNEFKIVFFLRQVRWPAGKREGFGRREKKQHCEAEEAEESV

SEQ ID NO: 200062 - protein, 87 aa, Glycine max
  Coding DNA Sequence Number=SeqID_83284
  Gene Ontology: Mol. function=sequence-specific DNA binding; Cellular component=nucleus; Biological process=regulation of transcription, DNA-dependent
  Homolog annotation: Hit_ID=Q9ZRZ4; Match level="QueryCoverage=73%, HitCoverage=25%, E-value=9e-15, Identity=64%"; Hit description=HB2 homeodomain protein
MVNVVELQKQLQRWQQSGNVNVNVNVDANGELMYVKVMTDEQLETLRKQIAVYGTICEQLIEMHRTLSAQQDLAENDRAKISTIPFP

SEQ ID NO: 200063 - protein, 33 aa, Glycine max
  Coding DNA Sequence Number=SeqID_83285
LGGFHVGLSFCHGPHGFELAVGNKFVCPRSKSS

SEQ ID NO: 200064 - protein, 97 aa, Glycine max
  Coding DNA Sequence Number=SeqID_83286
MLEDVQLADHEINIMEKEAAEILKLLQCYVLLNLLMYMVVFVEVLLVKRASSWRKRLNKVKKKFKEHEESQISEMRRDQSETAAAISDGYRGTSGDI

SEQ ID NO: 200065 - protein, 50 aa, Glycine max
  Coding DNA Sequence Number=SeqID_83287
MACTFACSYFLQILAQLIKDVLPVLRARISTLLVAVTKKYASYGEITGRE

SEQ ID NO: 200066 - protein, 150 aa, Glycine max
  Coding DNA Sequence Number=SeqID_83288
  Gene Ontology: Mol. function=protein binding; Biological process=two -component signal transduction system (phosphorelay)
  Homolog annotation: Hit_ID=Q9LU15; Match level="QueryCoverage=78%, HitCoverage=93%, E-value=1e-45, Identity=71%"; Hit description =Histidine-containing phosphotransfer protein 4
  Pfam annotation: Domain name=Hpt; Domain location=44-129; Score=50.7; E_value=4.8e-12; Accession=PF01627.13; Description=Hpt domain
MDKINSRRQVAAMKQSLFDQGYLDEQFIQLEELQDDANPNFVEEIVTLYYRDSSRLISNLDHTLERNPVDFNKLDTIMHQFKGSSSSIGAKKVKAECTLFMEYCRARNGEGCRRSFQQMKKEYATLRKKLETYFHLARQAGPVETAFRPK

SEQ ID NO: 200067 - protein, 672 aa, Glycine max
  Coding DNA Sequence Number=SeqID_83289
  Gene Ontology: Mol. function=protein serine/threonine kinase activity; Cellular component=membrane; Biological process=protein amino acid phosphorylation
  Homolog annotation: Hit_ID=Q5JNK2; Match level="QueryCoverage=55%, HitCoverage=91%, E-value=1e-139, Identity=65%"; Hit description =Putative Nod-factor receptor 1b
  Pfam annotation: Domain name=LysM; Domain location=125-165; Score =29.9; E_value=9.1e-06; Accession=PF01476.10; Description=LysM domain
  Pfam annotation: Domain name=Pkinase; Domain location=317-594; Score =109.0; E_value=1.4e-29; Accession=PF00069.15; Description=Protein kinase domain
  Pfam annotation: Domain name=Pkinase_Tyr; Domain location=317-594; Score=141.6; E_value=2.1e-39; Accession=PF07714.7; Description =Protein tyrosine kinase
  Pfam module annotation: Pfam domain module=LysM::Pkinase::Pkinase _Tyr; Domain location=125-165::317-594::317-594
MNCTDTSRVCTSFLAFKPHQNQTLAVIQSMFDVLPGEITVEGNGWDYIFIRKNCSCAAGMKKYVSNTTLTVKSNGGFEHDLVMEAYDRLALLPNTTTRWAREGGIISLSLFCSCSSGLWNYLMSYVIRDGDSVESLASRFGVSMDSIETVNGIDNPTVGSLVYIPLNSVPGESYHLMNDTPPAPTPSPSVNNFSADQVNQKAHVPHEWIIGGLGVGLALIILTIIVCVALRSPNCLVEAGNNAKDSSGKISNKFYVFGNPSLFCGCVKPVDQKQTDGESSSHQITGTKTSTLIPDMLDMDKPVVFSYEEIFSSTDGFSDSNLLGHRTYGSVYYGLLGDQEVAIKRMTSTKTKEFMSEVKVLCKVHHANLVELIGYAVSHDEFFLIYEFAQKGSLSSHLHDPQSKGHSPLSWITRVQIALDAARGLEYIHEHTKTRYVHQDIKTSNILLDASFRAKISDFGLAKLVGKTNEGETAATKVVNAYGYLAPEYLSNGLATTKSDVYAFGVVLFEIISGKEAIIQTQGPEKRSLASIMLAVLRNSPDTVSMSSTRNLVDPIMMDMYPHDCVYKMAMLAKQCVDQDPVLRPDMKQVVISLSQTLLSSVEWEATLAGNSQLKLVKHWYKAKAYLTRWIKRSSGIKDGPIINQENVPFLPRNGNRFFLQNVETIIDNVRG

SEQ ID NO: 200068 - protein, 51 aa, Glycine max
  Coding DNA Sequence Number=SeqID_83290
MNLLQTNIAPQKAMSLTSQVKSKIIFQLKYATHLKDSRSSFAAVKGNRYKG

SEQ ID NO: 200069 - protein, 93 aa, Glycine max
  Coding DNA Sequence Number=SeqID_83291
MTDEMGDEACAKFDKQPKETYSLYCIVNGRRKVFAASESWWTFNLGSSNWQRVMIRVKDWMLRWEYHSDGCREWKLWEWEGHQIESRTGLHMD

SEQ ID NO: 200070 - protein, 99 aa, Glycine max
  Coding DNA Sequence Number=SeqID_83292
  Homolog annotation: Hit_ID=Q9LHK2; Match level="QueryCoverage=46%, HitCoverage=3%, E-value=3e-08, Identity=67%"; Hit description =Arabidopsis thaliana genomic DNA, chromosome 3, P1 clone: MMF12
MMTMLAVIVPTQKVVRQMKLVGNAASECVEPQGNAHNSVISGLPQRPNPKGSGRFEGGGEGRGEAISDGATKRLRKLLEEGRSQPGYGGKLPQRETERG

SEQ ID NO: 200071 - protein, 270 aa, Glycine max
  Coding DNA Sequence Number=SeqID_83293
  Homolog annotation: Hit_ID=Q9LHK2; Match level="QueryCoverage=90%, HitCoverage=19%, E-value=2e-56, Identity=50%"; Hit description =Arabidopsis thaliana genomic DNA, chromosome 3, P1 clone: MMF12
MIDHFCSTIIAECDINLNRPWSRSLNHQTGALAISTNTSPLPVSSFTSEAILKSLSYVRSLVAQHIPKRHFQPASFAGPPSALGQSLPTLSSLLSKSFNSQLCPASVTESVEKDSVTSSISKLSKIEKIDEKDKLGFIAHDILQWRWLEKQQSSSMKADSDHAVNSQGMRAYNFLEVGAAALLEGDIGAKMKGQPWKYFGTDDMPYLDQLLQASPVTSFTNSASACPHLRAITASKRTKAGPRQVWHVLLSDNFLLRYFLFSFFVVSSLF

SEQ ID NO: 200072 - protein, 119 aa, Glycine max
  Coding DNA Sequence Number=SeqID_83294
  Homolog annotation: Hit_ID=Q9LHK2; Match level="QueryCoverage=90%, HitCoverage=8%, E-value=1e-30, Identity=62%"; Hit description =Arabidopsis thaliana genomic DNA, chromosome 3, P1 clone: MMF12
MAMLQLTFLISPIEKSSVILSTILKYALVNSRGERKNLHSVLFDYVLHQINENCIATGINEYSDDEIQPLASLLAQTNAAEAFHISVKLGVEGIGELLRRSIASALSRYPNSERLNMAE

SEQ ID NO: 200073 - protein, 420 aa, Glycine max
  Coding DNA Sequence Number=SeqID_83295
  Gene Ontology: Mol. function=methionine-tRNA ligase activity; Cellular component=cytoplasm; Biological process=methionyl-tRNA aminoacylation
  Homolog annotation: Hit_ID=O23761; Match level="QueryCoverage=93%, HitCoverage=61%, E-value=1e-152, Identity=69%"; Hit description=MEtRS
  Pfam annotation: Domain name=tRNA-synt_1g; Domain location=64-414; Score=358.4; E_value=1.2e-104; Accession=PF09334.1; Description=tRNA synthetases class I (M)
  Subcellular localization annotation: CTP_CleavageSite=51; ConfidenceScore=5.25e-01
MAVRINSSIQNTLCLLNPPLFSLRYRASSLKLKPQLHFRQNPSRGALFCTCATTDITPQSTEHFVLTTPLYYVNAPPHMGSAYTTIAADAIARFQRLLGKSVIFITGTDEHGEKIATAAMAQGSTPPDHCNLISRSYKTLWKDLDISYDKFIRTTDSKHEAIVKEFYSRVLANGDIYRADYDGLYCVNCEEYKDEKELLDNNCCPVHLKPCVSRKEDNYFFALSKYQKALEDTLYRNPNFVQPSFRLNEVQSWIKSGLRDFSISRASVEWGIPVPDDKTQTIYVWFDALLGYISALSDDQEQPDLLKTVSSGWPASLHLIGKAAQIVPTYTGLSYDEMLLFCMDILRFHAVYWPAMLMSAGLSLPKMVFGHGFLTKDKAIHFLGSVDRPWEVYVRRDMNQLKTQTLSRPELLVFVQYLCL

SEQ ID NO: 200074 - protein, 205 aa, Glycine max
  Coding DNA Sequence Number=SeqID_83296
  Gene Ontology: Mol. function=GTP binding; Cellular component =intracellular
  Homolog annotation: Hit_ID=Q9FH87; Match level="QueryCoverage=72%, HitCoverage=23%, E-value=9e-49, Identity=63%"; Hit description =Similarity to salt-inducible protein
MRFPALFFRKRDISPLLSLVIRHENTLCHFFCTTSELSSSQTPSSQLPPPHFKSTFDNNALTNQFGFIRLQEISINHTDDQTHDEFASDVEKVYRILRKYHSRVPKLELALRESGVVVRPGLTERVLNRCGDAGNLAYRFYSWASKQSGHRLDHDAYKAMIKVLSRMRQFGAVWALIEEMRQENPHLITPQVFVILMRRFASARM

SEQ ID NO: 200075 - protein, 39 aa, Glycine max
  Coding DNA Sequence Number=SeqID_83297
MTPGYQLGSMRIGQNSEGRNNRHTIRKNNEGAQSQSFTC

SEQ ID NO: 200076 - protein, 96 aa, Glycine max
  Coding DNA Sequence Number=SeqID_83298
MNCFVVCQSRLWVVTIVFYTCILIPLMKLKRALASMFLFSCETKGMAKEMEFPEIPSLPVARYEDLKGHNCDGEKQEICSICLVEYEGEDAVSKLG

SEQ ID NO: 200077 - protein, 108 aa, Glycine max
  Coding DNA Sequence Number=SeqID_83299
  Gene Ontology: Mol. function=methionine-tRNA ligase activity; Biological process=methionyl-tRNA aminoacylation
  Homolog annotation: Hit_ID=O23761; Match level="QueryCoverage=77%, HitCoverage=20%, E-value=4e-24, Identity=51%"; Hit description=MEtRS
VDKAHIHYENLSLSSACEAVLEIGNVGNLYMDQRAPWSLFKQGGTAAEAAAKRDTKWGGLKGGQVMAQPKPVFARIENQTEVEDKGVAVRKTKKSKAKPKQPQEVAGA

SEQ ID NO: 200078 - protein, 178 aa, Glycine max
  Coding DNA Sequence Number=SeqID_83300
WLIGKERHHLHPPKLDLTDQDSLPKRLGKDTDIIVPRKLLPERNMAVYYIEFDEFKEELERSHWDEELTDFGDGNIDVAIVKEFYANLYDPEDKSPKFALLRPDPQELAAKLCIPGKGFELNADGQPLKILRKNLTTLAQTWSVLSLSNLIPTSHTSDVTLDRARLIYGIIMKMDMNV

SEQ ID NO: 200079 - protein, 72 aa, Glycine max
  Coding DNA Sequence Number=SeqID_83301
MEYDSLSRCLGGEMVDTRDSKSRAKERGGDLSIEKIHRPETKRKKDSNNHLIWEKAIFFSTMSLSFDPIALR

SEQ ID NO: 200080 - protein, 420 aa, Glycine max
  Coding DNA Sequence Number=SeqID_83302
  Gene Ontology: Mol. function=cytochrome-c oxidase activity; Cellular component=membrane; Biological process=electron transport
  Homolog annotation: Hit_ID=Q33B99; Match level="QueryCoverage=92%, HitCoverage=48%, E-value=2e-80, Identity=43%"; Hit description =Expressed protein
  Pfam annotation: Domain name=DUF639; Domain location=27-420; Score =140.3; E_value=5.3e-39; Accession=PF04842.3; Description=Plant protein of unknown function (DUF639)
MEGMWENILRNHQHSLKSLFHRSKPSSPNAAAADESAYSPKPIPLLSHLANSVVSRCSKSFSSLSSSISISHFHIHFPFTIYHFRILGMSPQELQHCFDSELPMGVKELLTYARHLLEFCSYKALHKLIHNSDFLNDNDFRRLTFDMMLAWEAPSVHTLSDNPSSSSSKEETAGDEDDASLFYSSSTNMALQVDDKKTVGLEAFSRIAPVCVPIADVVTVHNLFHALTSTSAHRLHFLVYDKYLRFLDKVIKNSKNVMAVSAGNLQLAEGEIVLHVDGTIPTQPVLQHIGITAWPGRLTLTNYALYFESLGVGVYEKAVRYDLGTDMKQVIRPDLTGPLGARLFDKAVMYKSTSVVEPVYFEFPEFKANLRRDYWLDISLEILRAHKFIRKYYLKEVQKSEVLARALLGIFRYRAVREAF

SEQ ID NO: 200081 - protein, 266 aa, Glycine max
  Coding DNA Sequence Number=SeqID_83303
  Homolog annotation: Hit_ID=Q33B99; Match level="QueryCoverage=92%, HitCoverage=35%, E-value=3e-37, Identity=38%"; Hit description =Expressed protein
  Pfam annotation: Domain name=DUF639; Domain location=1-260; Score= -195.6; E_value=3.5e-08; Accession=PF04842.3; Description=Plant protein of unknown function (DUF639)
MALFYLGFKSKKVTDICEEATFVSDIRVGEIHPLEVAVKKSLLDTGKAEAAQATVDQVKVEGIDTNVAVMKELLFPVIVSANRLQLLASWKDFYKSAAFLLLSCYMIIRGWIQYFIPSIFMFMAILMLWRRHLRKGRPLEAFIVTPPPNRNAVEQLLTLQEAITQFESLIQAANIILLKLRALLLAILPQATEKVALLLVFLAAVFAFVPPKYILLVVFVEFYTREMPYRKESSDRWIRRIREWWVRIPAAPVQLVKPDHESKKRK

SEQ ID NO: 200082 - protein, 589 aa, Glycine max
  Coding DNA Sequence Number=SeqID_83304
  Gene Ontology: Mol. function=protein binding; Biological process =defense response
  Homolog annotation: Hit_ID=Q19PN2; Match level="QueryCoverage=49%, HitCoverage=49%, E-value=3e-34, Identity=33%"; Hit description=NBS -LRR type disease resistance protein
  Pfam annotation: Domain name=LRR_1; Domain location=245-266; Score =9.3; E_value=5.1; Accession=PF00560.23; Description=Leucine Rich Repeat
  Pfam annotation: Domain name=LRR_1; Domain location=268-291; Score =16.5; E_value=0.095; Accession=PF00560.23; Description=Leucine Rich Repeat
  Pfam annotation: Domain name=LRR_1; Domain location=419-450; Score =0.2; E_value=2.6e+02; Accession=PF00560.23; Description=Leucine Rich Repeat
  Pfam annotation: Domain name=LRR_1; Domain location=483-507; Score =7.3; E_value=12; Accession=PF00560.23; Description=Leucine Rich Repeat
  Pfam annotation: Domain name=NB-ARC; Domain location=3-234; Score =22.2; E_value=1.1e-11; Accession=PF00931.13; Description=NB-ARC domain
  Pfam module annotation: Pfam domain module=LRR_1::LRR_1::LRR_1::LRR _1::NB-ARC; Domain location=245-266::268-291::419-450::483-507::3-234
MKQKSSELPNDLVGENFNRNIEQMWELLGDDQVFIIGIHGMAGVGKTALVTYIENDITRKGSFKHAVVTVSQVFSIFKLQNDIANRIGMTPDEDDERMRAIKLSLVLERKEKTVLILDDVWKNIDLQKVGVPLRVNGIKLILTSRLEHATPAKLPHEVEKIARSIVKECDGLPLGISVMASTMKGGLINDTASLERVLDEGLTIVDKLKSHSLLLESDYLHMHGLVQKMDASHYNMCPPLGQLQALSRLKISGTSIEKVPEGLGKLINLKWLDLSENYNLTLLPGSVLPGLTNKQYLDICYNYGHLAKVNAEDVQGMTMLEHFAGSFHDWDNFNNYVQATLDRGSGPKTYHLHLGIGPGYSLDYSYDYNFLTNDECRIVSFRDCTKLDHVLPTDIARLCIAENKQWRCLCDVLSFRSPSLMYIDIRVCPKLESLFCLTGPCSLCSNLQNLESLNLTSLEGPAETWKENEVKAKNILLGGMFSHIKHLEVSKCHKIEKLLTIGPLLQLKNLVSLDVKSCDLMKEIFTVSITEDVGRVNEITLPKLTRLEFRELPQLKTVWWGIIKCGLSPKLNISDCPQLETPPILQSIS

SEQ ID NO: 200083 - protein, 369 aa, Glycine max
  Coding DNA Sequence Number=SeqID_83305
  Homolog annotation: Hit_ID=Q1S3Z6; Match level="QueryCoverage=40%, HitCoverage=36%, E-value=1e-16, Identity=35%"; Hit description =Cecropin
  Subcellular localization annotation: CTP_CleavageSite=78; ConfidenceScore=5.03e-01
MVLMLGLVDAPFSEIHSLFKLLVLAACRGNSTNLLNFSLNKQTQKWIRGERSSASCRSIRIPSRVQALKSDGGKWKKRGQEASSDTDDDDDDDDAPQRFNKNDPYLMSPEERLEWRRNIRQVLDRKPDVEEELDPLEKKKKLEKLLEDYPLVVDEDDPDWPEDADGWGFSLGQFFDKITIKNKKKDDDDDDDNDDVDRPEIMWQDDNYIRPIKDIKTAEWEETVFKDISPLIILVHNRYKRPKENEKIRDELEKAVHIIWNCRLPSPRVSRVSKVRHLLPLVPDTLACVAIDAVVETELVAALQVSIFPEIIFTKAGKILFRDKAIRSAEEWSKVMAYFYYGAAKPSCLNSLTYSQENIPSIVTDNPVS

SEQ ID NO: 200084 - protein, 232 aa, Glycine max
  Coding DNA Sequence Number=SeqID_83306
  Gene Ontology: Mol. function=hydrolase activity; Cellular component =cytosol; Biological process=G1/S transition of mitotic cell cycle
  Homolog annotation: Hit_ID=Q0WWV2; Match level="QueryCoverage=90%, HitCoverage=62%, E-value=1e-105, Identity=85%"; Hit description =Phosphoprotein phosphatase
MARKTHVVFDSLRISSSMDVRLKSKVYGFYDECQRKYGNANAWRYCTDVFDYLTLSAIIDGTVNIFYSLLFKYLPPMCLCASWWVLCVHGGLSPDIRTIDQIRVIDRNCEIPHEGPFCDLMWSDPEDIETWAVSPRGAGWLFGSRVTSEFNHINNLDLVCRAHQLVQEGLKYMFQDKGLVTVWSAPNYCYRCGNVASILSFNENMEREVKFFTETEENNQMRGPRTGVPYFL

SEQ ID NO: 200085 - protein, 209 aa, Glycine max
  Coding DNA Sequence Number=SeqID_83307
  Gene Ontology: Mol. function=zinc ion binding
  Pfam annotation: Domain name=SWIM; Domain location=66-98; Score=38.0; E_value=3.2e-08; Accession=PF04434.8; Description=SWIM zinc finger
MEGIKVYLMQRIVSQMEKMLRYNGPICPKIQEIYEKIKREAGGWTPEWCGDDQYSLFEVSKNFEKFVVNINKRTCSCRKWDLNSIPCCHGVACLWQNNYNPEAYVAACYRHPMAQIYGLKMDFHQCIPLLSEEHLVDQRRQGKKQIMSHKTVGHNKRTCKGKTRADREIPKGENKNLKRKRAAPRSVPNKKLRMEPIFKSGLGETSASA

SEQ ID NO: 200086 - protein, 82 aa, Glycine max
  Coding DNA Sequence Number=SeqID_83308
MESSGYSHSTGSGLNRRRVRCECDLDPPLVTAWTDNNVCRRIFGCGNYKQMMLGYQVVQEMAQMKLDSMELQQKKLNSHEVQ

SEQ ID NO: 200087 - protein, 111 aa, Glycine max
  Coding DNA Sequence Number=SeqID_83309
MIPCELVRKMSILRRENKRRQLWPRKTKKTKYSRRREGGYVGQNKEAKIAVVKVEGVTKRVIVEGGVVIGASLDLPLHICSDPPKQTHQPSLSMQNHQAWLKFKIATHDYE

SEQ ID NO: 200088 - protein, 156 aa, Glycine max
  Coding DNA Sequence Number=SeqID_83310
  Gene Ontology: Mol. function=ATP-dependent helicase activity; Cellular component=intracellular
  Homolog annotation: Hit_ID=Q10CV6; Match level="QueryCoverage=52%, HitCoverage=6%, E-value=9e-15, Identity=49%"; Hit description =Helicase associated domain family protein, expressed
  Subcellular localization annotation: CTP_CleavageSite=51; ConfidenceScore=5.49e-01
MPMTYSGIFQGFIRFKATSRLRSAPLRHSLPSISSAPFHRTAIRLRHHSCSAALQVVKNTRQRTFKFPFWHQRSSTYGRFAYQDVSSDESDVEFASSPSHNQQLGDSTHENIDDWRWKLTMLMRNKDEQEAVSREKKDRRDFEQLSTLATRMGLYR

SEQ ID NO: 200089 - protein, 198 aa, Glycine max
  Coding DNA Sequence Number=SeqID_83311
  Gene Ontology: Mol. function=polynucleotide adenylyltransferase activity; Cellular component=nucleus; Biological process=RNA polyadenylation
  Homolog annotation: Hit_ID=Q5Z7G3; Match level="QueryCoverage=94%, HitCoverage=33%, E-value=3e-44, Identity=40%"; Hit description =Putative poly(A) polymerase
  Pfam annotation: Domain name=PAP_RNA-bind; Domain location=76-191; Score=25.4; E_value=4.1e-09; Accession=PF04926.5; Description =Poly(A) polymerase predicted RNA binding domain
  Pfam annotation: Domain name=PAP_central; Domain location=1-106; Score=-41.8; E_value=1.3e-09; Accession=PF04928.8; Description =Poly(A) polymerase central domain
  Pfam module annotation: Pfam domain module=PAP_RNA-bind::PAP_central; Domain location=76-191::1-106
MPEVTELHPVPDAHVPVMRVYTQWCWPNPVMLCAIEEGSVGLQIWDPRRYPNDRFHLMPIITPAYACMNSSYNVSSITLCIMTEEFQRGNEICEIERHIYGMLQCHPHPGDSSDKSRPFHCSNFMALQRKQGVPVNDGGQFDIRLTVEEFKHSVNIYTLWIPGMDVHVPHVKHRNIPTFVFPGSVRPSHPSKVTWEIK

SEQ ID NO: 200090 - protein, 82 aa, Glycine max
  Coding DNA Sequence Number=SeqID_83312
MEKEQLEYVLVPLGLLVYLTYHIWLVYTIVHNPLRTVIGLNAESRHQWVLSIMSNSCFFWTCPNCSSIIPSHTKSVRSSGRG

SEQ ID NO: 200091 - protein, 62 aa, Glycine max
  Coding DNA Sequence Number=SeqID_83313
  Homolog annotation: Hit_ID=Q9LMT2; Match level="QueryCoverage=69%, HitCoverage=6%, E-value=4e-13, Identity=75%"; Hit description =F2H15.20 protein (Hypothetical protein At1g17980) (At1g17980) (Poly(A) polymerase)
MGNPGLNNRDNGQQQRLGITEPISLGGPTEYDVIKTRELEKYLQDAGLYENQQEAVRKCLAG

SEQ ID NO: 200092 - protein, 130 aa, Glycine max
  Coding DNA Sequence Number=SeqID_83314
MGVQIATRPTWALQKILQNAVASRGSHLARLGELGGKHLPHFPINRGRSEGEFGSALLVIQESLEISGKNWFREKDPSQGTSIRFLYRFRGDLRDDFKLFFDVLRSFFIVLRSSTGKFPKPNFSILSMYP

SEQ ID NO: 200093 - protein, 165 aa, Glycine max
  Coding DNA Sequence Number=SeqID_83315
MASRDQVWSFCTHDTRRYLTVIRPPFAIQTQSCSMASRDQVWSFCTHDTRRYLTVIRPPLPFRHSRVRWQAETKFGHSAHMIRGDTLRLSAPPLPFRHSRGLTQSSAPFVPPGTTKSFTCGNFMVTRDSRQPRGAKLVSYADFRGPLLDDMRPFFGPCEVLGASH

SEQ ID NO: 200094 - protein, 37 aa, Glycine max
  Coding DNA Sequence Number=SeqID_83316
DRLDAMDAHFEGMDTRITQLKDNMGFIRCCFDPPTAP

SEQ ID NO: 200095 - protein, 183 aa, Glycine max
  Coding DNA Sequence Number=SeqID_83317
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=11%, E-value=2e-63, Identity=68%"; Hit description=Chromo
MFIWVTRDRLLGPHSIRQGSNNGSRKGQAVLNWPYPINLKQLRGFLGLTGYYRKFIKGYVSIATPLSNLLKKENFHWNDHTSMAFDNLKAAITKAPVLALPDFSKAFTLETDASGIGIRAVLSQEQHPIAFFSKKLTPRMQRLSAYIRESYAIIEAVAKFRHYLLGHRFVIKTDQRSLKSLTE

SEQ ID NO: 200096 - protein, 519 aa, Glycine max
  Coding DNA Sequence Number=SeqID_83318
  Gene Ontology: Mol. function=ATP-dependent helicase activity; Cellular component=intracellular; Biological process=protein modification process
  Homolog annotation: Hit_ID=Q5ZEC6; Match level="QueryCoverage=99%, HitCoverage=48%, E-value=0.0, Identity=81%"; Hit description =Putative DEAD/H box polypeptide 36 protein
  Pfam annotation: Domain name=DEAD; Domain location=1-148; Score=7.4; E_value=1.3e-06; Accession=PF00270.19; Description=DEADDEAH box helicase
  Pfam annotation: Domain name=HA2; Domain location=446-518; Score =82.1; E_value=1.8e-21; Accession=PF04408.13; Description=Helicase associated domain (HA2)
  Pfam annotation: Domain name=Helicase_C; Domain location=290-384; Score=55.9; E_value=1.3e-13; Accession=PF00271.21; Description =Helicase conserved C-terminal domain
  Pfam annotation: Domain name=NACHT; Domain location=1-179; Score= -40.2; E_value=0.078; Accession=PF05729.3; Description=NACHT domain
  Pfam module annotation: Pfam domain module=DEAD::HA2::Helicase _C::NACHT; Domain location=1-148::446-518::290-384::1-179
MVVVVSGETGCGKTTQLPQYILESEIEAARGAVCNIICTQPRRISAMSVSERVAAERGEKLGESVGYKVRLEGMKGRDTRLLFCTTGVLLRRLLVDRNLKGVTHVIVDEIHERGMNEDFLLIVLKELLHHRPDLRLILMSATLNAELFSSYFNGAPTMHIPGFTFPVRAHFLEDILERTGYRLTPYNQIDDYGQEKTWKMQKQAQAFRKRKSHIASAVEDALEVAEFKGYSLRTQDSLSCWYPDSIGFNLIEHVLCHIVKNERSGAVLVFMTGWDDITSLKDQLQAHPLLGDQSRVLLLACHGSMASSEQRLIFENPEGGVRKIVLATNMAETSITINDVVFVVDIGKAKETSYDALNNTPCLLPSWISKAAARQRRGRAGRVQPGECYHLYPRCVYDAFADYQLPELLRTPLQSLCLQIKTLQLGSISEFLSRALQPPEPLSVQNAIEYLKIIGALDENENLTVLGHKLAMLPVEPKLGKMLILGAIFKCLDPIMTIVAGLSVRDPFVMPSDKKDKWW

SEQ ID NO: 200097 - protein, 146 aa, Glycine max
  Coding DNA Sequence Number=SeqID_83319
  Gene Ontology: Mol. function=ATP-dependent helicase activity; Cellular component=intracellular
  Homolog annotation: Hit_ID=Q5ZEC6; Match level="QueryCoverage=77%, HitCoverage=10%, E-value=5e-20, Identity=44%"; Hit description =Putative DEAD/H box polypeptide 36 protein
VVLPLGVHKEVDAHLLAHLSQKARNKWDFMEDSLHNSSDSRSIPANERMYEQPEPVTHNSVVKEKILQRKSLQLHHQQQDWQESPEGQKMLEFRRSLPAFKEKDAFLRVISQSQCEGEPLCNDKVAIFCNLEVTSSNLGSSPCLIG

SEQ ID NO: 200098 - protein, 1142 aa, Glycine max
  Coding DNA Sequence Number=SeqID_83320
  Gene Ontology: Mol. function=nucleic acid binding; Cellular component= spliceosome; Biological process=RNA processing
  Homolog annotation: Hit_ID=Q94BR5; Match level="QueryCoverage=90%, HitCoverage=93%, E-value=1e-160, Identity=58%"; Hit description =Putative DNA-binding protein
  Pfam annotation: Domain name=DEAD; Domain location=290-570; Score= -34.1; E_value=0.0043; Accession=PF00270.19; Description=DEADDEAH box helicase
  Pfam annotation: Domain name=Helicase_C; Domain location=987-1065; Score=85.1; E_value=2.1e-22; Accession=PF00271.21; Description =Helicase conserved C-terminal domain
  Pfam annotation: Domain name=ResIII; Domain location=286-564; Score= -39.4; E_value=0.093; Accession=PF04851.6; Description=Type III restriction enzyme, res subunit
  Pfam annotation: Domain name=SNF2_N; Domain location=292-805; Score =182.7; E_value=9.1e-52; Accession=PF00176.13; Description=SNF2 family N-terminal domain
  Pfam annotation: Domain name=zf-C3HC4; Domain location=843-883; Score= 26.0; E_value=0.00014; Accession=PF00097.15; Description=Zinc finger, C3HC4 type (RING finger)
  Pfam module annotation: Pfam domain module=DEAD::Helicase _C::ResIII::SNF2_N::zf-C3HC4; Domain location=290-570::987-1065::286 -564::292-805::843-883
MELSFVVMWNGMFMIPFYYRLAQHFNDDDLEEIEDPRRTLPQWATNTEKSSYNGGWSRRDSSSRGANSSNPSSSNVYNHSQVKPQTLPVSSTNTLNHRIARRDEPSYHALNGNTSQQQTVSSRISNIHGADYEKMSSQQAFKRTLPSSLQPSATRALPSSFASDSRLRNLKDNASSSQLHDAYKNRPHGVGPSTSSDRGYIRENFGRGYDEDRFLYQNGGNRILPSPLMLGKVISPQFATSSESAYRSGAGDERAAESDERLIYEAALQDISQPKTEYDLPAGVLSVSLLRHQKIALAWMLQKETKSLHCLGGILADDQGLGKTISMISLILAQRTLQSKSKIDDTCSHKTEALNLDDDDDNGSVDVEKHKNSEESDDIKPSREPSSSTQAPGRKRPAAGTLVVCPASVLRQWARELDEKVGDEKLSVLVYHGGSRTKDPVELAKFDVVLTTYSIVTNEVPKQPLVEEDDIDEKMGERFGLSSEFSVSKKRKKPFNGNKKSKKGGKGIDSSSIECGSGPLAKVGWFRVILDEAQTIKNHRTQVARACCSLRAKRRWCLSGTPIQNTIDDLYSYFRFLKYDPYAVYKSFYNTIKVPISKNTIQGYKKLQAVLRAIMLRRTKGTLLDGKPIINLPPKTIELSKVDFSIEERAFYTKLESDSRSQFKAKELGMQNNSDGGEIARLGSSKGYGCTGEVTTMCKARLERMSDVPPCPGQGSCLALWRSGLWELPKKLLDKSPAVVREVAKKGEKGPLGTVDPQRNMIFVIPLSGSRYHAYAAAGTVSQNYANILLMLLRLRQACDHPLLVKDFDSDPVGKDSVEMAKNLPREMLINLFNCLESTFAICLVCNDPPEEPVITMCGHVFCYQCVSEYLTGDDNTCPSVNCKELIGDDLVFSKATLRSCISDDGGSVSFANSHLCDYSLVQQRDYTSSKIKAVLEVLQSNCKLKISSSDLPNSSGGCRDSPSLDNLHVEDCDSDWTSMLDLVETSLKQFGIQYRRLDGRMTLGARDKAVKDFNTEPEITVMLMSLKAGNLGLNMVAACHVILLDLWWNPTTEDQAIDRAHRIGQTRPVTVTRITIKDTVEDRILALQDDKRKMVASAFGEDHAGASGTRLTVDDLKYLFMYLLTSVAQVGRQGEAWLIQV

SEQ ID NO: 200099 - protein, 462 aa, Glycine max
  Coding DNA Sequence Number=SeqID_83321
  Gene Ontology: Mol. function=transferase activity
  Homolog annotation: Hit_ID=Q6Z0Z4; Match level="QueryCoverage=84%, HitCoverage=78%, E-value=1e-98, Identity=45%"; Hit description =Putative HGA1
  Pfam annotation: Domain name=DUF563; Domain location=82-328; Score =334.4; E_value=1.9e-97; Accession=PF04577.5; Description=Protein of unknown function (DUF563)
MIYDTVLAKSFSRYDQKRLGYGAFVSCLLIVLSLCTVFKPYLGPVHVLNLKLFIDVDTKMLITRSSSQIAKVEGKETKKEELLCTSEERTKFCQARGDIRVHGKSSTVYIVSSKTTMSEKNMSWNLKPYARRDDVDAMIRVREWSVKAVNVSQKAPQCTQYHNIPAVLFSTGGYAGNHFHEFTDIVIPLFLTARQFNGEVQFIITDKRPWWISKHKPLLKKLSNYETMDIDGDDEVHCFPRVTVGLKRYQKELSIEPQKYSYSMKDFRDLLRSSYALKRVEAIKTRDGLRGKPRLMILSRKRSRFFTNTDEIAKMAESLGFDVIIKEAGWSMWGFANVVNSCDVLLGVHGAGLTNILFLPENAVFVQVVPYGGVTLDWLATNDFGNPSKDMNIKYLEYKISLEESTLIQQYPLDHMFIKDPPLIEKIGWEEFKSVYLDKQNVKLDVDRFRPTLQKALELLHQ

SEQ ID NO: 200100 - protein, 180 aa, Glycine max
  Coding DNA Sequence Number=SeqID_83322
  Subcellular localization annotation: CTP_CleavageSite=56; ConfidenceScore=5.48e-01
MAMSSIHTLYAFSFRLCFPNSSPQFKPLNAIPLRRTKHYNNNNNNVKFPRERTRTRATLDDVETDQLSSIPLVENEKAKKDVEESVKVLKDAAKTRKVAAEEILSALSIIEKAKVDPSAFFETLGGKESPGRTWMLIFTAEKQLKGGRYFPLTAVQRFDAALFLAGKAREIMTQETFDGC

SEQ ID NO: 200101 - protein, 463 aa, Glycine max
  Coding DNA Sequence Number=SeqID_83323
  Gene Ontology: Mol. function=pepsin A activity; Cellular component =anchored to membrane; Biological process=proteolysis
  Homolog annotation: Hit_ID=Q9LHE3; Match level="QueryCoverage=95%, HitCoverage=93%, E-value=1e-151, Identity=60%"; Hit description =Nucleoid chloroplast DNA-binding protein-like
  Pfam annotation: Domain name=Asp; Domain location=133-462; Score= -100.2; E_value=1.1e-07; Accession=PF00026.14; Description=Eukaryotic aspartyl protease
MFTVLLLFSLLLTTSTSHNIISYPHFQQLNVKQILTETKLNPTNTYKHLQHQKLNIATEASSPAKYKLKLVHRDKVPTFNTSHDHRTRFNARMQRDTKRVAALRRHLAAGKPTYAEEAFGSDVVSGMEQGSGEYFVRIGVGSPPRNQYVVIDSGSDIIWVQCEPCTQCYHQSDPVFNPADSSSYAGVSCASTVCSHVDNAGCHEGRCRYEVSYGDGSYTKGTLALETLTFGRTLIRNVAIGCGHHNQGMFVGAAGLLGLGSGPMSFVGQLGGQAGGTFSYCLVSRGIQSSGLLQFGREAVPVGAAWVPLIHNPRAQSFYYVGLSGLGVGGLRVPISEDVFKLSELGDGGVVMDTGTAVTRLPTAAYEAFRDAFIAQTTNLPRASGVSIFDTCYDLFGFVSVRVPTVSFYFSGGPILTLPARNFLIPVDDVGSFCFAFAPSSSGLSIIGNIQQEGIEISVDGAN

SEQ ID NO: 200102 - protein, 514 aa, Glycine max
  Coding DNA Sequence Number=SeqID_83324
  Gene Ontology: Mol. function=translation elongation factor activity; Cellular component=intracellular; Biological process=translational termination
  Homolog annotation: Hit_ID=Q40581; Match level="QueryCoverage=92%, HitCoverage=86%, E-value=0.0, Identity=76%"; Hit description=EF-1 -alpha-related GTP-binding protein
  Pfam annotation: Domain name=GTP_EFTU; Domain location=54-307; Score =297.0; E_value=3.5e-86; Accession=PF00009.17; Description=Elongation factor Tu GTP binding domain
  Pfam annotation: Domain name=GTP_EFTU_D2; Domain location=326-393; Score=56.4; E_value=9.7e-14; Accession=PF03144.15; Description =Elongation factor Tu domain 2
  Pfam annotation: Domain name=GTP_EFTU_D3; Domain location=405-514; Score=112.8; E_value=1e-30; Accession=PF03143.7; Description =Elongation factor Tu C-terminal domain
  Pfam annotation: Domain name=MMR_HSR1; Domain location=57-205; Score =0.4; E_value=0.00092; Accession=PF01926.13; Description=GTPase of unknown function
  Pfam module annotation: Pfam domain module=GTP_EFTU::GTP_EFTU_D2::GTP_ EFTU_D3::MMR_HSR1; Domain location=54-307::326-393::405-514::57-205
MEVGGHHIMNFTLVISDPKQDVEAEPKAVEAEPKVKDKEVPSVQDEEDEPEMTKRHLNVVFIGHVDAGKSTTGGQILFLSGQVDERTIQKYEKEAKDKSRESWYMAYIMDTNEEERVKGKTVEVGRAHFETETTRFTILDAPGHKSYVPNMISGASQADIGVLVISARKGEFETGYERGGQTREHVQLAKTLGVSKLLVVVNKMDEPTVQWSKERYDEIESKMVPFLKQSGYNSGKCYVLLKAWDELKMTGSFFAQMLSRFEILDVLFLPISGLMGANMKTRVDKSVCPWWNGPCLFEALDAIEVPLRDPNGPFRMPIIDKFKDMGTVVMGKVESGSVREGDSLLVMPNKDPVKVVAIFIDEDRVKRAGPGENLRIRLSGVEEEDILSGFVLSSVALISMETNPIPAVTEFVAQLVILELLDNAIFTAGYKAVLHIHSVVEECEIVELLQQIDTKTKKPMKKKVLFVKNGAVVVCRVQVNNSICIEKFSDFPQLGRFTLRTEGKTVAVGKVTGL

SEQ ID NO: 200103 - protein, 229 aa, Glycine max
  Coding DNA Sequence Number=SeqID_83325
  Gene Ontology: Mol. function=RNA-directed DNA polymerase activity; Cellular component=chromatin; Biological process=chromatin assembly or disassembly
MNQVIQTPEQQQYLAKLLGYDYTIQYRSGIDNIAAVALSGIVPPGQCLILSLPNLECLVDIKRSVLHSSAYRDLLDKIQHQPEAYPDFSLHTGWICYRGKLWLPTDNPYIPMLLDEFHSTPLGGHMGEAKTLRRLRDILFWDNMHRDVRRMDLSLDFITRLSPSHGFTTILVVVDRYSKGTHLGALLPKHSTHKVATLFIDIVCKLHVAPNSGTAQPIILSLTAYHPDS

SEQ ID NO: 200104 - protein, 89 aa, Glycine max
  Coding DNA Sequence Number=SeqID_83326
MMKDSSLWVMAKRCKKGRYNKQKGTEIKKRRRKSEEAQVQEKNKSHGDSTSGGFNPFSVSLTFKNSIGAARGKKLEESQRTARDAVIAG

SEQ ID NO: 200105 - protein, 85 aa, Glycine max
  Coding DNA Sequence Number=SeqID_83327
MKVIHLVEAHDTLHPPRASYRCDLHVIEGYPKSVRTYKAKLLQEEMAKRTEDGLLIKGKEGGSYKELNWSTLEISLMAHLATPAR

SEQ ID NO: 200106 - protein, 52 aa, Glycine max
  Coding DNA Sequence Number=SeqID_83328
MRSWGLDLNQEGEALTDSSESRPWWMTLKNLVPEDVGTQCVTTRLVTTISPL

SEQ ID NO: 200107 - protein, 97 aa, Glycine max
  Coding DNA Sequence Number=SeqID_83329
MRILLIGQGSKNSKVVSQWGLLSWEPDLDIWGARDNDDLETTCKISHGHSQEGTQASHLRHCDTTVRNLHKQTHRFPIMFFHQFNEFIHSYLGYSGK

SEQ ID NO: 200108 - protein, 182 aa, Glycine max
  Coding DNA Sequence Number=SeqID_83330
  Gene Ontology: Mol. function=sequence-specific DNA binding; Cellular component=nucleus; Biological process=regulation of transcription
  Homolog annotation: Hit_ID=Q1SQT4; Match level="QueryCoverage=97%, HitCoverage=76%, E-value=5e-41, Identity=55%"; Hit description=DNA -binding WRKY
  Pfam annotation: Domain name=WRKY; Domain location=159-182; Score= -8.5; E_value=0.0079; Accession=PF03106.6; Description=WRKY DNA -binding domain
MMSTTNVNHSLFEEQDQIPTQMGLFNIIPFPPNQTYPPLGCQTVTLKSISAIAPSLSSAANFSETLLSTAVNQRPREEDLTSSLVGGGGGQLLSLSRSRVNSWAWEEVSDCLMGKRIGGDDNHHHHLGVSAMKMKKMKARRKVREPRFCFKTMSDVDVLDDGYKWRKYGQKVVKNTQHPSDQ

SEQ ID NO: 200109 - protein, 72 aa, Glycine max
  Coding DNA Sequence Number=SeqID_83331
MLKNGRESSRNYSKKCYGSASAWIFFTETISLSKFKRIRREELATQLAQASKVASSRSNSLLEEESGRPKWA

SEQ ID NO: 200110 - protein, 45 aa, Glycine max
  Coding DNA Sequence Number=SeqID_83332
MSLYMYNHRLEAMAPKKLLSKRARKEATGEGSSAAPHADIEFDGH

SEQ ID NO: 200111 - protein, 220 aa, Glycine max
  Coding DNA Sequence Number=SeqID_83333
  Gene Ontology: Mol. function=amino acid transporter activity; Cellular component=membrane; Biological process=amino acid transport
  Homolog annotation: Hit_ID=P28635; Match level="QueryCoverage=90%, HitCoverage=73%, E-value=9e-51, Identity=49%"; Hit description=D -methionine-binding lipoprotein metQ precursor
  Pfam annotation: Domain name=Lipoprotein_9; Domain location=28-220; Score=236.1; E_value=7.8e-68; Accession=PF03180.4; Description=NLPA lipoprotein
MKKTWLTALLAASVTLLSACDNHNDNKIKVAINTGPDEALWQTVKQVAHDKYQLDVDVVAFNDYVQPNEALFNKDVDANAFQSLPYLEMQSKERGYKFAVVTNTFVFPIAGYSRKIKSLQDLPDGATVTVSNEATTLGRSLLLLQAQGLLKVKPEAGLLPTTLDITDNPKKLKIVEVDTPQLARTLDDPQVYLSIINNNFAALVNLSASRDGMFMEGKAS

SEQ ID NO: 200112 - protein, 32 aa, Glycine max
  Coding DNA Sequence Number=SeqID_83334
HLNLTSVSKVMTIGNSRELPLFNFERLDILCA

SEQ ID NO: 200113 - protein, 114 aa, Glycine max
  Coding DNA Sequence Number=SeqID_83335
IPARSCHHDIGIAPARHPVDPEKSNRVLGFLALITGLCQFYRVLVAPNKVRPLLIRLSSRSTAPPGRRRARHHDSGQQTHRHHLWSSPQLIHKKVRVLPTTHGRPIGDQVQSQR

SEQ ID NO: 200114 - protein, 176 aa, Glycine max
  Coding DNA Sequence Number=SeqID_83336
  Homolog annotation: Hit_ID=Q9CA40; Match level="QueryCoverage=23%, HitCoverage=27%, E-value=3e-10, Identity=58%"; Hit description=Nudix hydrolase 1
TVLLAEFYVISDNTIIVTQRIIKKLPIEANFRLTNCKSTLAKASTLHPRKSGCRCRGIHRRKRQWCTVSGLSQQRRWKDRLDEEEVIVGVLDLEGERKRGRRTTCHRGCHGGERRGQGQEGFGVEIETAKVEEQVPQNLEPTKCDGWDWYEWDHLPHPLVGPLEKMVKGAFDPFPI

SEQ ID NO: 200115 - protein, 69 aa, Glycine max
  Coding DNA Sequence Number=SeqID_83337
MDRCNYMSVSTDLALASRGRFRSEVAWLGDWPDAQIGEEPSESPGDADESHMDEDMTDLLGFLGGSGAT

SEQ ID NO: 200116 - protein, 146 aa, Glycine max
  Coding DNA Sequence Number=SeqID_83338
MALAHDFERSDPWNKWGPNLVLGYKRTQKWALVGAYLWAKMVSLGQHHDAGFAPQSGTPLLFGLAYEMAIMGDGSEEALHNEVQEGCLWGRLQHPVEFDSHRFRSAEHQERFEAIKGWSFHRERRVQLREDEYPDFQEEIARRRWA

SEQ ID NO: 200117 - protein, 102 aa, Glycine max
  Coding DNA Sequence Number=SeqID_83339
MRSRHYRIATVIDFYIVLHSFFVHHSLGEPTMKSKRKHHTKRNFSELSMTENLADHSFQGRALSAEGTLNQAERKRVLSPSPLTRAKCESDAKCNVAISGPI

SEQ ID NO: 200118 - protein, 182 aa, Glycine max
  Coding DNA Sequence Number=SeqID_83340
MLGRLLASSLAFESRILHYLIVRILLPRSSNLAQAHLVRYRMHKALRLNAPLPYPHLVTLFLQHFNIPFDSEPYVPIKRTFLIGASVIASFGYIKEHDGSWVKKGARNIGEEGHEGEDSSLLSKILERFDGLQTFVGERFDTLELQVDMCFNEMESRMTKVEEDVSYIQSSFDLPPPPPPSS

SEQ ID NO: 200119 - protein, 110 aa, Glycine max
  Coding DNA Sequence Number=SeqID_83341
MGLSGMTRSGHVFAPPDLPTQPANVKGKAKIAKEQNNNVIPAPDEDIPMKGLSEKKDGSGKKKVLLEEAGKFLRIIQQSEFKVIEQLNKNPAKVSLLELLMSSETHRALL

SEQ ID NO: 200120 - protein, 187 aa, Glycine max
  Coding DNA Sequence Number=SeqID_83342
  Subcellular localization annotation: CTP_CleavageSite=49; ConfidenceScore=5.03e-01
MSSPSEDYTSSPSEGYTSSLLEGFTSVPSENSRATNCASTTRGGDYRIATMHTGARFYPAATRRRVWIVRTNIWMMLLLSNLLPNDHHSNPPLSKCQLGSCPQDTRWTRRSPTEPWGSSSDYEPLSVLRSDHHSDLSLPKCQLGSCPQDTQWTRRSSIGSWDSSSDYGPLSVQRSARHPQQGHQAPY

SEQ ID NO: 200121 - protein, 98 aa, Glycine max
  Coding DNA Sequence Number=SeqID_83343
  Gene Ontology: Mol. function=RNA-directed DNA polymerase activity; Biological process=RNA-dependent DNA replication
VLLIQEFDIIIKDKKGSENVVADHLSQLKNKEVTKEEPERIGGISRRNEMPLQNITEVKIFDCWGINFMGPLPSSYGNVYILVAVDYVSKWVEAIATF

SEQ ID NO: 200122 - protein, 37 aa, Glycine max
  Coding DNA Sequence Number=SeqID_83344
MNMQGALSATPPRSARVDRGLSARVAGLARSSVGFQA

SEQ ID NO: 200123 - protein, 101 aa, Glycine max
  Coding DNA Sequence Number=SeqID_83345
MIDAASHGALGDMTPLSGVNEQLEAHVANIYNRLPQQQNQQQQNNYDLSNNRYNPGWRNHPNLRWENPPQQQQQQQQQFVPPFQNVVGPSRPYVPPPMQQQ

SEQ ID NO: 200124 - protein, 94 aa, Glycine max
  Coding DNA Sequence Number=SeqID_83346
MTQELVARGDTLRLSAPRHSVIPSVIDEQRPMWSSVPFPEMSASSGGDFFKSHKLSRTTHNFKFVRQPPLQIGSLLLSVFFKMLISSVNTLLVI

SEQ ID NO: 200125 - protein, 114 aa, Glycine max
  Coding DNA Sequence Number=SeqID_83347
MVLFCTWFSWIVHGNRKLQWRVREHRTRGYSNPLLVLAISGEGTSRQRCWRFQGCAEIAALTGDFQGLRVGCRGRGTEAISEALHGAAAAEQGVANGNCDLVRKPPAVLAICIR

SEQ ID NO: 200126 - protein, 123 aa, Glycine max
  Coding DNA Sequence Number=SeqID_83348
VVASGGSNPARLGELGDKLLPQFSINRGRSEVKKGSAPKALLSLSNLFGKIVSVKKIQAEALPKSFRNVSVRNFAKVSTVLRRSSFVLHRSSIFNGLKTNTGHVGLARPSTRIWLLIQHACVQ

SEQ ID NO: 200127 - protein, 207 aa, Glycine max
  Coding DNA Sequence Number=SeqID_83349
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=6e-22, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ALTFRGLHVLAIRGLHALIFRGLHVLAIRGLHALTSRGLDILAFSGLHVLAIRGLHALTFRGLHVLASRGLHTLTFRGLHVFTIKGLHALTLRGLHRTTRSRLQRDTRLHLWRAKHSTLRALHVVSIGGLHAFTFRGQHVFAIKGLHALTFRGLHVLAIRGLHVLAIRGQYSLTFRGLHVLAIRGLHALIFKGLHVLAIREMHAVTF

SEQ ID NO: 200128 - protein, 96 aa, Glycine max
  Coding DNA Sequence Number=SeqID_83350
MDKLPTNEKLQGEDCNIVSMCSLCEMAYKKNLVPYEVLFTWIIRSDRVDVSMLESSVGVTQLKGVTFIKMGITDYFPKYTQKHIKRKAKKKPKEKP

SEQ ID NO: 200129 - protein, 64 aa, Glycine max
  Coding DNA Sequence Number=SeqID_83351
MSARLPLVQTHELRCVDPATMTLAIVPQKIHEMAPPSSSIRPSSLCLWRLSLLSLSGMHLLKPN

SEQ ID NO: 200130 - protein, 132 aa, Glycine max
  Coding DNA Sequence Number=SeqID_83352
MGTMLKLEMKGVLREIMKFDADYRVIIGVLFYSGYKFFIRGKDNNEEKQRTVVLTSTVDADDAPSTVDGGVALHGNLLNAPCNLFTASSSSRQQWFVAEYENGELELVGEREGYYGLFTSSAGCTSKNAGCT

SEQ ID NO: 200131 - protein, 100 aa, Glycine max
  Coding DNA Sequence Number=SeqID_83353
MRIVIELCIRKVDNHMPTASARRQRVLVTAAHDELVVPAPNVEVDVFLDDPMAPADVEDTGADIPTDTGAQAAEDEHEGFSGGPSDLSVLTQYADHFACS

SEQ ID NO: 200132 - protein, 209 aa, Glycine max
  Coding DNA Sequence Number=SeqID_83354
LKKLTYHKELFIMVAQAKHVFYVQDPCDERWSVILHGKTIGVNVEDDDSTIDTCVNPFSTQISPNIMQEEFDDRPLVHVDPATRKADGPHKKKLRIYLGIVAYDKFNSDLTSKWALIDDKEGKDGKVCEKYDISKEKWKQFCQSRRDPSMFYDRGLSKEEEFGLGGLNMDGPIIEQGVRDSKRACQETKFSHGGKEEEAKLIYFSQLLE

SEQ ID NO: 200133 - protein, 91 aa, Glycine max
  Coding DNA Sequence Number=SeqID_83355
MYPLLYHKGCTLQCVQTKNSQAVSPLNLCKGKQKISQVEIGNRLPESKYSAFFYTSPTNVVTKKQKNVSCTSEITSTRIQGGGSTNETQQS

SEQ ID NO: 200134 - protein, 93 aa, Glycine max
  Coding DNA Sequence Number=SeqID_83356
MPDSTQRLTSSSAPFVIQGQRVRWWAEIPYGHPRLSSTEGNEFGSIRMMFFTLVIRKHSSLATRGIRLCWEEMIGCNGKGKCRGCPTLSFSKH

SEQ ID NO: 200135 - protein, 138 aa, Glycine max
  Coding DNA Sequence Number=SeqID_83357
VDCDEEDREEHTYSGVQGAPGPTPDSGCLLDPVWGASTERVVRKFGYTQAIPALLVDSWVSYDDIHDRPRIRPSAAPSRPLGPTSARPAVEEPRHAVEVFHGIAERLERHLSLRVITLGSSTHDDGSLLVGLLWRLDL

SEQ ID NO: 200136 - protein, 107 aa, Glycine max
  Coding DNA Sequence Number=SeqID_83358
MVVTHRLCLRTFKDGAYGENLSASGSETTQNDNWRSSNPKSHTFLTMTVEVVAKKETQVAEVVVVVETQKEEKVAEENVEPRESSVEESKPKMVDKSSSSKEKQLPF

SEQ ID NO: 200137 - protein, 125 aa, Glycine max
  Coding DNA Sequence Number=SeqID_83359
  Homolog annotation: Hit_ID=Q1RYJ7; Match level="QueryCoverage=39%, HitCoverage=3%, E-value=3e-11, Identity=64%"; Hit description =Timeless protein; Timeless C-terminal
MVYGFQEEMRLGFHFLEKRMEGGPGMITTIIQERMNGIGFSPAAYKIWPLFSPMVLPHFKHSRFKDDQHCSHRIAKVLDPDGKIPPAQISNMLKRLGLVVAPRRKMCDADAEGPLARKPKDLFIQ

SEQ ID NO: 200138 - protein, 222 aa, Glycine max
  Coding DNA Sequence Number=SeqID_83360
  Gene Ontology: Mol. function=sequence-specific DNA binding; Cellular component=nucleus; Biological process=regulation of transcription, DNA-dependent
  Homolog annotation: Hit_ID=O64645; Match level="QueryCoverage=37%, HitCoverage=39%, E-value=3e-18, Identity=60%"; Hit description =SUPPRESSOR OF CONSTANS OVEREXPRESSION 1 protein
  Pfam annotation: Domain name=K-box; Domain location=1-100; Score =87.2; E_value=5.1e-23; Accession=PF01486.8; Description=K-box region
MTNVLANAQHLKQEAANMMKKIGLLEAAKRKFLGEGLGACSIEELKWIEQQLEKSLSNVRARKIQVFKEQIKQLKEKEKVLLDENAKLTENGRLSEKIEAVPNYQGDNYMGKPVRINCHKAILMMKCSALFSRPLSTSPNQLDDDKITGATNHKSVNLEGSLLVQHLFKDHRRCSYMIANALDKDGKFTTAQVSQKLKQLGLYLPLPKDGKFTTAQGVLLLN

SEQ ID NO: 200139 - protein, 204 aa, Glycine max
  Coding DNA Sequence Number=SeqID_83361
  Gene Ontology: Mol. function=copper ion binding; Cellular component =periplasmic space; Biological process=electron transport
  Homolog annotation: Hit_ID=Q9C6V7; Match level="QueryCoverage=99%, HitCoverage=31%, E-value=5e-54, Identity=46%"; Hit description =Copper amine oxidase, putative
  Pfam annotation: Domain name=Cu_amine_oxid; Domain location=47-204; Score=-198.9; E_value=1.2e-05; Accession=PF01179.10; Description =Copper amine oxidase, enzyme domain
MPLEGITVVADLDETKIVEYFDRKIAPVPKAEGTEYVASNQKSPFGPTFTGATFVQPNGLGFKINGHSISWANWEFHVGYDIRARPVISLASIYDIQQQSGEFGFGQSMVSLEPLADWPSNAAFLDAYFAGEDGVLVKTTNAFCVFQKYAGDIMWRHIESEIHDEEIREVRPNVSLVVRIVSMVGNYDCIIDWEFKPSGSIKIG

SEQ ID NO: 200140 - protein, 72 aa, Glycine max
  Coding DNA Sequence Number=SeqID_83362
MGGSPPVVEGKEKLDLIEEGLRVVEGFGDYPFEDMTDLCLVLNVVIPSKFKVLDFNRYKGTTCPKNHLKMYC

SEQ ID NO: 200141 - protein, 117 aa, Glycine max
  Coding DNA Sequence Number=SeqID_83363
MSEIEEVQEQMKADIEAMLSMRRMMESNAATVVATSAAAEVDLTHPSDINQTSRPVLYMVGQGGQVLGSTGGLHMVQNKNSFPPYGLPPNYTPPNPVHVPNENTNHSIPIPLEGQQP

SEQ ID NO: 200142 - protein, 62 aa, Glycine max
  Coding DNA Sequence Number=SeqID_83364
MAGHRSYTSGRCHTGHRHGLSNVLTARAPLHIMGVAERARESEGHNKERGESKVQLCCGKRE

SEQ ID NO: 200143 - protein, 95 aa, Glycine max
  Coding DNA Sequence Number=SeqID_83365
  Gene Ontology: Mol. function=catalytic activity; Biological process =trehalose biosynthetic process
  Homolog annotation: Hit_ID=Q9FJQ1; Match level="QueryCoverage=95%, HitCoverage=24%, E-value=2e-34, Identity=77%"; Hit description =Trehalose-6-phosphate phosphatase
  Pfam annotation: Domain name=Trehalose_PPase; Domain location=1-94; Score=-72.3; E_value=0.042; Accession=PF02358.7; Description =Trehalose-phosphatase
MDFVSRMLKVYQQLVEKTKSTHGALVENNKFCLSVHFRCVDEKKWSELARQVKSVLKEYPKLRLTQGRKVLEIRPTIKWDKGKALEVLLESLGEF

SEQ ID NO: 200144 - protein, 290 aa, Glycine max
  Coding DNA Sequence Number=SeqID_83366
  Gene Ontology: Mol. function=monooxygenase activity; Cellular component=membrane; Biological process=electron transport
  Homolog annotation: Hit_ID=Q0H210; Match level="QueryCoverage=96%, HitCoverage=52%, E-value=1e-100, Identity=70%"; Hit description =Abscisic acid 8'-hydroxylase
MINLRKLVQRSLSLEALRNLVPHIEALALSAMNSWGGDGQVINTFKEMKMWDSDSNSTTEHHTGHIAEATNRPRRFSFEVGILTVFGHLEPRLREELKKNYRIVDNGYKSFPMCIPRTQYQKALLARRRLSKIICDIICERKEKKLFERDLLSCLLNWKGEGGEVLSDDQIADNIIGVLFAAQDTTASAMTWVVKYLHDEPKLLESVKAEQKAIHKSNEGNLPLSWDQTRNMRITHKMLQVSTESSGLSKVLDVSLLLVTYNGKLWTWSGCVREFKNGKHYIIPFQRSNS

SEQ ID NO: 200145 - protein, 103 aa, Glycine max
  Coding DNA Sequence Number=SeqID_83367
  Homolog annotation: Hit_ID=Q9FJF3; Match level="QueryCoverage=52%, HitCoverage=6%, E-value=8e-08, Identity=60%"; Hit description=Serine protease-like protein
MTFPDVKKQGKNSTGRKLHTTHSWELMDLEENDGVIPSYSLFRKARYGEDTIIANFGTEKGVITTTCQKQKQWEVLWIALSLTIWNHRYSLVFNNQLGKIVVF

SEQ ID NO: 200146 - protein, 205 aa, Glycine max
  Coding DNA Sequence Number=SeqID_83368
  Subcellular localization annotation: CTP_CleavageSite=37; ConfidenceScore=5.10e-01
DILRGKKAYFASSSKSLHVFLSLKECSSWTELGHFVSSSRGITIGSPRIVRRLEPPLSFLFACLYAFVNVHGEVALRKWMIDKDTWGRSGHRGLKNLGELVSGDYPAFGALICLLLLTGSKTMLFELGDEGTRPYNQQLLGTDDIEYTEASMGSVVHQVHPVEVIKDRGDHLNMSSKEMEEYQELLRQLEPKSKDKSDDSFEDMS

SEQ ID NO: 200147 - protein, 70 aa, Glycine max
  Coding DNA Sequence Number=SeqID_83369
MGEVEEVQEQIKADIEAVKEQMAIMMEAKISIKKIMEVNAVAIAATSTIAKVNLTPPSGLNQMNHPTSDM

SEQ ID NO: 200148 - protein, 86 aa, Glycine max
  Coding DNA Sequence Number=SeqID_83370
  Gene Ontology: Mol. function=RNA-directed DNA polymerase activity; Biological process=RNA-dependent DNA replication
  Homolog annotation: Hit_ID=Q1SLU4; Match level="QueryCoverage=77%, HitCoverage=16%, E-value=5e-10, Identity=47%"; Hit description=RNA -directed DNA polymerase
MAAITVVGNPHHTAKVGTIDYFEWCNIVKNWARYQKFRNETWKVVSDKQSKAFEDFYSDLGTKNEECKTYKLAKNKERKSKHLDQV

SEQ ID NO: 200149 - protein, 73 aa, Glycine max
  Coding DNA Sequence Number=SeqID_83371
  Homolog annotation: Hit_ID=Q5VRV7; Match level="QueryCoverage=54%, HitCoverage=5%, E-value=6e-10, Identity=67%"; Hit description =Putative Ubiquitin isopeptidase T; Ubiquitin-specific protease-5
MGIVSHSGTSTQCGHYVAHILKDGRWAIFNDNKAFNKVNISTIKRRRSFLNGLNMPPTSADVIIFMLPFLGGM

SEQ ID NO: 200150 - protein, 79 aa, Glycine max
  Coding DNA Sequence Number=SeqID_83372
MLTSSERVQMTTLDFACQSDLGSLNDEVRIMQRVCAGYRWVSPHATGLLGHGNKRWGGRQKQGFCSYVSLICDEKLRPT

SEQ ID NO: 200151 - protein, 89 aa, Glycine max
  Coding DNA Sequence Number=SeqID_83373
  Gene Ontology: Mol. function=binding
  Pfam annotation: Domain name=Sel1; Domain location=9-44; Score=21.1; E_value=0.0041; Accession=PF08238.2; Description=Sel1 repeat
MKAAKGGYVRAMYNISLCFSFGEGLTRNHQLARKRMKRAADCGRSKAQFEHGLALFSTSVLLGNWVYVEIWGKLNMGADLQVWGDAIIF

SEQ ID NO: 200152 - protein, 170 aa, Glycine max
  Coding DNA Sequence Number=SeqID_83374
  Gene Ontology: Mol. function=ATPase activity, coupled to transmembrane movement of substances; Cellular component=integral to membrane; Biological process=transport
  Homolog annotation: Hit_ID=Q9C8G9; Match level="QueryCoverage=99%, HitCoverage=10%, E-value=2e-68, Identity=78%"; Hit description =Multidrug resistance-associated protein 1
  Subcellular localization annotation: CTP_CleavageSite=72; ConfidenceScore=5.55e-01
CNGFILNSIPVFVTVITFGVFTLLGGDLTPARAFTSLSLFSVLRFPLFMLPNTITQVVNANVSLKRLEDLLLAEERVLLPNPPIEPGLPAISIKNGYFSWDAKAERASLSNINLDIPVGCLVAVVGSTGEGKTSLVSAMLGELPPMADSSVVLRGTVAYVPQVSWILNAT

SEQ ID NO: 200153 - protein, 132 aa, Glycine max
  Coding DNA Sequence Number=SeqID_83375
  Gene Ontology: Mol. function=protein serine/threonine kinase activity; Biological process=protein amino acid phosphorylation
  Homolog annotation: Hit_ID=P15792; Match level="QueryCoverage=78%, HitCoverage=17%, E-value=1e-27, Identity=61%"; Hit description =Protein kinase PVPK-1
MKIDSIVGCYLDPLADKIPFMESPVSEVGSLSKVQNSVSEVHDDLFSFGTPGPSWPPLRASRNHVDGHQTKTIHHENNHVINLKHSYQEGNNIDHGGLPKKLCSKHQLLDESQNCELSGALESDNWILGPSK

SEQ ID NO: 200154 - protein, 241 aa, Glycine max
  Coding DNA Sequence Number=SeqID_83376
  Gene Ontology: Mol. function=nucleic acid binding; Cellular component= intracellular
  Homolog annotation: Hit_ID=Q9FKA9; Match level="QueryCoverage=73%, HitCoverage=94%, E-value=7e-09, Identity=33%"; Hit description =Genomic DNA, chromosome 5, TAC clone:K24G6
MKISVMAEAGNTTKEIWSESKNPKHSDSKFSKPPRHHTSGELSSKRLVHVYGEESDWCEEMLGIEMEDEVKVAKVGESQREDSSRIFPCLFCSRKFYSSQALGGHQNAHKKERTAARKAKKASEHSCVSFPSPLPTPMVFAPTHLDIINPAMFITAHAAKLPHLPSHQISEQFGSNGAPRFGNALFYGGSSINRFHDDGKSSNFSWGNTSQHIQLISNNQNLGIWNNGTEKDQKLDLSLHL

SEQ ID NO: 200155 - protein, 40 aa, Glycine max
  Coding DNA Sequence Number=SeqID_83377
MVDRKIEKNIVDLHLWMIVDSRFHPQIGHWLAEGCCAFNS

SEQ ID NO: 200156 - protein, 144 aa, Glycine max
  Coding DNA Sequence Number=SeqID_83378
MKVVNNSFSVILNKPMYGTLQRHGACHCERQESYKDIVRVRNLTDTVPVTKHCARQESYRDTLRVRNPVESLCAFGILQRHCACQKSCKDIVPQESCQITVQRHYTCQESCRDTVQRHCAHQEFCRGTVRDRNLVGSLCMSGIL

SEQ ID NO: 200157 - protein, 78 aa, Glycine max
  Coding DNA Sequence Number=SeqID_83379
MVEIIALQWLFGPSSVAAKKPIEEDRNSIFWDLMLNPTQFQAKEEKVKVADDSLSEANPLSEKHLLSEASSRLADGKP

SEQ ID NO: 200158 - protein, 176 aa, Glycine max
  Coding DNA Sequence Number=SeqID_83380
  Gene Ontology: Mol. function=binding
  Homolog annotation: Hit_ID=Q7XD86; Match level="QueryCoverage=42%, HitCoverage=32%, E-value=1e-08, Identity=42%"; Hit description=TPR Domain containing protein, expressed
  Pfam annotation: Domain name=TPR_2; Domain location=106-139; Score =18.0; E_value=0.034; Accession=PF07719.7; Description=Tetratricopepti de repeat
MVLIEHEESKQRNANPSNAANDDSDGFETASDTDLAGEGDDSGAGIPEEQNRTEQSHTEKQTEQEPEHDAPRSSESSENNALISEEESRQNIECYSFMRQKALNQANEAKVEGNKLFVEGKYEEALLQYELALQAAPDMPSSVEIRSICHSNRGVCFLKLLGPWPFFVSIHFRVQN

SEQ ID NO: 200159 - protein, 121 aa, Glycine max
  Coding DNA Sequence Number=SeqID_83381
MAPTRHPLDPDKSNRALGFQALIIGLCQSYRGDAHQAAGTPPSPWQADPAGPLGMECYLQHLVLQQAANHQKFGAEVAWPGDWPDAQAGEEPIGSPGEADESHMDEDMTNLLGFLGGSGAT

SEQ ID NO: 200160 - protein, 722 aa, Glycine max
  Coding DNA Sequence Number=SeqID_83382
  Gene Ontology: Mol. function=transporter activity; Cellular component= integral to membrane; Biological process=ethylene mediated signaling pathway
  Homolog annotation: Hit_ID=Q9S814; Match level="QueryCoverage=99%, HitCoverage=55%, E-value=0.0, Identity=49%"; Hit description =Ethylene-insensitive protein 2
  Pfam annotation: Domain name=Nramp; Domain location=41-392; Score =2.4; E_value=1.1e-14; Accession=PF01566.9; Description=Natural resistance-associated macrophage protein
MEAETLNANHPPGFLHRSLPAVVPMLLISIGYVDPGKWVAIAEGGARFGFDLMAFTLIFNLAAIFCQYIAAKIGVITGKDLAQICSDEYDNWTCMLLGVQAELSVIMLDLNMILGMAHGLNILFGWDLFTCVFLTATGAVFHLLLFVILDIEKAKILGLFVSGFVFLSFVLGTLINQPDIPLSINGILTKLNGESAFVLMSLLGAILVPHNFYLHSSIVQWHQGSTTISKDALCHNHFLAIMCVFSGLYLVNNVLMNAAANEFYSMGLVLTTFQDALSPMEQVLRSPIAMLAFLLILFFSNQTTALTWSFGGEVVVRNFLKLDIPGWLHYATIRVIAVLPALYCVWNSGAEGMYQLLIFTQIVVALQLPSSVIPLFRIASSRSIMGVHKIPQFVEFLALIIFIGMLGLNIVFVVEMVFGSSDWVGNLRWNVETGVSLSYLVLLCTAFASFCLMLWLAATPLKSASVQLDDQAWNWDMPQAIPKSRIDNEETDLKETRYHGDASVQVKEPSPVLARTLEYSDVPIASFHHDLPETIMEPDVPVTTVRETHPFTSFPFSPTSVVKESASTSESEAVPAVSNETSDIILGDSKTLKTETTAPVEKTVEVEGDSNAERDDDYGDSWETEEIPKVVSLAPSSASDGPASFRSLSGKSDDGGNSIGSLSRLAGLGRGARRQLAAILDEFWGQLFHFHGQFTQEAKAKKLDVLLGVDSTLTGSLQKMDS
